United States Patent 11,078,247 (RNA ENCODING A THERAPEUTIC PROTEIN) - sequence listing, part 35

SEQ ID NO: 59390 - RNA, 5952 nt, Artificial Sequence
  derived and/or modified sequence opt3 from MYH7B__Homo_sapiens__NP_065935
augagcggcaacaagagaggguccagggccucuugcccccaccggggagcugagugucugcucccuugggcagcccuuaaucugcaggguuuccaauuguuacugcuacauccaucagcgaccgcuaugauggacgugagugaacucggcgagagcgcccgcuaccugcgacagggguaucaggaaaugacaaaaguccacacuaucccgugggauggaaagaaacguguuugggugcccgacgagcaggaugcauacguagaagccgaggugaaguccgaggcuacgggcgguagagucaccguggaaacaaaagaccaaaagguucuuauggugagggaggcagaacugcagccuaugaacccaccccgguuugauuugcucgaggacauggccaugaugacucaucugaaugaggcuucuguccugcacaaccuccgccagagauaugccagguggaugauuuacaccuauucgggguuauucugcgugacaauaaauccuuacaaguggcugccaguauauaccgcgucaguuguggcagccuacaaaggaaagcggcgcagcgauagucccccucauaucuacgcugucgccgacaacgcauauaaugauaugcuucgaaacagagacaaucaguccauguugauuacuggcgaaucuggcgcugggaaaacagugaacaccaagagggugauccaauacuuugccauugucgcggcccugggagaugguccaggcaaaaaggcacaguuccuagcuacgaagacugggggaacccucgaggaccagaucauagaagccaauccggcuauggaggccuuuggcaacgcaaaaacacugcggaaugauaacagcucccguuucgguaaguuuauccgcauucacuucgggcccucaggaaaacuugccagugcugacaucgacagcuaucuguuggaaaagucuagaguuauuuuucagcucccuggcgagagguccuaccacguguauuaccaaauccugucaggccggaaaccagaguuacaggauaugcugcuccuuagcaugaaucccuaugacuaccauuucuguagucaggggguaauaacuguggauaacaugaacgacggagaagagcugauugcgaccgaucacgcaauggacaucuuggguuuuucugucgaugaaaagugcgccuguuacaaaauugugggcgcucuacugcauuucgggaauaugaaguuuaagcaaaaacagcgagaggaacaggccgaggcagacggaacagaguccgccgauaaggcugccuaucucaugggcguuagcucgggugaccugcuuaaagggcuguugcacccucgcgugagagucggcaacgaauacgugaccaagggacagucuguagagcaaguuguguucgcagucggcgcgcucgcuaaagccacguaugauaggcuguuccggugguuagugucccgcaucaaucagacucuggacacaaagcuaccaagacaguuuuucaucgggguccucgacauugcaggauuugaaauauucgaguuuaacucauucgaacagcugugcaucaauuuuaccaacgagaagcuucaacaguucuuuaaucagcacauguucguguuggagcaggaagaguacaaaagggaagguauugauuggguuuuuaucgacuucggccuggaucuccaacccuguauagaccugauugagaagccgcuugggauccugaguaucuuggaggaagagugcauguuuccuaaagccagcgaugcuuccuuccgugccaagcucuaugacaaccaugcaggaaaaucucccaauuuccagcagccacggccugauaagaagcgaaaauaccaggcucacuuugaagugguacauuaugccggcgucgugcccuacagcauuguugguuggcuggagaagaacaaagacccauuaaaugaaacugugguccccaucuuccaaaagucacagaacagacugcuagcgacacucuacgagaauuaugccgggaguuguuccaccgagccuccaaaaagcggcgugaaggaaaagaggaaaaaggcugcaucuuuucagacgguaucacaacugcacaaagagaaccuuaauaaguugaugaccaaccugcgcgccacacagccgcauuucgugcggugcauuguucccaacgaaaauaaaacuccuggagucauggaugcuuuucucgugcugcaccaguuaagauguaacggcgugcuggaggggauaaggaucugccgccagggauucccaaaucgacuuuuguacaccgacuuucggcaacguuauagaauucucaaccccagugccaucccugaugacacauucauggauagcaggaaggcaacugaaaaacugcuagguucccuggaccucgaccacacccaguaccaguuuggccauacaaaggucuucuuuaaggcggggcugcuuggaguuuuggaggagcugcgcgaucagcgguuagccaaagugcucacccugcuucaagcuagaucuaggggccgacugaugcgcuuggaauaucagcggcuccugggugggagagacgcccuauucacuauccaguggaauauuagggcauuuaacgcugugaagaauuggucguggaugaaacuguucuucaagaugaaaccacuccugcguagcgcccaggcagaggaagagcuugccgcuuugcgcgcggaacugcggggcuuaagaggagcccucgcagcugccgaggccaagaggcaagagcuggaagagacgcacguauccauaacacaggaaaagaacgaucuugcucugcagcuacaagcagagcaggacaaucucgccgaugcggaggaacgaugccaucuguugaucaaaucaaagguccagcuggagggcaaagugaaggaauuaagugagcggcucgaagacgaggaggaaguuaacgcugaucuggccgcacgcagaaggaaacuugaggacgaauguaccgagcugaagaaggauauugacgauuuggaacucacucuggccaaagcugagaaggagaaacaggcaaccgaaaauaaggugaaaaaccuaacagaggaaauggccgcgcuggacgagucugucgcucggcuuaccaaggaaaagaaagcccuccaagaggcacaccagcaggcccugggggauuugcaggcugaggaagaccgagugagcgcccugacuaaggcaaaauuaagacucgagcaacagguugaagaccuggagugcucccuugagcaggaaaagaaacugcgcauggauacagagagggcuaagcguaaauuggaaggagaccucaagcugacgcaggagucaguggccgaugcggcccaagacaagcagcagcuagaagagaaacugaagaaaaaggauagcgagcuuucucagcucucccugcggguagaagacgagcaauuguuaggcgcacagaugcagaaaaagaucaaggaacugcaagcuagagccgaggaacucgaggaggaacuggaggcugaaagggcagcccgcgcccgagucgagaaacagagagcugaagcggcacgggagcuugaggaacugagugagagguuggaagaggccgguggggcuagcgccggacagcgcgagggcugucguaagagagaagcagagcuaggucggcugaggcgcgaacucgaggaagccgcucugcgacacgaggcgaccguggccgcacuuagacggaaacaggcugagggcgccgcagaauuaggggagcaaguggauucucugcagaggguccgccagaagcucgaaaaagagaaguccgaauugagaauggagguugacgaucuggccgcuaauguggagacucucacaagggccaaggcgucagcagaaaaacugugccggaccuacgaggaccagcuuagugaagccaagauuaaaguagaggaacugcaacgucaguuggcugaugccagcacacagcgcggacgacuacagacugagucgggcgagcuguccagacucuuagaagagaaggaaugucugaucucucaacuuagcagggggaaagcucuggcagcccagucacucgaggaguugcggcgccagcuggaagaggaaaguaaggcuaaguccgcccucgcacaugcggugcaagcccugagacacgacugcgaccuucuaagggagcagcaugaagaggaggcugaagcccaggcagagcugcagcgguuguuaucuaaagcuaacgccgaagucgcacaauggcgaagcaaguaugaggccgaugcuauacagagaaccgaagagcuggaggaagcgaaaaagaaacucgcccugcgccuucaggaggcagaagagggaguggaagcugccaaugccaaguguuccucacuggagaaggcaaaacucagguugcagacggagagcgaagacguuacccuggagcuagaacgggcuacaagugccgcggcugcccuggauaagaaacaacgucaccucgagagagcacuugaggaaaggcgccggcaggaggaagagaugcagcgagaacuggaggccgcucagagagagucuaggggcuuagguacugaauuguuucgccugcggcaugggcacgaggaagcacucgaggcccuggaaacccuuaagagagagaacaaaaaccugcaagaggaaaucuccgaccucacagaucaggugagcuugucgggaaagucaauucaggagcuggaaaaaacuaagaaggcguuagagggcgaaaaaucugagauccaggcugcccuagaggaagcagagggugcccuggaacucgaggagaccaagacgcuucguauucaacuggaauugagucaggucaaagcugagguggacaggaagcuggccgaaaaagaugaggaaugcgcaaaucuccggcgcaaccaccagcgagcuguugagucccugcaagccagccuugacgcggagacaagagccaggaaugaagcacuccggcugaagaagaaaauggagggcgauuugaacgaccuggaauuacagcuagggcaugcuacccgccaggccacugaggcacaggcugccacaagacugaugcaagcccagcucaaggaagagcaggcgggaagggaugaggaacagcgacuugcugcagagcugcacgaacaagcccaggcuuuggagcggcgugccucucugcucgcagccgaacuggaggagcuuagagcugcguuagaacagggcgagcgcagcaggcggcuggccgaacaggagcucuuggaggcaaccgaaagacugaaucuacugcauucccaaaacacugggcuccuuaaucagaaaaagaaacuggaggcugacuuggcccagcugucaggagaaguggaggaagcagcccaagagcgcagggaggcugaagagaaggccaagaaagcgaucaccgaugcagccaugauggcugaagagcucaagaaagaacaggacacaagugcccaccuggagcgaaugaagaaaacguuagagcagaccguccgggaacuucaggcaagacuggaggaagcugagcaagccgcucucaggggcgguaagaagcagguacagaaacuagaagccaaggugcgcgagcuggaggcagaauuggacgcggagcagaaaaagcaugccgaagcucugaaagggguucguaagcacgagcggagagugaaagagcucgccuaccaagcagaagaggauaggaagaaccuugcucgcaugcaggaccuggucgauaaguugcagagcaaagugaagucuuacaaacgacaguucgaagaggccgaacaacaggcaaauacuaaccuggccaaguaucggaaagcgcagcacgagcucgacgaugcugaggaaagagccgacauggcagagacacaagccaauaaguuaagggcucgcaccagagaugcccugggacccaagcauaaagaauga

SEQ ID NO: 59391 - RNA, 5808 nt, Artificial Sequence
  derived and/or modified sequence opt3 from MYH7__Homo_sapiens__NP_000248
augggcgacagcgagauggcaguguucggggcugcagcccccuaccugagaaaguccgaaaaagagaggcucgaagcgcagacccggccuuuugaucuuaagaaagacgucuucguuccagaugacaagcaggaguuugugaaagcuaagauaguaucucgcgaaggagguaaggugacagccgagacugaguauggcaaaacggucaccgugaaggaagaucagguuaugcagcagaacccgcccaaauucgacaagauugaggauauggcaaugcugacauuuuugcacgaaccugccguguuauacaaucugaaagaccgauaugggucauggaugauauacacuuauaguggacuauucugcgucaccgugaacccauacaaguggcuccccguauauacaccugagguuguggcugcauaccguggcaagaaaagaagcgaggccccaccccauaucuuuuccauuucugauaaugcuuaccaguauaugcugaccgacagggaaaaccagucgauccuuauuacuggugagucaggggccggaaagacagucaauaccaaacgggugauccaguacuucgcggugauagcagccaucggcgaucgcagcaagaaagaccagaguccuggcaaggggacgcuggaagaucaaauuauccaggcuaacccagccuuggaggcauuuggaaaugcuaaaacugucagaaacgacaauuccucuagguucgguaaguuuauucggauccacuucggcgccaccgggaagcucgcgagcgccgacauagaaacauaucugcuggagaaaucccgcguuauuuuucagcucaaggcagagcgagauuaccauaucuucuaucagauuuuaucaaacaaaaagccggaacugcuugacauguugcugaucacuaauaaccccuacgauuaugcuuucaucagucaaggagagaccacaguggccagcauugacgaugcugaagaacuaauggccaccgacaaugcauuugauguacucggcuucacgucugaagagaaaaacuccauguacaagcugacuggugccauaaugcacuuugggaauaugaaguucaaacuuaagcagagagaggaacaggcugagccugacggaacagaagaggcggauaaaucagcauaccugaugggcuugaacagcgccgaccuccugaagggcuuaugucauccaagggugaaagucgggaacgaauaugugaccaagggacaaaauguucaacaggugaucuacgcuacuggugcccuggcaaaggccgucuaugagcggauguuuaacuggauggugacacguauuaaugcuacccucgagacgaaacagccccgccaauacuucaucggcguacuugauauagccggguuugaaauuuucgacuuuaacaguuucgagcagcugugcaucaauuuuaccaacgaaaaguugcagcaguucuuuaaucaccacauguucguucuagagcaagaggaauauaaaaaggagggaaucgaauggacauucauugacuuuggcauggaucugcaggcauguaucgaccucauugagaaaccuauggguauaaugucuauccuggaagaggagugcauguucccaaaggcgacugauaugaccuuuaaggcuaaacuuuucgacaaccaucuggggaaguccgccaauuuucagaaacccagaaacauuaagggcaaaccggaagcacacuucagcuugauccauuacgccggaaucguggauuauaauauuauaggcuggcuccagaagaacaaagacccucugaaugagacagucgugggguuauaccaaaagucgucucugaagcuacucuccacucuguuugcuaacuacgccggagcagaugcucccaucgaaaaagguaagggcaaagccaagaaagggucaaguuuccagaccgucagcgcgcuucacagggagaauuugaacaagcugaugacaaaccuccgguccacccacccacauuuugugcgauguauuaucccuaaugaaacuaagucucccggaguuauggacaacccacuggugaugcaccagcuucgcugcaauggcguacuggaggguauuagaaucuguaggaaaggguuccccaaccggauauuguauggcgauuuucgccagagauacaggauccucaauccugccgcuauuccagagggacaauucaucgacagccguaagggcgcagaaaaacuguuaucaagucuggauauugaccauaaccaguauaaguuugggcacacgaaagucuucuucaaggccggacuacucggucugcuugaggaaaugcgggaugagcgauuguccagaaucauaacaaggauucaggcucaaagccgcggcgugcuggcccggauggaauacaagaaacuccuggagagaagggacucuuuacugguuauccaguggaauauucgcgcauuuaugggggugaagaacuggccguggaugaaacuuuauuucaagaucaaacccuugcucaagucagcggagcgagaaaaggagauggccaguaugaaagaagaguuuacccggcugaaggaggcucuagaaaagagcgaggcccguagaaaggagcuggaggagaagauggucucccuccugcaggagaagaaugaccuucaguugcaagugcaggcagagcaggauaaccuggcugacgccgaagagaggugcgaucaguuaaucaagaauaagauccaacucgaagcaaagguaaaagagaugaacgaacgccuggaggacgaggaagagaugaaugccgaacuuacugcuaagaaacggaagcuggaggaugaauguucugaguugaaaagagacauugaugaccucgagcugacccuagcgaagguggaaaaggagaaacaugccacagaaaacaagguuaaaaaucugaccgaggagauggcaggacucgaugaaaucauugcuaagcugacuaaagagaagaaggcccuucaggaagcccaccagcaggcuuuggacgaucugcaagcagaggaagacaaagucaacacauuaacgaaggccaaagugaagcucgagcaacagguggaugaccuggagggcucgcuugaacaagagaaaaaggucaggauggaccuggaacgagcgaagcgcaaacuagagggugaucucaagcugacccaggaaagcaucauggacuuggagaacgauaaacagcagcuggacgagcgguuaaagaaaaaggauuucgaacucaaugcucugaacgccagaauagaggacgaacaagcacuugggucccagcugcagaagaaauugaaggagcuccaggccaggauugaagaacuggaggaagaacuagaagcugagcguacugcacgcgccaaaguugagaagcugcggucagaucuuaguagagaacucgaggaaaucucugagaggcuggaagaggcgggcggagcuacaagcgugcaaaucgagaugaauaaaaagcgagaagccgaguuucagaaaaugcggcgcgacuuggaagaggcaacccugcagcacgaagccacagcugccgcauuaagaaagaagcaugcugauuccguggccgagcucggcgagcagauugacaaccugcaaaggguaaaacagaaacuugaaaaagagaagucagaguucaaacuggaguuggaugacgucacuagcaauauggaacagaucauuaaggcgaaggccaaccucgagaaaaugugccggacccuggaggaccagaugaaugaacaccgaucuaaggcagaggaaacgcaaagauccgugaacgaucuaaccagucagcgcgcuaaacugcagacagagaauggggagcuuagcaggcaacucgacgaaaaggaggcccugauaucucaguugacucguggaaaauuaaccuacacacagcagcuggaagaucucaagcggcaacuggaggaagagguuaaggcuaaaaacgcacuugcccaugcccugcaguccgcuagacacgacugugauuugcuaagggagcaguaugaagaggaaacugaggcgaaggcagaacugcagcgcgugcucucaaaagccaauagugaggucgcucaauggcgaaccaaguacgagacggacgccauccagagaacagaagaacuggaagaggccaagaagaaacuugcccagcgguuacaggaagcugaggaggcgguggaagccguuaacgcaaaaugcagcucgcuggagaagaccaaacacaggcuccaaaaugaaauugaggauuugaugguggacguagagcgcuccaacgcugccgcagccgcucuggauaagaaacagcguaauuuugacaagauccucgccgaauggaaacagaaguacgaggaaucucaaagcgagcuggaaucaagucagaaggaggcgagaucccuuucuacugagcuguucaaauugaagaacgcauaugaagagagccuagaacaucuggagacauuuaaacgggaaaacaagaaucuccaggaggagauuuccgauuuaaccgaacagcugggcucaagcgguaaaacuauccacgagcuugaaaaggucaggaagcaacuggaggccgagaaaauggagcuccagagugcuuuggaggaagccgaggcuucucuggaacaugaggaggggaagauacuccgcgcacagcuggaguucaaccagaucaaagccgagauugaacgaaaacuugcugagaaagacgaagagauggagcaagccaagagaaaucaccuacgggugguggauucccugcagaccagcuuggacgcagaaacaaggucgcgcaacgaggcguuaagagucaagaaaaagauggaaggagaccugaaugagauggaaauccagcucucacaugccaacaggauggcugccgaggcacagaaacaaguuaagucucugcagagucuucugaaagauacgcagauucagcucgacgaugcugugcgggccaaugacgauuugaaggagaacaucgcaauaguagaacgucgcaauaaccugcuacaagccgagcuggaagaacuccgagcuguggucgaacagaccgagagauccaggaaacuugcggagcaggaacugauugagacuagcgaacgggugcaauuauugcacucucagaauacaagccugaucaaccagaaaaagaaaauggacgccgaucucucccagcugcaaaccgagguugaggaagcagugcaggagugccgcaaugcugaagagaaggccaaaaaggccaucacagacgcagcuaugauggccgaggaacuuaaaaaggagcaggauacuucagcgcaccuggaaagaaugaagaaaaacauggagcagaccauuaaggaccuccaacauagguuggaugaagcugagcagauagcccugaaaggcgguaagaaacaguuacagaagcuagaagcacggguccgagagcuggagaaugaacucgaggccgaacaaaagagaaacgcugagagugugaaaggcaugcgcaagagcgaaaggcggaucaaagagcuuacguaccagacagaggaagaccguaagaaucuguugagacugcaggaucucguugacaaacugcaacuuaaggugaaggcauauaaaaggcaggccgaggaagcggaggagcaggcuaacaccaaccucucuaaguuucgcaaaguccagcacgaacuggacgaggccgaggaacgggcagauauugccgaaucccaaguaaauaaguugcgagcuaaaucaagagacaucgggacuaagggacugaacgaggaguga

SEQ ID NO: 59392 - RNA, 5814 nt, Artificial Sequence
  derived and/or modified sequence opt3 from MYH8__Homo_sapiens__NP_002463
augagcgccuccucugacgcugagauggcaguguucggagaagccgcgcccuaccugagaaagucagagaaggaaagaaucgaggcucagaacaagccuuuugaugccaaaaccagugucuucguugcagaaccaaaggagagcuaugugaaauccacaauucagucuaaggaagggggaaagguaacugugaaaacggaagguggcgccacccucacaguccgggaggaccagguguuuccgaugaaucccccuaaguacgauaaaauugaagacauggcuaugaugacucaccuucaugagccagggguucuguauaacuugaaggagcgcuacgcagccuggaugaucuauaccuacucgggauuauucugcgugacagucaaucccuauaaauggcugccuguguacaagccagaaguaguugcugccuaccgaggcaagaaacgucaggaggcgcccccucacauauuuucaaucagcgauaacgcauaucaguucaugcuaaccgacagagaaaaucaaaguauucucaucacuggugaguccggggccggaaagacagugaacaccaaaagggucauucaguacuuugcuacgaucgccgugacuggcgaaaagaaaaaggaugagucuggcaaaaugcaggggacccuggaggaccagauuaucagcgcaaauccacuucuggaggcuuucggaaacgccaagacagugcggaaugauaacuccucacgcuuugguaaguucauuagaauccauuuuggcacuaccgggaaauuggcgagugccgacauagagacauaucuccuggaaaagagcagggucaccuuccaacugaaagcagagcggucuuaccacauauuuuaucagaucacguccaauaagaaaccggaucucauugaaauguuacugaucacuacaaaccccuacgacuaugcuuucguuucacagggagagaucaccgugccuagcauugaugaccaggaggaacuuauggccacugacagugcuauagauaucuugggcuucacaccagaggaaaagguaucuauuuacaagcugaccggugccgugaugcauuacgggaauaugaaauuuaagcaaaaacagcgcgaggaacaggcagagcccgacggaacggaggucgccgauaaggcugcguaucuacaaucccucaacagcgcagaccugcuuaaagcccuguguuacccucgagugaagguuggcaaugaauaugugaccaagggccagacaguccaacagguguacaacgcuguaggggccuuggcaaaagccguuuaugagaagauguuccucuggauggugacuagaaucaaccaacagcuggauaccaaacagccaaggcaguacuuuauaggagucuuagacauugcugguuucgaaaucuuugauuucaauucgcuggagcaacucugcaucaacuuuacaaaugagaaacuucagcaguucuuuaaccaccacauguucgugcuggaacaggaggaauauaaaaaggagggcauugaauggacuuuuaucgacuucgggauggauuuggccgcauguauugagcuaauagagaagccccugggaaucuuuucuauucucgaagaggaaugcauguucccgaaagcgaccgacacauccuucaagaauaaacuguacgaucaacaucuuggcaagucagcuaacuuucagaaaccuaaggucgugaaagguaaggccgaggcacacuucagucugauccauuacgccgggaccguugacuauaauaucacuggcugguuggacaagaacaaagauccccucaaugacacggugguaggacuguaccaaaagagcgcuaugaaaacauuagccucccuguuuucuaccuaugcaagcgcugaagccgauucaagugcgaagaaaggcgccaagaagaaaggguccagcuuccagacugucucugcucuauuucgggagaaccucaauaagcugaugaccaaccuucguucaacacacccacacuucgugcgcuguauuauaccuaaugagaccaaaacucccggagcaauggaacaugaguugguucugcaccaacucagaugcaacggugugcuggaaggcaucaggauuugucggaagggguuuccaagucgaauccuuuacggagacuucaaacagcgcuauaagguccugaaugccagcgcuauucccgagggccaguuuaucgauuccaagaaagccucugaaaaguugcucgcaucgauagacaucgaucauacacaauacaaauucggucacacgaagguguuuuucaaagcggggcuguuaggccugcuagaggagaugagagacgaaaagcucgcccagauuaucaccaggacucaggcuguaugccggggauuucugaugcgcguggaguaucagaagaugcuucaaagaagggaagccuuguucuguauucaguacaacguucgugcauucaugaacgucaaacauuggccuuggaugaagcuguuuuucaaaaucaagccacuccugaaaagcgcugagacagagaaggaaauggccaccaugaaagaggaauuucagaagacaaaggaugaguuagcaaaauccgaagccaagcggaaagagcuggaggaaaagauggugacucuuuugaaagagaagaaugaccuccagcugcaagugcagucagaagcugauagucuagcggacgccgaggaacgaugcgagcagcugauaaagaacaaaauucagcucgaggcaaagaucaaagaagucaccgagagagcugaagaggaagaggagauuaaugccgaacugacggccaagaaaaggaaacuugaggaugaauguucugaguugaagaaagacaucgacgaucuggaguuaacccucgcuaagguugaaaaagagaagcacgcaacagaaaacaaagugaagaaucugacugaggaaauggccggccuugacgagaccauagcgaagcugagcaaagagaagaaggcuuugcaagaaacacaccagcagacucucgaugaccugcaagccgaggaagauaaggugaacauccuaaccaaagcaaagacgaagcuggagcagcagguagacgaucucgaagggucccuggagcaggagaagaaacuucgcauggacuuggaacgggccaaaagaaaacuggagggagauuuaaaacucgcucaagaaucaacaauggacauggagaaugauaagcagcagcuggacgaaaaacuugagaagaaggaguucgaaauuagcaaccugaucucuaaaauugaggaugaacaggcagucgagauccaacuacagaagaaaauaaaggagcuccaggccaggauugaagaacugggugaagagaucgaagcggagcgcgcuucccgagccaaagcagagaagcagcggagugacuugagccgugaacuggaggaaaucucugagagauuagaagaggccggcggggcuaccuccgcccaaguggagcucaauaagaaaagggaagcagaguuucagaagcugcgccgggaccuugaagaggcuacucugcagcaugaagccaugguugcggccuugaggaagaagcacgcagauucaauggcugagcucggagagcagauugacaaccugcaaagggugaaacagaagcuagaaaaggagaaaagugaacugaagauggagacagaugaccuuagcucgaaugccgaggcuaucuccaaagcaaagggcaaccucgagaagaugugccgaucucuggaggaucaggucagcgaauugaagaccaaggaggaggaacaacagcgccugauuaaugacuuaacugcccagcgggccagacuccagaccgaggcuggugaauacucaaggcaacuggaugagaaagacgcgcuugugagucagcugucccguucuaagcaggcaagcacacagcaaauagaagaguugaaacaucagcucgaagaggagacgaaggccaaaaacgcucuggcccacgcacuacaguccucacgccacgauugcgaccugcuucgggaacaguaugaggaagaacaggaagggaaggccgagcuccagagagcucugagcaaagcgaauagugagguugcccaguggaggaccaaguacgaaacugaugcaauccaacgaacagaggaauuggaggaggcuaagaaaaaguuagcccagcggcugcaggaagcagaggaacauguggaggccguaaacgcuaaaugugccucucucgaaaagaccaaacagcgccugcaaaacgaggucgaggaccuuaugcuggacguggaaagauccaaugcggcaugcgccgcuuuggauaagaagcagaggaacuucgacaaagugcuaagcgaguggaagcagaaauaugaagagacacaggccgaacuggaggcuucgcaaaaggagucacggucucucaguacugaacuguuuaaagucaagaauguuuacgaggaaucccuugaucaguuagagacccugcgaagagaaaacaagaaucuccagcaggagauuagcgacuugacggagcaaaucgcagaaggcggaaaacagauucacgagcuggaaaagaucaagaaacagguggagcaggagaaaugugaaauacaagccgcucucgaggaagccgaggcaucucuggaacaugaggagggcaaaauccuucgcauucagcuggaauugaaccagguaaagagcgagguggauaggaaaaucgcggaaaaggacgaggaaauugaucaacuaaaacguaaucacacacgggucguggagaccaugcaguccacucuggacgccgagaucagaucaaggaacgaugcucuccgcguuaagaaaaagauggaaggggacuuaaaugagauggaaauacagcugaaccaugccaaucgacuugcagcugagagucugagaaacuaucggaauacccagggcauucucaaagaaacacaauugcaccuggaugacgcccucaggggccaggaggaucugaaggagcagcuugcaaucguggaacgccgugccaaccuacugcaggcugagaucgaagaguugugggcgacuuuagagcaaaccgaaagaagccggaagauugccgagcaggaacugcucgacgcaucugagaggguccagcugcuucacacacagaauacgucccugauaaacaccaaaaagaaacucgaaaacgacgugucacaauugcagagugagguugaggaagugauccaggagagccgcaaugcugaagagaaggccaaaaaggccauuacugaugcagcuaugauggccgaggagcugaagaaagagcaagacacauccgcgcaucuagaacgaaugaagaaaaaccuggagcagaccgucaaggaucuccagcacagacuugacgaagcugagcagcuggccuuaaaaggugggaagaagcaaauccagaaauuggaagcacggguaagggagcuggagggagaaguggagaaugaacagaagcgcaacgccgaggcuguuaaaggccucagaaagcaugagaggcgggugaaagaacugacuuaccagacagaggaagaucguaagaauguccuucgccugcaagaccucguggauaaguugcaggcaaaaguaaagucuuauaaacgacaggccgaggaagcggaggagcagucgaacgcuaaucugagcaaguucagaaaauuacaacacgaacuagaggaagccgaggaaagggcagacauugccgagucacaggugaacaagcugcgggucaagucccgcgagguucauaccaaaaucagugcugaauga

SEQ ID NO: 59393 - RNA, 5883 nt, Artificial Sequence
  derived and/or modified sequence opt3 from MYH9__Homo_sapiens__NP_002464
auggcccagcaagcugcagacaaguaccuguauguggauaaaaacuucaucaauaacccccucgcccaggcggacugggcugccaagaaacuugucuggguuccuagcgauaaguccggauuugagccagcaucucugaaagaagaggugggggaagaggccauuguagaauugguggagaauggaaagaaggucaaagugaacaaggacgauauucagaaaaugaauccgcccaaguucucaaaaguugaggacauggcugaauuaaccugccugaacgaggcaagugugcuucacaaucucaaggaaagauacuauagcggucugaucuacacauauuccggacuauuuugugucgugauuaacccuuacaagaaucugccaaucuauucugaggagauuguagaaauguacaaagggaagaaaagacacgagaugcccccucacaucuacgccauaacugauacggcuuaucggucgaugaugcaggaccgcgaagaucaaucaaucuugugcaccggagagagcggcgccgguaagacagaaaacacuaaaaagguuauucaguaccucgcguauguggcaaguucccauaaaucuaagaaggaccagggggagcuggagcgacagcugcuccaagccaauccaaucuuagaggcuuucggaaacgccaaaaccgucaagaaugauaacagcucccguuuuggcaaauucauuagaaucaauuuugacgugaacggcuacauagugggggcaaacauugagacauaucugcuugaaaagucaagggcuauccggcaggccaaagaggaacgcaccuuccacauauuuuacuauuugcugaguggagcgggugagcaucuaaagacugaucuccugcuugagcccuacaauaaguacagauuccugagcaacggccacgucacaaucccugggcagcaggacaaagacauguuucaagaaaccauggaggccaugaggaucaugggcauuccagaagaggaacagaugggcuugcuccggguuauaucuggugugcugcaguuagggaauaucguauucaagaaagagcgcaacacggaucaagcauccaugccggacaauacugcugcccagaaggugucacaucugcucggaauuaacgucaccgauuuuacacgaggcauccuuacucccagaauaaaagugggcagggacuauguucagaaggcucagaccaaggagcaagccgauuucgcaauugaagcccuggcuaaagcgacauacgagcggauguuccguugguuggugcuacgcaucaauaaggcacuggacaaaaccaagagacagggggccagcuuuaucggcauucucgauaucgcugguuucgaaauuuuugaccugaacaguuucgagcagcuuuguauaaauuauacgaacgagaaacugcagcaauuguuuaaucauacuauguucauccucgaacaggaggaauaccagagggagggcauugaauggaacuuuaucgauuucgggcuggacuuacagccuugcaucgaucugauugagaagccagccggacccccuggcauacuagcacuccuggacgaggaauguugguuuccaaaggccacagacaaaucuuucgucgagaaggugaugcaagaacaggguacccaccccaaauuucagaagccgaaacagcuuaaggauaaagcugacuucugcaucauucauuaugccgggaagguagauuacaaggcagacgagugguugaugaaaaauauggauccucugaacgacaauaucgcgacucuccugcaccaauccagcgauaaguuuguuucggaacuuuggaaagacguggaucggauuaucggccuggaccaggucgcuggaaugucugagacagccuugcccggcgcauucaagacccgaaaagggauguuccgcacggugggacagcucuauaaggagcaacuggccaaguuaauggcuacccugagaaacacaaacccaaauuuugucagguguauaaucccuaaccacgagaagaaagccgguaaacuagauccccaucucgugcuggaccagcuucggugcaauggcguuuuggaggggauucgcaucuguagacagggauucccaaacagggugguauuucaggaguuccgucaacgguacgagauucugacucccaauuccaucccuaagggcuuuauggaugguaaacaggcaugcguccucaugauaaaggcucuggaauuagacucaaaccuguaccgaauugggcagaguaagguguucuuuagagccggcguucuugcgcacuuggaggaggaaagggaccucaaaaucaccgaugugauuaucggauuccaggccuguugccgcggcuaucuggcucggaaggcauuugccaaaagacaacagcagcuaacagcuaugaagguccugcagaggaauugcgccgcauaccucaaacugcgcaacuggcaaugguggcgacuuuucacuaaggugaagccauugcugcagguaagccggcaggaggaagagaugauggcgaaagaggaagaguuagugaagguucgugaaaaacaacucgccgcugagaauagacugaccgaaauggagacacuucagucccagcugauggccgagaaguugcagcuccaagaacagcugcaggcagagaccgaacuaugugcugaggccgaagaacugagggcacgccucacugccaaaaagcaggagcuggaagagauaugccaugaccuugaagcucgggucgaggaagaggaggaaagaugucaacacuugcaggcggagaaaaagaagaugcagcagaacauccaagaacuggaggagcaguuagaagaggaagagucugccaggcagaaacuccagcuggaaaaggugacgacagaggcaaaacuuaagaaacuggaggaagaacaaauuauccuagaagaucagaauugcaagcucgcuaaggagaaaaagcuguuggaagaccgaauugccgaguuuaccacuaaccugaccgaggaagaggagaaaagcaagucauuagccaaacucaagaauaagcaugaggcuaugaucacagaucuggaagaacgccuucggagagaggaaaaacagaggcaagagcuggaaaagacccgucgcaaauuggagggggacaguacugaucucuccgaccagauagcagagcugcaggcccagauugcggaacuaaagaugcaacuggcuaaaaaggaggaagaacuucaggccgcacucgcccggguggaagaggaggcugcacagaagaacauggcccugaaaaagaucagagaauuggagagccagaucucugaacugcaagaggauuuagaaucagagagggcgagucgaaauaaagcugagaagcagaaacgggaccucggagaagaacuggaagcccuuaagacagagcuggaagauacguuggacagcaccgcagcccagcaggagcuccgcuccaagagagagcaagaagucaacauucugaaaaagacucuagaggaagaggcuaaaacacacgaggcccagauccaggaaaugaggcaaaagcacucucaggcaguugaggaacuggcugagcagcuugaacagaccaaacgggugaaggccaaccucgagaaagcgaagcaaacacuggagaaugaacgaggugaguuggccaacgaagugaagguauuacugcagggcaaaggggauucggagcauaagaggaaaaaggucgaagcacagcuccaggagcugcaagugaaauucaaugagggagaacgcguuaggacugagcuugcugacaaggugaccaagcugcaggucgaauuggacaacgugacgggccuacugagccaguccgauucaaaaaguucuaagcucaccaaagacuuuagcgcccuggagucccagcuucaagauacacaggaauuacugcaggaggagaaucgucagaagcucucauugagcacuaaacugaagcaaguugaagacgagaagaacucuuuccgggaacagcucgaggaggaagaggaagcuaaacacaaucuggagaagcagauugcaacccuucaugcccaaguggccgauaugaaaaagaaaauggaagacuccguagguugucuggagacagcugaggaagucaagagaaaguugcagaaagaucuagaggggcugagucagaggcacgaagagaagguggcggcauaugacaaacucgaaaagacuaaaacccgcuuacagcaagagcuggaugaccuucugguggaucucgaccaccagcgacagagcgccugcaacuuggagaagaaacagaagaaguucgaccaacugcucgcugaagagaaaacgauaucugccaaguacgcagaagagagagaucgggccgaagcugaggcgagggagaaagaaacaaaggcccugucccuugcacgcgcucuagaggaagccauggagcagaaagcagagcuggaacguuugaauaagcaguuuagaaccgagauggaagacuuaaugucaaguaaggaugacgucggcaaaagcguucaugagcuggaaaagucgaaacgggcccucgagcagcaaguggaggaaaugaagacucagcuggaggaacuugaggaugaacugcaggcuacagaggacgccaaacucagguuggagguaaaccugcaagcgaugaaggcacaguucgaacgcgaucuacagggacgagacgagcaguccgaagagaagaaaaagcaacuggugagacagguccgggaaauggaggccgagcucgaagaugagaggaaacagcgcucuauggcuguggccgcuagaaagaaacuugaaauggaccugaaggauuuagaggcacacaucgacagcgccaauaagaacagggaugaggcuauuaaacaguugcggaagcugcaagcccagaugaaagacuguaugcgugaacucgacgauacccgcgcaucacgagaggaaauccuggcgcaggccaaggagaaugagaagaaacuuaaaaguauggaggcugagaugauucagcugcaagaggaacucgccgcagcugaaagagccaaaaggcaggcacagcaagagcgggacgaauuggccgaugagaucgcuaacuccucuggcaagggggcgcuggccuuagaggaaaaacgcagacuagaggcaaggauagcucagcuggaagaggaacucgaggaggaacagggaaauacugagcuuaucaacgaccggcugaagaaagccaacuugcagauugaucaaaucaauaccgaccugaaccucgaacgaagccaugcccagaagaaugagaacgcaagacagcagcuggagcgccaaaauaaagaacuuaagguuaagcuccaggagauggaaggcacagugaaauccaaguauaaggcuucaauuacggcccuggaggcgaagaucgcucaguuggaggaacagcuggauaacgagaccaaagaaaggcaagccgcaugcaagcagguccggcguacugagaagaaauuaaaggacgugcuacugcagguugaugacgaaagaaggaaugccgagcaguacaaagaucaagcugacaaggcaagcacacgccucaaacagcuuaagcggcagcuggaagaggccgaggaagaggcgcaacgagcuaacgccaguagaaggaaguugcagcgcgaacuggaggaugcaaccgaaacagccgacgcuaugaaucgggaggugucuucccucaaaaacaagcugagacguggugaccuuccguuugucguacccaggcggauggcccgcaaaggggcaggagauggcagcgacgaggaaguggaugguaaggcugacggcgccgaggcgaaaccugccgaauga

SEQ ID NO: 59394 - RNA, 516 nt, Artificial Sequence
  derived and/or modified sequence opt3 from MYL12A__Homo_sapiens__NP_001289977
augagcuccaagagaaccaaaacaaagacuaaaaagaggccccagcgggccacgucuaacguguucgcuauguucgaccaaucacagauccaggaguucaaagaagcauuuaauaugauugaucagaaccgcgacggcuucauagauaaggaggaccugcacgauaugcucgccagucuugggaagaauccuaccgacgaauaccuggaugcgaugaugaacgaggcuccaggaccgaucaauuuuacaauguucuugacuauguuuggugaaaaauuaaacggcaccgaccccgaggaugucauucgaaaugccuucgcaugcuuugacgaggaagccacagggaccauccaagaggauuaucugcgugaacuacucacuacaaugggagacagauucaccgaugaggagguugacgaacuguacagggaggcuccuauugacaagaaaggcaacuuuaauuauaucgaauuuacgcggauacuuaagcauggugcaaaagauaaggacgauuga

SEQ ID NO: 59395 - RNA, 519 nt, Artificial Sequence
  derived and/or modified sequence opt3 from MYL12B__Homo_sapiens__NP_001138416
augagcuccaagaaagccaagaccaaaacaacuaagaaaagaccccagagggcuacgucuaacguguucgcaauguuugaccaaucacagauccaggaguucaaggaagccuuuaauaugauugaucagaaccgggacggcuucauagauaaggaggaccugcacgauaugcucgcgagucuugggaaaaauccuaccgacgcuuaccuggaugccaugaugaacgaagcaccaggaccgaucaauuuuacaauguucuugacuauguuuggugagaaguuaaacggcaccgaccccgaagaugucauucgcaaugccuucgcuugcuuugacgaggaggcaacagggaccauccaagaagauuaucugcgagagcuacucacuacaaugggagaccguuucaccgaugaagagguugacgagcuguacagagaagccccuauugacaaaaagggcaacuuuaauuauaucgaguucacgaggauacuuaaacauggugcuaaggauaaggacgauuga

SEQ ID NO: 59396 - RNA, 585 nt, Artificial Sequence
  derived and/or modified sequence opt3 from MYL1__Homo_sapiens__NP_524144
auggcccccaagaaagacgugaagaaaccugucgcugcagccgcggcugccccagcaccggcccccgcuccugcaccagcccccgcuccugccaagccaaaagaggaaaagaucgaucugagcgcgauuaagauagaguucuccaaagaacagcaagacgaguuuaaggaagcauuccuccuuuuugauagaaccggcgacucuaaaaucacacugucacagguuggggauguguugagggccuuaggaacuaaccccacgaaugcugagguacggaaggugcuggguaacccuaguaaugaggaacuaaacgccaaaaagauugaguucgaacaguuucucccaaugaugcaggcaaucagcaauaacaaggaccaagcuaccuacgaggauuucgucgagggccugcgcguguuugacaaagaagggaauggaacaguuaugggcgccgagcuucgacacgugcuggcgacuuugggugaaaagaugaaagaggaagaggucgaggcccucauggcagggcaggaagauuccaacggaugcauuaauuaugaggcuuucgugaagcauaucaugucuauauga

SEQ ID NO: 59397 - RNA, 501 nt, Artificial Sequence
  derived and/or modified sequence opt3 from MYL2__Homo_sapiens__NP_000423
auggcccccaagaaagcuaagaaaagagcaggcggggccaacagcaauguguucuccauguuugagcagacccaaauccaggaguucaaggaagcguuuacaauuauggaccagaacagggauggauucauagacaaaaaugaucugcgggacacuuuugcugcccucggucgcgucaacguuaagaaugaagagaucgaugaaaugauuaaggaggcaccuggcccaaucaacuucacgguguuucuuaccauguucggggagaaacugaagggagccgacccggaagagacaauuuugaaugcuuuuaaaguauucgaucccgaaggcaaggguguguuaaaagcagacuacguccgagagaugcugacuacccaggccgagcguuuuucuaaggaagagguggaucaaauguucgcugccuuuccuccagacguuacagggaaccuagauuauaagaaucucgugcacaucauaacccauggagaagagaaagacuga

SEQ ID NO: 59398 - RNA, 588 nt, Artificial Sequence
  derived and/or modified sequence opt3 from MYL3__Homo_sapiens__NP_000249
auggcccccaagaaaccugagccaaagaaagacgaugcuaaggcagccccgaaagcggcucccgccccugcaccacccccugaaccagagagacccaaggaaguggaguucgacgccagcaagaucaaaauugaauuuaccccugagcagauagaggaauuuaaggaggcuuucaugcuguucgauaggacaccaaaaugcgaaaugaagaucacuuacggccaauguggggacguccuccgggcacuuggacagaacccgacgcaggccgagguucugcgcguguuggguaaaccccgacaggaggaauuaaauaccaagaugauggauuuugagacauuccugccuaugcuacaacacauuuccaagaacaaagacacuggcaccuaugaagauuuuguagaggggcuccguguguucgacaaggaaggaaauggcacagucaugggugcugagcugagacaugugcuugccacccugggggagagguugacugaagaugagguugaaaaacucauggcgggacaggaggacucuaacggcugcaucaauuacgaagcauuugugaagcacauuaugucaaguuga

SEQ ID NO: 59399 - RNA, 594 nt, Artificial Sequence
  derived and/or modified sequence opt3 from MYL4__Homo_sapiens__NP_001002841
auggcccccaagaaaccugagccaaagaaagaagcugcaaagccggcccccgcgccugcuccagcccccgccccugcaccagcucccgcaccugaggccccaaaagaaccggcuuucgaccccaagagcgugaagaucgauuuuaccgccgaccagauugaggaguucaaagaagcguuuucccuguucgauagaacaccuacuggcgagaugaagauaacguacgggcaaugcggagacguccucagggcacuuggucagaacccaaccaaugccgaaguucugcggguguugggcaaacccaagccugaggaaaugaacguaaaaauguuagauuuugagacauuccugccaauccuacagcacauuucucgcaauaaggagcaggggacuuaugaagacuuuguggagggacuccgagucuucgauaaggaaucaaacggcaccgugaugggugcugagcugcgucauguucuugccacacugggggagaaaaugaccgaagcagagguggaacaauugcucgcuggacaggaggacgccaauggcuguaucaacuacgaagcguuugucaagcacauuaugaguggcuga

SEQ ID NO: 59400 - RNA, 456 nt, Artificial Sequence
  derived and/or modified sequence opt3 from MYL6__Homo_sapiens__NP_066299
augugcgacuucaccgaggaucagacagccgaauuuaaggaggcuuuccaacuguuugacagaacuggcgaugggaaaauccucuacagccaguguggagacgugaugagggcacuuggucagaaccccacgaaugccgaaguccugaagguuuugggcaacccuaaauccgaugagaugaaugugaagguauuagacuucgaacacuuucugccaaugcuacagaccguggcgaaaaacaaggaucaagggacauaugaggacuacgucgagggacuccggguguucgauaaggaaggcaaugguacuguuaugggggcugagauucgccaugugcuggucacccuuggagagaaaaugacagaagaggaaguggagaugcugguagccggccacgaagacucuaacggcugcauaaauuaugaggcauuuguucgacauaucuugucaggguga

SEQ ID NO: 59401 - RNA, 528 nt, Artificial Sequence
  derived and/or modified sequence opt3 from MYL7__Homo_sapiens__NP_067046
auggccagcagaaaggcuggcaccagggggaaaguggcagccacaaagcaggcgcaacggggauccucuaacgucuucucaauguuugagcaggcucagauccaggaguucaaagaggccuuuaguugcauugaccaaaaucgcgaugguauaaucuguaaggcagaccugcgagaaacuuacagccagcucggcaaaguuuccgugcccgaggaagaacuugaugccaugcugcaggaggggaagggaccuauuaacuucacgguauuuuugaccuuauucggcgaaaagcugaaugguacagacccagaggaagcuauccuaucugcauuucguauguucgauccgucggggaaaggaguggucaacaaggacgaguuuaaacagcuccugcuuacucaagccgauaaguucucacccgcugagguggaacagauguuugcccugaccccuauggacuuggcgggcaauauugauuauaaaagccucugcuacaucauaacacacggcgacgagaaggaagaguga

SEQ ID NO: 59402 - RNA, 519 nt, Artificial Sequence
  derived and/or modified sequence opt3 from MYL9__Homo_sapiens__NP_006088
augagcuccaagagagccaaagcuaagaccacuaaaaagaggccccagcgggcaacaucuaacguguucgccauguuugaccaaucacagauccaggaguucaaagaagcguuuaauaugauugaucagaaccgcgacggcuucauagauaaggaggaccugcacgauaugcucgcuagucuugggaagaauccuacggacgaauaccuggagggaaugaugagcgaagccccagguccgaucaacuuuaccauguucuugacaauguuuggcgagaaauuaaaugggacugaucccgaggacgucauucgaaacgcauucgccugcuuugaugaagaggcuuccggauucauccaugaagaccaucugcgugagcuacucaccacaaugggcgauagauuuaccgacgaggaaguugaugagauguauagggaagcaccuauugacaagaaagguaauuucaacuacguggaguuuacucggauccugaagcacggggccaaagacaaggaugacuga

SEQ ID NO: 59403 - RNA, 1338 nt, Artificial Sequence
  derived and/or modified sequence opt3 from MYLIP__Homo_sapiens__NP_037394
augcugugcuacgugaccagacccgacgccguccucauggagguugaaguggaggcuaaggcaaacggcgaagauugucuuaaucagguaugcaggcggcuggggaucauugagguggacuauuucggauugcaauuuacagguagcaaaggcgaauccuuauggcugaaccuacgcaaucgaauaucucagcagauggaugggcucgccccuuaccgucugaaacuuagagucaaauucuuuguggagccacaccugaucuugcaggagcaaacuaggcauauuuucuuucuccacaucaaggaagcgcugcuggcuggacaucucuuauguucaccggagcaggccguugaacugagugcacuuuuggcccagacgaaauucggcgacuauaaccagaauaccgcuaaguacaacuaugaggagcugugcgcaaaggaacuaagcuccgccacacucaauucuauuguggcuaaacacaaggagcuggaagguacuucgcaagccucagcggaguaccagguccuucagaucgugagcgcaauggaaaacuaugggauagaguggcauaguguacgggauuccgagggacagaaacuguugaucggcguuggccccgaagggauuucuaucuguaaggacgauuuuagcccuauuaaucgcaucgccuacccagugguccaaauggcuacccaguccggaaagaacguguaccucacagugaccaaggagucagguaauaguauaguccuguuauucaagaugauuagcacuagagccgcaucuggccuguauagggcuaucacagaaacccacgccuuuuaccggugcgacacgguuacuuccgcggugaugaugcaguauucacgcgaucucaaagggcaccuugccagccuguucuugaacgagaauauuaaccuaggaaagaaauacguauuugacaucaagcgaaccaguaaagaaguguaugaucaugcaagaagggcucuguacaaugccggcgucguggaccucguuucucggaacaaccaaucccccagccacucgccucugaagucuuccgagucaaguaugaauuguagcuccugcgagggucuuucuugucagcagacacgugugcugcaggaaaaauugcgcaagcucaaggaggcuaugcugugcauggucuguugcgaagaggaaaucaacagcacuuucugcccaugugggcauaccgugugcugugagucaugcgccgcacaauuacagaguugucccguaugcagauccaggguugagcacgugcagcacgucuaucugccuacacauaccagccuacucaaucugacggugauuuga

SEQ ID NO: 59404 - RNA, 1791 nt, Artificial Sequence
  derived and/or modified sequence opt3 from MYLK2__Homo_sapiens__NP_149109
auggccaccgagaacggcgcuguggaacuggggauccagaaucccagcacagacaaggcaccuaaaggaccaacuggugagagaccgcucgccgcgggcaaggaucccgggccuccagaccccaaaaaggcuccugauccacccacgcuuaaaaaggacgccaaggcuccugccuccgaaaaaggagauggcacccuggcucaaccaucuacaucaagucaggguccgaagggggagggagacaggggcggcgggcccgcagaaggaagcgccgguccuccagcugccuugccccagcagacugcgaccccugagacauccgucaaaaagccaaaagcagagcaaggcgccucugggucgcaggaucccggaaagccgcggguuggcaagaaagcugccgaaggucaggcagcugcccgccgagggagcccugcguucuuacacucacccaguugcccagccauuauauccucuagcgagaagcugcuagccaaaaagccucccuccgaagcaucagagcucaccuuugagggagugccaaugacucauagucccacagacccucguccagcaaaagcugaagagggcaagaacauccuggccgaaagccagaaagagguaggcgaaaagaccccggggcaagcaggacaggccaagaugcagggugauacgucuagaggcauugaguuccaggcugugcccuccgagaaaucagaagucgggcaagcgcuuugucugacugcaagggaggaagacugcuuucagaucuuggaugacuguccuccacccccugccccauucccccaccggaugguggagcuccgcaccggaaauguuagcagugaauuuucuaugaacuccaaggaggcucugggcggugggaaauucggcgccgugugcacauguauggagaaggcaacuggacugaaacucgccgcuaaggucauuaagaaacagaccccgaaggauaaagaaaugguguuacuggagaucgaaguaaugaaucaacuuaaccauagaaauuugauacagcuguacgccgcaaucgagacaccucacgaaauuguucuauuuauggaguauaucgagggcggggaacucuucgagaggauuguggacgaagacuaccaucugaccgaggucgauacgaugguguuugugcggcagaucugcgacggaauacuuuucaugcacaagaugcgcguccugcacuuggaucucaaaccagagaacauucuguguguuaauacuacaggucauuuagugaagaucauugacuuuggccuggcgcgaagauauaaccccaaugaaaagcucaaaguaaacuucgggaccccugaguuucuuagccccgaaguggucaauuacgaucagaucucggacaagacugauauguggucuaugggagugaucacauauaugcuguuguccggccuaucaccauuccugggugacgaugacaccgagacgcucaacaauguucugagugggaacugguacuucgaugaagagaccuuugaggcugugagcgacgaagccaaagacuucgucuccaaccuuauugugaaggaucaaagggcacggaugaaugccgcucagugccuggcccacccuugguugaacaaucucgcagagaaagcuaagcguuguaaccgcagacugaagucucagauauuacugaaaaaguaucuaaugaaaaggcgguggaagaaaaauuuuaucgccguaagcgcggccaaccgauucaagaaaauuucaaguuccggcgcucucauggcacugggaguuuga

SEQ ID NO: 59405 - RNA, 2460 nt, Artificial Sequence
  derived and/or modified sequence opt3 from MYLK3__Homo_sapiens__NP_872299
augagcggcaccuccaaggagucucuggggcacggaggucuccccggccuugggaaaacaugccugacuacgauggacaccaaguugaacauguuaaaugaaaaaguggaucagcugcuacauuuccaagaggacgucacagaaaagcuccagucaauguguagagauaugggacaccuggagaggggccuucaucggcuggaagccagucgcgcuccugguccagggggagcagacggcguuccgcacaucgauacucaggccggcuggcccgagguguuggagcucguacgagcgaugcagcaagacgcugcccagcauggggcacgucuggaagcccuguuuagaaugguggcugcagucgauagggccauugcucucgugggagccaccuuccagaaaagcaagguugcggacuuuuuaaugcagggucgggugccuuggcgcagaggcuccccaggggauucucccgaggaaaacaaggagagggucgaggaagagggaggcaaaccuaagcacgugcugucgacaucagguguacaaagcgacgcacgggaaccaggggaggaaagucagaaagccgauguucuugagggaaccgcugagcgcuugcccccuauacgagccuccggccugggcgcagacccagcucaggccguggucucuccggggcagggagauggugugcccggcccugcgcaagccuucccagggcaccuaccccucccuacuaagguggaagcaaaagcuccagagacacccagcgaaaaucugagaaccggacuugagcuggccccggcuccuggcagggucaacguugugucccccucauuggaaguagccccaggugcagggcagggcgccaguagcucucggccugaccccgagccacucgaggaaggaacgcgucugacucccggcccugggccacagugcccgggacccccugguuuaccagcucaagcgcgcgcaacccauuccggcggggagacacccccuagaaucucaauucacauccaggaaauggacacuccaggagagaugcugaugaccggcagggguagccucgggcccacacuuaccacggaagccccggcugccgcacagccuggcaagcagggaccacccggcacugggcggugucugcaagccccuggaacagagcccggugagcagaccccagaaggcgcucgagaguugaguccucuacaggaaucuuccagccccgggggagugaaggccgaggaggaacagcgcgcaggcgcggagccagguacuagaccgucgcuggcuaggucugaugacaaugaucaugaagucggggcccucggccugcaacagggaaaauccccuggcgcagggaaccccgagccagaacaggacugcgccgcucgggcccccgugcgcgcagaggcuguuagaaggaugccuccaggagccgaggcgggcucagugguccuugaugacagucccgccccuccggcuccauuugaacaccgugugguaagcguuaaggagacauccauuucugcagguuacgaagugugucagcacgagguccugggagggggccgguucggucaagugcaucgaugcaccgagaaaagcacgggcuugccccucgccgcuaagaucauaaaagucaagucagccaaagauagagaagacgugaagaaugagaucaacauuaugaaucagcugagucacguuaacuuaauccagcuguaugaugcauuugaauccaagcauagcuguacccuagugauggaguacguagacgggggagaacucuucgauaggauuacagacgagaaauaucaccugacugaacuugacgucguguuguuuacccgccagaucugcgagggcguucauuaccugcaccaacacuauauacuccaucuggaucuuaagccugagaauauucugugugugaaccagacagggcaccagaucaaaauuaucgacuucggauuggcgcggagauacaagccaagggaaaaacucaaggucaauuuuggcacucccgaguuccuggccccugaagugguaaacuaugaguuugugucuuucccgaccgauauguggucaguuggugucaucacauacauguuacugagugggcuaagccccuuccucggagagaccgacgcugaaacuaugaauuuuauugugaacugcuccugggauuucgacgccgauacguuugagggccugucugaagaggcaaaggacuucgugucgcgccuuuuggucaaagaaaagagcugucgaauguccgcuacacaaugccugaaacaugaguggcucaacaaucugccagccaaggcaucacggaguaaaacccguuuaaagucucagcugcuuuugcagaaguacauagcccagagaaaauggaagaaacacuuuuauguugugacugcugcgaacaggcuccgcaaguucccuaccagccccuga

SEQ ID NO: 59406 - RNA, 5745 nt, Artificial Sequence
  derived and/or modified sequence opt3 from MYLK__Homo_sapiens__NP_444253
augggcgacgugaagcuggucgccagcucccacaucucuaaaaccucacucaguguugaucccagcagaguggacuccaugccucuuacagaggcuccagcauucauucugccgcccaggaacuugugcauaaaggaaggggccacugcgaaauuugagggacggguacgcgguuacccugaaccacaggugacguggcaucgaaauggccaacccaucaccucugggggacguuucuuacuggauuguggcauuagagguacauuuucgcuagucauccacgcugugcaugaggaagacagggggaaguauacuugcgaggccaccaacggaucaggcgcacggcagguuacaguggagcucaccgucgaaggcagcuucgccaaacagcuggggcagccugugguaaguaagacucuuggagaucgcuuuuccgcuccagcaguugagacaagacccucuauuuggggugaauguccuccaaaguucgccaccaaacugggcaggguggucgugaaggaggggcaaaugggacgguuuagcugcaaaaucacgggccgcccgcagccccaggugacuugguugaaggguaaugucccucuccagccauccgcucgaguuucagugagugagaaaaacgggaugcaaguacuggaaauacacggagugaaucaggacgaugucggcguguacaccugucugguugugaacggcagcgggaaggccucuauguccgcggagcucucaauccagggauuagacagcgcaaauagaaguuucgucagggaaacaaaggccacuaacucugaugugcggaaagagguaaccaauguuauuuccaaggaaagcaaacuggacucgcuugaggcugccgcaaagucuaaaaacugcuccucaccccagcgugguggcaguccuccaugggcugccaauagccaaccccagccgccucgcgaguccaaguuggaaucuuguaaagauagccccagaacagcgccacagaccccugugcugcaaaagacgucaaguuccaucacucuacaggccgcaaggguccagcccgagccacgggcucccgggcucggagugcugagcccuucuggcgaagagcgaaagcgcccagccccgcccagaccugcuacauuuccaaccaggcagcccggucuugggucacaagacgucgugaguaaagccgcaaaccggcgcauuccuauggaaggccagagagauagcgccuucccaaaguuugaguccaaaccccagucucaggagguuaaggaaaaucaaacugugaaauucaggugcgagguaucgggaaucccgaagccugaagucgcuugguuucuggagggcacaccagugcgucggcaggaagggagcauagagguuuaugaggacgcgggaucccauuacuugugucuccugaaggcacgaaccagagacucagguacguauaguugcaccgccucuaacgcucagggccaguuaagcuguuccuggacacugcaaguggaaaggcucgccgucauggagguggcacccucauucagcucuguacuuaaagauugcgccgugauugaagggcaggacuucguucugcagugcuccguccgcggaacuccugugccccggaucaccugguugcuaaauggccagccaauucaauacgcuagaaguacaugugaggccgguguggcagagcugcacauccaggaugcgcucccugaagaccacgggacuuauaccugccuggcugagaacgcccuuggccaggucagcuguucugcauggguuacagugcaugaaaagaaauccucaaggaagagugaguaccuguugcccguggccccaagcaaaccgaccgcuccuaucuuucuccaaggacugucggauuuaaagguaauggacggcucccaggucacuaugacggugcagguuucugggaaccccccacccgaagugauuuggcugcacaauggaaacgagauacaggagagcgaagauuuccauuuugagcaacgcgguacacagcacucacuaugcauccaggaagucuucccugaggacaccggcacuuacaccugugaagccuggaauagugcaggggaggugcgaacacaggcuguucucaccgugcaagagccacacgauggaacucagcccugguuuauuuccaagccucggucuguaacagccagccugggccaguccguccuuaucucaugcgcgauagccggugacccguucccaacggugcauugguugcgugaugggaaagcucuguguaaggacaccggccacuuugaagugcuccagaacgaggacgucuucacucugguucuuaaaaaggugcaacccuggcaugcaggacaguaugaaauucuguugaaaaauagaguaggcgagugcagcugucaggugagucucaugcugcaaaacucuuccgccagggcuuuaccucgcgggcgggaaccagccagcugcgaggaucuguguggaggcggugucggggcagacggaggcgguucggauagauacggcucacuaaggcccggguggccugcgcgaggacagggcuggcucgaggaagaggacggggaagaugugcgcggaguucugaagcggagaguggagacaaggcagcacaccgaggaagccauccgucagcaagaggucgaacagcuugacuuucgcgauuugcugggcaagaaagugucuacaaagacucucagugaggacgaucugaaagaaaucccggcugagcagauggacuuccgggccaauuuacagagacaaguuaagcccaaaaccguguccgaggaagagaggaagguccauagcccacagcagguagauuuucgaucugugcuggcaaaaaaggguacgagcaagaccccuguucccgaaaaagugccaccucccaagccagcuacaccggacuuccgguccguccuugggggaaaaaagaaauugccugccgagaacggcucaaguagcgcagaaacucucaaugccaaggcuguggagucuuccaagccccugucaaacgcgcagccaagugguccccuaaaaccuguaggcaaugccaagccagcagagacccugaaacccauggggaacgcuaagccugccgaaacacucaaaccgaugggaaaugccaagccagaugagaaccugaagagcgcuuccaaagaagagcuuaagaaagacgugaagaaugacgucaacugcaaacgcggccacgcagggacuaccgauaacgaaaagagaucugagucgcaaggaacggcccccgcguuuaagcagaaauugcaggacguucacguggcugagggcaagaaacuguuacuccagugccaagugagcucagauccucccgccacaauuaucuggacccugaaugguaagacucuuaaaacaaccaaguucauuauacugucccaggaagggaguuuguguucugucagcaucgagaaagcacucccagaagacaggggacuguauaagugcguggccaagaacgaugcuggccaggcagaguguuccugccaaguuacuguagacgaugccccugcgucagagaauaccaaagcucccgaaaugaagucucggcgaccaaaaagcagucuaccuccggugcuggguacagaguccgacgccacggucaagaaaaagcccgcaccaaagaccccucccaaagccgcuaugccaccucagauuauccaguuccccgaagaucagaaggugagagccggcgagagcguugaacucuuugggaaagugacuggaacacaaccgaucaccuguacauggaugaaguuccgcaaacagauucaggagucugagcauaugaaggucgaaaacucagagaauggcuccaagcugacuauacuugcagcuaggcaggaacacugcggguguuacaccuugcugguggagaacaaauuaggaagucgucaagcccagguaaaucucacggucguggacaagccagauccucccgcgggcacaccaugcgccagcgacauccggucgucuucccugacccuuagcugguaugguucaaguuacgaugggggaucugcaguucaguccuauagcauugaaaucugggacucagcuaacaaaacuuggaaggagcuggccaccuguagaaguacaagcuuuaaugugcaggaccuacuccccgaucaugaguacaaauucaggguccgcgcuauuaacguguacggcacuuccgaaccuucucaagagagcgaacugaccacaguuggcgagaagccggaagagcccaaggacgagguggaagucuccgaugacgaugagaaagaaccagagguggacuaucgaacgguaaccaucaauacugagcagaaggugucagauuuuuacgacauagaagagagauuggggucuggaaaauucggucagguuuuucggcuggucgaaaagaaaacaaggaaggugugggcaggcaaguucuuuaaagccuauagugccaaggagaaagaaaacauccgccaagagauuucgaucaugaauugcuuacaccacccuaagcucgugcagugugucgaugcuuucgaggaaaaagcgaacauuguaauggugcuggagaucguuagcgggggagaacuuuuugagcguauaauugacgaagauuucgagcugaccgagagagaaugcaucaaguacaugcggcagauuuccgagggcguggaauauauccauaaacaggguauaguccacuuggaccucaagcccgagaauaucaugugcgugaacaagacugggacaaggauuaaacugaucgacuuuggacuagcacgccgacuggaaaacgccggcucucuuaagguucucuucggcaccccugaguucguggcuccagaggucauuaauuacgaacccaucggguaugccacggauauguggucaauaggagugauuuguuacauccugguaagcgguuuguccccuuuuaugggcgacaacgauaaugagacucuggcaaacgugaccagugccacaugggacuucgaugacgaagcuuuugaugagaucucugacgaugcgaaagacuucauuagcaauuuacucaagaaagauaugaagaacagacuggacugcacccaaugucuucagcauccauggcugaugaaggauacuaaaaauauggaggccaagaaauugucaaaggaccggaugaaaaaguacauggcaaggcgcaaguggcagaaaacagggaacgcuguuagagccaucggaaggcucuccaguauggcaaugauuagcggccugucuggucggaaguccucaaccgggagccccacaucgccgcuaaaugccgaaaaacuggagucugaagaggacgucagucaggcuuuucuugaagccguggcggaggagaagccucacgugaaaccauauuucuccaagacuauacgugaucucgaagucguugagggaagcgcagcccgcuuugacugcaagaucgaaggcuaccccgauccugaggugguaugguucaaagacgaucaaucaauucgagaauccagacauuuucagaucgacuaugaugaggacggcaacuguucucugauuaucagcgaugugugcggggacgaugacgcuaaguacaccuguaaagccgucaauaguuugggagaggcuacgugcacagcagaauuaauaguggagaccauggaagagggugaaggcgagggggaggaagaggaagaguga

SEQ ID NO: 59407 - RNA, 510 nt, Artificial Sequence
  derived and/or modified sequence opt3 from MYLPF__Homo_sapiens__NP_037424
auggcccccaagagagcuaaaaggcggaccguggagggcgggagcuccucugucuucucaauguuugaccagacacaaauccaggaguucaaggaggcauuuacuguuauugaucagaaccgcgacggaauaaucgauaaagaagaccugcgagauacguucgccgcgaugggucgucucaaugugaagaacgaggaacuugacgcuaugaugaaagaggccaguggcccuauuaauuuuaccguauuccugacaauguuuggggagaaguugaagggagcagauccagaagacgugaucacuggcgccuucaaagucuuagauccggaggguaaggggaccauuaaaaagaaauuucuggaagaacuacucacaacccagugcgacagauucagccaagaggaaaucaagaacaugugggcugcauuucccccugaugugggaggcaauguugacuacaagaacauauguuaugugaucacucacggcgaugccaaagaccaggaguga

SEQ ID NO: 59408 - RNA, 1746 nt, Artificial Sequence
  derived and/or modified sequence opt3 from MYNN__Homo_sapiens__NP_001172048
augcaguacagccaccauugcgagcaucugcucgaaagacuuaacaagcaaagggaggccggcuuccugugugacugcaccaucgugauuggggaauuucaguucaaagcucaccggaaugucuuggcauccuuuucugaguauuucggagccauauaccgcucaacaagugaaaacaauguuuuucuggaucagagccaggugaaggcggacgguuuccaaaaacugcuagaguuuaucuauacuggcacgcucaaccuggauuccuggaauguaaaggagauucaccaggcugccgacuaccuuaaaguggaagaggucgugaccaaguguaagaucaaaauggaagauuucgcauuuauugccaaccccucuucgacagagaucucaagcauaacugggaauaucgagcugaaccagcagaccugcuugcucacacugcgagacuauaauaaccgugaaaagagugagguuuccaccgaucugauucaagcuaauccuaaacagggagcacucgccaagaaaucuagccagacuaagaagaaaaagaaggcuuucaacuccccaaaaacaggccagaauaaaaccgugcaauacccgucagacaucuuagaaaacgccagugucgagcuguuucuugaugcgaauaaguugcccacgccugugguagaacagguugcacagauuaacgacaacagcgagcuggagcuaacuucuguggucgaaaauaccuucccagcccaagauaucgugcauacagugacugucaaaagaaagagggguaagucccagcccaacugugcucucaaagagcacucaaugagcaauauagccaguguuaagucuccuuaugaagcagagaacuccggggaagaguuagaccagcgguacagcaaagcuaagccaaugugcaauaccuguggaaaaguguuuucggaggccucuucccuucgcagacacaugaggauucauaagggcguaaagcccuacgugugccaccuguguggcaaagcguucacacagugcaaccaauugaagacccauguccggacgcacacuggggaaaaaccuuauaagugugagcucugcgauaaaggauucgcccagaagugccagcugguguuucacucacgcaugcaucacggugaagagaagccauacaaaugugacguuugcaauuuacaguucgcaacaaguagcaaccugaagauccaugcucgaaaacacuccggcgaaaagccguaugugugugacagaugcgggcaaagguuugcccaggcuucuacccucacuuaccauguccggcgucacacaggagagaaacccuaugugugugauaccugcggcaaggccuucgcaguaagcucaagucuuauuacgcacucccgcaagcauaccggugagaaaccuuacaucugugggaucugcggaaagagcuuuauuucuucaggcgaacugaauaaacacuucagaagucauacaggcgccgacaagacuuuggauagcuccgcugaggaccacacccuaucugaacaggauucgauacagaaaagcccacuguccgagacaauggacguuaagcccucagauaugacucucccucuggcgcuuccacuggggaccgaggaccaccauauguugcuccccgugacagauacccaaaguccgacuucugacacgcuguuaaggagcacagucaacggauauuccgaaccucagcugaucuuucuacagcagcucuacuga

SEQ ID NO: 59409 - RNA, 6177 nt, Artificial Sequence
  derived and/or modified sequence opt3 from MYO10__Homo_sapiens__NP_036466
auggacaacuucuuuaccgaaggcacuagaguguggcugagggaaaaugggcagcacuuccccagcacugucaacuccugcgccgaaggaaucguuguguuucggacggauuacggucagguauucaccuauaagcagucuacaauuacucaucagaaagugaccgcuaugcacccuacaaaugaagaaggcgucgacgauauggcaucacucaccgaacuucaugggggaaguauaauguacaaccuguuucagcgcuauaagcgaaaucaaaucuacacuuauauuggcagcaucuuggccuccgugaacccuuaccagccgauugcggguuuauaugaacccgcuacaauggaacaguacucucguagacaccugggggaacugccuccacauaucuucgccauagcaaaugaauguuacaggugccucuggaaacggcacgacaaccaguguauccugauuucgggagaaucaggcgccggcaagaccgaaagcacgaaacuuauccugaaguuuuugaguguuauuucccaacagucucucgagcugagccugaaggagaagacuuccugcguggagcgcgcuauccucgaaucaagucccauaauggaggcauucgggaaugccaagaccgucuauaacaauaacagcucuagauuuggaaaauucgugcaguuaaauauuugucagaaggguaacauccaaggcgggaggauuguagauuaccugcuugagaaaaaucggguugugcgccagaacccuggagagcgaaacuaucacaucuuuuacgcuuugcuggccggccuagagcaugaagagagagaagaguucuaucucuccacaccagaaaauuaccacuaucugaaccagucagguugcgucgaggacaagacuaucagcgaucaagagaguuuuagggaagugauuaccgcgauggacgugaugcaguucucuaaggaggaaguccgggagguuucccgucuucuggcagggauauugcaucucggaaauaucgaguucauuacagccggcggcgcucaggugagcuuuaaaaccgcccuggggcgcucggcagaguuacugggacucgaucccacgcagcuuacugacgcucugacacaaagaucuauguucuugaggggugaggaaauccuaaccccucugaacguacagcaggccguggauucccgggacucacucgcgauggcccuguacgcauguugcuuugagugggucauaaagaaaauuaauagucgaaucaagggcaacgaagauuucaaaagcaucgggauucuugacaucuuuggauucgagaauuuugaggugaaccacuucgaacaguuuaauauuaacuacgcuaaugagaagcugcaagaauauuucaacaaacacauauuuuccuuggagcagcucgaauacucucgcgagggccugguuugggaggacaucgauuggauugacaauggugaauguuuagaucugaucgagaagaagcuagggcuccuggcccuuaucaacgaagagagccauuucccacaggcuacugacucaacauugcuggaaaaacuccacagucagcaugccaauaaccacuuuuaugugaagccgagagucgcagugaacaauuucggcguaaaacauuacgccggagagguucaauaugaugugaggggcauucuggagaagaaccgggacaccuuccgcgaugaccuucugaauuugcucagagaauccagguuugauuucauauacgaccuguuugagcacgucagcucucguaacaaucaggauacguuaaaaugcgggucaaagcaccggcgacccaccgugaguagccaguucaaggacucccugcauucucuaauggcuacacucucgagcuccaacccauuuuucgucagauguaucaaaccaaauaugcagaagaugcccgaccaauuugaucaggcggugguucugaaccagcuuagguauucaggaauguuggaaacugugcgcauucggaaagcagguuacgccguaagaaggccuuuccaagacuuuuacaagcgcuauaaaguccugaugcgaaaucucgcucugccagaggaugugcggggcaagugcaccaguuuacugcagcuuuacgacgccucuaacagcgaauggcaguuggggaagacaaaaguuuuccuccgugagucccuggagcagaagcuagagaaaagaagggaagaagaggugucacacgcagccauggucauccgcgcucaugugcugggauuucucgcccggaagcaauauagaaaaguacuguacugcgugguuauuauccagaagaauuauagggcauuccuuuugcgacgccgguuucugcacuuaaagaaagcggcuauagucuuccagaagcagcucagaggccaaaucgccaggcguguguaccgccagcugcuugcagagaaacgggaacaggaggaaaagaaaaagcaggaggaagaggagaaaaagaagagagaagaggaagagagggaacgagagcgggagcgcagagaagccgagcugagggcucaacaggaagaggaaacucggaaacagcaagaguuggaggcccuccaaaagagccagaaagaagcagagcugacccgagaacuagagaagcagaaagagaacaagcaaguggaagagauucugagacucgaaaaggagaucgaagaucugcagcgcaugaaagagcagcaggagcuuucuuugacagaggcuucccugcaaaaguuacaggagaggcgugaccaggaacuccggagacuggaggaagaggccuguagggcggcccaggaguuccuugaaagucugaauuuugaugagauugacgaaugcguccgcaacaucgagcgaagccuaucuguugguuccgaguucucaagugagcucgcugagagcgcaugugaagagaaacccaauuuuaacuucucgcaaccguauccugaagaggagguggaugaaggguuugaggccgacgaugacgcuuucaaggauucccccaacccaucugaacacggccauagcgaccagagaaccucaggaauacggacaagugacgauuccucugaggaagacccuuacaugaaugauacggugguacccacaagcccauccgccgacucaaccguccuguuggcacccagcgugcaggauaguggcucucugcacaacuccagcucgggggagucaacuuacugcaugccucagaaugcgggagacuuaccaucuccggauggugacuaugauuacgaccaagaugacuaugaggauggcgccauuaccaguggguccagcguuacauuuucuaacagcuacggaucccaguggucacccgacuauagguguagugugggcaccuacaauagcucuggugcuuaucgcuucuccucagaaggggcccagaguagcuuugaggacuccgaagaggauuucgacucucguuuugauacugacgaugaacucucguacagacgggacagcgucuacucaugcgugacacugccuuauuuccauuccuuccuuuacaugaaaggcggacugaugaacaguuggaagaggcgcugguguguuuugaaggaugagacguuucucugguuccgaucuaaacaagaggcacugaagcagggcuggcuacacaagaaagggggaggcagcuccacccugucaagacggaauuggaagaaaaggugguuugugcuucgccagucuaaacucauguauuucgaaaacgacagcgaggaaaaacugaaggguacuguagaggucagaacagcuaaagaaaucauugauaauaccacaaaggagaacgggaucgacauaaucauggccgauaggacuuuucauuugauugcagagaguccagaagacgccucccagugguucagcgugcugucucaagugcacgcuucaaccgaccaggagauccaggaaaugcacgaugagcaggcgaauccccaaaacgccgucggaacguuagacguuggccucauugauuccgugugcgcaagugacagcccugaucggccaaauucguuuguaaucauaaccgcuaaccgugugcugcauuguaaugccgacacacccgaggaaaugcaccauuggauuacucuucugcagcgcucuaaaggugauacccgagucgagggccaggaguucaucgugagagggugguugcacaaggagguuaaaaacuccccgaagaugagcucacucaagcugaaaaagaggugguuugugcuaacacauaacagucuggacuacuauaaaucuuccgaaaagaaugcccuuaaacucggaacucuggucuugaacagcuuaugcucagugguuccuccagaugagaagaucuucaaggagaccggcuacuggaaugugacggucuaugggcggaaacacuguuaccgccuguacacaaagcuccugaacgaagcuaccagauggaguagcgcaauucagaauguaacugacacaaaagcccccaucgauaccccuacucaacagcuuauucaggacauaaaggagaacugccuaaauuccgaugugguugaacaaaucuauaaaaggaaccccauuuugcgguacacccaccauccacuacacucuccucugcucccccugccauauggagacaucaaucuuaacuuacugaaggacaagggcuacacaacgcuccaggaugaggcgauuaaaaucuuuaauagcuugcagcagcuggaauccaugucagacccgauaccuaucauucaagguauccuccagaccgggcaugaucugcgaccccuuagagacgagcuguauugccaguugauuaagcagacuaacaaagugccacaccccggaucugucggcaaucuauacaguuggcaaauccugacaugucucucgugcaccuucuuaccuagccgcgguauacugaaguaucuuaaauuucaccugaagaggauucgggagcaguucccaggcuccgaaauggagaaguacgcucucuucacauacgaaucuuugaaaaagacuaaaugucgugaguuugugcccucaagagaugaaaucgaggcccugauccauaggcaggagaugaccagcacgguauauugccacgggggaggcuccuguaagauuacaauaaacagucauaccacugcaggggaaguggucgagaaacucauccgcggacuggccauggaagacucucggaauauguucgcucuuuuugaguacaacggccacguugauaaggcaauugagagccgaaccgugguggccgacguccuagcgaaguucgaaaaacuggcugccacaucagaggugggugauuugccuuggaaguuuuauuucaaauuauacugcuuucuggacacugauaauguuccgaaggacuccguagaguucgcauuuauguucgagcaggcccaugaagcugugauccacgggcaccauccagcccccgaggagaaccuccaaguccuggcagcucuuagacugcaguaucuccagggagauuacaccuugcacgccgcgauuccuccacuggaagagguguauagucuacagaggcugaaagcccgcaucagccaaucuacaaagacguuuacccccugugaacggcucgagaaaagacguacuuccuuccuugaaggcacacugaggcggucauuucgcaccgguagcguugugcgacagaaggucgaggaggaacagauguuagacauguggauaaaggaggaagugucgucugcaagagcuaguaucauugacaaauggaggaaguuccaaggcaugaaccaggagcaggccauggcuaaauacauggcauugaucaaggaauggccuggguacggauccacucuguucgauguagagugcaaagagggcggguuuccgcaggaacucuggcugggagucagcgccgacgccgugucaguuuauaagcggggcgagggucgcccccuugaaguguuccaauacgagcauauucuguccuuuggggcuccacucgcgaauacauauaagaucgucguggaugagagagaauugcuguucgagaccucugaaguuguggacgucgcaaaauuaaugaaggccuacauaagcaugauugugaaaaagagguauaguacgacucgauccgcuagcucucagggaucaagucgguga

SEQ ID NO: 59410 - RNA, 10593 nt, Artificial Sequence
  derived and/or modified sequence opt3 from MYO15A__Homo_sapiens__NP_057323
auggccaaggaggaagacgaggagaagaaggcuaaaaagggcaaaaaggggaagaaagcacccgagccugaaaagccaaaaagaagccugaagggaaccuccagacucuucauggguuuucgggaucgcaccccgaaaaucucuaagaagggccaguuccgaucagccagcgcguuuuucugggggcuucacacuggaccccagaagacgaagcguaaacgcaaggcuaggaccgugcugaaaagcaccuccaaguugaugacucagaugcggaugggcaaaaagaagcgcgccaugaaagguaagaaaccuucuuuuauggucauuagauucccagggaggcggggauacggccgcuuacgaccccgcgccaggucgcugucaaaggccagcaccgcuauaaacugguugaccaaaaaguuucuccugaagaaagccgaggagaguggcuccgaacaggccaccguugacgcuuggcuucagcggucuagcucccguauggggucacgcaagcugccuuucccaaguggagccgagaucuugaggcccgguggcaggcuccggcgauuuccucgcagcagaucuauuuaugcguccggggaaccacugggauuccugccguuugaggaugaggcacccuuccaccacucaggcagcaggaaaagucucuacgguuuagaaggguuucaagaccugggagaguacuacgauuaucaucgggacggcgaugacuacuaugaucgccagucucuucacagauacgaggaacaagaaccuuacuuggccggccuggggccauauucccccgcuuggccuccauacggagaccauuauuacgguuaucccccggaggauccuuacgacuauuaccaccccgauuacuauggcgggccauucgacccuggauacacuuauggcuacgguuaugacgauuacgagcccccauaugcacccccuagcggguacucgucuccauacuccuaucacgacggcuacgaaggagaggcacauccguauggcuacuaucuagaucccuacgcuccuuaugacgccccauaucccccuuacgaucucccauaucacacacccuacgacgugccguauuucgauccuuacgggguccauuauaccgugccauacgcggaaggagucuaugguggcggggacgaggccaucuaucccccugaagugcccuacuuuuauccagaggagucagcaagugcuuucguuuacccuugggugcccccaccgauuccuagcccccacaauccauaugcccacgcuauggaugacaucgccgaacuggaggaacccgaggaugcaggagucgaaaggcagggcacguccuuucgucuuccuucugccgcuuucuuugagcaacaggguauggacaagccagcgcggagcaaacugucauugauacgaaaguucagacucuuucccaggccucaggugaagcuguucgggaaagagaaguuagaaguaccgcugccacccagucucgacaucccucuuccacugggcgaugcagacgaggaagaggaugaggaagaguugcccccuguuuccgccgugccguacggacaucccuuuuggggcuuccuaacuccacgccagcggaaccugcaaagagcucucagcgccuuuggggcacacaggggacuggguuucggcccugaauuugggcgccccgucccacgaccugccaccucucuugcucgguuccugaaaaagacauugucagagaaaaagcccauugcccgucucagaggaagucagaaggcaagggcgggcgguccagcugugcgcgaagccgcauauaaacgguucggguacaagcuggccggcauggacccggagaaaccuggaacucccaucguguuaagaagggcucagccacgagcccgcagcuccaaugaugcacggagacccccugcuccacaacccgccccuaggacccugucucauuggucggcgcuacucagcccgccaguacccccucgucccccauccucaggcccucccccagccccuccgcugagucccgcucuuucuggguugccacgcccugcaagccccuauggaucccugcggagacacccaccucccugggccgcuccggcccauguuccgccugccccacaggcgucauggugggccuuuguggagccacccgcuguaagcccugaagugccgcccgaccuccuggccuucccaggcccuaggcccucuuuucgagguucccggcgcagaggggcagcuuucggauuuccuggcgccaguccaagggcaagccggagacgagccuggucuccccuugcuuccccucagccaucacugcgcaguagccccgguuugggcuacugcucgccgcucgcgccuccaucuccccaacuguccuuaaggacagggccuuuccaaccacccuuucugccgccugcccgucggcccagaagccuacaggagucaccagcaccuaggcgcgcugccggacgacucggacccccagggaguccccugccuggauccccaagaccgcccucuccuccacuuggcuugugucacagcccccggagguccucacugaaccucccuagccgccugccacacaccuggcguagauuaagugaacccccuacgcgggccgucaagccacaggugaggcugccauuccauagacccccucgagcuggugcauggagagcaccccuugagcaccgggaaucuccaagggagccugaggauuccgaaacucccuggacaguuccaccguuggcgccuagcugggacguggauaugcccccaacccagagacccccuucgccauggcccgggggagcuggcucaagaagggguuuuucucggccuccgccaguccccgagaauccuuuccuccaacugcuaggcccagugcccaguccuacucugcagcccgaagacccagccgcagauaugacacguguauuucucgggcgccaucacgagccgggaccuggccagcugaccaaauccgccgggcccacgccagaaaagccugaggaggaagcuacccuuggagacccccaguugccagcagagacaaaaccucccacuccggccccaccuaaggauguuacacccccaaaggacauuacacccccuaaagacgugcugccggaacaaaagacuuuacgaccaagccucucuuacccccuggcggcuugcgaucagaccagagccacauggccucccuggcacagguggggcacccuuccacaggcagccgcuccucuggcccccauccgggcaccagagccuuugccgaaagguggggagcgcagacaggcugcccccggaagguucgcggucgugaugccacggguccaaaagcucagcuccuuucagcgagugggcccugccacucugaaaccccagguucaaccaauacaggacccuaagcccagagcauguucacuacgcuggaguugccuguggcucagggcugaugccuaugguccguggccacgggugcauacgcacccucagagcugucaucugggccccggggcugcaugccuuucuuugcguggauccugggaagagguaggcccacccucauggagaaacaagaugcacaguauuaggaaucugccuagcaugcgcuuccgggaacagcauggggaggacggagucgaagauaugacacaauuagaggaccuccaggagaccacugugcuguccaaccuuaaaauccgauucgaaagaaaucugauuuacaccuauaucggcucuauccuaguuucggugaaccccuaccagauguuugguauuuaugggccagagcagguccaacaguacaauggaagggcccucggcgaaaacccuccgcaccuguucgccguggcuaauuuggcguuugcaaagaugcuggaugccaaacagaaccaguguauaaucauuagcggcgagucaggguccggaaagacagaagcuaccaaauuaauccuccgcuaucuggccgcaaugaaucaaaagcgggagguaaugcagcagauaaagauucuugaggccacuccccuguuggaaaguuucgguaacgcuaaaacagugagaaacgacaauucuagccguuuuggcaaguucguugagaucuuucucgaagggggagucaucuccggcgcgauuacgucacaauaccugcuagagaaaucuaggaucguguuccaggccaagaacgaacggaauuaccacauauuuuacgagcugcuugcaggucucccagcucagcugcgccaggccuucagcuugcaagaggcagaaaccuacuauuaccugaaccaagggggcaauugcgagauugccggcaaaagugaugcugacgauuuucgaagauuacucgccgcgauggaagugcugggcuucuccagcgaggaccaggauucuaucuucaggauucuugcaucaauccugcauuuggggaacgucuauuuugagaaguacgaaacugacgcccaggagguugcuuccguggugagugcccgggaaauccaagcuguagcagagcuccugcagauuagcccugaaggacuacagaaggccauaacauucaaagucaccgagacaaugcgcgagaagaucuuuacuccccugaccguggaaucggcuguugacgccagagaugcaauugcgaaagugcuuuaugcccuccuguucucuugguugaucacgagggucaaugcuuuaguguccccacgacaggacacccugagcauugccauccucgauauauacgguuuugaggaccugucauucaacaguuuugaacaacuuuguaucaauuacgcaaacgagaaucugcaguauuuguucaacaagauuguuuuucaggaagaacaggaggaauacauccgggagcaaauugauuggcaggaaaucacauucgcugacaaucagccuugcauaaaccuaauuucucugaaacccuauggcauccuccguauucuggaugaccaauguugcuuuccgcaggccacugaucacaccuuccuucagaagugccauuaccaccauggggcaaauccuuuauauuccaaaccaaagaugccccugccugaguuuacaaucaagcacuacgccggaaaagugacuuaucagguacacaaguuccucgacaaaaaccaugaucaagucagacaggacguguuggaccuguucgugcgcagcaggacccgggucguugcucaccucuuuucaagucaugcgccacaggccgcaccccagagacugggcaagagcuccucugugacgcgccuuuacaaagcucacacaguagccgccaaguuccaacagagccuguuggaucuaguggaaaagauggagagguguaacccucuguuuaugcgaugccucaaaccaaaucacaagaaagagcccgguuuauucgaaccggacgucgugauggcacagcugcgguacuccgggguucuugagaccgugagaauaaggaaggaaggauuuccuguccgccugcccuuccagggcuuuaucgaucguuauuguugccucguggcuuugaaacaugaccugccagccaacggcgauauguguguuucagugcucucucggcugugcaaggucaugcccaauauguacagaguaggggugaguaaacuuuuccuaaaagagcaccuguaucaauuguuagagucgaugagggaacauguucugaaccucgcggcucugacucuucagcgcugucugcgaggauuuuucauuaagcggagauuuaggagccuccgccacaaaaucauuuugcugcaguccagagcccgggguuaccuagcaaggcaacguuaucagcagaugcgacgcucucuggugaaguucagaucacucguccaugccuacgugagccggaggcgcuaucuuaaacugagagcugaguggcggugccagguagaaggcgcauuauugugggagcaagaggaacuguccaagagggagguggucgccguugggcaccucgaagugccugcggagcuggcuggacuucugcaggccguggcaggccucgguuuggcccaggucccacagguggcucccguucgaacaccucgucugcaagccgaaccaagaguaaccuuaccgcuagacaucaauaacuaccccauggcaaaguuugugcagugucacuucaaagagccugcuuucgggaugcugacugucccacuccgcacaccccuuacacagcugccugccgaacaucacgcggaggccgugaguauauuuaaguugauucugcgguucaugggagauccacaucuccacggcgcaagggagaauaucuuuggcaacuacaucguucagaaagggcuggcugugcccgaacuuagagacgagauucucgcccaacuggcaaaucaggucuggcacaaccauaaugcucacaacgccgaacgcggaugguugcuguuagccgcgugccuaucugguuucgcuccgagcccuuguuuuaauaaguaucugcucaaauucgugucagauuacggccggaacggguuucaggcaguaugccagcauaggcuuaugcaagccaugggacgagcucagcagcaaggcuccggugccgcaagaacgcugccacccacccaguuggaguggacugccacauaugaaaaggcuaguauggcgcuggacgucgggugcuucaauggagaucaguuuagcuguccugugcacucuugguccaccggcgaggagguugccggcgacauccuccggcauagggggcuggcagauggauggcgcgguuggacaguggcuaugaagaacggcguccagugggccgaacuugcagggcacgacuacguguuagaccugguuucagaucucgaguugcugcgugacuuccccagacagaaaagcuauuuuauugugggaacugaaggcccagccgcuucgcgaggugggccgaaggucguguucggcaacucuugggauagugacgaggauauguccaccaggccucagccccaggagcacaugccaaaaguacuagacagcgauggauacucaucccauaaucaggacggcacgaacggggaaacagaggcccaacggggaaccgcgacucaccaggaaucugauagccugggugagcccgcagugccucauaagggccucgacugcuaucuugauagucuguuugacccaguuuuguccuacggggaugccgaccuggaaaaacccaccgcuauagccuaccgcaugaagggaggcggucagccugggggcggaaguucuucaggcacagaggacacuccaagaaggccgcccgagccuaaaccaauccccgggcucgaugcaaguacccuggcuuuacagcaagccuucauucacaagcaggcuguccuucuggcccgggaaaugacacuccaggcaacggcgcuacaacagcagccucuguccgccgcuuugcgcagccugccagccgagaagcccccugcaccggaagcucagcccaccucugugggaacuggucccccugcaaaacccgugcuccuuagagcaacaccaaagccucuggcccccgcgccauuggcuaaagccccgcgacugccuaucaagcccgucgcagccccaguacucgcucaagaccaggccucgcccgagaccacuucaccuagcccagaauuagugagguauuccacacugaauagugagcacuucccccagccuacccagcaaauuaaaaacaucguucggcaguaccagcagccguuucguggcgggcgccccgaggcacuuagaaaggauggaggcaagguguucaugaaaaggccagacccucaugaagaggcucugaugauacuaaagggucaaaugacgcaccucgccgcggcucccgggacucaggucucucgggaagccguggcacugguuaaaccagugaccagcgccccuagacccuccauggcuccaacaucagcauugccgagucgcucucuggagccucccgaggagcucacccagacucgacuucauaggcugaucaauccaaacuuuuauggcuaccaagaugccccuuggaagauuuucuuacggaaagaggucuuuuaucccaaggacagcuacucccacccagugcagcuggaucuacucuucagacagauccugcaugacacacuaucagaagcgugucuucguauuagcgaggaugaacgccugaggaugaaggcccucuuugcucagaaucaacuggacacccagaaaccuuugguaacagagucugugaagcgggcaguugucuccacugccagagauaccugggagguguauuucagucgaaucuuucccgcuacgggaagcgugggcacagggguccagcugcucgccguuucgcacgugggaauaaaacuucugaggaugguaaagggcggucaggaagcagggggacaauuacgcgugcugcgggcuuacuccuucgccgacauuuuguuugucaccaugccgucucagaacaugcucgaguucaaucuggcgucagaaaaagugauccuauuuagcgccagagcacaccagguuaagacucuuguggacgauuucauccuggagcucaagaaagacagugauuacgucguagcugugaggaacuuccugccagaagaccccgccuuguuagcauuucauaagggcgauauuauacaucugcagccucucgagccaccccgcguugguuauuccgccggcugcgugguccgucggaaaguggucuaccuugaggaacugagacgaagggggccugacuucggauggcgcuuuggcaccauccaugggcgggugggaagauucccgucugagcuaguucaacccgcugccgcgccagauuuucugcagcucccuacagaacccggcaggggucgcgcugcagccguggcugccgcaguagccagcgcugcggccgcacaggagguggggagacggcgagaaggaccaccugucagggcccguucagcugaccacggcgaggaugcauuggcccugcccccauauacuaugcuugaguucgcucagaaguacuuuagagacccucaacggcgcccccaggauggucugaggcucaaauccaaggaaccgcgagagaguagaaccuuagaagacaugcuguguuucacgaaaacaccuuugcaggagagccugauugaacucucugauucaucccuuagcaagauggccaccgacauguuucuggcgguuaugcgguucaugggcgacgcaccacuaaaggggcaaucugaucuggacgugcucugcaauuugcugaaacuuuguggagaucaugaggucaugcgcgacgagugcuauugucaggugguaaagcagaucacugauaacacaaguucgaaacaggacuccugccaaaggggcuggagacuguuauacauugugaccgccuaucacagcuguucagaaguucuccacccccaucugacucgguuuuugcaggaugugucucguacaccugggcugccauuccagggaaucgcuaaggccugcgagcagaaucuccagaaaacccuucgcuuuggcgguaggcuggaacuacccagcuccauagagcugcgagcaaugcucgcugggagaaguucaaagcggcaguuguuccuguuaccgggaggccuugagaggcaccugaagaucaaaacgugcacugucgcccucgacguggucgaagagauuugugcggaaauggcccugacccgcccugaggcuuucaacgaauacgugaucuuuguuguaacaaauagaggccagcaugugugccccuugucucggagggcauacauucuggaugucgccagcgagauggaacagguggacgggggauauaugcucugguuccgccgaguucuuugggaucaaccacugaaguuugaaaacgagcuauacgugaccaugcacuauaaccagguccugcccgacuacuuaaaaggucucuucuccagugugccugcuagcagaccauccgaacagcuguugcaacagguaucuaaacuugcaucacugcagcaccgugccaaagaccauuuuuaucuccccagcgugcgggagguucaggaauacaucccugcucaacuguauaggacaacugccggcucgaccugguugaaucuggucucccagcaccgccagcagacgcaagcacuaaguccacaucaggccagagcgcaguuccucgggcuucugucugcuuuaccgauguuuggaagcucauucuuuuucauacaguccuguucuaacauugccgugcccgcaccuugcauccuggccaucaaucacaacggccucaauuuucugaguacagagacucaugaguugauggugaaguucccacuuaaggaaauucaaagcacccggacacagaggcccaccgcuaacuccucauacccuuacgucgagaucgcccugggugauguugcagcucagcgaacucuccagcugcaacuagaacagggguuggagcuguguagagugguagccgugcacgucgaaaaucuccuuagcgcgcacgagaaacgccugaccuuaccacccucugagauaacacugcucuga

SEQ ID NO: 59411 - RNA, 5643 nt, Artificial Sequence
  derived and/or modified sequence opt3 from MYO16__Homo_sapiens__NP_001185879
augagccacuaccacuucaucaagugcuguugcuuucaacuguguaacguguucagaucccacgagauggaaauugaucaaugccuccuugagucucugcccuugggccagaggcagcgguuagucaaacgcaugcgaugugaacagaucaaggccuauuacgagcgugaaaaggcuuuucaaaagcaggagggguuccugaaaagauugaagcaugcaaagaauccuaaaguucacuuuaaccucaccgauaugcugcaggacgccaucauucaucacaaugauaaggaggugcuuaggcuguugaaagaaggggcggacccacacacccucguaucaagugguggcagccugcugcaucucugcgcucgguaugauaacgccuucaucgcagagauuuuaaucgaccgcggggugaaugucaaccaccaggaugaagacuuuuggacuccgaugcauauagccugugcuugcgauaaucccgacaucgugcugcuuuugguucuggcaggagccaacgugcuacuccaagaugucaauggcaacauuccucuggacuacgcuguggaggguacggaguccucuucgauccuucugaccuauuuggaugaaaaugggguagaccucacaucacugagacagaugaaguuacagaggccaaugagcaugcugacugacguuaaacacuuccucaguuccggaggcaacgugaaugagaagaacgaugaaggcgucacccuucugcacauggccugugcgucuggguacaaggagguggugagcuugauucuagaacauggaggugaccugaauaucgucgaugaccaguauuggacuccccuccaccuggcagccaaauacggccaaaccaaccuuguuaagcuguugcucaugcaucaggcuaacccucaccuggugaauugcaacgaggagaaagccuccgauauagcagcuucagaauuuauugaggaaauguuacugaaggccgagaucgcgugggaagagaaaaugaaggagccacuaagugccagcacccucgcacaggaagaacccuacgaagagauuauccaugaccugccuguacuuucuuccaaauugucaccacuggugcucccgaucgcuaagcaagauagccugcuugaaaaggacauuauguucaaagaugccacaaaggggcuguguaaacagcagagucaggacucuauacccgagaauccuaugauguccggaagcaccaagccagagcaagucaaauugaugcccccugcuccaaacgaugaccucgccacgcugucggaauuaaaugacggcucucugcuauaugagauccagaagcgguuugguaacaaucagauuuacacuuucaucggggauauacuccugcuugugaaccccuauaaggaauugccgauuuacuccucaaugguuagucagcuguauuuuagcuccucuggaaaacucugcagcucacugccuccccacuuauucaguugcguggagcgcgcauuccaccaacuguuucgagagcagagaccacaguguuucauccuuuccggcgaaaggggcagcgggaagucugaggccucaaaacagaucauucggcauuugaccugccgugcuggagcgagucgcgcaacacucgacagcagauuuaagcacgucguguguauccuggaagccuucggucaugcuaaaacuacccuaaaugaucuguccucuugcuuuauuaaguacuucgagcuccaauuuugugaaaggaagcagcagcugacaggcgcccggauauauaccuaccuuuuggagaaaucgcgacugguaagccagccuuuagggcaauccaacuuccucaucuuuuaccugcuuauggacggacugucagcagaggaaaaguauggcuugcaccucaauaaccugugcgcccaccgcuaccuaaaucagacgauucaggaugacgcuaguacuggugagagaucucugaacagggaaaaacucgccguucugaagcgggcacuuaauguggucggguucagcuccuuggagguggaaaaccuguuugucaucuuagcggcuauccuccaucugggcgauauucgcuucacagcccuuaacgagggaaauucagcauuugugagcgaccugcaacuacucgagcagguugccggcaugcugcaagugucuaccgaugaauuggcuuccgcccugacuacagacauacaguauuucaaaggggauaugaucauuagaaggcacaccauccagauugcagaguucuuucgugacuuacucgcuaagagucuguacagccggcuuuucucuuuucugguaaacacgaugaacuccuguuugcauucacaggaugaacagaagaguaugcagacccucgacaucggaauacuggacaucuucgguuuugaggaguuccagaaaaaugaguuugagcagcuaugcgucaauaugacaaacgaaaagaugcaccauuauauuaaugaggugcuguuccuucacgaacagguugagugugugcaggagggcgucacuauggaaaccgccuacagccccgggaaccaaaauggagugcucgacuuuuucuuucagaaaccaucgggcuuccugacauugcuggacgaggaaucccagaugaucuggucuguagagagcaacuuucccaagaaauuacaaucacuccuggaaaguuccaauacuaacgcgguguauucuccuaugaaggaugguaaugggaacguugcccuuaaagaccacggcaccgcuuucacaauuaugcauuacgcaggacgagucauguacgauguggugggcgccaucgagaagaauaaggacagccugucccagaaccuacucuucgucaugaaaaccucagagaacguugugauaaaucaccuguuucagagcaagcuaagucagacugggucucugguguccgcuuauccaucauucaaauuuagaggacauaagucggcccuucucagcaagaaaaugacggcaucuaguauuaucggugaaaacaaaaauuaccuggaguuguccaaauuacugaagaaaaagggcacaagcaccuuccuccaaaggcuggaacgcggggauccgguaacuauugcgucucagcuucggaaaagccugauggacaucauaggaaaguugcagaagugcacaccccacuuuauccauuguauuagaccuaacaauuccaaacuaccagauacauucgacaacuuuuaugucucagcccagcugcaauacaucggcgugcucgagaugguuaagauuuucagguaugguuaccccgugcgccugaguuuuagcgauuuccuuucucgauauaaaccuuuagcugacaccuuucugcgggaaaagaaagagcaguccgccgcagagcguugcagacucgucuugcagcagugcaagcugcaaggguggcagaugggcgugaggaagguuuuccucaaauacuggcacgcugaucagcugaaugaccuuugucugcaguugcaacgcaagaucauaacuugccagaaagugauucggggauuccuagccagacagcaucugcuccaaaggaucucaauccgacagcaggaaguaacaaguauuaacagcuuuuuacagaauacggaggacaugggccugaagaccuacgaugcacuugucauccaaaacgccuccgacauugcucgcgaaaaugaucggcugagaucugagaugaacgcgccauaucauaaagaaaagcucgaggugaggaauaugcaggaggaagggucgaaacguacugacgauaagagcggaccccgccacuuccauccgucauccaugagugugugugccgcagucgacggcuugggucagugccugguugggccuucuauauggagcccaucccuccacucaguguuuucuauggaugacagcaguucccugcccagcccucggaagcagcccccaccuaaacccaagagagauccaaacacaaggcuuucugcuucauacgaggccguauccgccugucuaagugcugcacgagaagccgcgaaugaggcucuggcccggccgcgcccucacagcgacgauuauucgaccaugaaaaagauacccccaagaaaacccaagaggucuccuaacacaaaguuguccggaagcuacgaggaaauuucaggcagucggccaggugacgcacgacccgccggcgcuccuggggcagccgcgagaguguuaacuccgggaaccccacaaugcgcucugcccccugccgcaccacccggcgacgaggaugacucugaaccugucuauaucgagaugcucgggcaugccgcucgcccggauucccccgacccaggagaaagcguguacgaggagaugaaauguugccugccugaugacggcggucccggggccggaucauuccuucugcacggcgcaaguccaccucucuugcauagggcucccgaagaugaggccgcggguccaccgggcgacgccugugauauuccucccccauuucccaaccugcuaccucaccguccaccccugcucguuuucccuccgacgccagugaccugcagccccgcauccgacgaaucuccucuuacaccccuggaggucaagaaauuaccaguguuggaaacuaaucugaaguauccuguucagcccgaggggagcuccccacucucaccucaguacucuaaaagucagaagggagauggcgaccggccggcuucgcccgggcuggcccuuuuuaacggaagcggcagagcuuccccaccuucuacacccccaccucccccgccaccucccgguccacccccugcaccguacaggcccugugcccaucuggccuucccaccugagcccgcuccugugaaugcggggaaggcaggaccaucagccgaagcucccaaaguccacccuaagccaaacagcgcccccguagcaggcccgugcuccaguuuuccuaaaaucccauauucucccgugaaggccacacgcgcugaugcgcgaaaagccgguagcucagcauccccuccagcucccuacaguccgccuagcucuagaccccucuccucaccauuggacgagcuggccagcuuauucaauucgggccggucuguucuaaggaagagugcagccgggcgcaagauacgugaagcugagggauuugaaacuaacaugaauaucuccagcagagacgauccuucaaccuccgagauuacgucugagacacaagaccggaacgccaauaaccacggcauccagcugagcaauagucucuccagcgcgauuaccgcagaaaacggaaauucuaucucaaacggacuucccgaggaagauggcuauaguaggcuguccauaagcgguacugggacaucuaccuuccagcgccaucgagacucgcacacuacccaagugauucaucaguugagacugucagagaaugagagcgucgcccuccaggaacugcuugauuggcggaggaaacucugcgaggaaggacaggacuggcaacagauccugcaccacgcugagccacgcgugcccccuccaccgcccuguaagaaaccuuccuugcugaagaaaccagaaggcgccaguugcaacagauuacccucugagcuaugggauacaacgaucuga

SEQ ID NO: 59412 - RNA, 7704 nt, Artificial Sequence
  derived and/or modified sequence opt3 from MYO18B__Homo_sapiens__NP_115997
auggccaucagcucccgacuggcucucugggagcagaagauuagggaagaggacaaaucucccccuccaucaaguccgcccccucuuuucagcgugauaccaggcggguuuaucaagcaacugguccggggaaccgaaaaagaggcuaaggaagcccgccaacgaaaacaauuggcgguugcuucccccgagcgugagauuccugaaaucucuauuucgcagccaaacucaaagagcaguuccgguacaagaucuggcagccaacagaucucccaggaugaccagucaaguagccccgggucuuccgauauauuaggaaaggagucagaaggcagcaggaguccugacccagagcaaaugacuucuaucaauggugagaaagcccaggaacugggguccagcgcaacgccgaccaagaaaacagugcccuucaagcggggaguacgcagaggcgaugugcuacucauggucgccaaacuggacccugauucggcuaagccagagaagacucacccccaugacgcaccuccaugcaaaaccucucccccggccacagauaccggcaaggagaagaagggggagacuuccaggacaccuuguggaucacaggcuaguaccgaaauucuugcccccaaagcggagaagacgcggacugguggccugggggacccaggacagggcaccguggcauugaaaaagggugaggaagggcaaagcaucguuggaaagggccucggcacaccuaaaacuaccgagcugaaggaagccgagccccaggggaaagaucgccagggaacacgaccacaagcucagggucccggcgaaggggugagaccuggaaaggccgagaaagagggcgcagaaccaaccaacacggucgagaaggguaauguguccaaggacguagggucugaaggcaaacacguuaggccgcagauucccggacggaaguggggcggguuucugggacgucgcagcaaaugggaugguccucagaacaagaaagacaaggagggcgugcucuuaucaaaggcugagaagacuggggagccacaaacacagauggagaagaccagucagguccagggagaacugggcgacgaucuuagaaugggugagaaagccggggaauugagguccacuacaggcaaggcgggagagagcugggacaaaaaggagaagaugggccaaccccaggggaaaucuggaaaugccggugaagcacggucacagaccgagaagggcugcgaagcuccuaaagaggugaguacgaugguggaaagcccagccgcucccgggaagggaggcuggccggguucccgagggcaggaggccgaggaaccuuguucucgcgcaggcgauggagccggcgcucuggagaccgaacuagaggggccaucgcaacccgcgcucgaaaaagacgcagagagaccuaggauccggaaggagaaccaggauggacccgccccacaggaagagggcaaaggugggcagagccgcgacuccgaucaagcuccugaagacagaugguacgaggccgaaaaggucuggcuggcacagaaggauggauucacacuugccacuguucugaaacccgacgagggcaccgcugauuugccagccgguagggugcgucucuggauagacgcagacaagacaauuacugagguagaugaagaacaugugcaccgggcgaauccgccugaacuggaccaggucgaggauuuagcuucacugaucagugugaacgagucuagcguucucaauacccuucugcaacgauauaaagcccaguugcuacauacaugcaccggccccgaccugauugugcuccagccaagagggcccuccgucccuucagcaggaaaggugccaaaaggcaggcgcgaugggcugcccgcccacaucggaagcauggcucagcgggccuacugggcacuucugaaccaaagaagggaccagucuaucguagcuuugggcugguccggugccgggaagacuacguguugcgaacagguucucgagcaccuggugggaauggcgggcagugucgauggucgcgugagcgucgaaaagauucgagccacauuuaccguguuacgggcuuucggcucuguuuccauggcacauucacguagugccacuagauuuagcauggugaugucgcuggacuucaaugcuaccgggaggauaacagccgcacagcuacaaaccaugcuccuggagaaaucccgcguagcgcggcagccugaaggagagucuaacuuucuugucuucagccagauguuggccggccuggaucucgaccugagaacugagcuuaaucugcaccagauggcugauucaaguuccuuugggaugggaguguggucuaagccggaagacaaacaaaaggccgcagcugccuucgcacaguugcagggcgccauggagaugcucgguaucagcgaauccgagcaaagggcuguuuggcgagugcuggcggccauuuaucauuuaggggcagcuggagccuguaaagucggccgcaagcaguuuaugcgguucgaaugggccaacuacgcugcagaggcccuggguugcgaguaugaagaacuaaauacagcgacguucaagcaccaccucagacagaucauacagcaaaugaccuuuggcccaucaaggugggggcuggaagaugaggaaacuagcaguggacuuaaaaugacaggcguggacuguguagaggggauggcuucuggauuguaccaggagcuguucgccgcagugguuucccucauuaaccguagcuuuucgucacaucaccugucuauggccaguaucauggucguggacucccccggcuuccagaacccucgccaucaggguaaggaucgggcugcaaccuuugaagaguuaugccacaauuaugcccaugaaagacugcaacuuuuguucuaccagaggacauuugugagcacucuccagcgauaccaggaggagggggucccaguucaauucgaccugcccgauccuucuccgggaaccacgguggcggugguagaccagaaccccagccagguccggcuaccagcuggcggcggggcccaggaugcacgcggacuguuuugggugcucgacgaagagguucacguggaagguuccucagauagugucgugcuggagagacuuugugccgcuuucgagaaaaagggcgccgggaccgagggaagcucugcauugaggacaugcgagcaaccucugcagugcgaaaucuuucaccaguuaggcugggaccccguucgguaugaucucacugguuggcugcaucgagcuaaaccaaaucuuuccgcccuggacgcgccucaaguguugcaccagucaaagagagaggaacuccgcagucuguuccaggccagggcaaagcuacccccaguaugucgugcugucgccgggcuggagggaaccagccagcaagcucuccagcgguccagaauggugaggcgcacauuugcaucuucgcuggccgccgugcgaagaaaagcuccgugcagccagauuaaacuucagauggaugcguugacuucaaugaucaaacgguccaggcugcauuucauucacuguuuagucccuaaccccguuguggaaagucgcucuggccaagagagcccacccccuccacagcccggccgugacaagccuggggcaggagguccgcucgcccuggauauaccagcucuuagaguacagcuggccggcuuccacauccuagaggcacuccggcugcauaggaccggguacgccgaccacaugggauugacgcgcuuucgaagacaguuccaagugcuggacgcucccuuacucaaaaagcugauguccacaucagaaggcauugaugagcggaaagcggucgaagaacuucuggaaaccuuggaccucgagaagaaggccguggcaguuggucauucucagguguuucugaaagcuggggucaucagcaggcuagagaagcagcgcgaaaaacuggugagucaauccaucguucuuuuccaggccgcaugcaagggauuucucagcagacaggaguucaaaaagcugaagauuaggcgguuggccgcucaguguauacagaaaaauguggccgucuuucuggcgguaaaggauuggccuugguggcaguuacucggcucucugcagccccuucugucagcaacuaucggcacagaacaguugcgugccaaagaggaggaacucaccacucugcgccgaaagcuagagaaauccgaaaagcugagaaacgagcuuaggcaaaauaccgaccuccuggaaaguaagauugcugauuugacaagcgacuuagccgaugagcgguucaaaggggacguggcuugccagguucuggagucggaacgcgcagagagacuccaggccuuuagggaagugcaggagcugaagucuaaacacgaacaaguccagaagaaacuuggagaugugaacaagcagcuggaggaggcucagcaaaagauccaguugaaugaccuagaacggaacccaacggguggcgccgaugaguggcagaugcgauucgacugugcacaaauggaaaaugaguuucugagaaaacgccuccagcagugcgaagagaggcuggacuccgagcuuaccgcgcggaaggaauuagagcagaaacugggggaacuccaaagcgccuaugauggagcuaagaaaauggcccaucaguugaagcguaagugucaccaccugacuugcgaccucgaggauacauguguacugcuugagaaccagcagucaagaaaucaugaacuggagaaaaagcagaaaaaguucgacuugcagcuagcacaggcucugggcgaaaguguguuugagaaaggucucagggaaaaggucacccaggagaacacaucuguucgcugggaguuagggcaacugcagcagcaacuuaaacagaaggaacaggaggccucccagcugaagcaacagguggaaaugcuccaggaucacaaacgggaguugcugggaagcccuucacucggcgaaaauugcguggcaggccugaaggagcgacuuuggaaacuagagaguagcgcccuggaacagcaaaagauucagucccagcaggagaacacuaucaaacaauuggaacaguuaagacagagguucgagcuggaaauagagcgcaugaagcaaaugcaucagaaggaccgggaggaucaggaagaggaacucgaggacgucagacagucuugccaaaaacgucugcaccagcuugagaugcagcuggaacaggaguacgaagagaagcaaauggugcuccaugaaaaacaggauuuggaggggcugaucggaacccuaugugaccagauuggucacagggauuucgacguugagaagcggcugcgccgagaucucagaaggacgcacgcacuucugagcgacguacaguuauugcugggcacaauggaagacgggaaaaccuccgugucaaaggaggaacucgagaagguccauucucaacuggaacagagugaggcgaaaugcgaggaagcccuuaagacucagaaagugcugaccgcagaucucgagucgaugcacagcgaauuggagaacaugacacggaauaagucccugguugacgaacaguuauaucgccuacaauuugagaaagcugaucugcucaagagaaucgacgaggaucaggacgaucuuaacgaacugaugcagaagcauaaagacuugauugcccaaucugccgcagauaucggacagauacaggagcugcagcuccaacuggaagaggcuaagaaagagaagcacaaacuucaggaacagcuccagguggcccaaaugaggauugaguaccuggaacagucaacugucgaccgagcgaucgugagccggcaggaggcuguaauuugugauuuggaaaauaagaccgaguuccagaaaguccaaaucaagcguuuugaggugcugguuauaagauuacgcgacucccuaaucaagaugggcgaagaacugagucaggccgcaacaucugaaagccagcaaagggagucaucccaguauuaccagcggagacucgaggagcuuaaagccgauauggaggaacuggugcagcgcgaggcugaagcaaguaggcgaugcauggaguuggaaaaguacgucgaggagcuggccgcggugcggcaaacgcuccagaccgaccuggaaacuagcauuagaaggaucgcugaccuucaggccgcauuagaggaaguugccucuuccgauucagacacagagagcgugcagaccgcugucgauugugguucgucugggcgcaaagagauggacaacgugaguauucuguccagccaacccgaaggaucacuccaguccugguugucuugcacucugagccuagccacagauaccaugcguacgccaagucggcaguccgcaacuagcucuagaauccugucaccuaggauaaaugaggaagcuggcgacaccgagcgcacacagagugcccucgcgcuuucccgagcccggagcaccaacguacacucuaagacuucgggcgauaaaccggugucaccccauuucguuagaaggcaaaaguauugucacuuuggggacggagaaguccuggcagugcagcgcaagagcacagagagauuggagccagcuuccaguccucuggccucucggagcaccaauacaagcccccucucaagggaaaaacugccaaguccuucugcagcuuuaagcgaguucguggaaggucuucgucgaaagcgcgcccagagaggccagggguccacucugggacucgaggauuggcccacccuaccgauuuaccaaacgacaggcgccucaacccugcggaggggucgcgcggggagcgacgaaggcaacuugucucugagagucggagcuaaauccccacucgagaucgagggcgcagccgggggacuucugcggaguacuagcuugaagugcaucucguccgaugguguaggcgggaccacacugcucccugaaaaaucuaagacucaguuuucaagcugugagaguuuacuggaauccaggcccucuaugggacgaaaacuuagcucaccaaccacgccccgugacaugcugcuauccccuacacucagaccgcgccggaggugccuggagaguagcguggacgaugcuggcugucccgacuuggguaaagaaccacugguuuuccagaauagacaauuugcccaucucauggaggagccucuugggucugaucccuucucauggaagcugccuuccuuagacuaugaacgcaaaaccaagguggauuuugacgauuuccugccagcaauucggaaaccccagacuccuacauccuuggccggcucugcuaagggaggccaggacgggagucagaggucguccauccacuucgagaccgaagaggcgaaccggagcuuucucucaggaauuaagacuauacugaaaaagucuccagagcccaaagaagauccggcccaucuaagcgacuccaguucaucuagcgguuccaucgucaguuucaagagcgcagauuccauuaaaucuagaccuggcaucccaagacuugcuggggacggaggcgagaggacaucacccgaacgccgugagccugguaccgggagaaaggaugacgacguggccagcauuaugaaaaaguaccugcaaaaguga

SEQ ID NO: 59413 - RNA, 3132 nt, Artificial Sequence
  derived and/or modified sequence opt3 from MYO1A__Homo_sapiens__NP_005370
augccccugcucgagggcagcgugggggucgaagaccuuguucuguuggagccuuuaguggaagagucccugcuaaagaaccuccagcugagauacgaaaauaaagagaucuauaccuacauuggaaacguagugauaucugucaauccauaucaacagcuuccgaucuacggucccgaguucauugccaaguaucaggauuacacauuuuaugaacugaaaccucacaucuacgcuuuggcaaacguggccuaccagucacucagggaccgggaucgcgaccaaugcauucugaucacuggcgagagugggagcggaaagacggaagcguccaaacugguuaugucuuauguggcugccgucuguggcaagggugagcagguaaauucggugaaggagcagcucuuacagucaaacccaguucuggaagcauucgggaaugccaaaaccauacgaaacaauaacagcagucguuuuggaaaguacauggauaucgaguucgacuuuaaaggcaguccccuuggcggggugauuacaaauuauuugcuggaaaagucuaggcuagucaaacaacucaagggagagagaaacuuccauaucuuuuaccagcugcuugcuggugcagaugaacagcuguugaaggcccucaaacuggagcgggacacuaccggcuaugcuuacuuaaaucacgaggugagccgcguggaugggauggacgaugccuccucauucagagcgguccagagugcaauggccguuauuggauuuagcgaagaggaaaucaggcaagugcuggagguaacaucuauggugcucaaacuuggcaacguccugguggcugacgaguuccaggccuccgguauaccugcaucagggauucgggauggacgcggcguucgagaaaucggcgagauggugggguugaauagcgaagaggucgaaagagcucuaugcaguaggaccauggagacugccaaggaaaaggugguaacagcgcugaacguuaugcaggcccaauaugcacgggacgcucucgccaaaaacauuuacucucgucuguuugacuggaucgugaaucgcaucaacgaguccauuaaggucggaauaggugagaaaaagaaggugaugggcguccuugauaucuacggguucgaaauucuggaggacaauagcuuugaacaguucgugaucaacuauuguaaugagaaauugcagcagguuuucauagagaugacccucaaggaggaacaagaagaguacaaaagagaaggcauuccauggacgaagguggauuauuuugacaacggaaucaucugcaaacugauugagcauaaucagagggguaucuuagcuaugcuggaugaggaaugucuacggcccgggguagucucggacucuacuuuccucgccaagcugaaccagcuguuuuccaagcacggccauuacgagucaaaagugacccagaaugcacaacgacaguaugaucacacaaugggauugaguugcuuccgcauuugucacuacgccggcaagguuacuuauaacgugaccagcuuuauagacaaaaauaacgaucuucucuucagagaccugcuucaggcuauguggaaggcgcagcauccucuguugaggucccucuuuccagaagggaauccgaaacaagcaucucugaagcggcccccuacagccggagcucaguucaagagcucagucgccaucuuaaugaaaaaccuguacaguaaguccccaaauuacauucgcugcaucaaacccaacgagcaccagcagagaggucaauuuagcucugaucuaguggcaacccaggccagguaucucggccugcuugaaaacguacgugugcggcgagcuggguacgcccauagacagggauauggcccuuucuuggagagguaccgccugcucucacggaguacguggccacacuggaaugguggggacagagagggcguugaaaagguccugggagaguuaagcauguccucuggcgaacuggcauuugggaaaacuaagaucuucauuaggucgcccaagacauuguuuuaucuugaggaacaacgccgacuccggcugcagcagcuagcgacccugauacagaaaaucuaccguggauggagauguaggacucacuaucaacucaugcgcaagagccagauucugaucuccucaugguuccgggguaacaugcagaaaaagugcuacggcaaaauuaaggcuagugugcuuuugauccaggccuucgugagaggguggaaagcaaggaagaauuaccgaaaguauuuucgcucugaggccgcucugacauuagccgacuucauauacaaaagcaugguccaaaaguuucuccugggacuuaaaaacaaucugccguccaccaacguuuuggauaagacguggccugcagcucccuauaaaugucucucaaccgccaaucaggagcugcagcagcuauucuaccaauggaagugcaagcgguuuagagaccagcugagcccaaaacagguggaaauccucagggagaagcugugcgcgucugaacuuuucaaaggcaagaaagccuccuauccucaaagugugcccauuccauuuuguggugauuacaucggguugcagggcaaccccaagcugcagaaguuaaaaggaggcgaggaggggccuguacucauggcugaagcagucaagaaagugaaucguggaaacggcaagacaagcucucgcauucugcuucugacuaaaggucauguuauccuaaccgacacaaagaagucccaggccaaaauagugauugggcucgauaaugucgcuggagugucaguuacuucccugaaggacggcuuguucagccugcacuuaucggagauguccucuguggguagcaaaggcgauuuucuccugguaucagaacaugucaucgagcuucugaccaagauguaucgggccguguuggacgcaacacaaagacagcucaccgugacugucacggaaaaauucaguguuagguuuaaggagaacuccguggcgguaaaagugguccaggggccagccggaggcgauaauucuaagcugcgauacaagaaaaaggggagccacugccuagaggugacaguucaguga

SEQ ID NO: 59414 - RNA, 3237 nt, Artificial Sequence
  derived and/or modified sequence opt3 from MYO1B__Homo_sapiens__NP_036355
auggccaagauggaggugaaaaccagccugcucgacaacaugaucggcgucggggauaugguucuucuggaacccuugaaugaggaaacauucauuaacaauuuaaagaaaagauuugaccacuccgagauauacacuuauaucggaucugugguaauuucagugaacccuuacaggagucugccaaucuauagcccggaaaaggucgaggaguaccggaaucgcaacuucuaugaacuaaguccccauauuuuugcucucucugaugaggcauaccgaucgcugcgugaccaggauaaagaccaaugcauccuuauaacgggugaaucaggcgccgggaagaccgaggcgagcaagcuggugaugaguuauguugcugccguguguggaaaaggcgcagaggucaaucaggugaaggaacaguugcuccaguccaacccuguacuggaggccuucgguaaugcuaaaacaguuagaaacgauaauucuagcagguuugggaaguacauggacaucgaguucgauuuuaaaggagacccacugggcggcgugauuuccaacuaccucuuagaaaagucacgggucgugaagcaaccccgcggggaaagaaauuuccacguguuuuaucagcugcuuaguggagcaagcgaggaguugcugaacaaacuaaagcucgaaagggauuucucucgguacaauuaucugucccuugacucagccaaagucaacgguguugaugacgcugccaacuuucgcacugugcgaaaugcgaugcagaucguaggcuucauggaccaugaggcagaaagcgugcuggccgucguggcugccguuuugaagcucgggaacauugaguuuaaaccugaaaguagagugaauggacuggaugagucuaagaucaaagacaagaacgaguuaaaggaaauaugcgagcugaccggcauugaucaguccguccucgaaagggcauucagcuuccggacaguggaggcuaaacaagaaaagguaucgaccacucuuaauguugcccaggcguacuaugcccgugacgcacuggcuaaaaacuuguacucucgccuauuuuccuggcuggugaauagaaucaacgagucaauuaaggcccagacaaaagucaggaagaaggugauggguguccucgauaucuauggguucgagaucuuugaagacaauaguuucgagcaguuuauuauaaacuacuguaaugaaaaacugcaacagaucuucauugagcuuacccugaaggaggaacaggaggaauacauccgggaggauauagaauggacgcacauugacuauuuuaacaaugcuaucaucugcgauuugauugagaacaauacuaacggaauccucgccaugcuggacgaggaauguuuacgaccaggcaccgugacagaugagacuuuccuggaaaaacuaaaccaaguuugcgcaacccaucagcacuuugagagccgcauguccaaguguucuagauuccucaaugacacaagccugccccacucaugcuuuaggauucagcauuacgccggcaaagugcuuuaucagguagaaggguucgucgacaagaacaaugauuugcuguaccgggaccucagucaagcuauguggaaggcgucccacgcacugauaaaaagccuuuuuccugagggaaacccagccaagaucaaucugaaacgcccgcccaccgcugguucucaguucaaggccucaguggcaacguugaugaaaaaccuccagacuaagaauccuaacuauauuagauguaucaagccaaaugauaaaaaggccgcucauaucuucaacgaggcccugguuugccaccagauuagguacuuaggccugcuagaaaaugugcguguccggcgagcaggguaugcguuuagacaggcuuacgagcccugucucgaaagguacaaaaugcugugcaagcaaacauggccucacuggaaaggaccagcccgcaguggcguggagguacuuuucaacgaauuggagauacccguggaggaauauagcuuuggucgguccaagaucuucauuagaaauccgaggacccuguuuaaacucgaggaccugcgcaagcagcgauuagaagaucuggcaacucuuauccagaagauuuaccggggguggaaaugccguacacauuucuugcucaugaagaaaucucaaaucguuauagccgcuugguauagaagguacgcccagcagaagcgcuaucagcaaaccaaaucgagcgcacuggucauccaguccuacauucggggcuggaaggcuagaaagauccuaagggagcugaaacaccagaagcgauguaaagaggccgugacgaccauugcggccuauuggcauggaacacaagugcgccgggaauacagaaaguuuuucagggcuaacgcaggcaaaaagaucuacgaguuuacucuccagcguauaguccagaaguauuuccuggaaaugaaaaauaagaugccuucacuuagucccauugacaaaaacuggccaucucgcccuuacuuguuucuggauagcacccacaaggaguuaaaacggaucuuccaucucuggagaugcaagaaguauagggaccaguuuacagaucaacagaaacugauuuacgaagagaaacuugaggccuccgaacuguucaaagacaagaaggcuuuguaucccucaagcguugggcagccauuccagggagccuaccucgagaucaacaagaaucccaaauauaagaagcugaaagaugcaauagaagagaagaucauuaucgcggaaguggugaacaaaauuaaucgagccaacgguaagucuacuucccggaucuuucuacugaccaauaacaaucuccugcuugcugaccaaaaauccggccagauaaagagcgagguaccuuuggucgaugugacaaagguuucuauguccucacagaacgacggguucuuugccgugcaccugaaagagggaagugaagcagcuagcaagggcgacuucuuauuuucguccgaucaccucauugagauggccaccaaacuguaccgcacuacgcuuucucagacaaagcaaaaacugaauaucgaaaucagcgacgaguuccuaguccaguuuagacaggauaagguguguguuaaguucauucaagguaaccagaaaaaugggucagugccaaccugcaagaggaaaaacaaucggcuccuggaaguagcagucccguga

SEQ ID NO: 59415 - RNA, 3192 nt, Artificial Sequence
  derived and/or modified sequence opt3 from MYO1C__Homo_sapiens__NP_001074248
auggcccuucagguggagcucguccccaccggcgaaaucauuagaguugugcacccucauaggccaugcaagcuggcucuggggagcgacggaguacgggugacaauggaguccgcauugacugcccgcgaucgagucggugugcaagacuucguuuuacuggaaaacuuuacgucugaggcggcuuucauagaaaaucuacguagaagguuucgggagaaccucaucuacaccuauauuggcccggugcuggucucagugaaucccuaccgcgaucuucagaucuauaguagacagcacauggagagguaccgcgggguuagcuucuaugaaguaccuccacaucuguuugccguggcagacacagucuaccgggccuugcgaacugagagaagggaucaggcugugaugauuuccggagaaucuggcgcagguaaaaccgaggccacaaagcggcuccugcaauucuaugcugagaccugucccgccccugaacgugggggagcggugcgcgacagacugcuccagucgaacccagucuuagaggcauuuggcaaugccaaaacucugaggaacgauaauucaagccgguucggcaaguacauggacguucaguuugauuucaaaggggcucccgugggaggucacauccuuaguuacuugcuggaaaagucccgaguagugcaucagaaccacggcgagcgcaauuuucacauauucuaucaacuacucgaagggggagaggaggaaacacugagaaggcuuggccuggagcggaacccucagucuuacuuguaucucgucaagggucagugcgccaaagugagcuccaucaaugacaagucagauuggaaaguugugcgcaaggcacugaccgucauugacuuuacggaagaugagguggaagacuuacugaguaucguagcuagcguucuccaucuugggaacauucacuucgccgcgaaugaggagucuaacgcccaggugacuaccgaaaaucaacugaaauacuugacaagacuacuguccgucgagggaucaacucucagggaagcacugacccaucguaagaucauagcuaagggcgaggaacuucugagcccauugaaccucgagcaggccgcuuaugcccgggacgcacuggccaaagcuguguacagucgaacauucaccugguuagucggcaagauuaacagaucucuggcguccaaagauguggagagcccgucguggaggucuacgacuguucuagggcuccuggacaucuauggauuugaaguguuccagcacaauuccuuugagcaauucuguauuaacuacugcaaugaaaaacuucagcaguuguuuaucgagcugacacucaagucagagcaggaagaguacgaagcagaggguaucgccugggaacccguacaauauuucaacaauaagauuauaugugaucuggucgaggagaaauuuaagggcaucauuaguauccuugacgaagagugccugcgcccuggggaagcuaccgauuugacuuuccucgagaagcuggaagacacagugaaacaccauccacacuuuuuaacccauaagcuggccgaucagcggacgagaaaaagccuaggaaggggcgaguuccgccuccugcacuacgcuggugagguuaccuauuccgugacaggguuucuugacaagaacaaugauuugcuguuccgaaaccucaaagaaacuauguguucuagcaagaaucccauaaugucacagugcuuugaccggagugagcuguccgauaagaaacguccugaaaccgucgccacacaguucaagaugagcuuacugcaacuuguggagauuuugcagucuaaagaaccagcuuacguaagauguaucaagcccaacgacgccaaacagccgggcagguucgacgaggugcucauccgccaucagguuaaguaucugggacuacuggagaaucuccgggucagaagggcaggcuuugcguaccgacgcaaguaugaggcuuuccugcaacgguacaaaucacuuugcccugaaacuuggcccaccugggccgggagaccacaggauggaguggcaguguuggucaggcaccuggguuacaagccugaagaguauaaaaugggccguacaaagauuuuuauccgcuuccccaaaaccuuauuugccacugaggacgcucucgaaguucggagacagagucuggccacgaagauucaggcagcuuggaggggguuccacuggcgacaaaaguuucuucgggugaaacgcagcgccauauguauccaguccugguggagaggaacacugggcaggcggaaggcggccaaacgaaagugggcugcacagaccauuagacgcuugaucagggguuucgugcuccgucaugccccacggugccccgagaacgcauuuuuccuggaucacguaagaacuucuuuucuacugaaucucaggcgccaacugccucagaacguccuugacaccucguggccaacaccgcccccugccuugcgagaagcaagcgagcuguuaagagaacucugcaucaaaaauaugguguggaaguacugucgguccauuucaccagaguggaaacagcagcugcaacagaaggcgguugccagugagauauucaaggggaaaaaggauaacuauccccagucugugccuaggcuuuuuaucagcacccgccugggcacugacgaaauuuccccacguguccuacaggcucucggaucagagcccauccaauacgccgugccgguugugaaauaugauagaaagggcuacaaaccucggagcaggcagcuguugcugacaccaaacgcaguagucauuguggaagacgcuaaggugaagcagcgcaucgauuaugccaauuuaacggggauaucugucuccagucucagcgacucucuguucguucuucaugugcagcgagcagauaacaaacaaaagggagacguagugcugcaguccgaucacgucaucgagaccuugacuaaaacagcccucucagcuaauagagugaacaguauuaauaucaaccaggguagcauuaccuucgcgggcgggcccggacgggacggcacaaucgacuuuacuccugguucggaacugcuaauaaccaaggccaaaaaugggcaccuggcaguuguggcucccaggcuuaacucccgcuga

SEQ ID NO: 59416 - RNA, 3021 nt, Artificial Sequence
  derived and/or modified sequence opt3 from MYO1D__Homo_sapiens__NP_056009
auggccgagcaggaaagccuggaguucggcaaggcugacuuugugcucauggauaccgucuccaugcccgaguucauggcaaaccuuagacugagguuugagaaagggcggaucuacacauucauuggagaaguugugguaucugugaauccuuauaaguuguuaaacauauacggucgcgacacuaucgagcaauauaaaggccgagagcuguacgaacguccaccgcaccuauuugccauugcggaugcugccuauaaggcaaugaaaagaaggucaaaggacacgugcaucgucauuaguggggagagcggagccggcaagaccgaggcuuccaaauacaucaugcaguauauagcagccaucacaaaucccucucagcgggcugaaguggagcgcguuaagaacaugcuccugaaaucgaauugugugcuugaagccuucgguaacgcgaagacuaauagaaacgauaauucaagcagguuugggaaauacauggacauuaacuucgauuuuaagggagacccuaucggcggccauauuaauaacuaccuguuggagaagagucgggucaucgugcagcaaccaggggaacgcuccuuccacucuuuuuaucagcuccugcagggagguagcgagcagaugcugcgaucccuccauuuacaaaaaucacugaguagcuacaauuauauacacguaggcgcacagcuuaagucuuccauuaacgaugccgcugaguucagaguuguggccgacgcaaugaaagucaucggguuuaagcccgaagagauucagaccguguacaaaaucuuggcugccauccugcaucuaggaaaucucaaguucguggucgauggcgacacaccucugauugaaaacgguaaaguugugucaauaaucgcggagcuucugagcaccaagacugauaugguagaaaaggccuugcucuauaggacaguggcaaccgggcgggacauuaucgacaaacagcacacggagcaagaagcuaguuacggacgugaugccuucgcuaaggccauauaugagcgccuguuuugcuggauugucacuagaaucaacgacaucauugaggugaaaaauuacgauaccacaauccacggcaagaacacuguuauuggcguguuagacauauacggguucgaaaucuuugauaauaacucuuucgagcaguuuuguauuaauuauugcaacgaaaaacugcagcaacucuucauccagcuuguccugaagcaggagcaggaagaguaccaaagggagggaaucccauggaagcauauugacuauuuuaauaaccagauaaucguggauuugguagaacagcagcacaaagguauuaucgcaauucuagacgaugccuguaugaauguuggcaaggugaccgacgagauguuccuggaagcucucaacuccaaacuggggaagcaugcgcacuuuagcucgcggaaacuuugcgcaucugauaagauccuggaguucgaccgagacuuucgcauaagacacuacgccggagaugucguguauuccgucaucggcuucauugacaagaauaaagauacauuguuucaagacuucaagaggcucauguacaacucaaguaaucccgugcugaaaaacauguggccugaggguaaguuaagcaucaccgaaguuacgaaacggccacugacugcugccacacuauucaaaaauuccaugauugcacucguggauaaccuggccucuaaggagccguauuacguacgcuguaucaagcccaacgacaagaaaagcccucagauauuugaugacgaaagaugcaggcaucaggucgaguaccuuggguugcuggaaaaugugcguguucggcgagcuggcuucgccuuuagacagaccuaugagaaguuccuccacagguacaaaaugauuucagaguuuacuuggccaaaccaugaucugcccagugacaaggaagcagugaaaaagcugaucgagcgcuguggauuccaagaugacgucgcguauggcaagacaaaaauuuuuauccggaccccuagaacgcuuuucaccuuggaagaacucagggcucagaugcugauacgcaucguguuauuucugcagaagguauggcgagggacacuagcccggaugcguuacaaaagaacuaaggcagcccucaccauuaucagguauuaccgccgguauaaagugaaguccuacauucacgaaguugcuagaagguuccauggagucaagacaaugcgagauuacgguaaacacgugaaguggccaucacccccgaaagugcugcgccgguuugaggaggcccuucagacuaucuucaauagauggagggcaucucaauugauaaagucaauuccugcuagugaccugccccagguccgugccaaaguugcggccguggaaaugcucaagggccagcgcgcugaccugggguuacaacgggcaugggagggaaacuaucuggccagcaagccagauaccccucagacauccggcaccuuugugcccguagcuaaugaacuuaaaagaaaggacaaauacaugaacgucuuguucucuugccacgugaggaagguuaaucgauucucgaaaguggaggaucgggccaucuuugucacugaccgccaucucuauaagauggauccaacgaagcaguacaaagugaugaagacaaucccccuguauaaccuaaccggucugagcguuuccaaugggaaagaccagcucgugguauuccacacuaaggauaacaaagaccugauugucugucuuuuuagcaagcaaccuacccaugaaaguagaaucggcgaguuggugggagugcuggucaaucacuucaaaucugagaagaggcacuuacagguuaacgugacaaauccaguacagugcagccuccauggcaagaaaugcaccguguccgucgaaacucggcugaaccagccgcaacccgauuuuacaaagaaucgaucaggguucauucuuagcgugccuggaaacuga

SEQ ID NO: 59417 - RNA, 3327 nt, Artificial Sequence
  derived and/or modified sequence opt3 from MYO1E__Homo_sapiens__NP_004989
augggcagcaaggggguguaccaguaucacuggcaaucccauaacgucaaacacucuggaguugacgauauggugcugcucucaaagaucaccgagaauaguauuguagaaaaccuuaaaaagagauacauggacgauuauauauucacauacaucgguagcgugcugauuuccgucaaucccuuuaaacagaugccuuauuucggcgagaaggaaaucgagauguaccagggggccgcucaguaugaaaacccaccgcauauuuacgcauuggccgacaauauguacaggaacaugaucauagaucgggagaaucaaugcgugaucauuucuggagagucgggcgcggguaagacuguugcugccaaauauaucaugucauacauuagccgcgugagugggggaggcacgaagguccagcacgugaaagacaucauauuacaguccaacccccugcuagaagcauuuggcaaugccaagaccguacgaaacaauaacucuagccguuucgggaaauauuuugagauucaguucuccccuggaggugaaccagauggcgggaagaucucaaauuuucuccuggagaagaguagaguugugaugaggaaccccggagagcggagcuuccauauuuucuaccaacuuaucgaaggcgcuucugcagagcagaaacacucccuggguaucacaucaauggacuauuacuauuacuugagccucagugggucuuacaaggucgaugacauugaugaccgcagagaauuucaggagacucugcacgccaugaaugugauaggaaucuuugcugaggaacagacccuggugcuccaaauugucgccggcaucuuacaucugggcaacauauccuucaaagagguugggaacuaugcggcaguggaaagcgaggaauuucuugccuucccugcuuacuugcugggaauuaaucaggauaggcuaaaggagaaacucacaucgcggcagauggacucuaagugggguggcaaauccgaaucaauccacguaacccugaacguggagcaagccuguuauacucgcgacgcacuugcuaaggcccugcaugcgcgagucuucgauuuucucguggacaguaucaauaaggccauggagaaagaucacgaagaguacaacauugggguucucgacaucuauggauucgaaauuuuucagaagaauggcuucgagcaguuuugcauaaacuucgugaaugaaaaacugcagcaaaucuuuauugaguuaacacugaaggcagagcaggaagaguacguccaggaagguaucagauggaccccaaucgaguauuucaacaauaaaauugugugugaucucauagagaacaagguaaaucccccugggaucaugagcauucuugacgauguuugcgcuacgaugcacgccgugggcgaaggagcugaccagacucuguugcaaaagcuacagaugcagaucggcucccaugagcacuuuaacucuuggaaucagggguucauuauccaucacuacgccggaaaagucagcuacgauauggacgguuuuugugaaaggaaccgggaugugcuguucauggaccucauagagcugaugcaaucaagugaacuuccauuuaucaagucccuguucccggagaauuugcaggcagacaaaaagggccgucccaccacagccgggagcaaaauuaagaagcaggcuaacgaucucgucucuacucugaugaaaugcaccccucauuauauccgcuguauuaagccaaacgagaccaaaaagcccagagacugggaagagucaagggugaaacaccagguugaauacuuaggacugaaggagaauauccgggugcgacgcgcgggcuaugcauacagaaggauauuccaaaaguuucuacagcgguaugccauucucacaaaagcuacguggccuaguuggcagggugaagagaagcaagggguacugcaccuuuugcagagcgucaacauggauuccgaccaguuccagcugggccgcucuaaaguguuuaucaaggccccagagucguuguuccugcuugaagagaugagagaaaggaaauacgauggauaugcacguguuauucaaaagagcuggcggaaauuuguggcccgaaagaaguacguccagaugagagaggaggcuuccgaccuguugcucaauaaaaaggaaaggcgccggaacucaaucaauagaaacuucauaggcgauuacaucgggauggaggaacaucccgagcugcagcaguuugugggaaaaagggaaaagauugacuucgccgauacuguaacaaaauaugaccgccgauuuaagggugugaagcgggauuuacugcuaaccccgaaaugccucuaccugaucggccgugagaagguuaaacaagggccugacaagggacuugucaaagagguguugaagagaaagauugaaaucgagaggauacugagugugucucucagcacuaugcaggaugacauuuucauccugcacgaacaggaguaugacuccuuacuggaaucagucuuuaaaacagaguuccuuagcuugcucgcaaagcgcuacgaggagaaaacccagaagcaacugccccuaaaauuuucuaauacgcuggaacucaagcugaagaaagaaaacuggggcccaugguccgcgggugggagucggcagguucaguuccaucaaggcuucggagaucuugcuguguugaagccuagcaauaaagugcugcagguaucuaucggccccggguuaccaaagaacuccagacccaccaggcgaaauacaacucagaacaccggauauucaaguggcacacagaaugccaacuacccuguccgcgcagccccaccgcccccugguuaucaccaaaauggggugauucggaaccaguacguuccauacccccacgcuccuggaagccagagaucgaaccagaaaucccucuauacuucuauggccaggccaccccugccgcgucaacagagcaccucaagugaccgcgugucccagacaccugagucucuugauuuucugaaggucccagaccagggcgcagcuggugugcggagacaaaccacuagcaggcccccucccgccggcgggcgaccaaaaccucagcccaagccaaagccgcagguuccucaguguaaagcguuguacgccuaugaugcucaagacacggaugaacucuccuucaaugcaaacgacaucauugauauaaucaaggaggaccccucaggaugguggacaggccggcugcgcgggaaacagggacuauuuccaaauaacuacgugaccaagauuuga

SEQ ID NO: 59418 - RNA, 3297 nt, Artificial Sequence
  derived and/or modified sequence opt3 from MYO1F__Homo_sapiens__NP_036467
augggcagcaaggagagauuccacuggcagucccauaacgugaaacaaucuggggucgacgauaugguucugcucccccagaucaccgaagacgccauugcugcaaaucuuaggaagcgguuuauggaugacuacauauucacauauaucggaucagugcugauuaguguaaacccuuuuaaacagaugccauacuucacugaucgcgagaucgacuuguaucagggugccgcgcaauacgaaaauccgccccacauuuaugcuuuaacggauaacauguaccgaaauaugcugaucgacugcgagaaccagugugugauaaucagcggcgaauccggggccggaaagaccgucgcagccaaauauauuaugggcuacaucucuaaggugucgggugggggagagaagguucagcaugugaaagauauuauccuacagucaaauccucuccuggaggcuuuuggcaacgcaaagacaguccguaauaacaauagcaguagauucggcaaauacuuugaaauacaauucuccaggggaggagagccagacgguggcaagauuucuaacuuucuucuggagaaaagccgggugguaaugcagaaugaaaacgagcgcaauuuccacaucuauuaccaguugcucgaaggggccucccaggagcaaagacagaaccugggacugaugacucccgauuauuacuauuaccucaaccagucagacaccuaucaaguugauggcacagacgacaggagugauuuuggugaaaccuuaagcgcuaugcaagugauugggaucccuccaucuauccagcagcugguccuucaguugguggccgggauucugcaucuaggcaauauauccuucugcgaggacggcaacuacgcgcggguggaaucagucgaucuccuggcauuucccgccuaccuucuggggaucgacagcggacgcuugcaggagaagcucacuucacgaaagauggauucuagaugggguggcagguccgagagcauuaauguuacacugaacguggaacaggcugccuauacccgggacgcauuagcuaaagggcuguacgcccgucucuucgauuuccuuguagaggcgaucaaucgcgccaugcagaagccucaagaagaguauucgauaggagugcuggacauuuacggcuuugaaaucuuccagaaaaacgguuuugagcaguucuguaucaauuuugucaacgagaaguugcagcaaauuuucaucgaacuaacgcugaaagcagagcaggaagaguaugugcaggaagggauuagauggacuccaauacaguacuuuaauaacaagguugugugcgaucucaucgagaauaaacugucuccgcccggcauuauguccguccuugacgaugugugugcuaccaugcacgccacaggaggcggggcugaccaaacucuguugcagaagcuccaggccgcaguaggaacccacgagcauuucaacucauggagugccgguuuuguuauccaccauuaugcuggcaaggugagcuacgacgucuccggguucugcgaaaggaaucgggaugugcuguuuucugacuuaaucgagcugaugcaaacaagcgaacaggcguuccuacgaaugcucuuuccugagaaacuggauggagacaagaaaggccgcccaucaaccgcagguaguaagauuaaaaagcaggccaacgaucuugucgcuacguugaugagauguacuccccacuacauaaggugcaucaagccuaaugagacaaaacggccacgcgacugggaagagaacagagugaagcaccagguugaauaucuggggcucaaagagaacauuagggugcgucgggccggcuucgcauaccgaagacaauucgccaaguuucugcagagguaugcuauccuuacccccgaaacuuggccgcgcuggcggggagaugagagacagggcguacagcaucuguugagggccgucaauauggagccugaccaauaccagaugggguccacaaaaguguucguuaagaaccccgaaagccucuuucuguuagaggaagugcgcgagcgaaaguucgauggauuugcacggaccauucagaaagcguggcguagacacgucgcugugaggaaguaugaagagaugcgcgaggaagccucuaauauccugcuaaacaaaaaggagcggagaaggaauaguauaaaccgaaauuucguaggugacuaccucggccuggaggaacgcccagaacuucggcaguuuuuggggaaaagagagaggguggauuucgcagacaguguuacgaaguaugaucgucgcuuuaagccuaucaaacgggaccugauucucacccccaagugugucuacgugaucggaagagagaaagugaagaaaggcccagaaaagggucaagucugcgagguucugaaaaagaagguggacauucaggccuuacgaggggugagccuguccacaaggcaggaugacuucuuuauccuucaagaagaugcugccgacucuuucuuggagucgguauuuaaaacugaguucgucagccuccuguguaagcgguucgaagaggcaacccgcagaccccuaccucugacauuuuccgauacucuccaguucagggugaaaaaggaaggcuggggaggcgggggaacccggucaguuacauuuagucgaggcuucggugaccuggcugugcuuaaagucgggggaagaaccuugacugugucuguuggcgauggucugccaaagagcuccaagccgacgcgcaaaggcauggccaaggggaaacccaggcguucaagccaggcgccuacacgggccgcuccagcacccccuagaggaauggacaggaacggcgugccacccucugcccgcgggggaccguuaccucucgagauaauguccggcggugggacccaucgaccacccagaggaccucccaguacuagccugggcgcuucucggaggccacgcgcccguccucccuccgaacacaauaccgaguuucuuaacguaccagaucaggguauggcaggcaugcaaagaaagcggucagucgggcagaggccggugccuggagugggccgccccaaaccacagccccgaacacaugggccuagaugccgggcgcuguaccaguaugucggacaagacguugaugaguugaguuucaaugugaacgaaguaauugagauccucauggaagacccaagcggcugguggaaggguaggcugcacgggcaggagggacuauuucccggcaauuacguggaaaagauuuga

SEQ ID NO: 59419 - RNA, 4851 nt, Artificial Sequence
  derived and/or modified sequence opt3 from MYO3A__Homo_sapiens__XP_011517803
auguucccccugaucggcaagaccauuauauuugacaacuucccugauccaagcgacacaugggagaucacugaaacgauugggaaaggaaccuacgguaagguguuuaaaguccucaauaagaaaaacggccagaaggccgcuguuaagauccuugauccgauucacgacaucgaugaggaaauagaggcagaauauaauauccugaaagccuuguccgaccaucccaacgugguaagauucuacgggauuuauuuuaagaaagauaaggugaauggagacaaauuauggcugguccuagagcucugcucuggcgguucagugacagaucugguuaagggguuccuuaagaggggagagcggaugagugaaccucugaucgcguacauuuugcacgaggcucucaugggccugcaacaucugcacaacaauaaaacuauccaucgcgacgugaagggcaacaauauacucuuaaccacagaagggggagucaaacugguggauuuugguguaagcgcccagcuuaccuccacucgacaccguagaaacacaucuguuggcaccccauucuggauggcacccgaggugauugccugugagcagcaguuggacacgacuuaugaugcuaggugcgacaccuggucgcuggggaucacagcaauugaacuaggagacggcgauccuccacucgccgaccugcaccccaugcgggcucuuuuuaagaucccucgcaauccaccgcccaaacugagacaaccugaguuguggucagccgaguucaacgauuuuaucagcaagugucucacuaaagacuacgagaagaggccaaccgucagugaacuguuacagcauaaguucauuacacagauagaggguaaagaugugaugcugcagaagcaacucaccgaguuuaucgggauucaccagugcaugggaggcacggaaaaagcgcggcgcgagcgaauccauacuaagaaaggcaauuucaacagaccccuuauauccaaucugaaggacguggaugacuuggcaacacuagaaauucuggaugagaacaccgucucugaacagcucgagaaguguuauagcagggaccagaucuacguuuacgugggggauauccugauugcccuuaacccuuuccaaucccugggauuguauucaacuaaacacaguaagcucuacaucgguagcaaacggacagcuucuccaccccacauuuuugccauggcagaccugggcuaucaguccaugauaaccuacaauucagaccagugcaucguaauuagcggggagaguggagcuggcaagacggaaaacgcccauuuacuggugcaacagcuaaccguccucgguaaagcgaauaaccguacacugcaggagaagauccuucaggugaauaacuugguugaagccuucgggaaugcauguacuaucauuaacgauaauucuucccgcuuuggcaaguaucuggagaugaaauucaccagcucgggagcuguggucggcgcccaaauaucugaauaccuccuggagaaguccagagugauccaccaggcuauuggggagaaaaacuuucauaucuucuauuacauuuacgccggacuugcagaaaagaaaaagcuggcccacuauaaguugccggagaauaaaccucccagguaccuccagaacgaccaucugcggacaguacaggauaucaugaauaacucauuuuauaagagucaauacgaauuaauagagcagugcuucaaaguuaucgguuuuacuauggagcagcugggcagcauuuauuccauccuagcugcgauucucaauguggggaacaucgaguucucuagcgucgcaaccgaacaccagauagacaagucacacauuaguaaccauacagcccuggaaaauugugcuucccuuuugugcauccgagccgaugagcugcaagaagcacucaccagccacuguguggucacucgcggagagacgauuaucagaccaaacacaguggagaaagccaccgacguuagggaugcuauggccaagacucuguacggccgguuauuuucuuggauagugaauugcaucaacucacugcuuaaacaugacaguagcccuuccgguaauggggaugaauugucuauuggcauccucgacauuuucggauuugagaacuucaagaaaaauucguucgaacagcugugcaucaacauagcaaaugagcagauucaguauuacuacaaccaacacguauuugcgugggaacagaaugaguaucuaaacgaggaugucgacgcucgcgugaucgaauacgaggauaauuggccccugcucgacauguuccugcagaaaccaaugggccuuuugagccuguuagacgaagaguccagauuucccaaggccaccgaucaaacacucguugaaaaauucgaggggaaccugaagucacaguauuuuuggaggccuaaacguauggagcuuaguuucggaauccaccauuacgcagguaaggugcuguauaaugccucuggcuuuuuggcuaagaaccgggacacccucccaacugauauuguccugcuacugcgaagcuccgacaacucagugaucagacagcucguaaaucacccgcugacaaaaacggggaaccuuccccauagcaagaccaaaaaugugauuaacuaccagaugaggacuucugaaaaguugauaaaucuggccaaaggagauacaggcgaggcaacccgccacgcucgggaaacaacuaacaugaagacccaaacgguugccuccuauuucagauacaguuuaauggaccuccugagcaagauggucgugggucagccucauuuugugagguguaucaaaccaaauucugagcgccaggcgcgaaaguacgauaaagagaagguccuucugcagcuacgguauaccgggauucucgaaacagcccguaucagaaggcugggcuucucccaccgcauuuuguuugcuaacuucaucaaacgguacuaucuguuaugcuacaagucaagugaggaacccagaaugagcccugacacuugugcaaccauacucgagaaggccggacuggauaauugggcucuuggcaaaacaaagguuuuucugaaauauuaccacguggaacaauugaaccucaugaggaaggaggccaucgacaaacugauucuaauccaggcaugcgugcgagcguuccuguguucgcgccgguaucagaagauucaggagaaaagaaaggaauccgccaucauaauucaaucugcugccagggggcaucuuguacguaagcagcgcaaagagaucgucgauaugaagaauacugcagugaccacgauccagacaagcgaccaagaguucgauuacaaaaagaacuuugaaaauacccgggaaucauucguuaaaaagcaggcugagaacgccauuagugcaaaugagagauuuauauccgccccaaacaacaagggaucugugagcgucgugaaaacuuccacauucaagcccgaagaggaaaccacuaaugcuguugagucaaacaauaggguguaccagaccccgaaaaagaugaacaauguauaugaagaggaggucaaacaggaauuuuaccucgugggcccugaggugagcccaaagcaaaagagugucaaagaccuggaagagaacucuaauuugcgaaagguugagaaagaagaggcgaugauccaguccuauuaccagcgguauacagaagaacgcaacugcgaagagagcaaggccgcauaccuggagagaaaagcuauuucggaaaggcccucauauccugugcccugguuagccgagaaugaaacgucuuucaagaagacccucgagccaacucugagucagcgguccaucuaccaaaacgccaauagcauggaaaaagagaagaaaacaucuguagugacccagcgagcuccuauuuguagccaggaggaagguagagggcgccuuaggcacgagacagucaaggaacgucagguggagcccguuacucaagcacaggaagaggaggacaaagccgcgguguuuauccaguccaaguaccggggauauaagagaaggcagcaacugcgcaaagauaagaugucaaguuucaaacaucagcgaauagucaccacgccaacagaaguggcuagaaacacccacaauuuguacagcuauccgacuaagcaugaggaaaucaacaauauuaaaaagaaagacaacaaggauucuaaggccaccuccgagcgggaggcaugcggccucgccaucuuuucaaaacagauuaguaagcugagcgaagaguacuucauccuacaaaagaagcugaaugaaaugauacuuucccagcagcucaaaucucuguauuuggguguuucgcaccacaagccuauuaacaggcgcgugagcucacagcaauguuuauccggcgucugcaagggggaggaacccaaaauccugcguccacccagacggccuaggaagccaaaaacacucaacaaucccgaggacaguacuuacuauuaccugcuucauaagucuauccaggaggaaaaacgccgaccuagaaaggauagccagggaaagcuguuggaccuagaggauuuuuacuauaaagaguuccugccgucccggucaggcccaaaggaacacucucccagccucagggaacgcagaccucagcaagagcugcagaaccaguguauuaaagcuaaugagaggugcugggcagccgaaaguccagagaaggaagaggaacgggagcccgcggcuaacccuuacgacuuccgucgccuuuuacgaaaaaccucccagagaaggcggcugguacaacagagcuga

SEQ ID NO: 59420 - RNA, 3945 nt, Artificial Sequence
  derived and/or modified sequence opt3 from MYO3B__Homo_sapiens__NP_001077084
augaagcaccuguacggccucuuccauuauaaccccaugaugcuugggcuggagagcuugccugacccaaccgauacaugggaaaucauugagacuauaggaaaagguacguacggcaagguguauaaagucaccaauaagagagacggguccuuagccgcuguuaaaauccuggauccggugucugacauggaugaagagauugaagcagaguacaacauccuacaguuucuccccaaucacccuaacguagugaaguucuauggaauguuuuacaaggccgaccauugcgucggcggucaacuguggcuugugcuggaguuguguaaugggggaucaguuacagaacucgugaaaggccugcugaggugcggccagcggcucgaugaggcgaugauuaguuauaucuuauacggggcucugcuuggauugcagcaucugcacaacaaucgcauaauccaccgagacgucaaggguaacaauauucuacucacuaccgaaggcggggugaaacugguagauuucggaguuagcgcccagcuuacauccacccgucugagaaggaacacuucugugggcacaccauuuuggauggcacccgaggucaucgccugugagcaacaguacgacucgucauaugaugcucggugcgacguguggagcuuggguauuaccgcaaucgaacucggggauggagacccuccacuguucgacaugcaccccgugaagacguuauuuaaaauaccucgcaauccaccgcccacucugcuccauccugagaaguggugugaagaguucaaccacuuuauuagucagugccuuaucaaggauuucgaaagaaggccauccgucacccaucuguuggaccaccccuuuauuaaaggcguucacggcaaggugcuauuccugcagaaacaacucgccaagguacugcaggaucagaaacaucagaauccuguggcuaagacacggcacgagcgcaugcauacucgaagaccauaccacgucgaggacgccgaaaaauauugucuugaggaugaccuggugaacuuggaaguucucgaugaggacaccaucauccaucaacugcagaagagguacgcggauuuacugauuuauacauacgugggggacauacuaaucgcacucaaucccuuucagaaccugucuauuuauagcccgcaauucucccggcuuuaccacggagucaagcgugccucaaacccuccccacaucuucgcuagugccgaugcagcuuaccagugcauggugaccuugagcaaagaccaguguauaguaauuucuggugaauccggcucagggaagacggagagcgcccaucugaucguucagcaccucacuuuucugggaaaagcgaauaaccaaacacuucgcgagaagaucuuacaggugaauaguuuggucgaagccuucggcaacucuugcaccgcaauuaaugacaacuccagcagauuugguaaauaucucgagaugauguucacuccaacagggguggucaugggcgcuaggaucucggaauaccuguuagagaagucucgggugauuaagcaggccgcucgagagaaaaauuuucauauauucuauuacaucuaugccggacugcaccaccagaagaaacuauccgauuuucgccucccugaggagaagcccccaagauacauugcagacgaaaccggcaggguuaugcaugauaucacgucaaaagagaguuaucggcgccaauucgaagccauccagcacuguuuuagaauuauaggguucaccgacaaggaggugcauagcguauacaggauccuggcugguauucuuaacaucggaaauauugaguuugcggcaaucuccucucagcaccagacagauaagagcgaaguccccaacgccgaggcuuugcaaaaugccgcaucagugcugugcauaaguccugaagaacuccaggaagcccugacuucccauugcguugugacccguggcgagacaaucauucgggcuaacacugucgaccgagccgcagaugugagagacgcgaugagcaaagcucuguacgggaggcuguucucuuggaucguaaaucgcauuaacacccuuuugcagccagaugagaauaucuguucagccggaggcgguaugaacguggggauacucgacauuuuuggcuucgaaaacuuccagcggaauaguuuugagcaacugugcaucaacauugcaaaugaacagauccaguauuacuucaaccaacacguuuuugcccuagagcagauggaauaucagaaugagggaauagaugcugucccgguggaguacgaagacaacagaccccugcucgauauguuccugcagaagccucuuggcuugcuggccuuacucgacgaggaaagcagguuuccacaagcaacagaccagacccugguggauaaauucgaggacaaucuucgcuguaaguauuuuuggcgacccaaaggggucgaacugugcuucggaauccagcacuacgcugguaagguuuuguaugaugccuccggcgugcucgagaagaaccgggacacucugccugcggaugugguagucgugcuacguacgucugagaauaaacugcuccagcaacuguuuucgauuccacuuacaaagaccgggaacuuggcccagacuagagcuaggaucaccguugcaagcuccucacugcccccgcauuucagugccggaaaagcuaagguggacacauuagaagucauucgccacccugaggaaaccacuaauaugaaacggcagacaguggccucuuacuuuagauacagccucauggaucugcuuuccaagaugguugugggccagccacauuucguaagguguaucaaacccaacgacgaucgagaggcacugcaauuuucacgcgagcggguccuagcgcagcucagaagcacggguauacuggaaaccgugucuauuaggcgucagggguauucccaccgcaucuuguucgaggaguucgugaagcgguacuauuaccuggccuuuacugcucaucaaacaccuuuagccaguaaggaaagcugcgucgcaauccucgaaaaaucuagacuggaccacuggguucuuggcaagaccaaaguguuccugaaguauuaccacguagagcaguugaaucuccugcuaagggaggugauuggacgagucgugguucugcaggcuuauacaaaaggcuggcuuggggcccggcgcuacaagagagugagggaaaagcgggagaaaggagcaaucgccauucaguccggcgauacuucaaaccaaaguagcgguccccauucgccagucgcugcggggacccgaggauccgccgaagugcaggacuguucugagccuggcgaucacaagguucucagagguagcgugcaucgcaggucacacagucaggcagaauccaauaacggccguacgcagaccucuagcaacucccccgcugucacagagaaaaaugggcacucacaagcccagagcaguccaaagggaugcgacauauuugccggccaugcuaacaaacacucuguauccgggacugaccuguugagcucgcggaucugucauccggcaccugaucagcagggacugucauuauggggcgcgccccaaaagccagguucugagaaugggcucgcccagaagcacagaacccccaggcgccgaugccagcagccuaaaaugcugaguuccccagaagacacaauguacuauaaccaacuuaauggaacucuggaguaccagggcagcaagagaaaaccccggaaguugggucagauuaaagugcucgauggcgaagacgaguauuacaagucucugagcccuguugauuguaucccggaagagaacaauuccgcucauccaucauucuuuaguucuagcuccaagggggacucauucgcccaacacuga

SEQ ID NO: 59421 - RNA, 5568 nt, Artificial Sequence
  derived and/or modified sequence opt3 from MYO5A__Homo_sapiens__NP_000250
auggccgcuagcgagcuguacaccaaguucgcaagaguguggauccccgacccugaagaggucuggaaauccgccgaacuccuuaaggauuauaaaccaggcgacaagguucuguuguuacaccuggaggaagggaaagaucuagaguaccaucucgacccgaagacaaaggagcugccccaccuuaggaacccugauauucuggugggagaaaaugacuugacugcgcucucuuaucugcaugagccagcuguacugcacaaccuccgggugcgcuuuauagauucaaaauuaaucuacacguauugcgguauuguccugguggccaucaaucccuacgaacagcuuccuauuuauggcgaggacaucauaaacgcauacagugggcaaaauaugggagauauggacccacauaucuucgccguugcugaggaagcauacaagcagauggcccgagaugagcguaaccagagcauuaucguguccggcgaaucuggugcugggaaaaccgucucggccaaguaugcgaugagauacuuugcaacagugucaggaagcgccagugaggcuaauguagaagagaaaguuuuggccuccaaccccauuauggagucuaucggcaaugcaaagacuaccaggaacgacaauagcucccgguucggcaaguauauagaaauuggguuugauaaacgcuacagaaucauuggagcuaacaugaggacauaucugcuagagaagucacggguggucuuccaggccgaagaggaacgcaauuaccacaucuuuuaucaacucugugcgagugccaaacugccugaguucaagaugcuucgacuggguaacgcagacaauuuuaacuacaccaaacagggcgggagcccagugaucgagggaguggacgaugcuaaggaaauggcccacacuagacaggcuugcacauugcucggcauuucugagucccaucagauggguauauucaggauccuggccgggauuuuacaccugggaaacgucggcuuuaccucacgggacgcagauagcuguacgaucccgcccaaacaugaaccucucugcauauucugugaccuuaugggcguugauuacgaggaaaugugccacuggcugugucaccguaaguuggccacugcuaccgagacauauauuaagccaaucaguaaacuacaagcgacuaaugcacgcgacgcccuggcuaagcauaucuacgccaaacucuuuaacuggauuguggauaauguaaaccaggcacugcacucugccgugaagcagcauuccuucaucgggguccuugacauuuauggauucgagaccuuugaaauaaauagcuucgagcaguuuugcaucaacuacgcuaaugaaaaacugcaacagcaguucaacaugcacguguuuaaguuggagcaagaggaauauaugaaggagcagauucccuggacacucaucgauuucuacgacaaucagccuuguaucaaccugauugaaucgaaauuagguauacuggaucuacucgacgaggaaugcaagaugccaaaaggcaccgacgauacgugggcccagaagcuguauaauacucaucuuaacaaaugugcauuguuugagaagcccagacugucuaauaaggcguucaucauucaacacuuugcugacaaaguugaguaccagugcgaaggguuccucgagaagaacaaagauacaguguuugaagagcagaucaagguccugaaauccucaaaguucaagaugcuuccggaacuguuucaggacgaugagaaagccauuaguccuaccagcgcaacuuccucuggaaggacacccuugacccggacgccagccaagccuaccaaaggccgacccggucaaauggcuaaggagcacaaaaagacaguggggcaucaguuccgcaauagccuccaccuguuaauggaaacucugaacgccaccacaccacauuacguaagaugcaucaaacccaacgacuucaaguuuccuuucacuuuugaugagaagagggcaguucagcagcuacgggcuuguggcgugcucgaaaccauacgcaucucagccgcgggauucccaaguagauggacauaucaagaguuuuucuccagguaccguguccugaugaaacagaaggacgugcuuagcgaucggaaacagaccugcaagaaugucuuggaaaaacugauucucgacaaggauaaguaucaguuuggcaaaacuaagaucuucuuucgagccgggcaaguggcuuaccuggagaaauuaagagcagacaagcugagggccgcuuguauucgcauccagaaaacgauacggggauggcuuuugagaaagaaguaucucaggaugcgcaaagccgcaauuacaaugcagcgauacguucgggguuaucaagcgcguugcuacgccaaguuccugagaaggaccaaagcugccacuaucauucagaaguacuggcgcauguaugugguacggagaagguacaaaauccgacgcgcagcuaccauaguccuacagucuuaucugcggggcuuucucgccagaaacagguaccguaagauccugcgcgagcacaaggcagugauuauccagaaacggguuagaggguggcuugccaggacacacuauaagcgaucaaugcaugcuauuaucuacuugcaauguugcuuccggcgcaugauggcgaaaagagaacugaagaaauuaaagauagaggccaggaguguggaacgguauaaaaagcuccacauuggaauggagaauaagaucaugcagcugcagcgaaaagucgaugagcagaacaaggacuacaaaugucuuguggaaaagcugaccaauuuggagggcaucuacaacagcgaaacugagaaacucagauccgaccuggaacgccuacaacugucugaggaggaagcaaagguagcuacagguagggugcucucgcugcaggaggaaauugccaagcuucguaaagauuuggagcagacgcggagcgaaaagaaaugcaucgaggagcaugccgacagauauaagcaggaaaccgagcaacugguuuccaauuuaaaagaagagaacacucuccugaagcaggaaaaggaggcucuuaaucacaggauuguccagcaagcaaaagagaugacagaaaccauggagaagaaacugguggaagagacaaagcagcuagagcucgaucugaacgacgaacgcuugcgauaccagaaucuguuaaacgaguuuucaagacucgaagagcgguaugaugaccugaaagaagagaugacucuuauggugcaugucccgaagcccgggcacaagaggaccgauaguacgcacucuagcaaugaguccgaauacauauucucaagcgagaucgccgaaauggaggacauuccuucucgcaccgaagagccauccgagaaaaagguuccccuggauaugaguuuguuccucaaacugcagaagcgugugacagaacuagagcaagaaaaacaggugaugcaggacgagcuggauagaaaggaagagcagguacuucggagcaaggcgaaagaggaagagaggccucaaauccgcggcgcugaacucgaguaugagucucugaagcgacaggaauuggaguccgaaaacaaaaagcugaaaaaugaguuaaacgaacucagaaaggcccugucagagaaaagugcaccagaggucacugcccccggagcuccggcauaccgggugcuuauggaacagcugaccagcguuucggaggaauuggacgugaggaaggaggaaguccucauucugcgcucccagcuagugucucaaaaggaggccauccagccuaaagaugacaagaacacaaugacugacagcaccauacugcuugaggauguucagaaaaugaaggacaaaggcgaaaucgcgcaggcuuauauugggcucaaggagacgaauagaucaagugcccuggauuaccaugaauugaacgaggacggagaauuauggcugguguacgagggucucaagcaagcaaauaggcugcuugagucccagcugcagucucaaaaacggagccacgaaaacgaggccgaagcuuugcguggcgagauccagucccuaaaggaggaaaauaaccgccagcagcaacugcucgcccagaaucugcagcuuccacccgaggcacgaauugaagcuucauuacagcaugagaucacaagacugaccaacgaaaaucucgauuugauggagcaacuggagaaacaggacaagacuguaaggaaacucaagaagcagcugaaagucuuugccaagaaaauaggggaacuugaggugggacagauggaaaacauuagcccuggccaaaucaucgaugagcccauucggccagugaauauaccucgcaaggaaaaagacuuccaggguaugcuggaguauaagaaggaggaugaacagaaauuggucaagaaccuaauccuggagcucaaacccagagggguugcggugaauuuaauuccaggccugccggccuacauccuuuuuauguguguaaggcacgcagacuaucugaacgaugaccaaaaggugcggagucucuugacaucuaccauuaauuccaucaaaaagguccugaaaaagcgaggagacgauuucgaaacugugagcuuuuggcucucgaacaccugcagauuccugcauugucuuaagcaguacucaggcgaggaaggguuuaugaaacacaacacaucucgccagaaugagcacugccuaacgaacuucgaccuggcugaguauaggcagguuuugagugauuuagccauacaaaucuaccagcagcuggugcggguccucgaaaauauucugcagccuaugaucguguccggaaugcuugagcaugaaaccauucaaggcguuagcggugugaagcccacugggcugcguaaaagaacaucuagcaucgcugacgagggaaccuauacacucgauuccauauugaggcagcugaacucauuucacagugucaugugccagcauggcauggacccagagcuaauuaagcagguagugaaacaaauguucuacaucaucggugcaauuacucugaauaaccuccuucugcgcaaggauauguguagcuggucuaagggcaugcagauccgguacaauguuucccaguuagaagagugguugcgagacaaaaaccugaugaauucaggggccaaggaaacccucgagccccugauacaggccgcucaacuucugcaggugaaaaagaaaacggaugacgaugcggaagcaauuugcaguauguguaacgcccucacaaccgcucagaucgucaagguguugaaucuguauacuccuguaaacgaguuugaggaaagagugagcgucuccuucauuaggaccauccaaaugcgcuuacgggacagaaaggauucuccacagcuacugauggacgccaaacacauauuccccguuacauuuccuuucaauccgucgagccucgcacuugagacuauucagaucccagccucacugggauugggcuuuaucucccguguguga

SEQ ID NO: 59422 - RNA, 5547 nt, Artificial Sequence
  derived and/or modified sequence opt3 from MYO5B__Homo_sapiens__NP_001073936
augagcgugggcgaacuguacucccagugcaccagagucuggauccccgauccugaugaaguuuggaggucugccgagcucacaaaggauuauaaagaaggggauaagucacuucagcugcgguuggaggacgaaacuauuuuagaguacccaauagaugugcagcgcaaccagcugccguucuuacgaaaucccgacauccucguaggagagaacgaucugacggcucuuaguuaucugcacgaaccugcaguguugcauaaucucaaaguccguuuucuggagagcaaccacauuuacaccuauugugguaucgugcugguugccauuaauccauacgaacagcuccccaucuauggccaggacgugauauacacauacuccgggcagaacaugggagauauggacccucauaucuucgcggucgcugaggaggccuauaagcagauggcaagagaugagaagaaucagucuauuaucgugucgggcgagucaggugccgggaagacuguaagcgcuaaguacgcaaugagguauuuugccaccguuggaggcagugcuuccgaaacaaacauugaggaaaaaguguuagccucuagcccaaucauggaggcgauaggcaaugcaaagaccacucggaacgacaauuccucacgcuucgggaaauacauucagaucggauuugauaagagauaucacauuaucggugccaacaugaggacauaccugcuugagaaaagucgggucguguuccaggcugacgacgaacgcaauuaucauaucuuuuaccaguugugcgccgcagcuggccugcccgaguucaaggaacuggcccucaccagcgcggaggacuuuuucuacacgucucaagggggagacacuuccauugaaggcguggaugacgccgaggauuuugagaagacccgacaagcauucacacugcuuggugucaaagaaucacaccagaugagcauauuuaagaucauugcuaguauccugcacuuggggucuguugccauacaggcugagagagacggagauuccuguagcauuucgccucaagacguguaucucucuaacuucugcaggcuguuaggcguagaacauucccagauggagcacuggcugugucaucggaaacucgugacuaccucagaaacauacgucaagaccaugagucuucaacaggugaucaaugcccguaacgcacuggccaaacacaucuaugcucaauuguucggcuggauuguugagcacaucaacaaggcgcuacauacgagccugaaacagcacuccuuuauuggggugcucgauauauacggauucgagacuuuugaagucaauucuuucgagcaguuuugcaucaacuaugcaaaugaaaagcugcagcaacaguucaacagccauguguuuaaacuugagcaggaggaauacaugaaagagcagauuccauggacacugaucgacuucuaugauaaucaaccguguaucgacuugauugaagccaagcucgguauacuggacuuacuggaugaggaaugcaaaguacccaagggcaccgaccagaacugggcucagaaacuauacgaucgccacucaaguucccagcauuuucaaaagccuagaaugagcaauacugccuucaucauuguucacuuugcagacaagguggaguaccucucugauggguuccuggagaaaaacagggacacagucuaugaagaacagaucaauauucuuaaggccucaaaauuuccauugguggcugaucuguuccacgacgauaaggaccccgucccugccaccacgccaggaaaaggcaguagcuccaagaucucugugcggucggcacgacccccgaugaagguuagcaacaaagaacauaagaaaaccgugggucaccaguuccgcacaucccuccaucugcuuauggagacucugaaugcgaccacaccucacuacguaagauguauaaagcccaacgaugaaaaauugccauuucacuucgacccuaagagggcuguccaacagcuccgggccugcggggugcuggagacuauccgcauuucagcagccggcuaucccaguagaugggcuuaccaugacuuuuucaauagguaucguguuuuagugaagaaacgggagcuggccaacaccgacaagaaagcaaucugucgaucuguccuagaaaaucucauuaaggacccagauaaauuucaguucggaagaacaaagaucuuuuucagggcuggccagguggccuaccuggagaaacuucgcgcggacaaguuucggaccgccacuauaaugauucaaaagacgguaagagggugguugcagaaagugaaguaucacaggcugaaaggagcuacacucacccugcagcgcuacugccgaggucauuuagcacggcgucuggccgaacaccuuagaaggauccgcgcugccguugucuugcagaagcauuaccggaugcaaagagcaaggcaggcguaucagcgagugcgccgggccgcuguggucauucaggccuucacuagagcaauguuuguuaggcguaccuaccgccaagugcucauggagcacaaagcuacaaccauccagaagcacgugcggggcuggauggccagaaggcauuuccagcgacugcgggaugcagccauaguaauccaaugcgcuuuucgcaugcuaaaggcgagaagggaacugaaagcccuccggauugaggcacgaagcgcugagcaccugaagagacuuaacgucgggauggaaaacaaagugguucaguugcagcgcaagaucgacgagcagaauaaagaguucaagacucuguccgagcaauuaucagugacaacgagcaccuauacuauggaggucgaaaggcucaagaaagagcuggugcauuaccagcagucucccggagaagauacaucccuucgucugcaggaggaaguugagaguuugcggaccgagcuccaaagagcccacagcgaaaggaagauucuggaggacgcccauucucgcgaaaaagaugagcuacgaaagagaguggcugaccuggaacaggagaacgcacuccugaaagaugagaaggaacagcuuaauaaccagaucuugugucaauccaaggacgaguucgcccaaaauucaguaaaagaaaaccugaugaagaaagaguuagaagaggagcggaguagguaucagaaucucgucaaggaauacagccagcuggagcaacgcuaugauaaccuucgugacgaaaugacaauaauuaaacagacuccuggccacagacggaauccaucgaaccaguccucucuggagagcgauucaaauuacccgaguaucuccaccucugagaucggugacacggaagacgcgcuacaacagguggaggaaauugggcucgagaaggcugccauggauaugaccguguuucugaaauugcagaagaggguccgcgaacuggagcaggagcgaaagaaauuacaaguucagcucgaaaagagagagcagcaggacagcaaaaaggugcaagcagaacccccucagacagauaucgaccuggauccaaacgccgaccuugcuuacaauucccugaaacggcaggaguuggaaucagagaacaagaagcucaaaaaugaucugaacgagcuaaggaaggcaguagccgaccaggcgacucaaaacaauagcagucacggcucucccgauuccuauagccugcuucucaaccagcugaaauuggcucaugaagaacuggaagugcgcaaggaggaagucuuaauucucagaacccagauagugucggccgaccaaaggcggcuggcaggacguaaugccgagccuaacaucaaugcucgcucaucuuggccaaacagugagaaacacguugaucaggaagacgccauugaggcauaccauggcgugugccagacaaauuccaagacugaagacuggggguaucuuaacgaggauggagagcuggguuuggcuuaccagggccucaagcaagucgcccgacugcuagaagcgcagcugcaggcccagagccuugagcacgaagaggaaguggagcaccucaaagcacaacuggaggcuuugaaggaagagauggacaaacagcagcagaccuucugucaaacguuacugcucucucccgaagcccagguugaguuuggggugcagcaggaaaucagcagacugacaaaugagaaccuugaucugaaggaguuggucgaaaaacuagagaagaaugaaaggaagcugaaaaagcaacucaaaauuuauaugaagaaagcucaggaccuggaggcagcccaggcccuugcucaauccgaacggaagcgccaugaguuaaacagacagguaaccgugcagaggaaggagaaagauuuccagggaaugcuggaauaccacaaggaggacgaagcgcucuugauccggaaucugguuacugaucucaaaccgcaaaugcugucaggcacagugccuugccuuccagcauauauacuguacauguguauccgacaugccgacuacaccaacgaugacuugaagguccacagucuacugacuagcaccauuaaugguaucaaaaaggugcucaaaaagcauaacgaugacuuugagaugacaucuuucugguuauccaacacgugcagacugcuucacugucugaagcaguauucaggggaugagggcuuuaugacccagaauacugcuaaacagaacgaacacugccucaagaauuucgacuugacagaguaccgccaaguacugagugaccucagcauucagaucuaucagcagcugauaaaaauugccgaaggagugcuucaacccaugaucgucuccgcaaugcuagagaacgaaucuauccagggccugucggggguuaagccuaccggauacaggaaacggagcucauccauggccgauggcgacaauaguuauuguuuggaggcuauuauacgucagaugaacgcguuucauacagugaugugcgaucaagguuuagaccccgagaucauucuacagguguucaagcagcucuuuuacaugaucaaugccgucacucugaacaaucuucugcucagaaaggauguguguucuuggagcaccgggaugcaguugagguauaacauuucccaacuggaagaguggcuacgcggacggaaucugcaccagucaggcgcaguucagacgauggaaccacucauccaggcugcccaacuucugcaguugaaaaagaaaacacaggaggacgcagaagccauaugcucucuaugcaccagccugaguacucagcaaaucguaaagauucucaaccuguacaccccucuuaaugaguucgaggaacgagugacagucgcuuucaucagaacuauucaggcccagcugcaagagaggaacgauccccagcagcucuugcuggacgcgaaacauauguuuccaguguuauucccguuuaauccuuccagccuaaccauggauucuauccacauacccgcaugucugaaccucgaguuccuuaaugagguuuga

SEQ ID NO: 59423 - RNA, 5229 nt, Artificial Sequence
  derived and/or modified sequence opt3 from MYO5C__Homo_sapiens__NP_061198
auggccguggcugaacuguacacccaguauaacagagucuggauccccgacccugaagaaguuuggaaaagcgcagaaauugccaaagauuacagggugggcgacaagguucuccggcuucuguuggaagaugggaccgaauuagacuauuccgugaauccagaaucucugccgccccuacgcaacccugauauacucgucggagagaaugaccugacugcgcuuucauaccugcacgaaccagcuguguugcauaaccuccgaauccguuucgccgaaaguaaacugauuuauacguacagcgguaucauucugguugcaaugaaucccuauaagcaacucccuaucuacggcgaugccauaauccacgcuuacuccgggcagaacaugggagacauggauccacauauuuuugcaguggccgaagaggcuuauaaacagauggccagaaauaacaggaaucagucuaucauugucucgggcgagucaggugcggggaagaccgugagcgcacgguacgccaugcgcuauuucgcuacaguaaguaaguccggaucuaacgcccacguugaagacaaaguguuagcaagcaaucccaucacugaggcugucggcaacgccaagaccacaagaaaugauaacuccucaagguuuggcaaauacaccgaaauaaguuucgacgagcaaaaucagauuaucggggcgaacaugagcacuuaucugcuugaaaagucucgggugguguuucaguccgagaacgagcgcaauuaccauauuuucuaucaguugugcgccucagcacaacagagcgaauuuaaacaccugaagcuaggaagugcugaggaguucaacuacacacgaauggguggcaauaccgucaucgaggggguuaacgauagagccgaaaugguggagacgcagaagacuuuuacccuccugggauucaaagaggacuuucagauggacguauucaagauccuugcugccauucugcacuugggcaaugugcaaauaacagcagucgguaacgaaaggucuuccgugagcgaggaugacucgcaucucaaaguauuuugugaacuguuagggcuggagucuggacggguggcccaguggcucugcaaucguaagaucgucacuuccucagaaaccgugguaaaaccuaugacacgcccacaggcuguuaacgcgagagaugcacuugccaagaaaauuuacgcucaccuguucgacuucaucguggagaggauaaaucaagccuugcaguuuaguggcaagcagcauaccuucauuggcguccuagauaucuauggguuugagacguucgacgugaacagcuuugaacaguucuguaucaauuacgcaaacgagaagcugcaacagcaguuuaauaugcacgucuucaaacucgaacaggaggaguauaugaaggaagauauuccguggacucugaucgacuuuuacgauaaccaacccgugauugaccuuauagaggccaaaaugggaauccuggaauugcucgaugaggaaugccuguuaccucacgguacagacgagaauuggcugcagaagcuauauaacaacuucguuaaucggaacccacucuuugagaaaccccgaauguccaauaccucuuucgugauucagcauuuugcugacaagguagaauacaagugugagggcuuccuggagaagaaucgcgauacugucuaugacaugcuuguggagaucuugagagccagcaaguuccaccugugcgcaaacuuuuuccaggaaaacccuacaccacccucaccguuugggaguaugaucaccguuaaauccgcgaagcaagugauuaaaccuaauagcaagcauuucaggacgaccgucggaucuaaguuucggucaagucucuaccugcuuauggagacacugaacgcuacuacaccccacuacgugcgcuguauaaaaccaaaugaugagaaguugccuuucgaauuugacagcaaaagaaucguacagcagcucagggccugcggcgugcuggagacaauucguaucuccgcacagucuuaucccucgcgguggacuuacauugaguucuauagccgauacgguaucuuaaugaccaagcaagagcuguccuuuucagauaaaaaggaaguuuguaaggucgugcuacauagacucauacaggacaguaaccaguaucaauucgggaaaacaaagaucuuuuucagggccggccagguggcuuaccuggagaaacuucgcuuggauaagcugcggcagucuugcgucaugguucagaaacacaugagaggauggcuccaaaggaagaaauuucugcgcgagcgacgggccgcauuaauuauccagcaguauuuccguggccagcaaaccgugagaaaggcuauuacugccguggcgcugaaggaagccugggcugcaaucauaauucagaaacacuguaggggguaccuuguacgcagcuuguaccagcucauccggauggccacgauuacaaugcaggcuuauuccagaggauuccuggccaggcgacgcuaccggaagaugcuagaggaacauaaagcagucauccugcaaaaguaugcgagagccuggcucgcuaggcgucgcuuucagucaauacggagauucgugcugaauauccagcuuaccuacaggguucaacgauugcagaaaaagcuggaggaccagaacaaggagaaucacgguuuaguggaaaaacucacuagccuggccgcacuucgggcuggcgaugucgagaagauucagaaacuggaagccgaguuggaaaaggcagccacccaucgcagaaacuaugaggagaaagggaagagguaccgggacgcuguggaagagaagcucgcgaaacugcaaaagcacaauucugaacuagagacacagaaagaacagauccagcugaagcuccaagagaaaaccgaggaacugaaggagaagauggauaaccuuacuaaacaguuguuugacgauguucagaaggaagaacgacagagaaugcuguuagaaaaauccuucgagcucaagacacaagacuaugagaaacagauucagagucugaaggaagagaucaaagcccuuaaggacgaaaagaugcagcugcaacaccuaguggagggagagcauguaacgagcgauggccucaaagcagaagucgcucgccugucuaaacaggugaagaccauauccgaguuugaaaaggagauugaauugcugcaggcccagaaaaucgacguggagaagcacguccagucacagaagagggagaugcgugagaaaaugagugagaucacuaagcaguuacucgaaagcuacgauauugaggacguucggucgagacuguccguggaagaucuugagcaucugaacgaggacggugaauugugguucgccuacgaggggcucaaaaaggcuacaaggguacuggaaucucacuuucaaagccagaaagauugcuaugagaaggaaaucgaggcacuaaauuucaaggugguccaucugucacaggagauuaaccaccuucagaaacucuuucgcgaagagaaugacauaaacgaaaguauccgacacgaggugaccagacugacauccgagaauaugaugauuccagauuucaagcaacagaucucugaauuggagaaacagaagcaggaccuggaaauucgguuaaacgagcaagccgagaaaaugaagggcaagcucgaggagcugagcaaucagcuucauaggucccaggaagaggaaggaacucaacgcaaagcgcuggaggcucagaacgaaauccacaccaaggagaaagagaaguugauagauaaaauccaggaaaugcaggaggccucagaccaucucaagaagcaauuugaaacggagagcgaaguuaaaugcaauuuccgucaggaggcaaguagacugacccuagagaaccgggaucuggaagaggaacuugacaugaaggacagggugauuaaaaagcuccaggaucaggucaaaacacugucuaagacuaucggcaaagccaaugacgugcacuccagcucggggcccaaggaguacuugggaauguuacaauauaagcgcgaggaugaagcuaaacugauucagaaccucauccuggaccuuaagccucgagguguuguggucaauaugauaccaggccugccggcacauauuuuguucauguguguaagauacgccgauucacuaaacgacgcgaauaugcugaaaucucucaugaacaguaccaucaacgggaucaagcaagugguuaaagagcaccuggaagauuuugagaugcuuuccuucugguuaagcaauacaugccacuuucugaacugucucaagcaguauucuggagaagaggaguucaugaagcauaauagcccccaacagaacaaaaauugcuugaacaauuuugaccuguccgaauaccggcagauucucucagauguggcuauaaggaucuaucaccaguucauuaucauuauggagaagaacauccaaccuauaaucgucccaggcaugcuggaauacgagagucuucaggguauuagcgggcugaaacccacuggcuuucgcaagagaucuuccucaaucgacgauaccgacggauacacgaugacaaguguguugcagcaacuaagcuauuucuacaccacuaugugucagaauggccuggacccugaacucguaaggcaggccgugaaacaguuauuuuuccugauuggggcagucacacuuaacucccuguuucuccggaaggauaugugcucuugucguaagggaaugcaaauccgcugcaauauaucguauuuggaggaguggcugaaagacaagaaccuccagaauagccuggccaaagaaacccuugagccacuaucacaggcugccuggcuguugcagguuaagaaaacuaccgauuccgacgcaaaggaaauuuacgagcgauguacaaguuuaucugcugugcaaaucaucaagauucugaacagcuauacgcccaucgaugacuucgagaaaagagugaccccguccuuugucaggaaggugcaggcccuccuuaauucacgggaggauucuagccagcugaugcuggacacuaaauaccucuuccagguuacauucccuuuuaccccaaguccccaugcguuggagaugauacaaauuccuuccagcuucaagcugggcuuucuaaaccgccuguga

SEQ ID NO: 59424 - RNA, 3789 nt, Artificial Sequence
  derived and/or modified sequence opt3 from MYO6__Homo_sapiens__NP_001287828
auggaggacggcaagcccgugugggccccucacccaaccgauggguuccagaugggaaacaucgucgacauugguccggauagccugacaauagaaccccucaaucaaaaaggcaagacuuuucuugcucugaucaaccagguuuucccugcagaggaagacuccaaaaaggauguggaggacaauugcucuuugauguacuuaaacgaagccacgcugcuacauaauauuaaaguaagauauucaaaggauaggaucuacaccuauguggcgaacauucucaucgcugucaauccauacuuugacauacccaagaucuauaguagcgaggccauuaaauccuaccaggggaagucucugggaacacggccuccacacguguucgcaaucgccgauaaggcuuuucgcgacaugaagguucuuaaaaugucgcagucaauuaucgugagcggcgagaguggugcagggaagacugaaaacaccaaguucguccugcgauauuugacagaguccuacggaaccggccaagauauagacgaucguauuguggaagccaauccccuccuggaggcuuuuggcaacgccaaaacuguaagaaauaacaauucuagcagguucgggaaguuuguugagauccauuucaacgaaaaauccucaguggucggagguuuugugagucacuaccugcucgaaaagagccggauuugugugcagggcaaagaagaacgcaauuaucauaucuucuacagauuaugcgcgggggcaucugaagacaucagggagaagcugcaccuuuccucaccugacaacuuucgguauuugaaccgcggauguacacgauacuucgccaauaaagagaccgauaagcagauucugcagaacagaaagagcccagaauaucuaaaagcuggcaguaugaaggacccgcuccuggaugaccacggugauuucauaaggaugugcacggccaugaaaaagaucgggcuugacgaugaggaaaaacuggacuuguuucgggucguugcaggagugcuccaucugggcaauauugauuucgaggaagcuggcucuacuuccgggggauguaacuuaaagaauaagagcgcccaaucgcuggaguacugcgcggagcuccuuggucuggaccaggaugacuugcguguaucucuaaccacacgcgugaugcugacuaccgccggcgggacaaaaggaaccgucaucaaggugccccucaaaguugaacaggcaaacaaugcuagagacgcccuggcuaagacgguguauucccaccuuuuugaucaugucgugaacaggguaaaucaguguuucccuuuugagacuucaaguuacuucauaggcguucuggacauugccgguuuugaauacuucgagcacaacagcuuugaacaauucugcaucaauuauuguaacgagaaauugcagcaguuuuucaaugagcggauccucaaggaggagcaagaacuguaccagaaggagggguuaggcgugaacgagguccacuauguggauaaucaggacugcauugaucugaucgaagcaaagcuagucggaauuuuagacauacuggaugaggaaaaccgacuuccacagcccuccgaccaacauuuuacaucugccgugcaccagaaacauaaagaucacuuccgcuugaccaucccuagaaagagcaaacuggcuguucauaggaacauucgggacgaugagggcuucaucauccgccacuuugcgggggcaguguguuacgaaacuacacaguucguagagaagaauaacgacgcccuccacaugucacuggagagucuuauuugcgaauccagagauaaguuuauaagggagcuguucgaaagcucuaccaauaacaauaaagacacgaagcagaaagcuggaaaguugucauuuaucagugucgguaacaaauucaagacccaacucaaucuguuacuggacaaacuacguagcacaggcgccuccuuuauucggugcaucaagccaaaccucaagaugacuucucaucacuucgagggggcacagauucugucgcagcuucaguguagcggaaugguguccguuuuggaucugaugcaaggcgguuaucccucacgagccaguuuucaugaacucuacaauauguauaaaaaguacaugccggacaaacuggcuagauuagauccuaggcuguucugcaaggcccuuuuuaaagcauuggggcucaacgagaaugacuacaaguucggccugaccaagguguuuuuccgccccggaaaauucgcggaguuugaucagaucaugaagucugacccagaucaccuagcugaacuggucaaacgggugaaccacuggcucacauguagcagauggaagaaaguacaguggugcucccugucagugauaaaacuuaagaauaaaaucaaguauagggccgaggcauguauuaaaaugcagaagacuauccgcaugugguugugcaaacgacggcauaagccucguauugacggccugguuaaggucgggacccucaaaaagagacucgauaaauucaacgaaguggugagcguccugaaggacggaaaacccgagaugaauaagcaaaucaaaaaccuugaaauaucuauugauacacugauggccaagaucaaguccaccaugaugacucaggagcagauucaaaaagaguacgacgcuuugguuaagaguagcgaggagcuccugucugcccuacagaaaaagaaacagcaggaagaggaggcagaaaggcugcgccggauccaagaggaaauggagaaggaaagaaagaggcgagaggaggaugaaaaacgccggagaaaggaggaagaggaaaggcguaugaaacucgagauggaggcuaagcgcaaacaggaagaggaggaacggaagaagagagaagacgacgagaaaaggauacaggccgagguggaagcgcagcuggcccgacaaaaggaggaagagucccagcagcaggcugugcuugagcaagaacggcgcgauagagaguuggcacugaggaucgcccagucagaagcugaguuaauuagugacgaagcccaggcagaucucgcgcugcggcgagguccagccguacuugcuacgaaagccgcagcuggcacaaagaaauaugaccugagcaaguggaaguacgccgagcuaagagauaccaucaacacuucgugugacauugagcuccuggcagccugccgcgaagaguuucacaggcguuugaaagucuaucaugcuuggaaguccaaaaauaagaaacggaacaccgaaacagagcaaagagcgcccaagucugugaccgauuacgacuucgccccuuuucugaauaacagcccacagcagaauccggcagcucagauccccgccaggcaacgcgaaauagagaugaaccgacagcagagauucuuucggauuccuuucaucaggccagccgaucaguauaaggacccccaaaguaaaaagaaaggguggugguacgcucacuuugauggaccuuggaucgcacgccagauggaguuacauccagacaagcccccgauucuccugguugccggcaaagacgauauggaaaugugugagcuuaaucuggaagagacugguuugacacguaagagaggggcggaaauccucccucggcaguucgaggagauuugggaaaggugcggcggaauacaguaccugcaaaacgcuaucgagucacgccaggcccgaccaacguaugcaaccgccaugcuacagucccugcuuaaauga

SEQ ID NO: 59425 - RNA, 6648 nt, Artificial Sequence
  derived and/or modified sequence opt3 from MYO7A__Homo_sapiens__NP_000251
auggugauccugcagcaaggcgaucacgucuggauggaucuccgacuugggcaggaguucgacguucccauuggagccguggugaagcugugcgauagcggucaggugcaggucguggacgaugaagacaaugagcauuggaucuccccucaaaaugcuacccacaucaaaccaaugcauccgacaucuguucacggcguggaagauaugauuagguugggggacuuaaacgaggcaggaauccugcggaaucuacucauucgcuaccgagaucaucugaucuauacuuacacgggcucaauacuugucgccgugaaccccuaucagcuguugaguaucuacagcccugaacacauucgucaguauaccaauaagaaaaucggugagaugccaccccacauuuuugcgaucgcugacaacuguuacuucaauaugaagaggaacuccagggaucagugcuguauaauuucuggggagucgggagccggcaaaacagaaucaacuaagcucauccugcaauuucuggcagccauuagcggccagcauaguuggaucgagcagcagguacucgaagcuaccccuaucuuagaggcauucgggaaugccaagacaauucggaacgacaauuccucucgcuuuggaaaauauauagauauccacuucaacaagagaggugcuauugagggcgccaaaaucgaacaauaccugcuugagaaaagcaggguuugccggcaggcguuggacgaacgcaauuaccauguguuuuauuguaugcuggaagggauguccgaagaccagaaaaagaagcuaggacucggccaagcaucagauuacaacuaucuggccauggguaauugcauaaccugugaggggcgagucgacagucaggaguacgcuaacauuagaagcgccaugaaagugcuuauguucacugauacagaaaacugggagaucucuaagcuguuggcagcuauccuccaccugggaaauuuacaguaugaagccaggaccuuugagaaccuggacgcgugcgaaguacucuucuccccaucacuugccacggcagcuagccuguuggaggucaaucccccugaucuaaugaguugucugacuucucggacccucauuacacguggcgagacuguuuccaccccacugagccgcgaacaggcccuugacgugagagaugcuuuuguaaaaggcaucuacgggaggcuguucguguggauugucgacaagauaaacgccgcaaucuauaaaccgcccucgcaagaugugaaaaauucucggcgauccauuggauugcucgacaucuuugguuucgagaacuucgccguuaauucauuugaacagcugugcaucaacuucgcuaaugagcacuuacagcaguuuuucgugcgccaugucuuuaaacuggaacaagaggaguacgaucuagaaaguauugacuggcuccacauagaguucacagacaaccaggaugcgcuggacaugaucgcaaauaagccuaugaacauuaucagccuuauugaugaagaguccaaguuuccaaaaggcaccgacacgacuauguugcauaagcuaaauucucagcacaaacucaacgccaauuacauaccaccuaagaacaaccaugagacacaguucgggauaaaucacuuugcuggaaucguguauuacgaaacccaaggcuuccuggagaaaaacagagauacucuucacggugacauuauccagcugguacauagcucaaggaauaaguuuauuaagcagaucuuccaggccgauguugcaaugggggccgaaacacggaaacgcaguccaaccuuguccagccaauuuaagagaucucucgagcuguuaaugaggacgcugggcgcuugucagcccuucuucgugcguugcauaaaaccgaacgaauuuaagaaaccuaugcuauucgaccggcaccucugcguccgacagcugagauauucaggaaugauggagaccauuaggauccgccgggccggcuaccccauuagauauaguuuuguggaguucgucgaaagguaccgcgugcuuuugccagggguuaagccugcauauaagcaaggagaucugcgagguacaugucagcggauggcggaggcugugcucggcacucaugacgauuggcagaucgggaaaaccaagauauuucugaaagaccaccacgauauguuacuggaaguagagcgugacaaggccaucacagacagagucauucuuuugcagaaagugaucaggggauucaaggaucgcagcaauuuucucaagcugaaaaacgcagccacucuaauucaacggcauuggagaggccacaauugcaggaagaacuacggucugaugcgacucggguuccugcgccuucaggcuuugcaucgguccagaaaacugcaccagcaguacagguuagcccgucaacgcaucauacaguuucaggcacgguguagagcuuaucucguuaggaaggccuuccgacaucggcugugggcggugcuuaccguccaggccuacgcucgcggcaugauugcaagaaggcugcaccaacgguugcgagccgaauaucucuggagacuggaggcugagaaaaugcgccuagccgaagaggaaaagcugaggaaagagaugucugcaaagaaggcgaaagaagaggccgagcguaagcaccaggaacggcucgcucagcuggccagagaggacgcagaaagggagcuuaaagagaaggaagcugcccgcagaaagaaggaguugcuggaacaaauggagagagcacggcaugaacccgugaaucacucggauaugguagacaagauguuuggauucuuaggcacaagcgggggacucccaggucaggagggccaggcccccuccggguuugaggaucuggaaaggggacgccgugagaugguggaagaggaccuugaugcugcgcugccucuaccagacgaagaugaggaggaccucucagaauacaaauucgccaaguucgcagcuaccuauuuucagggcacuacgacacauaguuacaccagacggccgcugaaacaacccuugcuguaucacgaugacgagggugaucaguuagccgcccucgcuguuuggaucacuauccugagguucaugggggaccuuccugaaccaaaguaccauaccgcaaugucugacggcagcgagaaaauucccgucaugacaaagaucuacgaaacccugggaaagaaaacuuauaagcgcgaguugcaggcccuccagggcgagggggaagcgcaacugccugagggacagaaaaaguccucagugcgacacaagcuggugcaccugacacuuaagaagaaaagcaagcucacggaagaggucaccaaaagacugcaugauggcgagucuacuguucaggguaacuccauguuggaagaccggccaacaaguaaucuggagaaguuacacuuuauuauagggaacggaauccucaggcccgcucugcgcgaugaaauuuacugccagaucagcaaacaacuuacccauaauccgucuaaguccucauaugccagaggcuggauucuggugaguuuguguguggguugcuucgcaccuagcgagaaauuuguaaaguaccucaggaacuucauccacggcgggccacccggauaugccccuuacugugaggagcggcugcgucgcacauuugucaauggcacucgaacccagcccccaucguggcuagagcugcaggcuacgaaguccaaaaagccuauaaugcuucccgugaccuucauggacgggacaacuaaaacccuccugacagauucugcaacuaccgccaaggaauugugcaacgcguuagcugacaaaaucagccugaaggauagauuuggauucucacucuauauugcccuguuugacaagguuaguucccuuggcucugguagcgaucacgugauggacgcaaucucccagugugagcaauacgccaaagaacagggggcucaggagaggaacgccccauggcggcuguucuuccgcaaggaagucuuuacgccguggcauucaccuagcgaggauaauguggcaacaaacuugauuuaccaacagguugugagaggaguaaaauucggcgaguauaggugcgaaaaggaggacgaccuagcugaacuggccagucagcaguacuuugucgauuaugguucugagaugauccucgaacggcugcuuaauuuagugcccaccuacauaccagaccgagagauuacuccccugaaaacacucgagaagugggcgcaauuggccaucgcagcucacaagaaaggcaucuaugcccagagacgcaccgaugcucagaaggugaaagaagacgucguuuccuacgcaagguucaaguggccucugcucuuuagccgguucuaugaggccuacaaauuuucggggccaucacugcccaagaacgaugugauuguagccgugaauuggacuggagucuacuucguggacgaacaggagcaaguucuucuggaguugucuuuuccugaaauaauggcugugaguuccagccgugaguguagagucuggcuaucucugggcugcagcgaucucgggugcgcggcaccgcauuccggaugggccggcuuaaccccagcuggucccuguucaccuugcuggaguuguagaggggccaagacaacggcacccagcuucacccuggccacuaucaaaggagacgaauauacauuuaccucuuccaacgcugaggauauucgcgaccuugugguuacauuccuggaaggccuccggaagcgaucaaaauacguggucgcguugcaggauaaucccaacccugccggugaggagaguggcuuucugagcuucgcaaagggggaccucaucauucuggaucacgacacuggagaacagguaaugaacuccggcugggcuaacgggaucaaugagagaaccaaacagaggggagacuucccgacggauucuguguauguuaugcccacagugaccaugccaccucgcgaaauagucgcccuugugacuaugacccccgaccaacggcaggauguagugagacuacugcaguugcguacagcagagccagaagucagggccaagccuuacacuuuagaggaguuuucguaugacuacuuccggcccccaccgaagcauacccugagccgcguuauggugucaaaagcucgaggcaaggauagacucuggucccacacaagggaaccucugaaacaagcccuucugaagaaacucuuggguagugaggaacugucucaggaggcgugccuagcauuuaucgccgugcugaaguauaugggggacuaccccagcaaacggacgcgcuccgucaacgaacucaccgaucagauuuucgagggaccacuuaaggcugagccccugaaggacgaagccuacgugcagaucuuaaaacaauugacugauaaucacauuagauauucagaggaaaggggcugggagcugcucuggcuguguacaggccuuuuuccuccaucuaacauccugcucccccauguucagcgauucuugcagagccggaagcacugcccucuggcuauagacuguuuacagcgucuacaaaaagcacugagaaaugggagucgcaaguacccgccacaucucguagagguggaagccauucagcacaaaaccacucagaucuuucacaaggucuauuuccccgaugacacagaugaggcuuuugaaguggaguccagcaccaaggccaaagacuucugccagaacaucgcaacgaggcuucuguugaagucuucagaaggauuuucccuguucguuaaaauugcggacaaggugcucagugucccugagaacgacuuuuucuucgacuuugugcggcaucugacugauuggaucaaaaaggccagacccauaaaggacgguauuguaccaagccuuaccuaccaagucuucuuuaugaaaaagcucuggacaaccacugugccuggcaaagaucccauggcugacucgaucuuccacuauuaccaggagcugccaaaguauuugcgcggguaccauaaauguacaagggaagagguucugcaguuaggagcccuaauuuaccgagugaaguuugaagaggauaagucuuauuucccuuccaucccgaaacugcuccgggaacuugucccccaggaccugauaagacaagugagcccagaugacuggaagaggucaauuguugcauacuuuaauaaacacgcuggcaagaguaaagaggaggccaaguuggcauuccugaaacucaucuuuaaguggccuaccuucgguucugccuuuuucgaagugaagcagacaacugagcccaacuuuccagaaauccugcuuauugcuaucaauaaauauggggucuccuuaauugauccuaagaccaaagacauacugacgacacaucccuucaccaagaucagcaacuggucaaguggaaauacuuacuuccacauuaccaucggcaaccucgugcgcggcagcaaauugcugugcgagacaucccuaggguauaagauggacgaucugcucacuucuuacaucagccagaugcuuaccgcgauguccaagcaacguggaucacggucugguaaauga

SEQ ID NO: 59426 - RNA, 6351 nt, Artificial Sequence
  derived and/or modified sequence opt3 from MYO7B__Homo_sapiens__NP_001073996
augagcggcuucagacugggggaccacguguggcucgagcccccuuccacacauaagacaggagucgccaucgguggcauuauaaaagaagcuaagccagggaaaguucuuguggaggaugacgaaggaaaggagcacuggaucagggcagaagauuuuggcguacugucuccgaugcaucccaacucagugcagggugucgacgauaugauucgguugggggacuuaaaugaggccggaauggugcacaaccugcucauccgcuaccaacagcauaaaauuuauacuuacacgggcaguauccucguugcggugaauccuuuccagguccugccacuuuauacccuggaacaggugcaauuguacuauagccgacacaugggcgaacuacccccucacguauuugcuauagccaacaauugcuacuucuccaugaagcguaacaagagagaucaguguugcaucauuucuggggagucgggagcagguaaaacagaaacuaccaagcugauccugcaguuucucgccacaauuucaggccagcauagcuggaucgagcaacagguuuuagaggcuaauccaauacuggaagcauucgggaacgccaaaaccauuaggaaugacaacaguucccgguuuggaaaguauaucgauauuuacuucaaucccucuggcgugaucgagggugcucgcaucgaacaguuucuuuuggagaaaagcagagucuguaggcaggccccugaagaacggaacuaccacauuuucuauugcaugcugauggggguguccgcggaggacaagcaacuacucucacugggaacuccaagugaauaccauuaucuuacaaugggcaauuguaccagcugcgagggccugaacgaugcaaaggacuacgcccacauacgcucugcuaugaaaaucuugcaguuuuccgauucagaaagcugggacgugauuaagcuccuggccgcaaucuuacaccuggggaaugucggauucauggcuaguguuuuugagaaccucgacgccucugaugugauggaaacgccggcguuccccacuguaaugaaacuucuggaggugcagcaucaagaguugcgagacugucuaauaaagcacaccauucugaucagaggugaguucgucacaaggucccucaacaucgcccaggcagcugaucggcgugacgccuuugugaaaggcauuuaugggcaucuguuccuuuggaucguuaagaaaauuaaugcugccauauuuacuccuccagcacaggaucccaagaacgugcgcagagccaucggacuguuggacauuuucggcuuugagaauuucgaaaacaauagcuuugagcagcucugcaucaacuucgcuaaugaacaucugcagcaguuuuucguccagcacguguuuaccauggagcaggaggaauacaggucggagaacaucucuugggauuauauucacuacacagacaaucggccuaccuuagaucugcuagcgcucaagccaauguccauaaucucacugcuugacgaagagagucgauucccccaagguacggauuugacuaugcugcagaaacucaacagcguacacgcaaauaacaaggccuuucugcagccgaaaaauauucaugacgcucgcuucgggaucgcccacuucgcaggcgagguuuacuaucaggccgaaggauuucuugagaagaacagagacgugcuguccacagauauuuugacccucgucuacucuagcaaaaauaaguuccugagggaaaucuuuaacuuagagcuggcugaaacuaagcuaggccaugggacaauacggcaagccaaagcaggaaaccaccucuucaagucagcggacaguaauaaacgcccuuccacccuggguagccaguuuaagcagucucuugaucaguugaugaaaauccugacgaacugucaacccuauuucauuagaugcaucaagccaaaugaguacaagaaaccucuccuguuugacagggaguuaugucugcgucagcuucgguauucaggcaugauggaaaccgugcacauucgaaagaguggguuccccaucagauacacauuugaggaguucagccagagguuuggagucuugcucccaaacgcuaugcgcaugcaacugcagggcaaacuacggcagaugacucuggguauaaccgauguguggcucagaacagacaaggauuggaaagccgggaagacuaagauuuuccugagggaccaucaggauacccuuuuggagguucaacgcucccaggugcuggaccgagcagccuuaucuauccagaaaguacuccggggcuaucguuacagaaaggaauuucugaggcagcgccgggcugccgucacacuucaagcaugguggagaggauacugcaauaggcgaaacuucaaacugauuuuggugggcuucgagcgccuccaggcuaucgcccggucgcagccccuggcgagacaguaucaagccaugaggcagcguaccguucagcuacaagcucugugccgcggguaccucgugcggcagcagguccaggcaaagagaagggccgugguagugauacaagcucacgcccgaggaauggcagcgcggcgcaauuuucagcagagaaaagccaacgcuccucugguuaucccagccgagggucaaaagagccaaggcgcacuuccggcuaaaaagaggcgguccauuuaugauacugucacggacacagaaaugguggagaagguguucggguuuuugcccgccaugaucggaggccaggaaggucaggcaucaccucauuucgaggaucuggaaaguaaaacccagaaguuacucgaggucgaccuggacacuguuccaauggccgaggaacccgaggaagauguggacgggcuugcugaguacaccuuuccuaaauucgcggugacauauuuucaaaagucugccagccacacccauauucgaagaccacugcgcuacccccuacucuaucacgaggaugacacugauugucuggcagcuuugguaaucuggaaugucauacugagguucaugggcgacuuaccggaaccugugcucuacgcccguuccucacagcagggaagcucuguuaugcggcagauucacgauacacugggcagagagcauggggcccaagugccacagcacuccaggagugcucaggucgcaagccaacuuaacaucggagaagaggcccuggaacccgacggcuugggugcggaucgcccuaugucuaaucucgagaaagugcauuuuaucguuggguacgcuauucugcgacccucccuaagagacgagaucuauugccagauuuguaagcagcugucagaaaacuucaagacgaguagccuugcccggggauggauacuccugucguugugccugggcuguuuuccaccuuccgagagguucaugaaauacuuacucaauuucaucggucagggccccgcaaccuaugggccauuuugcgccgaacgccugcguagaacuuacgcuaacggagugcgggcagagccgccuacauggcuugaacugcaagccguaaagucuaaaaagcacauucccauccaggucauuuuggcgaccggcgagagccucacagugccaguggauucagcuaguacuuccagggagauguguaugcauaucgcccacaaacaggggcugucugaccaccuaggauucagccugcaggucgcaguuuaugauaaguuuuggucccuuggcucaggucgcgaccauaugauggacgccauagcucgaugcgaacaaauggcccaggagagaggggaaagccagcggcagagucccuggaggaucuacuuccgcaaggaguuuuucaccccuuggcacgauucuagagaagacccaguguccacggagcucauuuauaggcaaguacugcggggaguguggagcggcgaguacucguuugaaaaagaggaagaguuggucgaguuacuggcacgucauuguuacgugcagcucggugcuucagccgaaucuaaggcgguucaggagcugcuucccaguugcaucccucacaaacuguaucgcaccaagccgccagaucgaugggccuccuuggugacagcagcuugugccaaagcucccuacacucaaaagcaggucaccccucuagcagugagagaacagguuguggacgccgccaggcugcaguggccacuccuguucagccggcuuuuugaggucauuacauuaucuggcccccgccugccuaagacucaacucaucuuggcuguaaauuggaaagggcugugcuuccucgaucagcaggaaaagaugcugcuugagcugagcuuuccggaggugaugggauuggcgaccaacagagaagcacagggcgggcaaaggcuacugcucuccacgaugcacgaggaauaugaguucguuucacccaguagcguggccauagcugaauuagucgcccuguuucuugagggacugaaagagcggucuauuuucgcaauggcccuccaggaccgaaaggcuacagaugacaccacuuugcuggcguucaaaaagggcgaucuccuggugcuuaccaaaaagcagggucuacuggccuccgaaaacuggaccuuggggcagaaugacagaacuggaaagaccggcuuaguaccaauggcaugccuguacacaaucccuacggugaccaaacccucagcucaacuccugagucuucuggccaugagcccagagaagcgcaaacucgcagcccaggaaggucaguuuacugagccuaggcccgaggaaccaccgaaggagaaauugcauacacuggaagaguucuccuaugaauuuuuccgggcuccugagaaggauauggucucuauggccguucuaccccuggcgcgugcaagaggccaccucugggccuacucgugugagccacuuaggcagccccuguuaaagcgcgugcaugcuaacguggacuugugggacaucgccugccaaauuuuugucgcuauacugcgguauaugggggauuacccuagccgacaggcauggccaacccucgaacugacagaccagaucuucacucuugcccugcaacaccccgcucuccaggaugagguguacugucagauuuugaaacagcugacccauaauucaaacagacacuccgaagagaggggauggcaauuacuauggcugugcacgggccucuuuccuccgaguaaggggcuucugccacacgcccagaaauucaucgacacacgccggggaaaguugcuggcacccgauuguucuagacguauucagaaaguucucaggaccggcccucggaagcagcccccacaucaaguagaaguggaggcggccgagcagaaugucagccgcaucugccacaagauauauuuuccuaacgacacuuccgaaaugcuggaggugguugcuaauacccgagugagagaugucugugacucaaucgccacaaggcuucagcucgcaucuugggaagguugcagccuguucauuaaaaucagugauaaggugauuucccagaaagagggggacuuuuucuuugauagcuugcgggaaguaucugacugggucaagaaaaacaagccccaaaaggagggagcuccagugacucugccuuaccagguuuauuucaugcgcaaauuauggcuaaauaucucaccgggcaaggaugugaacgccgacaccauacugcauuaccaccaggagcuccccaaauaucuuagaggcuuccacaaguguuccagggaagacgcaauucaucuggccggguugaucuacaaagcucaauuuaauaacgaucgaagucagcuggcgagcgucccaaagauccuccgggagcuggugccugaaaaucuuacacguuuaaugucgucugaggaauggaagaaauccauucugcucgccuaugacaagcacaaagauaagacgguugaggaggcaaaaguggcuuucuugaaguggaucugcagauggcccaccuuuggaagcgccuucuuugaagucaaacagacuucagagccaaguuacccugacgugauacugauugccaucaaccgccaugguguacuacugauucaccccaagacaaaggaucuccuuaccacuuacccguucacaaaaaucucuuccuggagcucaggcaguaccuauuuucauauggcacuggggagcuugggaaggggcucccggcugcucugugaaacgucucuggguuacaagauggacgauuuacuuacuagcuaugugcagcaacugcucuccgcuaugaauaaacagagagggucaaaggccccagcgcuagcuucuaccuga

SEQ ID NO: 59427 - RNA, 7647 nt, Artificial Sequence
  derived and/or modified sequence opt3 from MYO9A__Homo_sapiens__NP_008832
augaacaucaaugacggcgggagaaggcgguucgaagauaacgaacacacccugcgcauuuaccccggagccauaagcgaggguacaaucuauugcccuauuccggcucguaaaaauuccacugcagccgaagugaucgagucucucauuaacaaacuucaucuggacaagacgaaguguuacgucuuggcggaaguuaaggaguuuggcggggaggaauggaucuuaaauccgaccgauugccccgugcaacgaaugaugcuguggccuagaauggcucuggagaacaggcucucaggagaagacuaucgguuccugcuucgcgagaaaaaucuggauggcaguauacacuacgguagcuugcaauccuggcucagaguaacagaggaaaggcggcgcaugauggagcgaggguuucugccacagccccagcagaaggacuucgaugaccuguguucucucccugauuuaaacgaaaagacucugcuugagaauuugagaaacagguuuaaacaugaaaagaucuauaccuacgugggaucgauucugaucgucauuaauccauucaaauuucugcccaucuauaacccuaaguacgugaaaauguacgacaaucaccaacucggcaagcuggagccacauauuuaugccguugcagauguggccuaccacgcuaugcuucagcggaagaaaaaccagugcauugucaucucaggcgagagcgggaguggaaagacacaguccaccaauuuccugauucaccauuugacugcacucucucaaaaagguuuugccagcggcguggaacagaucauccugggggcuggaccgguauuagaggccuucggcaacgcgaagacagcacacaacaauaacuccucacguuuugguaaauucauucagguuaauuaucaggaaaccgggacggugcugggagccuacgucgagaaguaucuccuugagaagagucgccugguguaccaagagcauaacgagagaaauuaucacguguuuuacuacuugcuagcuggcgccagcgaagacgagaggucugcauuccaccugaagcagcccgaagaguaucauuaccucaaccagauaacuaagaaaccucugcggcaauccugggaugacuauuguuacgacucagaaccagauugcuucaccgucgagggcgaggaccuucgacacgauuuugaacgccugcaguuggcuauggagaugguuggguuccuccccaagacaagaaggcagaucuuuagccuguuaagugccauucugcaucuaggaaauaucuguuauaaaaagaaaacuuaccgggacgauucuauagacauuugcaacccugaagugcucccaaucguauccgagcugcuugaggugaaggaagagauguuguucgaagcgcuggucacccgcaagacagugaccguuggugagaaacucauccugcccuauaaacuugccgaagcagugacggucagaaauagcauggcuaaaucgcuguacucugccuuguuugauuggauuguguucaggaucaaccacgcucuccuaaauuccaaggacuuagagcauaacacuaaaacacugucaauuggcguacuagauauauuuggguucgaggacuacgaaaauaacaguuuugagcaguucuguaucaauuuugccaacgaacgucuccaacacuauuucaaccagcacauuuuuaagcuggagcaggaagaguaccggaccgagggaaucagcuggcauaauaucgauuauauugacaacacuugcuguauaaaucuuaucuccaagaaaccgacaggcuugcugcaccuccuggacgaagagucuaacuucccucaggcaaccaaucaaacguuacuggauaaguucaaacaucagcacgaagacaacagcuacauugaguuucccgccguuauggaaccagcuuucaucauuaagcacuaugcggguaaagugaaguacggggucaaggauuuucgagagaaaaauaccgaccauaugagaccugauaucguggcacuuuugaggucaaguaagaacgccuucauauccggcaugaucggaauugaccccgucgcuguguuucgcugggccauccuccgggcauucuuuagagccaugguugcuuucagggaggccggcaaacgcaauauucaccgaaagacagggcaugaugacacugcaccaugcgcgauccugaaaagcauggauucuuuuucauuccuacagcaccccgugcaucagcggagucuggaaauacuccaacguugcaaggaggaaaaauauagcauuaccagaaagaacccuaggacaccacuguccgaccuucagggaaugaaugcuuugaacgagaagaaucagcacgauacuuuugacaucgccuggaacggucgcaccggcauucggcagucuagacugucgagcgggacauccuuacucgauaaagacggaaucuucgcaaauucaaccaguucuaagcugcuugagagggcccacggcauacugacucgaaacaaaaacuuuaagagcaaaccggcuuugcccaagcaucuccuggaaguaaauucccuaaagcaccugacgcgccucacacugcaagaccggaucaccaaaucacuuuugcaucugcacaagaaaaagaaaccuccaagcauuucugcccaguuccaggcauccuuaaguaagcucauggagacucugggucaagcugaacccuacuucgucaaguguaucagaagcaacgccgagaaacuuccucugagguuuucugaugugcuaguucuccgucagcugcgcuacaccgggauguuggaaacagugcggauuagacaguccggcuauucaaguaaguacagcuuccaggacuuugucucgcauuuccacgugcuguuaccaaggaauaucauacccuccaaauuuaacauucaagauuucuuucgaaagaucaaucucaacccggacaauuaucagguaggaaaaaccaugguguuccugaaggagcaggagcggcagcaccuucaagaucuguugcaucaggaaguucuccgcagaaucauucugcuacagaggugguuucggguccugcuuugccgacagcacuuccuccaucugagacaagcgucugugaucauucagcgcuuuuggaggaacuacuugaaucagaagcaagugcgugacgccgcuguccagaaagaugcauucguuauggccagcgcugccgcacuguuacaggcgucauggcgggcccaccucgagagacagagguaucuggaacuucgcgcugccgcaauagugauccaacagaaguggcgagacuacuauagacggaggcacauggcugccauuuguauccaggcacgcuggaaagccuaccgugagaguaagagauaccaggaacaacggaaaaagauuauccuguugcaguccacuugcaggggcuuccgcgcucgacagagauuuaaagcgcucaaggagcagcggcugagggagacaaagccugaaguggggcuaguaaacauaaaaggauaugguucucuggagauccaaggcagcgauccauccgggugggaagacuguucauucgauaaucgcauuaaggccaucgaggaaugcaaaagcgucauugagaguaacagaaucucuagggaguccagcguggacugucuuaaggaaucgcccaauaaacagcaggagcgggcacagucacaaucuggaguugaucuccaggaagacgugcugguccgugagcgcccucgaaguuuggaggacuuacaucagaagaaggugggcagagcuaaaagggaaucccggcgcaugagagagcuggaacaagccauauuuagccucgagcugcuuaagguuaggucucugggugggauuagccccuccgaagaucggcgauggucaacggaguuggugccagagggccuacagaguccuagaggaacccccgacagcgaaucuucccagggcucacuggagcuccugaguuacgaagagagccagaaauccaaacuugaaucuguaaucucggaugagggggacuuacaauucccaagcccgaaaaucucauccaguccuaaguuugauucucgcgacaacgcccugagcgcuuccaaugagacuucaucugcagaacaccucaaggauggaacaaugaaagagauggucgugugcagcagugaauccauuaccuguaagccccaguugaaagacagcuucauaucuaacucacugccaacauuuuucuauaucccccagcaggauccucucaagacuaacucccaacuggacaccaguauucagaggaauaaacuucuggagaacgaagauacggccggcgaggcguugacccuagacaucaaucgggagacacguagauaccauugcagcgguaaggaccagauugugccaucgcugaacacugaaucuuccaaucccguccucaagaaauuagagaagcugaacaccgaaaaagaggagaggcagaagcaacuucagcagcaaaaugaaaaagagaugauggaacagauccgccagcagacagauauacuggagaaggaacggaaggcuuuuaaaacuaucgagaagccucgaauuggggagugucucguugccccgagcucauaucaaaguaaacagagaguggaaaggccaucuuccuugcugagccucaacaccucaaauaagggagagcugaacguacuuggcagucuaagccugaaagacgcagccuuggcucagaaggauuccucuagcgcacacuuacccccuaaagaccgcccagugacggucuucuuugaacggaaggguucccccugccagucaucuacagugaaggagcugaguaaaaccgauagaaugggcacucaacucaauguugccugcaagcugucgaacaaucguaucagcaaaagggaacauuuccggccuacacaguccuacucucacaacucagacgaucuuagccgcgaggggaaugcgcgaccgauauuuuucacccccaaggacaacauguccaucccacuggugaguaaagaggcucucaauucuaagaacccucaguugcacaaggaagaugagcccgccuggaaaccagucaagcuggcaggaccuggccagagagaaacuagccaaagguucucauccguggacgagcaggccaaacuacauaagaccaugagucagggggaaauaacaaaacuggcuguucggcagaaggccagcgauucugacauucgcccccaaagagcaaagaugagguuuugggcuaaaggaaagcagggcgagaaaaagacgacccgagugaaaccaacuacacaguccgaggucucaccacucuucgccgguaccgauguaaucccugcgcaccaauuucccgacgaacuugccgcauaucauccaacacccccucugagcccagaguuacccgggucgugucggaaggaguucaaggagaacaaagagccuucuccgaaggcuaaacguaagagaagugugaaaaucuccaauguugccuuggacagcaugcacuggcagaacgauucagugcagauuaucgcuuccgucucugaccuaaagagcauggaugaauuucuccugaaaaaggugaaugaccuugauaacgaggacaguaagaaagauacucugguagacguggucuucaagaaagcacucaaggaauuucgccagaauauauucuccuuuuacagcucugccuuggccauggaugacggaaaaucaauuagguacaaggaucuguaugcuuuauucgagcaaauccuagaaaagaccaugcggcuggagcagagagacagucucggcgaguccccaguucgcgugugggugaacacguuuaaagucuuccuugaugaauacaugaaugaguuuaagacaagcgacugcaccgcgacuaaagugcccaagaccgaaaggaaaaagcgacggaagaaagagacagaccugguugaagaacacaacggucauauuuucaaggcaacucaguauucuaucccuaccuacugugaguauugcucgucauugauauggauuauggauagagccagcguauguaaacugugcaaguacgcuugucacaaaaagugcugucucaagacaacggccaaaugcuccaagaaauaugaccccgaacugaguucuaggcaguucggcguggagcuuagccgccucaccuccgaagaucguacugucccacuggugguugagaaguugaucaauuacaucgaaaugcaugggcuguacacagagggaauuuaucggaaaucaggcaguaccaacaagaucaaagaguuaagacaagggcuagacacugaugcagaaucugugaaucuggacgauuacaacauucacgucauagccagcguguuuaagcaguggcucagggaccuuccuaauccccugaugacauucgaguuguaugaagaguuucugcgcgcuaugggacuccaggagcgaaaggaaaccauccggggcguauacuccgucauugaucagcugucaagaacgcaucuuaacacuuuagagaggcugaucuuccaccucgugcgcaucgcguugcaagaagacaccaauagaaugagcgccaacgcacuggcuauuguuuuugccccauguauacuacggugcccugauacaaccgacccgcugcagucugugcaggacaucuccaaaacuacaaccugcgucgagcucauugugguugaacaaaugaacaaguauaaagcaaggcuuaaggauaucaguagccuggaguucgccgagaauaaagcuaagacacguuugucgcugauucgacgcuccauggguaaggggagaauccggaggggaaacuaccccggcccaucuucaccuguggucgugcgccuccccagcguaagugacguguccgaagagacucugaccucugaagccgcgauggagacggauauaacagaacagcagcaggcagccaugcaacaggaggagagaguuuuaaccgaacagaucgagaaucuucagaaagaaaaggaggaacugacuuuugagaugcucguccuagagccacgggcuagcgacgaugaaacccuggagucagaagccuccauugguacagcugacaguagcgagaacuugaauauggagucugaauaugcaaucucagagaaauccgaaaggagccuggcccucucuagucuuaagacugcuggcaaaucggagccuuccagcaagcugcgaaagcaauugaaaaagcagcaggauucacuggacgugguggauucuagcgucuccagucucuguuuaucaaacaccgccucuagccacgggacgcguaaacuguuccagauuuacuccaagagucccuuuuacagagcagcgagcggaaaugaagcccuuggcauggaggggccgcugggacaaacaaaauuccuagaggacaagccacaguuuaucucccgcggcaccuucaacccugaaaaggguaaacagaagcucaaaaauguaaagaacucuccccagaagacuaaggagacaccagaagggaccgugaugucaggacggaggaagacuguugaucccgacugcacaagcaaucagcagcuggcuuuguuuggcaacaaugaguucaugguguga

SEQ ID NO: 59428 - RNA, 6069 nt, Artificial Sequence
  derived and/or modified sequence opt3 from MYO9B__Homo_sapiens__NP_001123537
augagcgugaaggaagccggauccucugggagaagggaacaggcugcauaccaucugcacaucuauccccaacucucaaccacagagagucaggccagcugccgggucacugcgacgaaagacuccaccacaucugauguuauuaaggacgcuauagccucgcuucgccuggauggaacuaaauguuacguguugguagaagugaaggagucagguggcgaagagugggucuuagacgcaaacgauagcccugugcaccgaguucugcuauggccacguagagcccaggacgagcauccgcaggaagauggguauuacuuccuccugcaagagaggaaugcugacggaaccaucaaauaugugcacaugcagcuugucgcacaggccacagcuacccggcgccugguggaaagaggcuugcuccccaggcagcaagccgauuuugacgaucugugcaaccugccugagcucacugaggguaauuuacugaagaaccuuaagcaucgguucuugcagcagaaaauuuacacauaugcggggaguauccugguagcaauuaauccauuuaaguuccuacccaucuacaacccuaaauacguuaagauguaugaaaaucagcaacucggaaaacuggagccacacguguuugcccuugcugacgucgccuacuauaccaugcugcgcaagcgagugaaccaguguauagugaucuccggcgaaucuggcagcgggaagacgcaguccacuaauuucuugauucacugccucaccgcacugucacaaaaaggauacgcuaguggugucgagagaacaaucuuaggcgccgggcccguucuggaagcguuuggaaacgccaagacugcacauaauaacaauagcucuagguucggcaaauuuauucagguguccuaucucgagucagguaucguaagaggggcuguggucgagaaguaccuucuggagaaaagccguuuggugagucaggagaaggaugaacgcaacuaucacguuuucuacuaccuacugcucggagugucugaggaagagagacaggaguuucaacugaaacagccugaagacuauuucuaccuuaaucagcauaaccugaagauagaggacggcgaagauuugaagcacgacuuugagaggcucaaacaggccauggaaauggucggcuuccugccagcuaccaagaaacaaauuuucgccguguuauccgcaauccuguaucuagggaacguaacauacaagaaacgggccaccggacgagaggagggucucgaaguuggcccgcccgaggugcuggauacgcuuagccaguugcugaaggucaagcgcgaaauucucguggagguccugacuaaaagaaagacagugaccguuaaugacaaacuuauccugccuuauucguugucugaggcuaucacugcgagggauuccauggcaaagucacucuacagugcccuguuugacuggauuguguuacggauaaaccacgcucugcuaaauaaaaaggauguagaagaggccgucagcugucucuccaucggggugcuggacauuuucggauuugaagauuucgagcgcaacucuuuugaacaguucugcaucaauuaugcaaacgagcagcuucaauacuacuuuaaucagcauauauucaaguuggagcaggaagaguaucagggcgaagguauuacauggcacaacaucggguacaccgacaauguuggcuguauccaucugauuagcaaaaagccaacgggacucuuuuaucuguuagaugaggaaucaaacuucccccacgccaccagucaaacacugcuugcuaaauuuaagcagcagcaugaggacaauaaauacuucuugggcacuccugugauggagccagccuuuaucauucaacacuucgcagggaaggucaaguaucagauaaaagacuucagagaaaagaacauggauuacaugaggcccgacaucguggcgcuccugcguggauccgauagcucuuauguacgggagcuaauugguauggacccgguggcuguuuuucgaugggccguccugagagcagccaucagggcuauggccgugcuccgcgaagcaggccggcugagagcugagagggccgaaaaagcggccgggaugucaaguccuggagcucagagccaccccgaggagcuuccacgcggcgcauccaccccuucugaaaaguuguaccgagaucugcauaaucagaugaucaaaucgauuaaggguuuacccuggcaaggggaggacccacggagccuccugcagucccuuucacgucugcagaaacccagagccuucauauugaagaguaagggcaucaaacagaagcaaauuaucccuaaaaaccuccuggauucuaagagccuaaaacugauuaucuccaugacacuccacgacaggacuaccaagucacugcuucauuugcacaagaaaaagaaaccaccgagcauaucugcucaguuucagacaucccugaauaaguuacucgaagcccugggaaaagcagagcccuucuuuauccgcugcauucggaguaacgcggagaagaaggaacuuuguuucgaugacgagcuggugcuacagcaacucagauacaccggcaugcuggaaacugucaggauccgacgcagcggguauucugccaaauacacguuucaggauuucacagagcaguuucaaguuuugcugccuaaggacgcucagccaugccgggaagugauuuccaccuuacucgagaaaaugaagaucgauaaaagaaacuaucagauaggaaagacuaagguguuccugaaagagaccgaaaggcaggcccuucaagagacacugcaccgugaaguaguccgcaagauuuugcuccugcagucaugguuucggauggugcuagagagaaggcauuuccugcagaugaaacgagcagcuguuaccauccaggccuguuggcggaguuaccgcgugagaagggcacuugaacggacucaagccgcugucuaucuccaggcgagcuggcgagguuacuggcagagaaagcuguaucgccaccagaaacaaucgauuaucagguugcagucccugugccguggccauuuacagcggaagucuuuuagccagaugauaucagagaaacaaaaggccgaggaaaaggagagagaagcacucgaggcugccagggccggggcugaagagggaggccagggucaggcagccgggggccaacagguggcggagcagggacccgaaccugcugaggacggcgggcaccuggccagugaaccagagguucagcccuccgaccgcucuccgcuugagcauagcuccccugaaaaagaggcaccaucacccgaaaagacacugccuccccagaaaacgguggccgcugagagccacgaaaagguaccaaguucucgagagaaaagagagucccggaggcagcgcggauuggaacacgucaaguuccagaauaagcauauccagagcugcaaagaggaaucggcacuccgugagccuucaagacgggugacccaagaacagggcgugucucugcuagaggauaagaaagagaguagggaagacgagacucugcuugucguugaaacagaggccgaaaacaccucccagaagcagcccacagagcaaccacaggcgauggcuguggguaaaguaagcgaggaaacugagaagacccucccgucugggagcccucgccccggacagcuggaacgaccaacguccuuggccuuagauucaagagugagucccccugcaccaggcagcgcccccgagaccccugaggacaagucuaaaccgugugguuccccacggguccaagaaaagcccgauucaccuggcgggaguacacagauucagagguaccuggacgcugagcgccucgccagcgcaguggaacuguggagaggcaagaaacuuguugcugccgcguccccaucugccaugcugucgcagagcuuggaucuaucagacaggcaccgggcaacuggcgcugcccugacccccacagaggaacgucgcacuuccuucaguaccucugaugugagcaaacuccugccuucccuugcuaaggcacaaccggccgccgagacgacagacggggagcgaucagcuaagaaacccgcgguccagaagaaaaagccaggagaugcaucuagcuuaccugacgccggccugagucccgguucccagguggauagcaaaucuaccuuuaagagacucuucuugcauaagacuaaagacaagaaauacucacuggaaggggcugaggaacucgagaaugccguuuccggacacgugguccuggaagcaacaaccaugaagaaaggccuugaggccccaaguggucagcaacauaggcacgcugcgggcgagaagcggacuaaagaaccugggggaaagggcaagaaaaaccgcaauguaaagaucgggaaaauuaccgugagcgagaaguggagagaaucgguuuuuaggcagaucacaaacgccaaugagcugaaauauuuggacgaguuccuacugaacaagauaaaugaucuccggucucagaagacgcccauugaguccuuauuuaucgaggcaaccgaaaaauuccgaagcaacaucaagacuauguacucagugccaaauggaaaaauucacgucggcuauaaggaccugauggagaacuaccagaucgugguaaguaaucuugcuacagaaagaggucaaaaagauaccaaccuggugcucaauuuguuucagucucugcucgacgaguucacacgcggguauacuaagaacgauuuugagccggucaagcaguccaaagcccagaagaaaaagaggaaacaagaacgggcaguucaggagcauaacggacacguguucgccagcuaccaggugucaauuccucaaaguugcgaacagugucugagcuauauauggcuuauggacaaggcucuacugugcuccgucuguaagaugaccugccauaaaaagugugugcacaaaauccagucucacugcagcuacacguacggccguaagggugagcccggcguugaaccagggcauuuuggaguauguguggauuccuugacaucagacaaagccucuguccccauuguguuagagaagcugcucgagcacguugaaaugcauggccuguauaccgaggggcuuuacagaaaaaguggagcggcaaauaggacucgcgaacugcggcaggcccuccaaaccgauccugcugccgugaaguuggagaacuucccaauccacgcuauuacaggcguccugaagcaguggcuacgagaacugcccgagccucucaugacuuucgcacaguauggugacuuucuuagagccguggagcugccggaaaaacaggagcaauuagcugccaucuacgcaguauuggaacaucugccagaggcgaaucacaacucgcucgaaaggcugauauuccaccuugucaagguggcccugcucgaggauguuaaucgcaugagccccggggcuuuggccaucauuuuugcaccuugccuguuacggugucccgacaacuccgacccacuaaccucuaugaaagaugugcugaagaucacaacgugcgucgagaugcucauuaaagaacagaugagaaaguauaaggugaaaauggaggaaaucucacagcuugaggcugccgagagcauagcauuccguaggcuguccuugcugcggcagaaugccccuuggccccucaagcugggauuuaguucuccauacgaaggcguucuuaacaaaagcccuaagacccgcgacauucaagaggaagaacucgaagugcuguuggaggaggaagcugcgggcggggaugaggaccgagaaaaagagauccugaucgaacggauucaaucaauaaaggaggagaaggaagauaucacuuauagguuaccggagcuagacccccggggauccgaugaagagaaucuggacagugaaacaagcgccucuaccgagucccuccuugaggaacgcgcagguagaggcgcuucagaggggcaguacuga

SEQ ID NO: 59429 - RNA, 2961 nt, Artificial Sequence
  derived and/or modified sequence opt3 from MYOCD__Homo_sapiens__NP_001139784
augacccugcucggcagcgagcacucccuucugaucagaucuaaguucaggucaguguugcaguuacggcugcaacagcgccgaacacaggaacagcuagccaaccaagggauuauacccccucucaaacguccagcugaguuucaugaacagagaaagcaccuggacagugauaaagcaaagaauagccuuaaaaggaaggcccggaaccgcugcaauuccgcggaccuggucaacaugcauaucuugcaggcuucuacugccgagagaucgauuccgacggcacagaugaagcucaaaagggcccggcuggcugaugaccugaaugaaaagaucgcacuccgccccggaccuuuagagcugguugagaaaaacauucuuccaguggauucagccguaaaggaagcuaucaaagguaaucaagugagcuucaguaaguccaccgacgccuuugcguucgaggaagauucuagcuccgacggcuugucacccgaucagacacgaagugaggacccucagaacagcgcagggucuccacccgaugccaaggcuuccgacacuccuucaaccggaagccugggcacaaaucaggaucuagccagugguucugagaacgacagaaaugacuccgcaagccaaccaucgcaccagucugaugcugggaaacagggacucggcccgcccuccaccccuauagccguccaugcggccgugaagucaaaaagucugggcgacagcaagaacaggcacaaaaagccaaaagaucccaagccuaagguuaaaaaguugaaauaccaccaauauaucccacccgaccagaaggcagaaaaauccccgccucccauggauucugcuuacgcccggcuguugcagcagcaacagcucuuucugcaguuacagauucugagccaacagcagcagcaacagcagcaucguuucucauaucucgggaugcaccaggcucaacuuaaggagccaaaugaacagauggugcgcaacccuaauaguuccagcacuccccugucuaacacaccauugucacccgucaagaacaguuuuagcggacagaccgguguguccucuuucaaaccuggcccacuaccgcccaaucuggacgaucucaagguaucggagcugagacaacagcuuaggauccgggggcugccuguuagcggaacgaaaacugccuugauggaccgacuccgcccauuucaggauuguuccggcaaccccgugccuaauuucggugacauuaccacagucacuuuuccagugacccccaacacacugccgaauuaccagucaaguucuagcaccuccgcauuaucaaacggguucuaucauuuuggaagcacgucuuccaguccuccaaucagccccgccucuuccgaucugucaguggcuggcagucuaccugacacuuucaaugacgcgagccccucguucggccuccacccauccccuguccacguuugcacagaagagucucugaugagcucacuuaacgggggaagugugcccuccgaguuggauggucuggacucugaaaaggauaaaaugcucguagagaagcaaaaggugauaaaugaacugaccuggaaacuucagcaggagcagagacaagucgaggaacugaggaugcaguugcagaagcagaaacggaacaauuguagcgagaagaaaccacucccguuucuggcagccuccauuaagcaagaagaggcugugucaagcugcccuuucgccagucagguucccgugaagcgccagucuuccagcucggaaugucauccacccgcaugcgaggccgcucaauuacagccucugggcaacgcccacugugucgaaucaucugaccagacuaaugugcuaaguuccacauuucucagcccacagugcucuccccaacauagcccucugggggcaguaaaauccccgcagcacaucucacuuccacccaguccuaacaauccacauuucuugcccucaucuuccggagcgcagggcgagggucacagaguuucaaguccuauuagcucccagguguguaccgcucaaaacucuggggcccacgauggccauccgcccucguuuagcccacacucauccagucugcauccucccuucucuggagcacaggccgacagcucccacggcgcugggggaaacccaugcccuaagucacccuguguccagcagaaaauggccggucuccacucuagcgauaaggugggcccaaaauuuaguaucccguccccuacguucagcaagucuucauccgcaaucagugaggucacccaacccccaagcuacgaagacgcugugaaacagcagaugacaaggucgcagcaaauggaugagcuguuagacguucugauugaaucuggggagaugcccgccgaugcgcgugaggaccauuccugccuucagaaggugccuaagauaccacggagcucacgaagucccacugccguauugaccaaaccuucugcuuccuuugaacaggcaagcucaggaagucaaaucccguucgauccauaugccacagacagcgacgagcaccucgaaguccugcuaaauucccagucuccccugggcaagaugagcgaugugacucuccugaaaauugguuccgaggaaccucauuuugacgggaucauggauggcuucucaggaaaggcugccgaggaccuuuuuaacgcacacgagauauugcccggcccacugucuccuaugcagacccaguucagucccucgagcguugauuccaauggguuacaacucucuuucacagaaucaccaugggagaccauggaauggcuggaccuuacuccuccgaacagcacgcccggauuuuccgcgcugacaaccaguucuccaagcauuuucaauaucgauuuucuugacgugacugaucucaaccugaauagcuccauggaccuacaucugcagcagugguga

SEQ ID NO: 59430 - RNA, 1515 nt, Artificial Sequence
  derived and/or modified sequence opt3 from MYOC__Homo_sapiens__NP_000252
augagauucuuuugcgccagguguugcagcuucggccccgagaugccugcugugcagcugcuccuucuggcauguuuggucugggacguuggggcccggaccgcgcaauuacgcaaggcuaacgaucaguccggacgaugccaguacacauuuucuguggccucaccaaaugaaaguagcuguccggagcagucccaagcaaugucuguaauccacaaccugcagcgugacucgucaacucagagacuagaucucgaagccacgaaagcuaggcugagcagucuugagucccuguugcaucagcucacccuggaccaagcagcccggccccaggaaacacaggagggucugcagcgcgagcucggcacuuuaagaagggaacgggaucaacuggagacccagacacgcgaacuugagaccgcuuauucuaauuugcugcgagacaagagcgugcuagaggaagagaaaaagagacucaggcaggaaaacgagaaucuggcccggcgucuugaauccucaagucaagaggucgcgcgccugagaagggggcagugcccucagacucgggauacagcacgagccgugccacccggaagccgcgagguuucuaccuggaacuuggacacgcucgcuuuccaggaacugaaauccgaguuaacugaagugccugccucaaggauucugaaggagagcccaaguggcuaccucagaucuggugaaggggauaccggauguggcgagcuugucugggugggcgagccccugacauugcggacugcagaaaccauaacagggaaguauggaguauggaugcgcgacccuaaaccaaccuacccguauacgcaagagacuacauggagaaucgauaccguugguacugacgugaggcaggucuuugaauacgaucuaauuucccaguucaugcagggcuaucccagcaaggugcacauccugccucguccacucgagucgacaggggcuguggucuacucuggaucccuguacuuucaaggcgccgaaucacggaccguuauucgauaugagcuuaauacggagaccgugaaagcggaaaaggagauccccggugccggguaccauggacaguucccuuauaguuggggcggcuacacagacauagaccuggcaguagaugaagcuggguugugggugaucuauagcacugacgaggccaaaggagcuauuguccucuccaagcugaacccagagaauuuagaacuggagcagaccugggaaacaaacaucagaaagcagucuguggccaaugcauuuauuaucugcgguacucuauacaccguuagcucauauacaagugccgaugcuaccgugaacuucgcguacgacacuggcacggggauauccaaaacacucaccauucccuuuaagaauagguacaaauauagcucuaugaucgauuacaacccgcuggagaagaaacuuuucgcaugggacaauuugaacauggucacuuaugauauuaagcugucaaaaauguga

SEQ ID NO: 59431 - RNA, 963 nt, Artificial Sequence
  derived and/or modified sequence opt3 from MYOD1__Homo_sapiens__NP_002469
auggagcugcucagcccuccccuuagagacguggaucugaccgccccagacggcuccuugugcucuuucgcuacaacugaugacuuuuacgaugacccguguuucgauucacccgacuuaagguuuuucgaagaucuggacccucggcuaaugcacgucggggcacuccugaagccagaggaacauagucacuuucccgccgcgguucauccugcuccaggagcccgcgaggaugaacacgugcgagcacccagcggucaucaccaggccggccguugccuucugugggcuuguaaagcaugcaagagaaaaacgaccaacgccgacaggcggaaggcugccacaaugcgcgagagaaggcgguuguccaaaguaaaugaggcguucgaaacucucaagcgcuguaccucuucgaacccuaaucaacgacugccaaagguggagauccugagaaacgcaauuagguauauagaagggcuccaggccuuacugcgggaucaggacgcugccccgcccggagcagcugccgcguuuuacgccccuggcccacuucccccuggucgugggggagagcacuauucaggcgacagcgaugcaaguuccccacgcucuaauugcagcgacggcaugauggauuacuccgggcccccgucaggagcuagaaggcggaacuguuaugagggugccuacuauaaugaagcuccuagugagccccgaccaggcaaaagcgccgcagucucuuccuuggacugccugucaagcaucguggaacgcauuaguacagagucuccugccgcucccgcgcuacuccuggcagauguuccauccgaaucgcccccuagaaggcaggaggccgcugccccaagcgagggggaaucuuccggagacccgacccaaucacccgaugcagccccucaguguccagcuggcgccaaccccaauccuaucuaccaggugcuuuga

SEQ ID NO: 59432 - RNA, 6186 nt, Artificial Sequence
  derived and/or modified sequence opt3 from MYOF__Homo_sapiens__NP_038479
augcugagagugaucgucgagagcgccuccaacauucccaagaccaaauucggcaagccugacccaauaguuucugugaucuuuaaagaugaaaagaaaaagacaaagaaaguagacaaugagcucaacccgguguggaaugaaauucuugaguucgaucugagggggauccccuuggacuuuucaaguagcuuaggaauuaucgucaaggauuucgaaacuauaggucagaacaaacugaucggcacggcuaccguggcacuaaaggaccucacaggggaucaaucccggucucugccuuacaaacuuauuucgcuguugaaugagaagggacaggacacuggcgccaccaucgaucucguuauugguuaugacccacccucagcgccucacccaaacgaucugagcgggcccagugugccuggaaugggcggcgacggggaggaagaugagggagacgaagaccgccuggauaaugcuguccgagguccaggcccgaaggggcccgugggaacaguauccgaggcccagcucgcacguagauuaaccaaaguuaagaacucuaggcggaugcugagcaauaaaccucaggacuuucaaauccgcgugagagucauagagggcaggcagcuuuccgguaacaauauucggccaguggugaagguccauguuugcgggcagacucaccgcacacgaaucaaaagaggaaacaaucccuucuuugaugaauuguucuuuuacaacgugaauaugaccccuucagagcugauggacgaaauuaucaguaucaggguauauaacagccauucucuacgggccgauugucucaugggcgaguucaagauugacgugggcuuugucuacgaugaaccagggcacgcugugaugcguaaauggcugcuucugaacgaccccgaggauacguccucaggaagcaaggguuauaugaagguuaguauguucguguugggcacuggggacgagccgccucccgaacgcagagauagggacaaugacucugaugacgucgaguccaaccuccuguuaccagcaggaauagcccugcggugggugaccuuucuccuuaaaaucuaccgagcugaagauauuccucagauggacgaugccuucagccaaacaguaaaggagaucuucggcgguaaugcggacaaaaagaaccugguugaucccuuuguggaagucucguucgcagggaaaaaggugugcacuaauauaauugagaagaacgccaauccagaguggaaccaggucgugaauuugcagaucaaauuucccucuguuugugaaaagaucaaacuaaccauuuaugacugggaucgccugacaaagaacgacgugguaggcaccacguaccuccaucuguccaaaaucgcugccucaggaggcgaggucgaagauuucaguagcuccgggacuggagcagcuucuuacacagugaauaccggugagacugaaguuggcuuugugccuacauucgggccaugcuaucuuaaccuguacggaagcccgagagaguauaccggcuuucccgacccuuacgaugaguugaauacggguaagggggaaggcgucgccuauaggggacggauucucguggagcuggcgaccuucuuagaaaagacaccacccgacaaaaagcuggagccuauaucaaacgacgaucuacucguaguggagaaauaccagcgcagaaggaaguauagucuguccgccguuuuucacagcgcaacuaugcuucaagacgucggcgaagcuauccaguucgaggugucuauugggaauuacggaaacaaauuugauaccacauguaagccauuggccucaacuacccaguacagucgugcuguguucgacgguaacuauuacuauuaccugcccugggcccacacaaagccggucguuacccucacuagcuauugggaagauaucucccaucggcuggacgcagugaauacgcuucuggccauggcugagcgauugcaaacaaacaucgaagcgcucaaaucuggcauucaggggaagauaccugcaaaucagcuggccgaguuauggcugaaacuaaucgaugaggugauugaagacaccagauacacucucccacugaccgagggaaaggcuaacguaacaguccuugauacccagaucaggaaauugcgcucgcggagccugucccaaauucacgaagccgcagugagaaugaggucagaggccacugacguuaagaguacacucgcugaaaucgaggauuggcuggacaaauuaaugcagcugacggaggaaccccagaauucuaugccugauauaaucauuuggaugauccgcggcgagaagcgacuugccuaugcacggauucccgcgcaucagguguuguacagcaccuccggugaaaacgcuucagggaaguacugcggcaaaacucaaacaaucuuucucaaguauccacaggagaaaaauaacggaccuaagguccccguggaacugcguguuaauauauggcuaggccugagcgccguggagaaaaaguucaacucuuucgcagaggggaccuuuacaguauucgccgaaauguacgagaaucaggcucucauguuuggaaaguggggcacuuccggucuggucgggagacacaaauucagugacgugaccggaaagauuaaacuuaagagggaauuuuucuugccaccgaaaggcugggagugggagggugaauggaucguggacccugagcgcagccuguuaacggaagccgaugcaggccacaccgaguuuacagacgaagucuaucagaacgagucucgguaccccgggggagauuggaagccagcugaggacacuuauaccgaugccaauggcgacaaggcggccucccccucagaacucacauguccuccagggugggagugggaagaugacgcuuggaguuacgauauuaacagagcaguugacgagaaaggaugggaauauggcaucacuauacccccugaucauaagccgaaaagcuggguggccgcugagaagauguaccacacccauaggcgacgccggcugguaagaaaaaggaagaaggaccuuacgcaaacagccucguccaccgcacgugcgauggaggaacugcaggaccaggaggguugggaauacgccucuuugaucggguggaaauuccacuggaagcagcgcagcucagauacuuuucggagaaggcgauggcggcgcaaaauggcuccaagugagacacauggagccgcagcuauuuucaagcucgaaggcgcccugggugcagacaccacugaggauggcgacgagaaaucccuagaaaagcaaaaacacucugccaccacaguguuuggggcuaauacgcccaucgucagcugcaacuucgauagaguguauauuuaccaccugagguguuauguuuaccaggcgcggaaccuccuggcccuugacaaggauuccuuuucagacccuuaugcacauaucugcuucuugcaccgaagcaagaccacugagauaauucauaguacacugaauccaaccugggaucagacaaucaucuucgacgaaguggagauuuacggagagccccaaacugucuuacagaacccuccgaaagugaucauggaacucuuugauaaugaccagguuggcaaggaugaguuccuggggagaucuauuuuuucccccguggucaaacuuaacagcgaaauggacauaaccccaaagcugcuauggcacccuguaaugaauggagacaaagcuuguggcgaugugcucguuacggccgagcugaucuugcgcgguaaggacgggucgaaccugcccauuuuaccaccucagagggcccccaaucucuauauggugccacaaggaauccguccggucgugcagcugacagcuauugaaauccuugcauggggccugcggaacaugaagaauuuccagauggccucaauaaccucuccuaguuugguaguggagugcgguggcgagagagucgaauccguugugaucaaaaaccucaagaaaacucccaauuuuccaagcucugugcuguucaugaaggucuuucuacccaaagaggaacuguacaugccuccacuugugauuaagguuaucgaucacaggcaguucgggcgcaagcccguagugggacaaugcaccauugagcgacucgacagauuucggugugauccuuacgcgggcaaagaagacaucgucccgcagcugaaggcuagcuugcuguccgccccacccugcagggauauagugauugagauggaggacacaaaaccuuuacucgcaucaaagcugacugaaaaagaggaagagaucguugauugguggaguaaguucuaugccagcucuggggaacaugagaaguguggacaguacauccagaaaggcuauuccaagcuuaaaauuuacaacugcgagcuggaaaauguggcugaguuugaagguuugaccgacuucucagauacauucaagcucuaucgcgggaaaagugacgagaacgaggaucccagcgucgugggagaauuuaagggcuccuuccguauauacccacugccugacgaccccucuguaccagcaccuccgagacaauuucgggagcuacccgauucggucccacaggaauguacggugaggaucuauauuguucgcggccuggagcuucagccucaagacaauaacgggcucugcgaucccuacaucaagauuacccugggaaaaaaggugaucgaagaccgagaucacuacauaccaaacacuuugaauccugucuucgguagaauguaugaguuaagcuguuaccugccccaggagaaagaccucaagaucucaguguaugauuacgacacauuuacccgggaugaaaaaguuggcgagacuauuaucgaccuggaaaacagguuccuuucccgcuuugggagucauugcggaauuccggaggaauauugugugucuggcgucaauacauggagagaucagcugaggccaacccaguugcuacaaaacguggcccgguucaaggguuuuccucagcccauccugagcgaggacgggucccguauacgcuacggaggccgagacuauucacucgaugaguucgaagcgaauaaaauucugcaccagcaucuuggcgcuccagaggaaagauuagcccugcacauccucaggacgcagggguugguacccgagcacguggaaacucggacccugcauucuacauuucaaccuaacaucagccagggaaagcuccagauguggguugacgucuucccgaagagucugggucccccaggcccucccuuuaauauuaccccucgcaaagcaaagaaauacuaccuuagagugaucauauggaacacuaaggaugugauucuggacgagaaauccaucacaggggaggaaaugagcgauauuuaugucaagggauggaucccaggcaaugaggaaaacaagcagaaaaccgacguacacuacaggucuuuggauggugaggggaauuucaacuggcgguucguguuucccuucgacuaucuaccugccgagcaacugugcauaguugcuaagaaagaacauuuuuggucaauugaucagacagaguuccgaaucccacccagacucaucauucagaucugggacaaugauaaguuuuccuuagacgauuaccugggauuccuugaacuggaccuccgccacacuauuauaccggccaaaaguccugagaaguguagguuggacaugaucccagaucugaaggcaaugaacccccucaaagcuaagaccgccagccuguuugaacagaaaucgaugaagggcugguggccuugcuaugcggagaaagacggcgcccgggugauggcagggaaggucgagaugacgcuugaaauucuaaaugagaaggaagcugaugagcguccagccggaaaagguagagacgaacccaacaugaauccgaagcuggauuugccuaacaggcccgagacaucuuucuuaugguuuaccaacccaugcaaaacuaugaaguucaucguguggcgccgguuuaaauggguuaucauuggccugcucuuccugcuuauacugcucuuguuuguggcuguccugcuauacucccugccuaauuaucucagcaugaagaucgugaaacccaacguauga

SEQ ID NO: 59433 - RNA, 675 nt, Artificial Sequence
  derived and/or modified sequence opt3 from MYOG__Homo_sapiens__NP_002470
auggagcuguacgaaaccagccccuauuucuaccaggagccuagauuuuaugacggcgaaaacuaccucccagugcaccuucaaggguucgagccgcccggauaugaaaggacagagcugacuuuguccccugaggccccaggucccuuagaagauaagggccuggggacgccugagcauugcccaggacagugucuacccugggcuugcaaagucuguaagcggaaaucuguuucaguggaccgccgacgugcagccacccucagagaaaagaggcggcugaaaaagguaaaugaggcguuugaggcucuuaagcgcaguacacuguugaacccuaaucagagacucccaaaaguggaaauccugaggagcgccauucaguacauagagcggcugcaagcacucuuauccucucugaaccaggaggaacgcgaucuucgauauagaggcggugggggaccgcagcccggcgucccuucggaaugcucaagccacagugccuccuguucuccagaguggggcagcgcuuuggaguucuccgcaaaucccggggaccaucugcuaacugccgauccuaccgacgcucacaaccuccauucacugacaaguaucguggauagcauuaccguugaagacgugucugucgccuuuccagaugagacuaugcccaauuga

SEQ ID NO: 59434 - RNA, 5058 nt, Artificial Sequence
  derived and/or modified sequence opt3 from MYOM1__Homo_sapiens__NP_003794
augagccugcccuucuaccagagaugccaccaacacuaugaccucuccuacaggaacaaggaugugcggucuaccgucucacacuaucagcgcgagaaaaagcgaagugccguuuacacacagggcagcacugcuuauuccucucguucgucagcagcccauagaagggaaagcgaagcguuucggcgcgcuagugccuccucuagccagcaacaggcaucccagcacgcccuuucaagugaagugagcagaaaagcugcaucugccuacgacuauggguccucacauggacugacggauagcaguuuguuacuggacgauuacucuuccaagcuaagcccuaaaccaaagagggcuaagcacucgcuccugucuggugaagaaaaagagaaucuuccguccgacuacauggugcccaucuucucaggccggcagaagcacgugagugggauuaccgauacagaggaagaacgcauaaaagaagccgcggcauauaucgcccaacgaaaccuguuggcuagcgaggagggaauuacuaccuccaagcagucuacagccagcaaacagaccacugcaucaaagcagaguacagcuuccaagcaaagcaccgccucuaaacagucaacggcgaguagacagagcacugccuccaggcaaucugucgugucgaagcaggcaaccagcgcucuccagcaggaagagacauccgagaaaaagucacggaaaguugugauccgugagaaggccgaacgccugagucugagaaaaacucucgaggagaccgaaacauaccaugcuaaguuaaaugaggaccaucugcuucaugccccugaauuuauuaucaagccaaggucucacaccgucugggagaaagaaaacgugaaguugcacuguagcauagcaggcuggcccgagccucggguaacgugguauaaaaaucaaguuccaaucaacgugcaugccaaucccgguaaguacauuaucgagucccgauaugggaugcacacucuggaaauuaacggaugcgauuucgaggacacagcucaguaccgcgcgucagcaaugaaugucaaaggcgaacuaagcgccuaugcuucugugguggucaagagauacaagggcgaguuugaugaaaccagguuccaugccggggcauccacuaugccucucaguuuuggaguuacaccauacgguuaugccagccgguucgagauccacuuugacgauaaauucgacgugucuuuuggccgcgagggggaaaccaugucccugggauguagaguagugauaacgccggagauuaagcauuuccagcccgaaauccagugguacaggaacggcgucccucuuucaccaaguaaaugggugcaaacccuguggagcggugagcgugcuacauugacuuuuucgcaccucaauaaggaggacgaagggcuguauaccauucggguucgaaugggagaguacuaugaacaguacuccgccuauguguucgucagagaugcagacgcggagaucgaaggcgcucccgccgcaccuuuagaugugaaaugccuggaggccaacaaggacuacaucauuauaucuuggaagcagccagcuguagauggcgggagccccauccucggauacuucauugacaaaugugagguugguacagauucauggagucagugcaaugacacuccggugaaguuugccagguucccugucaccggccuuaucgaagggcgcuccuauauauuucgggugagagcagucaacaaaaugggaauuggcuuccccucuagggugagcgagccaguugcugcccuggauccugcggaaaaggcccgcuugaaaucccgacccucagcuccauggacaggucaaaucaucgugaccgaggaagaacccagcgaggggauuguaccuggcccaccgacugaccuaagugucacggaagcaacacggucuuacgugguucuguccuggaagcccccuggacagcguggccacgaggggaucauguauuuuguggaaaagugugaggccggaaccgaaaauuggcagagagucaacacugagcucccagugaaaagccccagguucgcucuguuugaucuugccgaggguaagucguacugcuuccgcguacgguguucaaacucugcaggcgugggggaaccuagugaggcgaccgaaguuacagucgugggagacaaacuggacauuccaaaggcccccggcaaaauaaucccguccagaaauaccgauacuagcguggucguuucuugggaggagagcaaggacgcuaaagaauugguggguuauuacauugaggccuccguggcagggucaggcaagugggaaccuugcaacaauaacccaguaaagggaaguagguuuacaugucauggccucgucacggggcagagcuauaucuuccgagugcgcgcuguuaaugccgcaggacugucugaguacucccaagauucagaagccaucgaggugaaagcugcgauugguggcggggucagucccgacgugugcccugccuuaagcgaugagcccggaggccugaccgcaucccgggguagaguucacgaggcuucuccaccuacuuuucagaaggacgcccuacucgggucgaaacccaacaagccaagccugccgucauccagucagaaucuuggccaaacagaggugucuaaaguaagcgaaaccguccaggaggaauugacaccucccccacagaaggccgcuccccagggaaaguccaaaucagauccucugaagaaaaagacugacagggcaccacccucuccuccgugcgauauaaccugucucgagagcuuccgugacaguauggugcugggcuggaaacaaccagauaagaucgggggagccgagauuacgggcuacuaugugaacuaccgcgaagucaucgacgguguucccgggaaguggcgggaggcgaaugugaaagcuguauccgaagaggccuauaagauuagcaaccuuaaagaaaauaugguguaccaguuucaggucgcagccaugaacauggcuggacugggcgcaccuucugccgugucagagugcuucaagugugaggaauggaccaucgcgguuccaggucccccucauuccuugaaaugcagugaggugagaaaggauagccucguccugcaguggaagccgcccgugcacucgggcaggacaccaguuacuggguauuucguggacuuaaaagaagcuaaggccaaagaggaccaauggcgaggacugaaugaggcagccauaaagaacgucuaccuaaaaguacggggccucaaggaaggggugucuuauguuuuucgcgugagagcuaucaaucaggccggagucggcaaaccuuccgaucuggcaggucccgugguagcugagaccaggccagggacaaaggaaguggucguuaacguggacgaugacggagugauuagccuuaacuucgagugugauaagaugacuccuaaaucagaauuuaguuggucuaaggacuacgucuccaccgaggauagcccccgguuggagguggaaucaaaaggcaauaagacgaaaaugacauucaaggaccuggguauggaugaccucggcaucuacaguugcgauguuaccgacacugaugggauugccagcuccuaucugaucgacgaggaagaguuaaagcgacugcuugcguugucucacgaacauaaauuuccaacaguaccgguaaagagcgagcucgccgucgagauacuggaaaaaggacaggugagauucuggaugcaggcagagaagcuauccggcaacgcuaaaguuaauuacauuuuuaacgaaaaggagaucuucgaagggccuaaguauaaaaugcacauugaccgcaauaccggaaucauagagauguuuauggagaagcugcaagaugaagacgagggcacuuacaccuuccagcuccaggaugguaaagccacaaaccauucaacggugguccuggugggggacguauuuaagaaacuucaaaaggaagcugaguuccagaggcaggaguggauccguaagcagggaccccacuuugucgaauauuugucuugggaggugaccggcgaauguaauguucuguuaaaaugcaagguggcaaacauuaaaaaggagacucauaucgucugguacaaagaugaacgggagauuaguguggacgagaagcacgauuucaaggacgguaucuguacacuccugauaaccgaguucucgaaaaaggaugccggcauuuaugagguuauccuuaaagacgauagagggaaggacaaaagcaggcugaaguugguggacgaagccuuuaaagagcucaugauggaagucugcaagaagaucgcucuguccgcgacagaucuaaaaauucaaucuacugcagagggaauccagcuguacucauucgugaccuacuauguagaggaccucaaggugaauuggagccacaacggcuccgccauucgcuacagugaucgaguuaaaacgggggucacaggagaacagauauggcugcagaucaaugagccaacccccaacgacaagggcaaauaugugauggaacuuuuugaugguaagacugggcaucaaaagaccguggacuugucuggacaggcuuacgaugaggccuaugcagaguuccagagacugaaacaggccgcuauugcggagaagaaucgggccagggucuuaggcggccucccugacguagugacaauccaagaggggaaagcacugaaccuuacuuguaauguuuggggagauccacccccugaagugagcuggcugaagaacgagaaagcucuagccucagacgaucacugcaaccucaaguuugaagcaggucgcaccgccuacuucacaauuaauggcgucuccacggcugacagugggaaguauggacuggugguuaaaaacaaguacggcagcgagaccucugauuuuacuguguccgucuucaucccggaggaagaggcccguauggcggcauuggaaucacugaaaggugggaagaaagccaaguga

SEQ ID NO: 59435 - RNA, 4398 nt, Artificial Sequence
  derived and/or modified sequence opt3 from MYOM2__Homo_sapiens__NP_003961
augagccuggugaccguccccuucuaccagaagagacacaggcauuuugaccaauccuaucggaacauccagacacgcuaccuccuugaugaguaugccucuaaaaagcgagcuucaacucaggcaaguagccagaaaucccugucucaacguucgucaagccagagagccaguucccagacgucuuugggcgggaccauuugcaggguuugugcgaagcgggugagcacacaggaagacgaggaacaagagaaucgcuccagauaccagucauuaguagcugccuauggagaagcaaaaaggcagcgguuccugagugagcuagcccaccucgaggaagaugugcaucuggcucgcagccaggcacgagacaaacuugauaaguacgccauacaacagaugauggaggacaaacuggcuugggaaagacacacuuuugaggagaggaucucucgggccccugaaauuuugguccgucuccgcucccauaccgugugggagagaaugucaguuaagcugugcuucacagugcaggguuuuccaaccccggucgugcaaugguauaaagauggcagccugaucugucaggcggcagaacccgggaaguacaggauugagaguaacuacggaguacacacucucgaaaucaaucgggccgacuucgaugacacagcuaccuauucugccguugcaacgaacgcucacggccagguguccacuaaugccgcggucguggugcgacgcuuuagaggugaugaggagccuuucaggagcgucggguuaccaauaggacugccccuuucgucuaugaucccuuacacccauuuugacguucaguucuuggaaaaauuuggcgugacauuccggcgcgagggcgaaacuguaacccugaagugcacaaugcuagugaccccagaucucaagagaguccaacccagggccgagugguaucgugacgacgugcugcuuaaagaauccaaguggacgaaaauguuuuucggggagggacaggcaucacugaguuucagccacuugcauaaggaugacgagggucucuacacucugcggauuguuucccgaggcggggugucugaucacagcgccuuuuuauucgucagagacgcugauccucuggugacaggagcuccaggcgccccgauggaccuccagugucacgaugcaaacagggacuauguaaucguuaccuggaaacccccuaauacuacaaccgaaucaccagugauggguuacuuugucgaucgcugcgagguggggacgaacaauuggguccaguguaacgacgcccccgugaagauuugcaaauauccuguuaccggacuuuucgaaggccggaguuacaucuuuagagugagggcuguaaauuccgcgggcauaagccgcccaucucgagucucagaugcaguggccgcucuggaccccuuggaccuacggcgucugcaagccguucaucucgagggggaaaaggagauugcaaucuaccaggaugaccuggagggagaugcccaggugccggguccucccacaggcguccacgcuagugaaauuagcagaaacuaugugguacuuuccugggagccaccuacucccagggggaaggacccacugauguacuucaucgaaaaaucugugguuggaucgggcagcuggcagcgcgucaaugcccaaaccgcagugcggucccccagauaugcgguguuugauuugauggaggguaagucauacgucuucaggguucucagugcuaaccgacaugggcugucugagccuagcgaaaucacauccccaauucaggcccaggacgugacugugguaccgucagcacccggccgcgucuuagccagccggaauaccaaaacaucugugguugugcagugggauagaccuaagcacgaggaagaccugcuaggauauuacgucgauuguugcguggcuggcaccaaccucugggagccauguaaccauaaacccauaggguauaauagguuuguugugcacggacugacuacgggugaacaauacaucuuccguguaaaggccgucaacgcagugggcauguccgagaauagucaggagagcgacgugauuaagguccaggcugcccuuacaguuccuucucacccauacgggaucaccuugcugaacugcgauggacauuccaugacucucggcuggaaagugcccaaguuuucaggugggaguccgauacugggcuauuaccuugacaaacgcgaaguacaccauaagaauuggcacgaggugaacagcucgccuuccaaaccaaccauucugacagucgauggauugaccgaaggcucucucuaugaguucaagaucgcggccgugaaucuggcugggaucggagaacccagcgacccuucagagcacuuuaagugcgaggcauggacuaugcccgaaccagguccugccuacgacuuaacauucugugagguucgggauacgagucuggugaugcuauggaaagcucccgucuauuccggcucuagcccaguguccggguacuucguugacuuuagagaagaggaugccggagaauggauuaccgugaaccaaacuacaaccgcaucaagguaucucaaggucagcgaccugcagcagggcaaaacauacguauuccgagugcgggcgguuaaugccaacgguguggggaagccgagugauacuucugagccuguccuuguggaggcucgccccggcaccaaagaaaucuccgccggaguagacgagcagggcaauauuuacuugggguuugauugccaagaaaugacggacgcaagccaguucaccugguguaagucguaugaggagauaucagaugacgaaagauuuaagaucgagacagugggagaucauucuaaacuguaccucaagaacccagacaaagaagaucugggcacuuauagugucuccguuagcgacaccgacggugugucuagcuccuucguguuagaucccgaggaacuggagaggcuuauggcuuugucaaaugagauuaagaacccuacaaucccacucaaaagugaacuggccuacgagaucuuugacaaggggcggguccgauucuggcuacaggcagaacaccugagccccgaugccucuuauagauuuauuauaaaugaccgcgagguguccgauucagaaauccauaggauuaaaugcgacaaggcuacuggaaucauugagaugguuauggaucguuucaguaucgagaacgaaggcaccuacacgguacagauacacgacgguaaggcgaaaagccaauccucucucgugcugaucggcgaugccuuuaagacaguccuugaggaagcagaguuccagcggaaagaauuuuugagaaagcaggggccucauuucgcugaguaucugcacugggacgugaccgaggaaugugagguuagguuagugugcaaagucgccaacacuaagaaggaaacaguguucaaauggcucaaggaugacguacuguacgagaccgagacucuuccgaaucuggaacgcggaauuugugaguugcucaucccaaaacugucgaagaaagaccacggcgaauacaaggccacccuaaaggaugaccgagggcaggaugucagcauucuggagaucgcuggaaaaguguaugacgauaugauacucgcaaugucaagaguuugcggcaaguccgccaguccccugaaagugcuuuguacaccugaagguauucgguugcaaugcuuuaugaaguacuucacggacgagaugaaagucaacuggugucauaaggaugcgaagaucucuagcuccgagcacaugaggauugggggaucagaagagauggcuuggcugcagaucugcgaaccaaccgagaaagacaagggcaaauauacuuuugaaauauucgaugguaaggacaaucaucagcgcucuuuagaucucagcggccaagccuuugacgaggcauucgccgaguuucagcaguucaaagcugcagccuuugcggaaaagaaccgugggagacugaucggaggccuucccgaugugguuacaauuauggaggggaaaacccugaaucuaacaugcacuguguucggaaacccugacccggaagucaucugguuuaagaaugaccaggauauucaacucagugagcacuucuccgugaagguagaacaggcuaaauacgugagcaugaccaucaagggcguuacgucugaggacucagguaaauauuccauaaacauuaagaauaaauacgggggagagaagaucgaugucacagugaguguguauaagcauggcgaaaagauccccgacauggccccaccucagcaggcaaagcccaaacugauuccagccagcgcuucggccgcaggucaauga

SEQ ID NO: 59436 - RNA, 945 nt, Artificial Sequence
  derived and/or modified sequence opt3 from MYOT__Homo_sapiens__NP_001129412
auggccagaaggcugcucggcccccagaacgcugcagccguguuccaagcgcaggacgauagcggggcucaggacucccagcaacacaauucugagcaugcccggcuucaggucccuaccucacagguucgcagucgaagcacaucccguggagaugugaacgaccaggaugcaauccaagaaaaguuuuacccaccgagauucauucagguacccgagaauaugucuauagacgaagguagguuuugccggauggauuucaaagugucgggccugccugccccagacgucucaugguauuugaacgggcgcacugugcagagcgaugacuuacacaagaugaucguuagugagaaaggacugcauucccuaauuuuugaaguggucagagcuucugaugcaggcgccuacgcuuguguggccaagaauagggcgggugaggcaacguucaccguacagcucgacguucuggccaaagagcacaagcgggcucccauguuuaucuauaagccucaaagcaaaaaggugcuugaaggggauuccgucaaacuggagugccagauuucagccaucccacccccuaaguuguucuggaaacgcaacaaugaaauggugcaguuuaacacagaccgaauaagucucuaccaagacaauacuggaagagugacccugcugaucaaggaugucaacaagaaagacgcaggcugguauacaguuagcgcugugaaugaggccggcguaaccacuuguaacacaaggcucgaugugaccgcgcggccaaaucagacguuaccggcccccaagcagcugcguguccgcccuacuuucucuaaauaccuugcauugaacgggaagggacugaaugugaaacaggcuuuuaacccagagggugaguuccaaagacuagccgcucaguccggccucuaugagucagaagaacuguga

SEQ ID NO: 59437 - RNA, 900 nt, Artificial Sequence
  derived and/or modified sequence opt3 from MYOZ1__Homo_sapiens__NP_067068
augccccugagcggcaccccugccccaaacaagaaaagaaaguccucuaaacucaucauggagcuuacagggggaggucaggaaucaaguggccugaauuuggggaagaaaauuagcgugccgagggacgucauguuagaggaacugucccuacucacuaaccggggaucuaagauguucaagcugcgccaaaugcgaguugagaaauuuauauacgaaaaucaccccgauguguucucggacucaagcauggaucauuuucagaaguuccuuccuacgguaggcggucagcuggggaccgcuggacagggcuuuaguuauuccaaaucuaacggccgugggggaagccaagccgguggcuccgggucagcaggacaguacggcagugaccagcagcaccauuuggguagcgggucuggagcgggcggcacagggggaccagcuggucaagccggcagagggggagcagccggcacugcuggugugggggagaccggcuccggagaucaggcaggcggggagggaaagcacaucacagucuucaaaaccuauauuucacccugggaaagggccauggguguggacccucagcagaagauggagcucggcaucgaucugcuggcuuacggggccaaggcggaacucccaaaauauaagagcuuuaaucggacugcaaugcccuacggaggcuaugagaaagccaguaagcgcaugacauuccaaaugccuaaauuugacuuagguccacugcuuucugagccguugguucuguacaaccagaaucuauccaacagacccagcuucaauaggaccccuauuccauggcucucgucuggggaacccguggauuacaacgucgacaucggcauaccucuggauggagagacggaggaacuuuga

SEQ ID NO: 59438 - RNA, 795 nt, Artificial Sequence
  derived and/or modified sequence opt3 from MYOZ2__Homo_sapiens__NP_057683
augcugagccacaacaccaugaugaagcagagaaaacaacaggccacagcuaucaugaaggaggugcauggcaaugacgucgaugggauggaccucgguaaaaagguuuccauucccagggauauaaugcuugaggaacugucucacuugucaaaccggggagcacgcuuauucaaaaugcgacagcguagaagugacaaguacacuuuugaaaauuuccaguaucaaagcagggcccagaucaaccauuccauugcgaugcagaauggcaagguggaugggucuaaccuggagggaggcucgcagcaagcuccucuaacgccaccgaauacccccgacccucggucaccacccaacccugauaauaucgccccagguuacagcgggccccucaaagaaauuccuccagagaaguuuaacacaacugcaguaccgaaauauuaccagagucccugggagcaggccaucuccaaugacccugaacugcuugaggcucuguauccaaaguuguucaaacccgaaggaaaggcagagcucccugauuaccgcucuuuuaacagaguggccaccccauucggcggcuuugagaaggcuagcaggauggucaaauucaaggugcccgacuuugaacugcugcucuuaacagauccgcgguucauguccuuuguuaauccucugucagggcgccgaaguuucaacagaacccccaaaggauggauaagcgagaauaucccaauugugaucacuacagaaccuaccgacgauacgacuguccccgagucugaagaccuuuga

SEQ ID NO: 59439 - RNA, 756 nt, Artificial Sequence
  derived and/or modified sequence opt3 from MYOZ3__Homo_sapiens__XP_011536006
augauccccaaggagcagaaaggcccugugauggccgcuaugggggaccugaccgaaccagucccgacacucgaucuuggaaagaaacugagcguuccccaagacuugaugauggaggaauuaucccugagaaacaauagggguucucuacucuuccagaagcggcagcgccgagugcagaaauuuacuuucgagcuggcagccucacaacgugcgaugcuugcuggcagugccagaaggaagguaacggggaccgcagaaagcggaacaguggccaacgcuaauggcccugaggguccaaacuaccgguccgagcugcacauuuuucccgcaucuccuggggccucguugggaggcccagaaggcgcucaucccgccgcggccccugcagggugcgucccaucaccgagcgcucucgcccccggauaugcagagccucugaagggugugccacccgaaaaauucaaucacacugcuauaaguaagggcuaccgcuguccuuggcaggaguuuguuuccuauagagauuaccagucugacgggaggagccauaccccaucccccaacgauuaucggaauuucaacaaaacaccggugccuuuuggaggcccccuggucggugggaccuucccacgcccuggaacucccuuuaucccagagccccucucaggcuuagaacugcuucgauugagaccuaguuucaauaggguggcccagggcuggguacggaaccugccagagagcgaggaacuauga

SEQ ID NO: 59440 - RNA, 3963 nt, Artificial Sequence
  derived and/or modified sequence opt3 from MYPN__Homo_sapiens__NP_001243196
augcaggacgauagcauugaggccuccaccucuauuucacaacugcucagagaaaguuaccuugcugagacaaggcaccggggcaacaaugaacgcagccgagcagagcccuccucuaacccuugccauuucgggucgccaucaggagccgcggaagguggcgggggacaggacgaucugccggacuugagcgccuuuuuaagucaggaggagcuggaugaauccgugaaucuagcccgucucgcaauaaacuaugacccccuggagaaggccgaugaaacucaggcuagaaaaaggcuuucuccugaccaaaugaagcacagcccaaaucuguccuucgagcccaacuuuugucaggauaauccucggucaccaacgaguagcaaagagucuccccaggaagcaaagcgcccucaguacugcuccgagacccaaagcaaaaaggucuucuugaacaaggccgcugacuuuaucgaggagcucagcagucuguucaaaucucauuccagcaagagaauuaggccacgggccuguaaaaaucacaagucgaaacuggaaucucagaacaagguuaugcaggaaaauuccucaaguuuuagcgaucucuccgagcgccgagaaagaucuagcgugccgauccccauuccugcggacacaagggauaacgagguaaaucaugcauuagaacagcaagaggccaagcggcgugaagcugagcaggccgcaucagaggcugccggcggugacacuaccccagggaguucccccagcucucuguauuacgaggaaccucuuggacagccaccccgcuucacacaaaaauugagaucaagggaagugccggagggcacccggguccagcuggacugcaucgugguuggcauaccucccccacaggugcgaugguauugugaagggaaggagcuagagaacaguccugauauccacauuguccaggcgggaaaucuccacagccugacuaucgccgaagcauuugaggaagacacaggucgcuacuccugcuucgcuucuaacauuuauggcaccgauucgacgagcgccgagaucuacauagaggggguguccucaagugacucugaaggagaucccaacaaagaggaaaugaauagaauccaaaagccaaacgagguaagcagucccccuacuaccucagcuguuaucccaccggccgugccccaggcacagcaucuugucgcccagccuaggguggcuacaauucaacagugucagagcccaacuaauuaccugcagggcuuggacgguaaacccaucaucgcggcaccuguguuuaccaagaugcuccaaaaccugucugccuccgaagggcaguuagucguuuucgagugccgggugaaaggagcuccaagucccaagguagagugguaucgcgaaggcacacugauugaggauagcccggacuuuagaauacuccagaagaaaccuaggucuauggccgaaccagaggaaaucuguacccuugugauugcagaggucuucgccgaggauuccggcugcuucacguguacugcuucaaauaaguacgggacagugaguagcaucgcccagcugcacguucguggaaacgaagacuugucgaauaacgguucccuacauucugcaaauagcaccacuaaccuggcggcuauagagccccaaccuucacccccacacagugaaccucccuccguggagcagccaccgaaaccuaagcucgaaggcguccuggugaaucacaacgagccccggucuagcucccgaauugggcuuagaguacauuuuaaucugccagaggaugacaaaggaucagaagccagcagugaggcaggcguugugacaaccaggcagacgcgccccgacucuuuccaagaacgguuuaacggucaggccaccaagacaccugagccauccagccccgucaaggagccuccgccaguguuggcuaaacccaagcucgauucgacucagcugcagcaauuacacaaucagguccugcuagaacagcaucagcuccaaaacccuccacccucaucuccuaaagaguucccguuuaguaugaccgugcugaacuccaaugcucccccagcaguuacaacuagcucuaaacaggugaaagcuccuagcucccagaccuucucacuugccagacccaaguacuuuuucccaaguacaaacaccacugcggccacgguagcuccuucaucuucccccgucuuuacauugucaaguaccccacagacuauccaaaggaccgugagcaaggaaucccugcucguuucucacccgucggugcagacaaaaagcccugggggccugucaauccagaaugagccccuuccacccggaccuaccgaaccaacucccccuccguucacauuuuccauuccaaguggcaaccaauuccagccccgcugcgucucuccuauccccgugagcccaacgucccggauucagaauccuguagcauuucugucaucuguguugcccagccucccagccauaccuccgaccaacgcuauggggcugccccgaagugccccauccaugccuagccagggauuagcaaagaaaaauacuaagucuccccaaccaguuaacgacgauaauauccgugagacaaagaacgcggucauuagagaccuggguaagaagaucaccuucucagaugugaggccuaaucagcaggaguauaaaaucuccaguuucgaacagcgccuaaugaacgagauugaauuucggcucgagagaacacccguggacgaaagcgaugacgagauacaacaugaugagaucccgacuggcaagugcauugccccaaucuucgacaaaaggcugaagcacuuucgagucaccgaagggucgccuguuacguucaccuguaaaauugugggaauccccgugccaaagguauauugguuuaaagauggcaagcagauaucuaagcgcaaugagcacugcaaaaugcggagagaaggugacgggacauguucccuucauaucgagagcacuaccucagaugacgacggcaacuacacaauuauggcugccaauccccagggaaggaucaguugcucuggccacuugaugguccagucccugccuauucguagccgccucacuucagcagggcaaagucaucggggaagaagcagggugcaggaacgagauaaggagccgcugcaggagcgguucuuucgcccccacuucuuacaggcuccaggugacaugguugcccacgaaggcagacuguguaggcuugauugcaaaguguccggguugccucccccugagcucaccuggcugcuaaacggacaaccaguccugcccgacgcaucucauaagaugcucgugcgggaaacgggcguucacagccugcuuaucgauccuuugacacagcgagacgccgguaccuauaaauguauagcuacuaacaagacagggcaaaauuccuuuucacuggaguuaucugugguagcgaaggaggucaaaaaggccccagugauucucgaaaaacugcagaacugcggcgugcccgagggacauccggucagacuugaaugucgcguuaucggcaugccuccacccguguucuacuggaagaaagauaaugagaccauuccuugcacuagggaacguaucaguaugcaccaggacaccacaggguacgcaugucuguugauacagccagcuaagaagucggaugccggaugguauacgcucagcgccaaaaacgaggcuggcaucguauccugcaccgcacggcuggacauuuacgcccaguggcaucaccaaauucccccgccuaugucugugagacccucagguagcagguaugggucccuaacuuccaagggacuggauaucuuuucugcguucagcucaauggaguccacaauggucuacaguugcagcucucgcuccgugguugaaucagacgagcucuga

SEQ ID NO: 59441 - RNA, 3456 nt, Artificial Sequence
  derived and/or modified sequence opt3 from MYRF__Homo_sapiens__NP_001120864
auggagguggucgacgaaaccgaggcccugcagagauucuuugaaggccacgauaucaacggggcucucgagcccagcaauauugacacauccauacuugaagaguacaucucuaaggaggaugcaucagaccugugcuucccugauauuagugccccagcgagcuccgcuucuuauucgcauggacaaccggccaugcccgguucaagcggcguucaccauuugaguccuccagggggaggccccuccccugguaggcacgggccauuacccccuccaggauacggcacuccgcugaacuguaauaacaauaacggcaugggggcagcccccaaaccuuuuccaggagguacggggcccccuaucaaggcugaaccaaaagcacccuaugccccgggcacccuaccugacucucccccagauagcggauccgaggcuuacucaccucaacaggugaaugaaccccaucuccugcggacaauuacuccagagacccuuugccacguaggcgugcccagucgccuggagcacccuccaccgcccccugcccauuugccaggucccccuccacccccgccuccacccccucacuaucccguccuccagcgagaccuguacaugaaggcggaaccaccuaucccccauuaugcagccauggggcagggacuggugccaacagaucuccaccacacccagcagagccagauguuacaucaacugcuucagcagcacggcgcugaguugccgacucauccuucuaaaaagcguaagcacuccgaaucacccccaagcacacugaacgcccagaugcuaaauggcaugauaaaacaagagcccgggaccguuacggcacucccucugcauccaacuagagcucccaguccuccguggccaccccagggaccucuuucuccaggucccggcucccugccuuugagcaucgccagggugcagaccccgcccuggcacccaccuggggcgcccucgccaggacuccugcaagacucugauuccuuaucaggcaguuaccuggacccuaacuaccagagcauuaaguggcagccccaccagcaaaauaaaugggccacacucuaugaugcaaacuacaaggaacuuccaaugcugacuuaucgggucgacgcugacaaagguuucaauuuuuccgugggggaugacgccuucguaugucagaagaagaaccauuuucagguuaccguguacaucggcauguugggagagccgaaauaugucaagacaccugagggccuaaaaccccuggauugcuucuaccucaagcugcacggggugaaacuugaagcucugaaucagucuauuaacaucgagcaaagccagucagaccgcaguaagagaccauuuaaccccgugaccgucaauuugccuccagaacagguuacgaaagugacuguaggaaggcuccauuucuccgagacaaccgccaacaauaugcggaagaaggguaaacccaacccugaucagcgcuauuuuaugcugguggucgcauuacaagcccacgcucagaaucagaacuacacucuggcggcacagauaagcgaacgaauuaucgugagagccucuaauccgggccaauucgagucagacagugauguucuauggcagagggcucaggugccagacacagucuuucaccaugggcgggugggaauuaacaccgaucgucccgacgaggcccucguaguucacggcaaugugaaggucauggguagccugaugcauccuuccgaucuucgcgcaaaagaacacgugcaagaggucgacacgaccgaacaguugaagagaaucucuaggaugcggcuggugcauuaccgauauaaacccgaguucgccgcuucggccgggaucgaagcaacagcgccagagacuggcguuauugcucaggaggugaaggaaauacucccugaggccguaaaggacaccggagauauggucuucgcaaacggcaaaacaaucgaaaauuuucuggugguuaacaaggagcgcauuuucauggagaaugugggggccgucaaagaacuuuguaagcugacugacaacuuggagaccagaaucgaugaacucgagagguggagccacaaacuggcuaaguuacggcgccuggacucccuaaagucaacaggaaguucuggugccuuuagccacgcaggcucccaguucucaagagcugggagcgugccccauaaaaagaggccaccuaaaguagccucuaaguccaguagcgugguuccggaucaagcgugcauaucucagcguuuucuccagggaaccauuaucgcccuggucguggugauggcuuucuccgucguuucaaugaguacucuuuacguguugagccugcggacggaagaggaccucguggauacagacggcucguuugcaguauccaccucuugucuguuagcccugcuucgaccccagccaccuggugggagcgaggcuuugugccccuggucaagucaauccuucggcacuacccagcucagacagucuccacugacaaccggacuaccuggcauccagcccagccugcuccuggucacuacaucccuuacgucaagcgccccggggagugcagugaggaccuuggauauguguucuucccacccaugcccuguuauuuguugcagcucgcccacuacaaauccaaccacaggacccucacugggcccuucuuuuaacccgggucauguguuaagucccuccccaagcccuucuacuaaccgcagcgggcccucccaaauggcgcuccugccugucaccaauauccgggccaaaucauggggacuuagugugaacggcauuggucacagcaagcaucacaagucucuggaaccauuggcuucccccgccguuccuuucccaggcgggcagggaaaagcaaagaauagccccagucucggcuuucacgggagagcuaggcgcggagcccugcagagcuccgugggcccggcagagccuacgugggcccaaggucagucugcuucgcuacuggcggaaccaguacccagccucaccucaauacagguccuggagaacuccaugaguaucacaucucaguauugcgccccuggggacgcaugucgaccaggaaauuucacuuaccauauucccgugagcuccggcaccccgcuucacuugucacugacauuacaaaugaacucuagcaguccuguguccgucguucucugcagccugcggucuaaagaggaacccugugaggaagguucacuuccacagucccugcauacucaccaggauacccagggcacgagucaccguuggccuaucacaauccuaucauuuagagaguucaccuaucauuucaggguggcucuccuggggcaagccaauugcucgucugaagccuuggcucagcccgcaacugacuaccacuuucauuucuaucgccugugugauuga

SEQ ID NO: 59442 - RNA, 2208 nt, Artificial Sequence
  derived and/or modified sequence opt3 from MYRFL__Homo_sapiens__XP_011537358
augaacuucaccgccacaacucagacggagaugaccagcagauccaggucuucagaagugcaagaccccgauagugagggccagaaucggaugccuacagaccagugcagcccagcucugaaguggcagccgugucacuccguccccuggcauucucuccuuaacucgcacuacgaaaaacugccugauguuggguaucgcgugguaacugacaagggauuuaauuucucaccagcagaugaggccuuugugugccagaaaaagaaccauuuccagaucaccauucacauacaggucugggguagccccaaauuuguggaaacagagaugggcuugaagccuaucgagauguucuacuuaaagguuuuugggaccaaaguggaagcgacuaaucagauuaucgcuauugagcaaagucaggccgaccgauccaagaaaaucuucaacccagucaagauagaucugcuagcagaccaggugacaaaaguaacccucggacgucugcauuuuucugaaacgacugccaauaacaugagaaagaagggcaaacccaauccugaucagagguauuucaugcuuguugugggucuguacgcugcaaaccaagaccaguuuuauuugcucagcgcccacaucuccgagcggauuaucguccgcgcuucaaauccagggcaguucgagaacgauagugacgcccuguggcaaagaggacaggugccggaaagcauugugugucacggcagggucggcaucaauaccgaugcgcccgacgaggcacugguugugugcgggaacaugaagguaaugggaacaauaaugcauccuucugacucccgggccaaacagaauauucaggaaguggauacuaacgagcaacucaagcgcaucgcucagaugcgaauugucgaauacgacuauaaaccagaguuugccucagcaauggguaucaacaccgcucaccagacaggcaugaucgcccaggaggugcaagaaauuuuacccagagcgguuagggaggugggggaugucaccuguggaaauggcgaaacgcuggagaacuuccuuaugguggacaaggaucagauauucauggaaaauguaggugccguuaaacaguugugcaagcugacuaacaaucuagaggagcggaucgaggaacucgaaauuuggaaccguaagcuggcacgccuuaaaagacugagcaguuggaagucuuccgcuagcgaggccucgacaaucucuaaauccucaagggcugugagugccagcuccccucggcgagcaguccauaagaaaaauaacaagguguacuuuucugggaagcgccaggccuguccaaauugggucuuccaaaccuuggugauaacucucauugcuguuauggcguuuugcgcacugacaaucguggccuuauacauccugagccucaaagaccaggauagaaggguacccaaccuuccgccuucaaauauuaccaguucccaggaacccgcucuguugccaacggccucuagcucagcaccuaacaccagucuagucacaacucccgccagccugcaagugccagagaucaccuucugugagauucuccccugccaagaaacauauuguugcccuauacggggaaugaaggagguuuccucuucgccagugcagcgccagagcgaagagaaagaguuucaccaaagaaggugguccgaagacaagucaaaaaguguccuggcucguaaugcccuuucuggcccggauugggagagcgacuggaucgauacuaccauuuccucaauccagaucauggaaauucagcagauaaucgaccaccaauacugcauucagagccugcaguguggcucugggaacuauaauuacaacauccccgugaacaagcauacaccuaccaauguaaaguucuccuuggagauuaacacuacggaaccacucaucguguuucagugcaaauucacacugggaaauauauguuuucacaguaagcgggguaccaaaggcuuagagagccaucgagagaucucucaagaaaugacucagggguaucagcacauuuggucccugcccguugcaccuuucucagacaguauguuucauuucagagucgcggcuccagaucuagccgacugcagcaccgaucccuacuuugcaggaaucuucuucacagacuacuuuuucuauuuuuacaggcgcugugccuga

SEQ ID NO: 59443 - RNA, 2580 nt, Artificial Sequence
  derived and/or modified sequence opt3 from MYRIP__Homo_sapiens__NP_001271352
augggcagaaagcuggaccucagcgggcuuaccgaugacgagacagaacacgugcugcaggucguucaaagggauuucaacuugcggaaaaaggaggaagaacgcuuauccgaacugaaacagaagcuagacgaggagggaucuaaaugcucaauccucaguaagcaucagcaguuuguggaacacuguugcaugcgauguugcagccccuucacuuuucugguaaauacgaagcgucaauguggugauugcaaauucaacguguguaaguccugcuguucuuaccagaaacaugagaaggccugggucugcugugugugccagcaggcuagacuucugagggcacaaucguuggaaugguuuuauaauaacguuaaaucacgguucaagcgcuuuggcagcgccaaggugcucaaaaaucuguacagaaagcacaggcuggagaguggggcgugcuucgacauucucggaggcuccuuauuugagucuaaccuggaaaaugaggguagcauauccgggucagauaguaccuucuaucggcagagcgaaggacauucugucauggacacacuugcuguggccuugcgcguagcagaggaagccaucgaggaggcuauuuccaaagcagaagccuacggcgauucacuggacaagcagaacgaggcuagcuaucuacgagaucacaaagaagaacucacugaggagcuggccaccacaauccuucagaagauuaucagaaaacaaaagaguaagucugagcagcagguugaagaggaaccuggcuggccacacccgcaauccuguagcaccaaaguggcggacgaggggacuucggcaucucccggagguuacagggccccugcugcccuguggcggucccagucagcauuuaguauaacaggcgaagaggcuuugaagaccccacccgucgaggccccuagccgucagccacgcgaucaggggcaacaucccagagcggaauccgcccucccuucuuggaaaagcguggacaggcuggacgagacgaauuuagcaccagugcugcagucaccggauggaaacugggucgcucucaaggacggcgcucccccuccaacucggcuucuggccaaacccaagagugguaccuuccaggccuuggaaguugcauccagcguggccucugcuuaugaugagauggggucagacagugaggaagauuuugacuggagcgaggcgcuauccaagcugugcccucgaucucgcgcacucccaagaaauccccagccgcaaccuacacaggcccagucgagcgaucagggacccaucgcugccuccccaucaagugcacugucuccuaaccccgaagccauguguagcgacuccgagacuucaagcgcuggcuccuccagggaaguaggccaccaagcccggcuuaguuggcugcagcgcaaagcaccaagaaaucccgcggcugagaagaugagguugcauggggagcucgaugugaacuucaauccucagcuggccagccgugaaaccucugacuccucagagccagaagaggcaccgcacacaaccgaucggcgagccagaagguggcgccgggcuagauuaggaagugaggagcccagcaaagagccuucguccccaucugcccagcugagggaccuagacacgcaccaagucagcgaugaccucucagaaacugauauuaguaacgaggcacgcgacccccagacacugaccgauacuacagaagagaagcgacggaaccgucuuuacgaauuggcuaugaaaauguccgagaaggagaccucuagcggugaagaccaggaguccgaaccuaagacggagucagagaaucaaaaagaaagccugaguucugaggauaacucccagagcgugcaggaggaacucaagaaaaaguucucggccguuucacugugcaauaucucuaccgaagugcuuaaagucauuaacgcgacagaggagcugaucgccggcaguacugggccaugggaaucuccccaggugccgccugacagacaaaagggaauguuuccaaggggcaccgaucagguacgcuuggacgagcagcucacaagccuggaagagaauguuuacuuagcugcagguacuguguaugggcuggaaacccagcuaacagagcucgaggaugccgcucgguguauacauucuggcaccgacgaaacucaccuggccgaucuugaggaccaagucgcaacggcggccgcucaggugcaucacgccgaauugcagauuagcgacaucgaguccagaauuucagcacugacaaucgcuggacucaacaucgcccccugcgucagguucacccgacgccgggaucagaagcaaagaacucaggugcagaccauugacacaaguaggcaacagcgucgcaaacugccugcacccccaguuaaggccgagaaaauagaaaccagcucugugacuacaaucaagacguuuaaucauaacuucauuuuacagggcuccucaaccaaucggacuaaagagagaaaggggacaaccaaagaucugauggaaccugcucuugagagugcgguaauguacuga

SEQ ID NO: 59444 - RNA, 3366 nt, Artificial Sequence
  derived and/or modified sequence opt3 from MYT1__Homo_sapiens__NP_004526
augagccuggagaacgaagacaagagagccaggacccgguccaaagcucuccgcggcccuccugagacaacugcagccgaucuuucuugcccaacgccgggguguaccggaucaggucacgugcgaggcaaguacagucgucauagaagccugcaguccugccccuuggcgaaaaagaggaaauuagaaggggcugaggccgaacaccuggucucuaagcggaagucgcauccucuaaaacucgcacuggacgagggauauggcguugauucagacgguagcgaggauacagaagugaaggacgccaguguauccgaugagucugaagggacucuugagggagcugaggcagaaaccagcggccaagacgagauccaccgcccagaaacagccgagggcagaucccccgugaaaucacauuucgggaguaauccuauuggaagcgcuaccgccucuuccaaggguucauacagcaguuaucagggcauaaucgcgacuucucuguugaaccucgggcagauugcagaagagacacuggucgaggaagaucugggacaggccgcuaaaccaggccccgguaucgugcaccucuuacaagaggccgcagaaggggcugccuccgaggaaggagagaagggccuguuuauucagccugaggacgcggaagagguuguggaagucaccacggagaggagccaggaucuuuguccacagucguuggaagacgccgcaucugaggaguccucaaagcaaaaaggcauccugagucacgaagaggaagaugaggaggaagaggaagaggaagaggaggaagaggaagacgaggaagaggaggaagaggaagaggaagaggaggaagaggaagaggaggaagaggaagaggaagaggaggaagaggaagaggaagaggaggaagaggcugccccggacgugauauuccaggaagauacuagccauaccuccgcucagaaggcccccgagcuacgggggccugaaucuccaagccccaaaccugaguacucaguaaucguugaggugcgcagugacgaugacaaggaugaagacacacacucccgaaaaagcacugucaccgaugagucugaaaugcaggacaugaugacaagaggaaaucucggucugcuugagcaagcaauugcccugaaggcugaacaggugaggaccgugugcgaaccaggcugucccccggcggagcagucacaauuggggcucggagaaccuggcaaagcagccaagccccuggauacgguccggaagaguuauuacagcaaagacccaucccgugcugagaagcgcgaaaucaaaugcccuacucccgguugugaugggacaggccauguuaccggauuauauccacaccacagaucucugucgggcugcccccauaaggacaggauuccuccagagauccucgccaugcacgagaacgugcuuaaauguccgacucccgggugcacaggacagggucauguaaauagcaaccggaauacccaccgaucccugucaggcuguccuauagcagccgcugaaaaguuggccaagagucaugagaaacagcagccacaaacgggggaccccucuaagagcuccucaaacagcgaucgcauucuaagaccuaugugcuuugugaaacagcuggaagucccacccuacggaucuuacaggccgaauguggcacccgcgaccccacgggcuaaccucgccaaggagcuggaaaaauucuccaagguuacauuugacuaugcaaguuucgaugcccagguguuuggcaagcgcaugcuugcucccaaaauccagacuagcgagaccucuccuaaggccuuccaaugcuuugacuacucccaggaugcagaggcugcccacauggcggccacagcuauucugaauuugucaacuagauguugggaaaugcccgagaaccucaguaccaaaccacaggaccugccuagcaagucggucgauaucgaaguggacgagaaugguacauuagaucuguccaugcacaaacauaggaagcgugaaaacgcauuccccucuagcucaaguugcuccucuagcccagggguaaaguccccggacgccucacagcggcacagcaguaccucugcuccuuccagcucgaugacuucaccccaaucuagucaggccucccgacaggaugagugggacagaccacuagauuauacgaaacccagcaggcuccgcgaggaggagccugaagagucugagccagcagcgcauagcuuugccuccucagaagcugacgaccaggagguuagugaagagaauuucgaggaacggaaguaccccggcgaggugacacugaccaacuuuaaacuuaaguucuugagcaaagauaucaagaaagaacugcucacuuguccuaccccgggaugcgacggcucugggcacauuacaggaaacuaugccucccacagaucacugagugguuguccacuugcagauaagagccugaggaauuugauggcugcccauuccgcagaccucaagugccccaccccuggcugugaugggucuggacacauaacuggcaacuacgccucgcaucgcagccugucagguugcccacgagcuaaaaaguccggggucaaaguggcgcccacaaaggacgauaaagaggacccugaauuaaugaaguguccgguccccggcugcgugggacugggccacaucagugggaaguaugccucucaucggagcgcauccggauguccacuagcugcccguagacaaaaagagggcucacucaaugguucuagcuucaguuggaagucccugaaaaacgaagggccuacgugccccaccccaggaugcgauggcagcggucacgccaauggcucuuuucuuacucacaggucauuguccggguguccucgcgcuacauucgcaggaaagaaaggcaagcugaguggggacgagguucucagccccaaguuuaaaaccucggaugugcuggagaacgacgaagagauuaagcaguuaaaucaggaaauccgggaucugaacgagucuaauuccgaaauggaggccgcgaugguacaacuucagagccagauaucaaguauggagaaaaacuugaagaauauugaagaggaaaacaaacucaucgaggagcagaaugaagcucuguuccuagagcugucuggacucucccaagcccugauccagagccuugcaaacauuagauugccacauauggaaccgaucugcgagcagaauuuugacgccuacgucucaacacugacugacauguacaguaaccaggauccugaaaacaaggacuuacucgagagcauuaagcaagcugugaggggcauacagguuuga

SEQ ID NO: 59445 - RNA, 3561 nt, Artificial Sequence
  derived and/or modified sequence opt3 from MYT1L__Homo_sapiens__NP_001289981
auggagguggacaccgaagagaagagacacaggacacggagcaaaggcguccgcguucccguggaaccugccauccaggagcuguucuccugcccaacuccggggugugauggaucuggucauguaucaggcaaguacgcucgacaccguaguguguaugggugcccccucgccaaaaagagaaaaacgcaagacaagcagccucaggaaccagcacccaagaggaaaccuuuugcggucaaggcugauagcuccucuguggacgagugugaugacucggauggaaccgaggacauggaugaaaaagaggaagacgagggcgaggaauacucagaggauaacgacgaaccaggugaugaggacgaagaggacgaggaaggggaucgggaggaagaggaagagauugaggaagaggacgaagaugacgaugaggacggagaagauguugaggacgaggaagaggaagaggaggaagaggaagaggaagaggaggaagaggaaaaugaggaucaucagaugaacugccacaauacacgcauaaugcaagacacugaaaaggaugacaacaauaacgacgaguaugauaauuacgacgagcuuguggccaaaagccuguugaacuuaggcaagaucgcagaagaugccgcuuauagagcaaggaccgagagugaaaugaacuccaauacaucuaauagccuggaggacgauuccgacaagaacgaaaaucuaggccggaaaucagagcucagucuggaucuugacagcgaugucgugcgcgagaccguagacucucugaaguugcucgcccaggggcauggaguugugcuguccgaaaacaugaaugaucgaaacuacgcugacucaaugagccagcaggauaguagaaacaugaauuaugucaugcuggguaaacccaugaacaauggccucauggagaagaugguggaagagucugacgaggaaguguguuuauccagccuggagugccuuaggaaccaauguuucgacuuggcccggaaacugucggaaacuaauccucaggagcguaacccacagcagaauaugaacauucgccaacacgucagaccggaagaggauuuucccgggaggacaccugaccggaauuacucugauaugcuaaaccucaugcgacuggaggaacagcuuuccccacgcucaagaguuuucgcgaguugcgcaaaggaggacggaugucacgaaagggaugacgauaccacgagcguaaauuccgaccggucugaggaaguguuugauaugacuaaaggcaaccugaccuugcucgagaaggccaucgcucuggagacagaacgcgccaaggcaaugagagagaaaauggcuauggaagccgguaggcgugacaauaugcggagcuacgaggaucagucaccccgacaauuaccuggggaagacagaaagccaaaaaguuccgauagccaugugaagaaacccuauuacggaaaggacccgucuaggacugagaagaaagagucaaagugcccuacccccggcugugacggcacagggcacgucaccggacuguauccacaucaccgcagucucagcgguugcccucacaaagaucgggugcccccagaaauucuugcgaugcaugaguccguucugaagugccccacgccuggcuguacugggagaggacacgugaacucuaauaggaacucgcaucgcagcuuguccggcugcccaaucgccgcagcugaaaaacuagccaaggcucaggagaagcaccagucaugugacgucaguaaaucuagccaggccuccgaucgagugcugcggccgaugugcuucguaaagcaacucgagauaccccaguacgguuaucguaacaauguuccuacaaccacuccaagaucaaaccuggcaaaagaacuugagaaguacagcaaaacaucuuuugaauauaauuccuacgacaaccauaccuacgggaagagggccaucgcucccaaggugcagacgcgcgauauuaguccuaaaggcuaugacgaugcgaagcgguacuguaaagacccaagccccucuuccucaaguaccagcucguaugcaccguccucuagcucaaaucugaguugcggaggcggguccucugccagcuccacauguucaaagagcaguuucgauuacacucacgacauggaggcugcccacauggcagccaccgcuaucuugaaccucucuacaagaugcagggaaaugccucagaaucuguccacuaaaccacaagauuuaugugccacccgaaaccccgacauggaggucgacgagaauggaacacuggaucuaagcaugaacaagcagcgcccucgggacucgugcugucccauucucaccccacuggaaccuaugucaccccagcagcaagcagugaugaauaacagaugcuuucagcuuggugagggcgauugcugggacuugccagucgauuauacuaaaaugaagccgaggcguaucgacgaagaugagucuaaggacauaacgccugaagaucuggaccccuuccaggaggcgcucgaggaacgccgguacccaggggaggugacaauucccaguccuaaaccaaaguauccccaguguaaagaauccaagaaagaucugaucacccuuagcggaugcccucuggcugacaagucuauuagaagcauguuggccacuuccucacaagagcucaaguguccgaccccaggcugcgaugguagugggcauaucacaggcaauuacgcaagccacaggucucuguccggauguccccgagccaaaaagucaggcauccggauugcucagaguaaagaagacaaggaggaccaggagccuauacgcugcccaguucccgggugugauggacaaggucauaucaccggcaaauacgccagccacagauccgcaucugggugcccuuuagcugccaagaggcagaaggacggauaucugaacggcucgcaguuuagcuggaaaucagugaagacugaagguauguccuguccgacacccgggugcgauggcaguggacacguaucuggcagcuuccuaacgcaucggucccucucaggguguccacgagcgaccucugccaugaaaaaggcuaaacugagcggagagcagaugcuuacuauuaagcaaagagcaaguaauggcaucgaaaacgacgaggagauaaagcaguuggaugaagagauuaaagaacugaacgaguccaauagccagauggaagccgacaugaucaagcuccgcacacagaucaccacaauggagucuaaccugaaaacuauugaggaagagaauaaggucaucgaacaacagaacgagucauuacugcacgaacuugcuaauuugucccagagucucauucauagccuggccaacauacagcuaccucacauggaucccaucaaugagcaaaacuuugacgcauacgugaccacgcugaccgagauguauacaaaucaggauagguaccagucgccagaaaacaaagcgcuccuggagaauauuaagcaagccguucgugguauccagguguga

SEQ ID NO: 59446 - RNA, 1401 nt, Artificial Sequence
  derived and/or modified sequence opt3 from MYZAP__Homo_sapiens__NP_001018110
augcugagaagcaccuccacagugacucuccuuucuggcggggccgcuaggacgcccggagcaccuucacggcgcgccaacgucugccgacugcguuugaccguuccaccggagagucccgugccugaacagugugagaagaaaaucgaaagaaaggagcaauuacuggaccuaagcaauggugaaccaacaaggaaacucccccagggcguaguguacggggucgugcggcgcuccgaucagaaccagcaaaaggagaugguuguguauggauggucuacuucgcagcugaaagaggaaaugaauuacauuaaggacgucagagcgacccuugagaaggugaggaaacggauguauggcgauuacgacgaaaugcgccagaagauacgacagcugacacaagaguugucaguaagccacgcucagcaggaguaucucgaaaaccauauccagacccaaaguuccgcccuggauagauucaaugcaaugaacucugcccuggcuagcgacuccauuggucuccagaaaacuuuaguugaugugacacuggaaaauucaaacaucaaggaccagauuaggaaucuucaacagaccuacgaggcaaguauggauaaauugcgggagaagcagcgucagcuggaagucgcccaaguggagaaccagcuacucaagaugaaaguggagagcucucaggaagcuaaugccgaggucaugcgcgaaaugacgaagaaacuguauucccaguacgaggaaaaacuucaagaggagcagagaaagcacucagcggaaaaggaggcacuguuggaagagacuaacagcuuucucaaagccaucgaagaggcuaauaagaagaugcaggccgcagagauaagucuggaagagaaagaccagaggaucggggaauuagaucggcugauugagcgaauggagaaggaacgccaucaacuccagcuucagcuguuggagcacgaaaccgagaugucuggagaacuaacagacuccgauaaagagagauaccagcaacuggaggaagcuagcgccucgcucagggagcggauccgccaucuggacgacaugguucacugccagcagaagaaagugaagcaaaugguagaagagauugaaucucuuaagaaaaagcugcagcagaaacaguugcucauccugcaauuacuggagaagauauccuuccuagagggcgaaaacaaugagcuccagucaagacuggauuaucuuacugaaacccaggcgaaaacagagguggaaaccagggagauuggcgucgggugugacuugcugccuagucagacgggacguacucgggagaucgugaugccaagccgaaacuacacacccuauaccagaguucucgaacugacuaugaagaagacacuuaccuga

SEQ ID NO: 59447 - RNA, 570 nt, Artificial Sequence
  derived and/or modified sequence opt3 from MZB1__Homo_sapiens__NP_057543
augagacugagccucccccuucuguuguuacugcuaggcgccugggcuaucccugggggacucggugacagggcaccacugaccgccacagcgccgcagcuugaugacgaggaaauguacuccgcucacaugcccgcccaucugcggugcgaugcaugucgcgccguggcuuaucaaauguggcagaacuuggcaaaggccgagacuaaacuccacacgucuaauucaggcgggcgacgugaacugagugagcuggucuacaccgacguucucgauagaagcugcuccaggaacuggcaggacuauggagugcgggaaguagaucaggugaagcgcuuaacaggcccuggucugucugaggggccagagcccucgauuucagucauggugacuggaggcccuuggccaaccagacuuagcaggacauguuugcauuaccugggcgaguucggggaggaccaaauauaugaagcucaccagcagggacggggugcccuagaggcgcuccugugcggcgggccccagggagcauguagugagaaaguuuccgccacccgcgaagaacuuuga

SEQ ID NO: 59448 - RNA, 873 nt, Artificial Sequence
  derived and/or modified sequence opt3 from MZF1__Homo_sapiens__NP_001253962
augagacccgccgugcugggcagcccugacagggcuccaccggaggaugaagggcccgucaugguuaagcucgaggacuccgaagaggaaggagaggcagcccuuugggauccugguccagaggcggcucggcugcgcuuccgaugcuuucguuacgaagaggccaccggcccccaggaagcauuggcccaauuaagagagcuguguaggcaguggcuacggccugaggugcgcucuaaagaacagaugcucgagcugcuuguacuggaacaguucuugggggcucucccacccgagauccaagcaagagugcagggacagaggccuggcucaccagaagaggccgcugcccuggucgacggucugcggcgcgagcccgggggaccccgaagaugggugacaguucaggugcaaggccaggaaguccucagugagaagauggaaccuagcuccuuucagccauuacccgagacugaaccuccaacgcccgagccgggcccuaaaaccccgccaaggacaaugcaggagucuccucuggggcuucaagugaaggaagagucggaaguaacugaggauucagacuucuuggaaagcggaccccuggcggcaacccaggagaguguuccaacacuacuccccgaggaagcccagcggugcgguaccgugcuggaucaaauuuuuccucacuccaaaacuggcccagaggggccgucuuggcgugaacauccccgcgcucuuuggcacgaggaggccggaggcauauucagcccuggugcaggggcuggagccgcgccagcccugggcgcaggcugguugggggcugccgucgcuauguauguggccagauguuccgcaaacgccgcuacaugcuga

SEQ ID NO: 59449 - RNA, 2691 nt, Artificial Sequence
  derived and/or modified sequence opt3 from N4BP1__Homo_sapiens__NP_694574
auggccgcuagagcagugcuggacgaguucaccgcccccgcggaaaaggcugagcuccuugaacagagcaggggccggaucgaggggcuguuuggagucuccuuggccguuuuaggugcacugggcgccgaagaaccucuaccagcucgcauuuggcuccaacugugcggggcacaggaggccgugcacucugcuaaagaauacauaaagggaaucugugagccggaacuugaggagcgagaaugcuaucccaaagauaugcauuguauuuucguaggcgccgagucacuguuuuugaagagucucauccaggacacaugcgcggaucuguguauucuggacaucggucucuuagggauacguggaagcgcagaagccguggucauggcuagaucccacauccagcaauucgugaaacuguuugagaacaaggaaaaucuuccuucuucgcagaaggagucagagguuaaaagggaauuuaagcaguuuguggaggcccaugcagauaacuacacuauggacuugcugauucuaccaacgagccucaaaaaggaacugcuuacccugacacagggcgaggaaaauuuguucgagacuggcgaugacgaggucaucgaaaugcgggauagucaacagaccgaguuuacacagaacgcugccaccgggcucaauauuucccgcgacgaaacugugcugcaggaggaagcgagaaacaaagccggaacacccguaucugaguuaaccaagcaaauggauacgguucugagcuccucaccugacguccucuucgauccaaucaauggucuuacucccgacgaggaagcacugaguaacgagaggauaugccagaagcggcgcuuuagcgacucugaggagcgacacaccaaaaagcaguucuccuuggagaaugugcaagaaggcgagauucuacaugaugcuaaaacacuggccgggaacgugaucgcugaccucucagauagcagugccgacucugaaaaucuguccccugauauuaaggagacuaccgaagagauggaguauaacauccuugugaauuucuucaaaacaaugggauacagccaggaaaucgucgagaagguuauuaaaguguauggcccaucgaccgaaccgcuguugcuccuggaggaaauagagaaggagaacaagagauuccaggaagacagggaguuuucugcagguacgguauaccccgaaacuaauaaaacaaagaacaaagggguguauuccucaaccaacgaguuaacuacagauaguaccccuaagaaaacgcaggcccacacccaacagaauauggucgaaaaguucagccagcugccauuuaagguggaggcuaaacccuguacauccaacugccggaucaauacuuuccguaccguuccuauugagcagaagcacgaaguguggggaucuaaccaaaauuacaucuguaacacagacccagagacugauggccuaagccccucagucgcgaguccguccccuaaagaagugaauuuuguaagccgcggcgcaucuucacaucagcccagaguuccacucuucccugagaacgggcugcaccagcagcccgagccacuuuugcccaauaacaugaagagugccugcgaaaaacgacugggauguugcagcuccccucauucuaagccaaauugcucgacccucagcccgcccaugccucugccacaacuucugcccuccgugacagacgcucggucagccgguccuagugaucacauagacucuagcgucaccggcgugcagcgauuucgcgacacuuugaagauuccauacaaacucgagcugaagaacgaacccgggagaacggauuuaaaacacaucgucaucgacggauccaauguggcaauuacacauggccugaagaaauucuuuucauguagggguaucgccauugcuguugaguauuucuggaagcuagggaaccggaauauaaccguguuuguaccgcaguggcgcacuagaagggauccuaacgucaccgaacagcacuuccucacacaacugcaggagcuuggcaucuugagccugaccccagcccguaugguguuuggagagcggauugcaucucaugacgaucgauuccuccugcacuuagcggacaagacuggcgggaucaucguuacaaacgauaauuucagagaauuugugaacgaguccgucaguuggagggaaauuauaacgaaacgccugcuucaguacaccuucgugggagacaucuuuaugguacccgaugacccuuugggucggagcggccccagacucgaggaguuccugcaaaaggaagugugccuaagggauaugcagccacugcucucugcucugccuaauguugggauguuugaccccuccuuccgcgucccaggaacucaggccgcaucaacaagucaucagccgccuaccaggauucaaggcgcccccagcucgcacuggcuuccacagcagccccacuuuccuuugcugccagcuuuacccucccuccagcaaaaccugccuaugccggcccagcggucuagcgcagagacaaaugaacuucgugaggcucuguugaaaaucuucccagauucagaacagagacucaagauugaccagauccugguggcccaucccuauaugaaagaccuaaacgcgcugagugccauggugcucgauuga

SEQ ID NO: 59450 - RNA, 522 nt, Artificial Sequence
  derived and/or modified sequence opt3 from N4BP2L1__Homo_sapiens__NP_001073159
auggaggacagcuuccugcaguccuuuggcagacucucucuucaaccccagcagcagcaacagaggcagcggccuccacgcccgcccccucgagggaccccaccccguagacacucauucaggaagcaucuguacuuguuacggggacugccugguaguggcaaaacaacucuagcccgccagcuccaacacgauuuuccaagagcucugaucuucagcacggacgacuuuuucuuuagggaagauggggcauaugaguucaaccccgauuuucuugaagaggcccaugaauggaaucagaagcgggcgcgcaaagcuaugcgaaacggaauuuccccuauaaucauugacaauaccaaccugcacgccugggagaugaagccauacgcagugauggucuuccagacagagcagaaaaauuuguuuagacucgaaauggauaugguuguguucaggccggagaugaagaagcauucuuggugccugaaacggaagaaucccccuaacgaacguacuguauga

SEQ ID NO: 59451 - RNA, 2214 nt, Artificial Sequence
  derived and/or modified sequence opt3 from N4BP2L2__Homo_sapiens__NP_001265361
auggcccugugcagcgcucucaugaccaucuucacaauuaagaugggcacugcaaaacaggccauagaccaagggagaucccccgugaucauugauaacacgaauauccaggcgugggagaugaagccuuacgucgaaguugcuauuggaaaagguuauaggguggaguuucacgaaccagagaccugguggaaguucgacccggaagaacuugagaaacggaacaagcauggcguaucucgcaagaaaaucgcccagaugcuggaucgauacgaauaucagaugucaauaaguaucgugaugaauagcgucgagcccucccacaagucuacacaacguccuccacccccucaggggagacagagggaacggguguugaaaaagacuggacaucgcuuaucgaaaaccaagcagaagagaaacaggaaacggaauaagaaacaaaacucacagaaucgcauuauggaggagaacagccuggaauuucuaagugaccucacaccaggcgaucaggaccccucccagucugaggaagaggauaucgaaaagacccgaagagagagcgaguacccuuucauugacggucugcaaaaugaaguuggggauuuugugacuggauauaaagagaagagguggaaaaacaaggacccaaaggauuccuuccagaaugucaugucaaucguggaacuugacaacacaccgaaaaauuaccugaguaaggagggcgauaacuuguuuguaagccuccugcugcggcccaaugaaauaucuguuaccuguccuauucucacgcagaacuuauccugcgugacuaccgacgacuguucaggcaugaaagucgagaagcacauccguaaccgccauacaauugcacuggauacucaagaccuuagcgccgagaccaguugcuuguucaugaaaaagagagaaaucguggauaagaaucugucucacgagccaauccuaugucaccagcaugggauuaggauguccgacaaagugcuccgggaggagcaggucuauacaaccaagauaaaccacugggcauuuuucacgacuaaucugagcgaugaagaccuucagcugggaucggaucgacaacccuacuuugguucuuggccugcuggcccacauaaauucaucugcgagcagcgccccaagaaagacagagccuguaaguuggcugggccggauuccaggggacaguggauucagaugaucuuuacaucaguugccgcgagugagccuggcaacaaucccgaaauacucaccgacaagcuguuaauugguaacgaggauuucagcccaccucccgaaacuauggacuccuucaucgagacaaaucuguuucggucuugccucccacaacccgacaucccuaaaaacgcacuugagagcaccaagaauaaaaagcgcagaaagaagaggauuuucaaccuggugccaaauuuugauuugcuagggcagucacguaucggaguaaaggaacgggagaaaugugaccugcucacgaagaaccacggccugaaaauuacccuuggcgaagagaaggaucgaauaagugaaagaaauuccgaggaggaaaacaaacagaagcugaugacauucgaccaccauccguugugguuuuaccucgauaucauuaaagccacuccccugaauaucgacgggcagagguauagccacugcuuaucuuucaaccgccugcgguguucagcuagucuauacaagaacuauaucccuagcuuugugcuccauaaucuguccucuauuuggaagccaucguucaccaacaaaaaguuguuucuuacauucgagagccaaacuagagucggaaauaaacugaacgaugccgguuuuauaucccccgaaauccuccacucacauccugacaccaguugcucucugggcgugacaagcgauuuccacuuucuuaaugagagguucgaccgcaagcugaaacgaugggaggaaccaaaggaguugcccgcagaagauucccaggaccucaccucaacugauuaccggagccuggaguuaccgcugucucagggguucgcuuuucagcuaguuaaacucuucggauccccuggcgugccaauggaaagucugcuucccgacgacuaugucgugccuuuggauuggaaaacgcugaagaugauuuaccuccaauggaaaaugagcguagagaagcgucagaaaaagaucgguuga

SEQ ID NO: 59452 - RNA, 663 nt, Artificial Sequence
  derived and/or modified sequence opt3 from NAA10__Homo_sapiens__NP_001243048
augaacaucagaaaugccaggcccgaggaccugaugaacaugcagcacugcaaucuccuuugucugccugaaaacuaccaaaugaaguauuacuucuaucauggcuugagcuggccacaguuauccuacauugcugaggaugaaaaugggaaaauagugggauauguccuggcaaagauggaggaagacccggaugacguuccccacggucauaucaccucucuagccgugaaacggucacaccgccgacucggccuggcgcagaaacuuauggaucaggcuagucgugccaugauugagaacuuuaaugcaaaguacguaagccugcaugugagaaagaggaucuccgaggucgaaccuaaguauuacgccgacggggaggaugcuuacgcaaugaaacgggacuugacacaaauggccgaugaacuccgcagacaccuggagcugaaggagaaaggaaggcacgugguucucggcgcuauugaaaacaagguggagucuaaagguaauucgccacccucaagcggggaagccugccgggaggaaaagggauuagcggcagaggacaguggcggcgauuccaaggaccugucugaggucagcgaaacuacggaguccaccgaugugaaagacucaagugaagccagcgacucugcuuccuga

SEQ ID NO: 59453 - RNA, 2601 nt, Artificial Sequence
  derived and/or modified sequence opt3 from NAA15__Homo_sapiens__NP_476516
augcccgccgugagccugccuccaaaggagaacgcucucuucaaaagaauccuuaggugcuacgaacacaagcaguaucggaauggccugaaauuuuguaagcaaauuuuguccaacccgaaauucgcagagcauggggaaaccuuagccaugaagggacugacacuaaauugccucgguaagaaagaggaagcguacgagcugguccgccgaggccuucguaacgaccugaagucucacguuuguuggcauguguauggguugcuccagagaucagauaaaaaguacgacgaggcuauaaaaugcuauaggaaugcccugaagugggauaaggacaaccugcagauccuccgggauuuaagucugcuucagauucaaaugcgcgacuuggaaggauacagagagacuagguaucagcugcuacagcuccggcccgcacagcgcgccagcuggaucggcuacgcuauugcauaccaccuccuugaagauuaugagauggccgcuaaaauccuggaggaauuucgaaagacgcaacagaccuccccugacaaaguagauuacgaguauucugaauugcuccuguaccagaaucagguguuaagagaggccggucuguauagggaagcgcucgagcaucuuuguacauacgagaagcaaauaugcgacaaacuggcagucgaagagacuaagggggaauugcuacugcagcucugucggcuggaggaugccgcugacguguaucguggacuucaggaacgcaacccagagaauugggccuacuacaaaggccuggagaaggcauugaagcccgcuaacaugcucgaaagacugaaaaucuaugaggaagccuggaccaaguacccuaggggcuuaguuccacggcgacugccccuaaauuuccucucgggggagaaauuuaaggaaugccuggauaaauuccuucgcaugaacuuuucaaagggauguccuccaguguucaauacauugagaagccuguauaaggacaaagagaaggucgcgauuaucgaggaacucgugguagguuacgagaccagucugaaauccugcaggcuuuuuaacccgaaugacgauggcaaggaagaacccccuacuacacuguuguggguucaauauuaccucgcccagcacuaugacaaaauugggcagccaucuaucgcacuggaguacauaaacaccgcuauugaaagcacgcccacuuuaaucgagcuguuccuagugaaggccaagauuuacaaacacgcuggaaacaucaaggaagccgcacgguggauggaugaggcccaggcucucgacaccgcggaucgcuuuaucaauuccaaaugugcaaaguauaugcugaaagccaaccuuauuaaggaagcugaggagaugugcucaaaguucacaagagaaggcaccagugccgucgagaauuugaacgaaaugcaaugcaugugguuucagacugagugugcacaggccuacaaagcuaugaauaaguucggugaagcccugaaaaagugccaugagauagagaggcacuucaucgaaauuacagacgaucaguuugacuuccauaccuauuguaugcguaaaaucacgcuccggagcuacguggaucuguuaaagcuggaggacgugcuucgacaacacccuuuuuauuucaaagcagcgagaauagcuauugaaaucuacuugaagcuccacgauaacccacugacugacgagaauaaggaacaugaggccgacacagcaaacaugucugauaaagagcuaaagaaacugaggaauaagcagcgccgggcccagaaaaaggcucagaucgaagaggaaaagaaaaacgccgagaaggagaaacaacagagaaaucagaagaaaaagaaggacgaugacgaugaagagauugggggacccaaagaggagcucaucccggaaaagcuggcaaaagucgagaccccucuugaggaagcuauuaaguuuuugacuccccugaaaaacuuaguuaagaauaagauagagacacaccucuucgccuuugaaaucuauuucaggaaagagaaguuucugcuuaugcugcaguccgugaaacgcgcguucgccauugacucaagccauccaugguugcacgaaugcaugauccgacucuuuaacaccgcuguaugugagaguaaggaucugucugacacggugcggaccguccuaaaacaagagaugaaucgucuguucggcgcaacaaacccuaagaacuuuaaugaaacuuuccucaaaagaaacuccgauagccugccccauaggcuuucggccgcuaagaugguguacuacuuggacccaucuucccagaagcgcgccaucgagcuggcaaccacauuagaugaaucacucacuaaucggaaccugcagaccugcauggagguucuugaagcgcuguaugacggcagucuaggggauuguaaagaggccgcugagauuuacagagccaauugccacaagcuguuccccuaugcacuggcuuuuaugccuccaggauacgaagaggacaugaaaauaacagugaacggugacagcuccgccgaagcagaggaguuggccaaugaaaucuga

SEQ ID NO: 59454 - RNA, 1290 nt, Artificial Sequence
  derived and/or modified sequence opt3 from NAA16__Homo_sapiens__NP_001104268
augcccaacgugcugcucccuccaaaggagagcaaucuuuucaaaagaauccugaagugcuacgaacagaaacaauauaagaacggcuugaaauuuuguaagaugauuuuauccaauccgaaguucgccgagcacggggaaacccuggcuaugaaaggacuaacacucaacugccuggguaagaaagaggaagcauacgaguuugucaggaagggccuucggaaugacguuaaaucucauguguguuggcacguauaugggcuguugcagcgcucagauaagaaguacgacgaggccauaaaaugcuaucgaaacgcgcucaagcuggauaaagacaaucugcagauccuccgugauuuaagucugcuucagauucaaaugagagacuuggaaggauacagggagacucgguaucagcugcuacagcuccgccccacgcagagagcuagcuggaucggcuacgccauugcauaccaucugcuuaaggauuaugacauggcccugaaauugcucgaagaguucaggcaaacccaacaggugccuccaaacaagaucgauuacgaguauuccgaacugauauuauaccagaaucaggucaugcgggaggcugaccugcuccaggaaucucuugagcacaucgaaauguaugagaaacagauuugugauaagcuguugguggaggaaaucaagggugagauucuacugaaacucgggcgccugaaggaagcaucggagguuuuuaaaaaccuuaucgaccgaaaugccgaaaacuggugcuacuaugagggacuggagaaggcuuugcaaauaucaacacucgaagagagacugcagauuuacgaagagaucagcaaacagcaucccaaggccauuacuccuaggcgguuaccacugacccuagugcccggcgaacguuuccgcgagcucauggauaaguuucugagagucaauuucaguaaaggcuguccuccacuuuuuacaaccuugaagucccuguacuauaacacugagaaagugucuaucauccaggaacucguaacaaauuacgaggcgagccugaagaccugcgacuucuuuuccccguaugaaaacggggagaaagagcccccuacgacucuucuguggguucaauacuucuuggcacagcacuuugacaagcucggacaguauucacuggccuuagauuacauuaacgcugccauagcaaguaccccaacacugaucgaacuauucuauaugaaggcuaaaauuuacaaggugaaaagcgagucuuguuuccucuccucauga

SEQ ID NO: 59455 - RNA, 537 nt, Artificial Sequence
  derived and/or modified sequence opt3 from NAA20__Homo_sapiens__NP_057184
augaccacacugagagccuucacuugcgacgaucucuuuagguucaacaauaucaaccuugacccccugacggagaccuacggcauuccuuuuuauuugcaguacuuagcucacuggccagaauauuucauaguggcagaggcccccgggggagaacugauggguuacaucaugggcaaggcggaggggagcgucgcucgggaagaguggcauggacacguuacagcccuauccguggcaccggaguuucgccgacucggccuggccgcuaaacuuauggaacuguuggaggaaauuucugagcguaaggguggguucuuuguagaucucuucgugagagucucaaaucaaguggcaguuaacauguauaaacagcugggauacaguguguauaggacugucaucgaguacuacagcgccuccaauggcgaaccugacgaggaugcuuaugacaugcggaaggcccugucucgcgauaccgagaaaaagucgauuaucccacucccccauccugugagaccagaagacauagaauga

SEQ ID NO: 59456 - RNA, 2919 nt, Artificial Sequence
  derived and/or modified sequence opt3 from NAA25__Homo_sapiens__NP_079229
auggccaccagaggccacgugcaggaccccaacgauaggcggcugcgcccuaucuacgacuaucucgauaaugggaacaauaagauggcuauucaacaggcagacaaacuucugaagaaacauaaggauuugcacugcgccaaagucuuaaaggcgauaggacugcagcgaacagguaagcaggaggaggcuuucacucuagcccaagagguugcagcccucgaaccaacggacgauaacagccugcaggcucuuaccauccuguaccgugagaugcauagaccggaauuggugacaaaacucuaugaggcagccguaaagaaagugcccaauuccgaggaauaccacucucaucuguuuauggcuuaugccagggucggcgaguacaagaaaaugcagcaggcggggauggcacuguauaagauugugccuaagaacccauacuacuucuggucaguuaugagucucaucaugcaaagcauuuccgcccaggacgaaaauuuaucuaaaacuauguuucugccccuugcugagcggaugguggagaagauggucaaagaagauaagaucgaggccgaagcagagguggaauuguauuacaugauacuggagcgccuaggaaaauaucaggaggcucucgacguaaucagaggcaagcugggugaaaaacuuaccucggagauucagucaagggaaaacaaguguauggccauguacaagaaacugagccgguggccugagugcaaugcguugagucgccgacuccuguuaaagaacuccgaugacuggcaauucuaucugacauacuuugauucuguuuucagacucaucgaagaggccuggagcccacccgcagagggggaacacucccuugagggagaagugcacuauucagcugagaaagccgucaaguuuauugaagacaggaucaccgaggagaguaaaagcucucggcaucugcguggcccucacuuggcuaagcuagaacugauacgcagacucaggucccagggcuguaaugacgaguacaagcugggggauccagaagaacuuauguuccaguacuuuaaaaaguucggagacaaaccgugcuguuuuacugaucugaagguguucguggacuugcuccccgccacacaaugcaccaaauuuauuaaccagcuguuaggugucguuccucugucaacgccaacugaggauaagcuagcacuccccgccgacauccgggcucugcagcagcaucuuugugugguacaauugacccgacugcucggccuguaucacacaauggauaagaaucagaaacuuagcgugguccgcgaacugauguugagauaccagcacgggcucgaguucggaaagacuugccugaaaaccgaauuacaguucagugacuauuacugucugcuagcggugcaugcacucauugauguuuggagggagacaggcgacgaaaccacgguguggcaagcccugacucuuuuggaggagggucugacacacucuccuuccaacgcucaguuuaagcuccuguuaguccggaucuauugcaugcugggggccuucgaaccagugguagaucuuuacagcucguuggacgcaaaacauauccagcacgacaccauuggauaucuccugacucgcuacgccgagucucuaggccaguacgcugccgcaucccaaucauguaauuuugcgcugagauucuuucauaguaaccagaaggauacaagcgaauauauaauccaggcuuacaaguauggcgccuucgagaaaauucccgaauuuaucgcauucaggaaccgucucaauaacucccugcacuuugcccagguucggaccgagcgaaugcuuuuggaccuguuacucgaggcuaauauaucuacgagccuggccgaaucaauuaagaguaugaaccuuagaccggaggaagaugacaucccuugggaggaucugagggacaaucgcgauuugaacguguucuuuuccugggaccccaaagaucgggacgucagcgaagaacacaagaaacucucucuggaggaagagacccuauggcugagaaucaggucacucacacugcgccuuauuaguggguugccaagccugaaucauccuguggaacccaagaacuccgagaaaacugcagagaauggagucucuucgcgaaucgauauuuuacggcuccugcuucaacagcuggaagcuacccuagagacagguaagcguuucauagaaaaggacauccaguacccauuucucggccccgugccuacuagaaugggaggguucuucaacagcggcugcucccaaugccagauuucaaguuuuuaucugguuaaugauaucuacgaguuggacaccucuggucuggaagacacaauggagauccaggagaggauugaaaacagcuucaaauccuuacucgaucagcugaaggacguguuuucaaaauguaagggggaucuucuggagguaaaagacggcaauuugaagacccacccaacucuccuggaaaaccuagucuucuuuguggagacgauaagcguuauccugugggugucuuccuauugcgaaaguguccuucgcccguacaagcucaaucugcaaaagaagaaaaagaaaaagaaggagacaagcauuaucaugcccccuguguucaccucuuuucaggauuacguaacuggauugcagacccugauuuccaacgugguugaccauaucaaaggcuuagagacacaccucauagcccugaaacuugaggagcugaucuuggaagauaccucacucaguccagaggaacggaaauucagcaagacuguccaggggaaagugcaaucguccuaucugcacucucuacuggagaugggagagcuucucaagaagagacuggaaacaacgaaaaaguugaaaauuuga

SEQ ID NO: 59457 - RNA, 1089 nt, Artificial Sequence
  derived and/or modified sequence opt3 from NAA30__Homo_sapiens__NP_001011713
auggccgaggugcccccuggcccaagcucccugcucccgcccccugcuccacccgccccugcagcggucgaaccaagaugccccuucccugcuggggccgcacuugccuguugcucugaggacgaagaggaugacgaggagcacgagggagguggcucaaggaguccagcugggggagaaagcgcaaccguugccgcuaagggccauccgugucugcggugcccccagccuccacaagagcagcagcaguugaacgguuuaaucucccccgaacugcgccaccuacgagccgcggcaucucucaaaucgaaggugcugucaguagccgagguggcugccacaacugcaacgccugaugggggaccacgugcuaccgccacaaaaggcgcgggcguccauagcggggagagacccccgcacagucuuuccucuaaugccaggacugcagugccuagccccguugaagcugccgcugccuccgacccagcagccgcucggaacggacuggcggaggguaccgaacaagaggaagaggaggaagaugaacaggugcgcuugcucucaaguagccugacagcagacuguucucugagauccccuucaggcagggaagucgagcccggggaagaucggaccauucgcuacgugcgauaugagagcgagcuccagaugccagacauaaugagauuaaucacuaaggaucugagugaacccuacucuauuuauacauacagguauuuuauccauaauuggccucagcuuugcuucuuggccaugguaggagaggaauguguuggcgcuauugugugcaaacuggacaugcacaagaagauguuucggcgugguuacaucgccaugcuagcagucgauuccaaauaucgcagaaacgggauaggaaccaaucucgugaagaaagccaucuacgcuaugguggagggcgacugugaugaagucguucuggagacggagauuacuaacaagagcgcccuuaaacuguacgaaaauuugggcuucgugagggacaagcggcucuuucgauauuaccugaacgggguagacgcauuacgccugaagcucuggcuuagauga

SEQ ID NO: 59458 - RNA, 2178 nt, Artificial Sequence
  derived and/or modified sequence opt3 from NAA35__Homo_sapiens__NP_078911
auggugaugaaggccagcgucgacgaugacgauuccggcugggaacugucuaugcccgagaaaauggaaaagucaaacaccaauuggguugacaucacccaggauuucgaagaggcuugcagagaacucaaacuuggggagcuguugcacgacaaguuauuuggacuguucgaggcaaugagugccauugaaaugauggauccuaaaauggacgcggguaugauaggcaaccaagugaauaggaagguacuaaacuuugagcaggcuaucaaggaugggacuauuaaaaucaaggaccucacgcugccagaacuuauuggaaucauggauaccuguuucugcugucugauaacaugguuggagggccauagccucgcccagacuguguuuaccugccuguacauccacaauccggacuucauugaggaucccgcaaugaaagccuuugcucuggguauccucaagauuugugacaucgcacgggaaaaagucaacaaggccgcuguguucgaggaagaggacuuucaguccaugacauauggguucaagauggccaauucuguuaccgauuuacgcgugacuggaaugcugaaagacgucgaagaugacaugcaacgacgugugaagucgacaagaucaaggcagggcgaggagcgggauccugaaguagagcuugaacaucagcagugcuuggcgguuuuuagccgcgugaaauucaccagaguccugcuaacggugcucauagcauuuacuaagaaagagaccagugccguggcugaagcccaaaagcugaugguccaggcagcugaccuucuguccgccauucacaacucuuugcaucacggcauccaggcgcagaaugauacaacuaaaggggaccacccaauuaugaugggauucgagccccucguuaaccaaaggcuguuaccuccaaccuucccccgguacgccaagaucaucaagcgcgaggaaauggugaauuauuuugcacgacugauugauagaauaaaaacaguaugugagguggucaaccucaccaaucuucauugcauccuggacuucuuuugugaguucagcgaacaguccccuugcguguugucaaggagucuacugcagacgacuuuucucguugauaacaagaaaguguucgguacacaccugaugcaagacauggucaaggacgcccuucggagcuuugugucuccaccgguacugucccccaaauguuacuuguauaauaaccaucaggcuaaggauugcauugacucauucguuacccacugcgugcguccuuuuuguagccucauccagauacacggccauaaccgcgcuagacagagggauaagcuggggcacauuuuagaagaguucgccacucugcaagacgaggcagaaaaagucgaugccgcucuacauacaaugcuccugaagcaggagccacagcggcagcaccuugcgugcuugggaaccugggugcuguaccauaaucuccgaaucaugauccaauaucugcuuaguggcuuugaacuggaguuguacucuaugcacgaguacuauuacauuuauugguaccucuccgaguuccuguaugcaugguuaaugagcacgcugucgcgcgccgacgguucucagauggcugaagaaagaaucauggaggaacagcagaaagggagguccucaaagaaaaccaagaagaaaaagaaaguccggccccuaagucgcgagauuacaaugagccaagccuaccagaacaugugugcaggaauguuuaagacuaugguggccuucgauauggacggcaaaguuagaaagccuaaguucgagcucgauuccgaacaggugagguaugagcaccguuuugcuccauucaauucuguaaugacacccccgccuguccauuaccugcaguuuaaagaaaugagcgaccuuaacaaguacucacccccaccucaaagucccgaguuguauguggccgcauccaaacacuuccagcaggcgaagaugauacuggaaaauaucccaaaccccgaucaugagguuaaucggauucucaaaguggcuaagccuaacuuugucgugaugaaacuguuagccggcgggcacaagaaggagagcaaaguaccaccggaguucgacuuuucugcacacaaguacuuccccgugguuaaacuggucuga

SEQ ID NO: 59459 - RNA, 651 nt, Artificial Sequence
  derived and/or modified sequence opt3 from NAA40__Homo_sapiens__NP_001287729
auggacgccgugugcgcuaaggucgaugcagccaacagacugggcgacccccucgaggcguucccuguuuuuaaaaaguacgauaggaaugggcuuaacgugagcaucgaauguaaacggguauccggacuggagccagcuaccguggacugggccuucgauuugacaaagacuaauaugcagacgauguaugaacaaucugagugggguuggaaagaccgcgaaaagcgagaggagaugaccgaugaccgugcaugguacuuaauugccugggaaaacucaagugucccgguggcuuuuagccacuucagauuugauguugagugcggcgacgaagugcuguauuguuacgagguccagcuagaguccaaggugaggcggaaagggcucggaaaguuccugauacagauccuucagcugauggcaaauucuacacaaaugaaaaagguaauguugacuguuuuuaaacauaaccacggcgccuaucaguucuuucgcgaagcucuccaguucgagauugaugacucgucacccagcaugagugguugcuguggggaagauugcuccuacgagauccugucuagaaggaccaaguuuggagacagccaucacucccaugccggcggccacugugggggaugcugucacuga

SEQ ID NO: 59460 - RNA, 510 nt, Artificial Sequence
  derived and/or modified sequence opt3 from NAA50__Homo_sapiens__NP_079422
augaagggcagcagaaucgagcugggggacgugacaccccacaacauuaaacagcucaagaggcuuaaucaagucauauucccuguuuccuacaacgauaaauuuuauaaggacgugcuggaaguaggagaguuggccaaauuagcuuacuucaaugauaucgcagugggugccgucugcugucggguggaccauucucagaaccagaagcgccuguauauuaugacccuaggcugccucgcgccauaccgacgucuggggaucggaacuaagaugcuuaaucacguucugaacauuugugaaaaagauggcacguuugacaauaucuauuugcaugugcagauaucaaacgagagugcuaucgauuucuacagaaaguuugguuucgaaauuaucgagaccaaaaagaauuauuacaaaaggauugagccggccgacgcacacguccuccaaaagaaccugaaggugcccagcgggcagaaugccgauguacagaaaacagacaacuga

SEQ ID NO: 59461 - RNA, 729 nt, Artificial Sequence
  derived and/or modified sequence opt3 from NAA60__Homo_sapiens__NP_001077069
augaccgaggugguccccagcuccgcccugucugaaguuucacucagacuucugugccacgacgauaucgacacagugaagcauuuguguggcgauugguucccuauugaguacccagacaguugguauagggauauaacuagcaacaaaaaguuuuucuccuuagcugcaacguaccgcggggccaucguaggaaugauuguggcggaaaucaaaaaucggaccaagauucacaaagaggacggugauauccuggcuucuaacuuuucggucgacacacagguggccuauauacuaucacucggcguugugaaggaguuccgaaagcaugggaucggaagccugcuucuggaaaguuugaaagaucacauuuccacuaccgcacaagaccauugcaaggccaucuaccuccacguccugacaaccaauaacacugcuauuaauuuuuaugagaaccgugauuucaaacagcaccauuaccugccguauuacuacucuaucagaggcgugcucaaggacgguuuuacauauguauuauacauaaaugggggacaucccccuuggaccauucuggauuauauccagcaccuuggcagcgcauuggccucccugucaccauguaguauuccccacaggguuuaccggcaggcucacagccuacucugcucuuuccugccuugguccggcaucucaagcaaaagugggaucgaauauucucgcacgauguga

SEQ ID NO: 59462 - RNA, 972 nt, Artificial Sequence
  derived and/or modified sequence opt3 from NAAA__Homo_sapiens__NP_001035861
augagaaccgccgacagggaggcucggcccggccugccuagccuccuucuguuguuacuggcaggggccggacuauccgcggcuucuccaccggccgcaccccgcuucaacgugucacucgauagugucccugaacugcgauggcuuccaguucugcgucacuacgacuuggaucucgugagagccgcuauggcacagguaaucggugacagggugcccaaguggguccaugugcugauuggcaaaguugugcuggagcucgaacgguuuuuaccucaaccauucacaggggagauacgcggaaugugcgauuuuaugaaucugagccuugccgacuguuugcuggucaaccuagcuuaugaauccucuguguucugcacuucgaucguagcccaggauucaagaggccacauuuaccaugguaggaaucucgacuaucccuuugggaacguucugcggaaacuuacgguggauguccaguuccugaaaaauggacagaucgcguuuaccggcacaacuuucauuggcuacgugggguuguggaccggacaaagcccucacaaguuuacagugaguggugacgagcgcgauaaaggcugguggugggagaacgcaaucgccgcucucuuccgaagacauauaccagucuccuggcugaucagggccaccuuaucugaaagcgagaauuuugaagcagcuguugggaagcuggccaagacuccgcucauugcggacguguauuacaucguaggaggcacaucaccccgggaggguguggucauuacccguaaccgcgaugggccugccgacaucuggccacuugacccccugaauggagcaugguucagaguggagacgaacuaugaucacuggaaaccugcuccaaaggaagacgauaggcggacuuccgccauaaaggcuuugaaugccaccggccaggcaaaccuaagucuggaggcccucuuucaguga

SEQ ID NO: 59463 - RNA, 2328 nt, Artificial Sequence
  derived and/or modified sequence opt3 from NAALAD2__Homo_sapiens__XP_011540854
auggccuuccaggacugcagauguaggcugcaacggcgccagagcuaccucucccccgaggcucgagaaugcucucguagaccuaaacuuggcccacaggaggcaauggccgaaucaagggggcggcuguauuuguggauguguuuagcggcugcccuggcaaguuuucuaaugggauucaugguggguugguuuaucaagccgcucaaggagaccacaacuagcguccgcuaccaccaguccauuagauggaaacugguuucugaaaugaaggccgagaacauaaaaucguuccuuaggucauuuacgaagcugccccauuuggcuggcaccgagcaaaauuuccuccuggcaaagaaaauccagacacaguggaagaaauuugggcuggauagcgccaagcucgugcacuaugacguauuacugaguuacccuaacgaaacuaaugcuaacuauauuuccaucguggaugagcaugaaaccgagauuuucaaaacaucuuaccuugagccacccccugacggauaugaaaaugucaccaacaucgugccacccuacaaugccuuuagcgcgcagggcaugccugagggugauuugguuuacgugaacuaugcacggacugaagacuucuuuaagcuggagcgcgaaauggggauaaauugcacaggaaagaucgucauugcccgauacggcaaaaucuucagaggcaacaaggugaaaaaugcuaugcuagccggggcaauuggaaucauacucuauuccgauccagcugacuacuuugccccggagguacaacccuauccuaaggguuggaaccugccaggcaccgcggcccagagggggaauguucuuaaccugaauggagcaggcgaucccuugacgccugguuacccagcuaaagaguauacuuuccggcucgacguggaagagggggucggcauuccccguaucccggugcacccuauuggauacaacgaugccgaaauccuguuacgcuaccugggcgggaucgcucccccagacaagucauggaaaggagcccucaacgugaguuauagcauugguccuggcuucaccgggucugauuccuuuagaaaggucaggaugcauguuuacaauauaaacaagaucacacggauuuauaaugugguaggaacuauccgaggcucaguggagcccgaccgcuacgucauacuuggugggcacagagacagcuggguguucggcgcaauugauccaaccaguggaguugccgugcugcaggaaaucgcuaggucuuuuggcaaauugauguccaagggguggcggccccgcagaacaaucauuuucgcgagcugggacgcagaggaguuuggacuacuggguucgaccgaaugggccgaggaaaacgucaaaauccuccaggagaggucuauugcuuauauaaauuccgauucaaguaucgaaggcaacuacacgcugcguguggacuguacuccucuucuguaucaauugguauacaagcucacaaaagagauuccaagcccggaugacggguucgaguccaagucucuguacgaaagcugguuagagaaggaucccucaccugaaaauaaaaaccugccacggaucaauaagcuaggaaguggcuccgacuuugaggccuauuuccagcgacucgguaucgcaagcgggagagccagguacaccaaaaacaagaaaacugauaaguauucuucauaccccguuuaucacacaauuuacgagaccuuugaacugguggagaaguucuaugacccuacguuuaaaaagcagcuuagugucgcucaauugcgcggcgcccugguguacgaacucgucgauagcaaaauaaucccauucaauauucaggacuacgcagaggcgcugaagaacuaugcugccuccaucuacaaucuuucuaaaaagcaugaccagcagcugaccgaucacggagugucguuugacagcuuguucuccgcaguuaagaacuucucagaagccgcuagugauuuucauaaacggcucauucaaguggaccugaauaaccccaucgccguaagaaugaugaacgaucaguuaaugcugcuagagagggcauucauagacccgcucggccugccugggaaguuguuuuaucgccacaucauuuucgcuccaucuagccacaauaaauacgccggagaguccuuucccgguaucuaugaugcgauuuucgacaucgaaaacaaggccaauucacgacuugcuuggaaagaggucaagaaacauauaagcauugcagccuuuacaauccaggcugccgcaggcacucugaaggaagugcucuga

SEQ ID NO: 59464 - RNA, 2223 nt, Artificial Sequence
  derived and/or modified sequence opt3 from NAALADL1__Homo_sapiens__NP_005459
augcaguggaccaaggugcugggccucgggcuuggagccgcugcacuguuggguuuaggcaucauucuggggcacuucgccauacccaaaaaggcgaacagccuagcuccucaagaccucgaucuggagauccuugaaacagucaugggacagcuggacgcccauagaauuagggagaauuugcgggaacucucccgcgagccacaccuggcaucuucaccgcgagaugaagaccugguucagcucuuacugcagcguuggaaagaucccgagaguggccuugacagcgccgaggcuuccacuuacgaaguguugcugucuuuuccuucgcaagagcagccaaacguaguggauaucgucggucccaccgggggaauuauccauucaugccacagaacggaagagaaugugacaggcgagcagggcgggccugacguugugcagccauaugcagccuacgcucccagcggaacuccucaaggucuacucgucuaugccaacaggggcgcggaagaggauuucaaggaacugcagacccaggggauaaaacuugagggaacaaucgcacugacccgguacggcgguguggggcgcggagccaaggcuguaaaugccgcaaagcauggcguugcuggcguguuggucuauacugacccagccgauauuaacgacgggcucaguuccccggaugaaacauuucccaauucuugguaccugccuccaagcggaguggagagagguuccuauuacgaguacuucggcgaccccuuaaccccuuaucugccagcggugcccucaaguuuuagggucgaccucgccaacguuagcggguucccgccuauccccacgcagccaauuggauuucaagaugcacgggaccuucuguguaauuugaacggcacucuagcuccugccaccuggcagggugcucuggggugccacuaccgccucggccccggauuccgaccagauggcgacuuucccgccgauucucaggugaauguauccguguauaacagacuggaacuuaggaacucaagcaauguccuggggaucauacggggagcaguggagccugaccguuacguuuuguaugguaaucaccgcgauaguugggugcauggcgccgucgacccaucuuccgggacagcugugcuccuggaauuaagcagaguacugggaacucuacucaaaaagggcaccuggaggccgcggcgaucgauuguuuucgcgucuuggggugcagaggaauuugggcugaucggcuccacagaguucaccgaggaauuuuucaacaaacuucaagagcgcacgguggccuacauuaacgucgauaucucaguguucgcuaaugccacuuugagaguccagggaacacccccugugcagaguguuguguuuagcgcaaccaaggaaaucagguccccaggccccggggaccugucuauuuaugauaacuggauacgguacuucaaucgcagcucaccuguauacggacucgucccaagucuggguucccuuggcgccgggagcgacuaugcucccuuugugcacuuccugggaaucucuucaauggacauugccuacacuuaugauagaaguaaaacaagcgcaaggaucuacccgaccuaucauacggcguuugacaccuucgauuacguugacaaguuuuuggauccuggcuucuccucucaccaggcuguggcccguacagcagguucggucauacuccggcugagcgacuccuuuuucuuaccacugaaggugucagauuauagugagacucuacgaucuuuucuccaagccgcucagcaggaccugggggcccuuuuggaacagcacagcauuucccugggcccccucguaaccgcaguggagaaauucgaggcugaagccgcggcccugggacaaagaaucucaacauuacagaagggcagcccugauccccugcagguuaggaugcuuaacgaccaguugaugcuccuggagcgcacuuuucuaaauccacgggcuuucccugaagagagauacuacucucauguccugugggcacccaggaccggguccguggugacauucccaggacucaguaacgccuguagccgcgcucgagauaccgccucuggcuccgaggcaugggcggaaguccaacggcagcugucaaucguugugacugcccuugagggugcugccgcaacguugcguccgguggcugaccuguga

SEQ ID NO: 59465 - RNA, 2388 nt, Artificial Sequence
  derived and/or modified sequence opt3 from NAALADL2__Homo_sapiens__NP_996898
augggcgagaacgaagccagccugcccaauaccucccuccaggggaagaaaauggcuuaccaaaaggugcacgcagaccagagagccccuggacauucucaguaucuugauaacgacgaucugcaggcgacagcuuuggacuuagagugggauauggaaaaagagcuggaagagucagguuucgaccaauuucagcuagauggcgccgagaaucagaaccucgggcacagugaaacuaucgaccugaaucuugauagcauucagccagcaacguccccgaagggaagguuccaacggcugcaggaggaaucugacuacauaacccauuauacacgcucggcccccaaaucaaaccgaugcaauuuuugucacgucuugaagauccucugcacugcuaccauucuguucaucuuuggcauucugaucgguuacuauguucauacaaacuguccuagcgaugcaccaaguuccgggaccguggacccccagcucuaccaggagauauuaaagacuauccaagccgaggauauuaaaaagucuuuccguaaucugguacagcuuuauaaaaacgaagacgacauggagaucagcaagaaaauuaagacacaguggaccuccuugggacuggaagaugugcaauuugucaauuacucagugcuacucgaccugccuggcccaagucccagcacgguuacucuuucuuccucaggccagugcuuccacccuaacgggcagccauguagcgaggaagcuagaaaggauaguucucaggaccuguuguacuccuaugccgcguacagcgcaaaaggaacccucaaggccgaggugaucgaugucucguaugguauggcugacgaucugaaaaggauacggaagauuaaaaaugugacaaaccaaaucgccuuacugaagcucggcaaacuuccgcuguuguacaagcuaucuucccuggagaaggcaggguuuggaggcguacuccuguauauugaccccugcgaucuuccuaaaacuguuaauccaucacacgacaccuucauggugagucugaaccccgguggggauccuagcacaccaggauaccccuccgucgacgaaucuuuucgccagagcagaucaaacuugaccagucuccuggugcagccgaucuccgcuccuuuaguggccaagcugaucagcucucccaaagcgaggacgaagaaugaggccuguucaagucuagaacucccaaacaaugagauucgggucguuagcaugcaagugcagacuguaacaaaacugaagaccgugacuaacgucgugggcuucguuaugggccuuacauccccugaccgcuauauaaucguggggucucaucaccauaccgcacacucguacaauggacaggaaugggcuagcuccacggccauuaucaccgcuuuuauacgagccuugaugucaaaggucaaaagagguuggaggcccgaucggacaauuguguucugcaguuggggcgggacugcauucggaaacaucggcucuuacgaguggggugaggacuuuaagaaaguacugcagaagaauguuguggccuauaucagccuccacuccccaauucgugggaacucaagccuguaccccgucgcuucuccuucccuucagcaacugguggucgagaaaaauaacuucaauuguacccgcagagcgcagugcccagaaacaaacaucaguagcauucagauacagggcgaugcagacuauuuuaucaaucauuugggagugccgauuguucaauucgccuacgaagauaucaagacucucgagggccccucuuuucuguccgaagcuagguucucaacccgggccacaaagaucgaggagauggacccuaguuuuaacuuacacgaaaccauuacuaaacugagcggggaggugauacuacagaucgcaaaugaaccaguacuccccuucaacgcccuggauauugcucuugagguccagaacaauuugaagggagaccaaccuaacacgcaucagcugcucgccauggcacugcgauuacgcgagucggcggaacuguuucaguccgaugagaugagaccagcuaaugaccccaaagaaagggccccgauccggauucgcaugcuuaacgauaucuugcaggacauggagaagucuuuccucgugaaacaagcaccuccagguuuuuauagaaauauacuguaccaccuagaugaaaagacaagcagguucucaauccugauugaggccugggagcauuguaagccccucgcuaguaacgaaacccugcaggaggcccuuuccgaaguuuugaacucuaucaauagcgcacagguguauuuuaaagcuggccuggacgucuucaaguccguguuagacgggaaaaauuga

SEQ ID NO: 59466 - RNA, 1464 nt, Artificial Sequence
  derived and/or modified sequence opt3 from NAB1__Homo_sapiens__NP_005957
auggccgcugcacugcccagaacccucggcgagcuucagcuguacaggaucuugcaaaaggccaacuuacugagcuauuucgacgcguuuauucagcaagggggagaugacgugcagcagcuaugcgaagcuggugaggaagaguuccucgaaauaauggcccuggucggcauggcauccaaaccucuucacguucggcgccugcagaaggccuugcgagauugggugacaaauccagggcucuuuaaccagccgcugacuucucugcccguaucaaguaucccuauuuacaaacucccagagggaagccccacgugguuaggcaucuccuguucuucguaugagcguucaagcaaugcuagagaaccucaucugaagauuccaaaaugcgcagccaccacaugugugcagagucuuggucaagggaaguccgacgucgugggaucuuuggcucugcagagcguuggcgaguccaggcuauggcagggccaccaugccacugaaucagagcacagucucagccccgcggaucuggggucuccugcauccccaaaggagucaagcgaagcccuugacgcugccgcagcucugaguguggccgagugcgucgaacggauggcgccgaccuugcccaaaucugaucucaacgaggugaaggaacuguuaaaaacaaauaagaaacuggccaagaugaucggacauauauucgagaugaacgacgaugacccucacaaggaggaagagauccgcaaauacuccgcaauuuaugguagauuugauagcaagaggaaagacggcaagcaccucacccuucaugaacugacuguaaaugaggcugccgcucaguuguguguuaaagauaacgcccuacugacacggcgcgacgaacucuucgcacuggcccgacaaaucucgagagaggugaccuacaaguauacguacaggacuaccaaaucuaagugcggggagcgggacgaacuuuccccaaagcguauuaaagucgaggauggauuucccgacuuccaggauucagugcagacacuguuucaacaggcucgcgcgaagagugaagaguuggcagcccucagcucccagcagccugaaaaagugauggcuaagcaaauggaguuccuguguaaucaggccggcuacgagagauuacagcacgcagaaaggcggcugucugccggucuauaucgacagagcucagaggaacauaguccaaacgggcucacuuccgacaauagcgauggacaaggcgagcgcccccugaaccuuagaaugccgaauuugcagaacaggcagccucaccacuuugucguugacggcgagcugucucggcucuaccccucagaagcuaaaagucauagcuccgagucucuggggauccuuaaggauuauccacacucggccuucacccuggaaaagaaagugauaaagacagagccugaagacagccgcuga

SEQ ID NO: 59467 - RNA, 1578 nt, Artificial Sequence
  derived and/or modified sequence opt3 from NAB2__Homo_sapiens__NP_005958
augcacagagcccccagcccuaccgcugagcagccaccgggcgggggagacuccgcaaggcggacacugcaaccccgccucaagccuucugcccgagcgauggcccuuccacguacucugggugaauugcaguuauacagagugcugcagagggcuaaccuacucucauauuacgagacguucauccagcaaggcggggaugacguccagcagcugugcgaagcaggagaggaagaguuucuugagauuauggcccugguuggcauggcuaccaaacccuugcaugugcggcgccuccagaaggcacugagagaaugggccacaaauccuggucuguucagucaaccaguacccgcugugccugucagcuccauaccacucuuuaaaaucucugagacugccgggaccaggaagggaucgaugucaaacggccacggcagcccgggggaaaaagcgggaagugcacgguccuucucucccaagagcccuuuagagcugggugagaagcuguccccauugcccggcgggccuggagccggcgauccacgcauuuggcccggucgaucaacaccggaaagugacgugggggcuggaggcgaggaagaggccggcagcccucccuuuucucccccugcagggggagguguucccgaaggcaccggggcuggaggccuggccgcgggugggacuggcggaggcccagauagacuagagcccgagauggugaggauggucguggaauccguagagcggaucuuccguucauuuccucgcggggacgccggagaaguuacaagccuccugaaacuuaauaagaaacuggcaagaagugugggucauauuuucgagauggaugacaacgauucucagaaggaagaggagaucaggaaauauuccauaaucuacggccgguuugacagcaagcgacgcgaagggaagcaguugucgcuccacgagcugaccauuaaugaagcugccgcucaguucuguaugagagauaacacguuacugcucaggcgggucgagcuguuuucucuuucccgccaaguggccagagaaucaacuuauuugaguagccuaaaaggauccaggcugcauccagaggagcucggcgguccgccccugaagaaacuuaagcaggaagugggggagcagucucacccugaaauccaacagccacccccuggcccagagagcuacgucccaccguaucguccuucacuggaggaagacagugcauccuugagcggagagucucucgauggccaccuucaggccguugggucaugcccacgguuaacacccccucccgcugaccugccacuagcgcucccugcacauggacuguggagucgacacauucuucagcaaaccuugauggacgaaggucugagacucgccaggcuggugagccaugaucgcguaggccggcuuucccccugugugccagcuaaaccgccucuggccgaguucgaagagggguugcucgacagaugccccgcaccaggaccccacccugcccuggucgagggcaggcgaucuucggugaagguugaagcugaggccagccgccaguga

SEQ ID NO: 59468 - RNA, 615 nt, Artificial Sequence
  derived and/or modified sequence opt3 from NABP1__Homo_sapiens__NP_001026886
augaacagagugaaugacccccugaucuucauuagggauauaaagccuggccucaaaaaccuuaaugucguuuuuaucgugcuggagauugggcggguaaccaagacaaaagacggacacgaagugcgcagcugcaaggucgccgauaaaacugguuccaucacgauuucugugugggacgagaucggcggguugauacagccaggagauaucauucgauuaacccguggcuacgcuucaauguggaaggguugucugacacuauauacugggagaggaggcgaacuccaaaagaucggcgaguucugcaugguuuacagugaagugccgaacuuuagcgagcccaauccugacuauagggggcagcagaacaaaggagcacaguccgagcaaaagaauaacucuaugaacucgaauauggguaccggcacauucgggccagucggaaauggcgugcauaccggucccgaaucacgggagcaccaguuuagccaugccgggcgcaguaacggaagaggccugauuaauccucagcuucagggcacugcguccaaccaaacaguaaugaccacgaucucuaaugggagggauccacggcgcgcuuucaaacgauga

SEQ ID NO: 59469 - RNA, 636 nt, Artificial Sequence
  derived and/or modified sequence opt3 from NABP2__Homo_sapiens__NP_076973
augaccacagagacuuucgugaaggacaucaaacccggccugaagaaccucaaucuuauuuuuauaguccuggaaacggggagaguuaccaaaacaaaggauggacacgaggugaggacuugcaaaguagccgacaagaccgguagcaucaacauuuccgugugggaugacgucggcaauuugauccagccuggggauauuauccgguuaacaaagggauacgcuucuguguucaaaggcugucugacccuauauacuggucgcgggggagaccuccaaaagauaggcgaauuuugcaugguuuacucagaggugccaaacuucagugaaccgaaucccgaguauagcacacagcaggcaccuaacaaagccguccagaaugauuccaacccaucugcgucgcaacccaccacgggcccuucagcugccagcccagcaagugagaaucagaacgggaauggacuguccgcucccccugguccaggcgggggaccgcaucccccucacacuccaucucaucccccuagcacccgaaucacacguucccagccaaaccacacucccgccggcccgccuggucccucaaguaauccagugagcaacgggaaggaaaccagaaggucuuccaaacgguga

SEQ ID NO: 59470 - RNA, 2778 nt, Artificial Sequence
  derived and/or modified sequence opt3 from NACA__Homo_sapiens__NP_001106674
augcccggcgaggccaccgaaacagugccugcuacugagcaggaacugccacaaccgcaggcagagacggccguccuccccaugagcuccgcgcuuucuguuaccgcugcccuggggcagccuggaccaacauugcccccuccaugcucacccgcaccucagcaauguccauuaagugccgcuaaccaggcaagcccguuccccuccccuucuacuaucgccucgaccccacuggaagugcccuuuccucagucaagcagugguacagcucuaccacucggcaccgcccccgaggcgccgacuuuccugccuaaucuuauugggcccccaauauccccugcagcccuggcuuuggccucucccaugaucgcaccaacacucaagggaacccccagcuccucagcuccucuggcccugguagcgcucgccccacacagugugcagaaaagcucugcauuuccgcccaacuuacugacguccccuccaucagucgcuguggccgagagcggcaguguuauuacucuuucugcucccaucgccccuuccgaaccaaagaccaauuugaacaaagugcccagcgaggucgugccgaauccuaaggguacaccaucgcccccuugcauuguaucuacuguucccuaccauugugugaccccaauggcauccauccaaucaggggucgccagucugccucagacaacccccacgacuacacuagcuauagcgagcccacaggugaaagacaccacuaucuccucugugcucauuagcccgcagaacccuggaucacugagucuuaagggccccgucuccccacccgcagcccugagcuugucuacacaaucacucccuguugugaccaguagccagaagacggcuggcccaaauacacccccugauuucccgaucucccuggggucucacuuagccccacugcaucagucgagcuuuggauccguacaacuccuuggucagaccggccccucagcacugagugacccuacugugaaaaccauuucugucgaucacagcuccacaggggccucauauccaagccagagaucugugauacccccuuugccguccaggaacgaaguugugcccgcuacugucgccgcauucccagugguagcgccuaguguugacaagggacccagcaccaucucuuccauuacaugcucaccaaguggcagccuaaauguggcuaccucguuuucccugucuccuacuacgagccucauccugaaaucaagucccaacgccacauaccauuauccacuugucgcacagaugccgguguccucugucgguaccacuccucuggugguuaccaaucccuguacaauugccgcugccccaaccacuacauucgagguggcaacgugcguaagcccaccuauguccucagggccaaucagcaacaucgagcccaccaguccugcugccuuggucauggcgccgguggccccaaaggaacccucuacucaaguugcuacaacccuccggauuccuguguccccaccccugccugaucccgaggacuuaaagaaucugccaagcucgguccuagugaaguuuccuacacagaaggaucuccagacuguaccggcaucacuggaaggagcccccuucucuccagcucaggccggccuuaccacgaaaaaggacccuaccguguugccccugguucaagcagcgcccaaaaacaguccuuccuuucagagcacaucuagcucccccgagauaccgcucucaccagaagccacucuggcuaagaaaagucuuggcgagccucugcccaucgucgccgcauucccauuggagagcgcugaucccgccgggguggcaccuaccacagccaaggcugcggccuuugaaaaagugcucccgaagcccgagucugcauccgucucagcugccccaaguccucccguuagccugccuuuagccccaucccccgugccuacucugccacccaagcagcaguuccuaccgucuucgccuggacucgugcuggaaagcccaucaaaaccccuugcuccugcagacgaggaugaauugcugccacucauucccccggagccuaucuccgguggcguacccuuccaaaguguccuggugaauaugccaaccccuaagucugccgggauacccguuccaacgcccagcgcgaaacagccugugacaaagaacaacaaaggauccggcaccgagucagacucugaugaaagcgucccagaguuagaggaacaggacaguacucaggcuacaacccaacaggcccagcuggcagccgcugcagaaauugacgaggagccgguguccaaggccaagcaaagccgcucugagaaaaaggcgcgaaaagcuaugucaaaacuugguuugcgucagguuacuggggugaccagaguaacaaucaggaaauccaagaauauccucuuugucauuacgaagcccgauguguacaaaaguccugccagcgacaccuauaucguguucggcgaagcaaagauugaagaucugucgcagcaggcccaacuagcugccgcagagaaauuuaagguccagggagaggcuguuucuaacauacaggaaaauacucagacaccaaccgugcaagaggaauccgaggaagaggagguagacgaaacaggcguggaggucaaagauaucgaacuggugaugagccaggccaacguuucacgggcgaaggccgugcgcgcacucaagaauaacaguaaugacauugucaacgcuaucauggagcugacuauguga

SEQ ID NO: 59471 - RNA, 1584 nt, Artificial Sequence
  derived and/or modified sequence opt3 from NACC1__Homo_sapiens__XP_005259778
auggcccagacccugcaaauggagauccccaacuucggcaauagcauucucgaaugccuuaacgagcagagacugcagggguuguacugugacguguccgucguugugaagggacacgcuuuuaaagcacauagggccguauuagcggcuucuucaaguuauuuccgggaucuguuuaauaacagccgcuccgccguggucgaacuaccugcagccgugcagccacaaucuuuccagcagauacucucguuuugcuacacaggucgacugucaaugaauguuggcgaccaguuccuucugauguauacugcuggguuuuugcaaauccaggagauuauggaaaagggaacggaguucuuucucaaagugagcaguccguccugugauucucagggccugcacgcagaggaagcccccagcuccgagccucagucaccagucgcucaaaccagugguuggcccgccugcagcacaccucugccacucgugucucguguaaagacugaacagcaggaguccgacucaguucaauguaugcccguggcgaaaagauuaugggauagcgggcagaaggaggcaggaggcggcgggaacggaaguaggaagauggccaaauucucuaccccugaccuggcugccaaucggccacaucagccgcccccuccacagcaagcacccgucguggcugccgcgcagccugccguggcagcuggugccggccagccagcugggggagucgccgcagccggcgguguuguguccgggcccagcacaucggaacgcaccucuccgggaacuuccucagcuuacacaagugauagcccuggcuccuaucacaacgaggaagacgaggaagaggauggcggggaggaaggaauggacgagcaguacagacaaaucugcaauauguauaccauguacucuaugaugaacguaggucagacggcggaaaagguggaggcacuucccgaacaggucgccccagagagcaggaaucggauucgcgugcgacaggauuuggcuucacugccugccgagcuaaucaaccaaauaggcaauagaugucaucccaaacucuacgacgaaggggauccaagugagaagcuggaacuuguuacuggaaccaacguguauaucacaagggcacagcugaugaauugccacgucuccgccggcacucggcacaaaguguugcuccgucgccuguuagcuagcuuuuucgacagaaacacccuggccaacucuugugguacagggauuaggucaaguaccaaugacccccggcgaaagccucucgauagccgcguacuucaugcaguuaaguacuauugccagaacuuugcgccaaauuucaaagaguccgaaaugaacgcuaucgccgcagacauguguacgaaugccagaagggugguccggaagucuuggaugccgaaagugaagguccugaaagcugaggaugacgccuacacuacauucauuucggagaccggcaagaucgaacccgauaugaugggaguggagcacggcuuugaaacugcaagccaugagggggaggcuggaccuuccgccgaagcguugcaguga

SEQ ID NO: 59472 - RNA, 1764 nt, Artificial Sequence
  derived and/or modified sequence opt3 from NACC2__Homo_sapiens__XP_011516523
augagccagaugcugcacaucgagauucccaacuucggcaauaccgugcucgggugccuuaacgaacaaagacuguugggauuauacugugacgucuccauaguugugaagggucaggccuuuaaagcucauagggcaguacuggccgcgucuucacuauauuuccgggaucucuuuaguggcaauagcaaguccgcuuucgagcugccugggucugugccaccggccugcuuucagcagauccuuucguucuguuacacaggacgccugacuaugacggcaucagaacaauuggucgugauguauaccgccggcuuucuccagauucagcacaucguugagcgagguacagaccugauguucaaagugagcaguccccauugcgauucccagacugcugucauugaagacgcagggucugagccucaaagcccauguaaccagcugcagcccgccgcugccgcggcagccccuuacgugguauccccaucaguucccaucccucucuuaacccgugugaagcacgaggcuauggaacugccaccggccggacccggccuugcaccuaaaagaccauuggagacaggccccagggauggggucgcuguggccgcgggagccgcaguggcugccgguaccgcuccucugaagcuaccacgggucaguuauuacggcguucccagccucgccacucugauaccggggauccagcaaaugccuuauccccagggagaacgcacaucuccaggcgcauccucacuuccuaccacggacagccccaccaguuaccauaaugaggaggaugaagaggacgaugaagccuacgacacuaugguggaggaacaguauggucaaauguacauuaaggcuucuggguccuaugcgguacaggagaaaccagagcccgugccucuggaaagcagaucgugcgucuugaucaggcgggaucucguggcacugccagccucuuuaauuucccagaucggauaccgcugucacccgaagcuguauucagagggcgaccccggcgaaaaacucgagcuuguugcugggaguggaguguacauaacacgaggucagcugaugaacugccacuugugugccggcgucaagcauaaagugcuacugagaaggcuccuggcaaccuuuuucgaucggaauacucuugccaacagcugcgggacaggcauucguuccucuaccagcgacccuucacgcaagccacuggacaguagaguauugaaugcuguuaagcucuauugucaaaacuuugcccccuccuucaaagaaagcgagaugaaugugaucgcagcggauaugugcacgaacgcuaggcggguccgaaagcgcuggcugccuaaaauuaagucuauguuaccagagggaguggaaauguacagaacugucauggguucagccgcagccagugugccccuggacccggaguuuccuccagcugccgcacagguuuucgaacagaggaucuacgcugagcggcgcggggaugccgcgacaaucguggcccuaagaaccgacgcuguaaaugucgaucucagcgcagccgcuaaccccgccuucgacgcaggcgaagagguggauggagcgggcuccguuauucaggagguggccgcuccugaaccccugccagccgacgggcaaucuccuccccagccauuugagcagggagguggcgggccgucgaggccucagacucccgcagcugccgcacgucggccagaaggaacauaugccggcacccuuuga

SEQ ID NO: 59473 - RNA, 2121 nt, Artificial Sequence
  derived and/or modified sequence opt3 from NADSYN1__Homo_sapiens__NP_060631
augggcagaaaggugaccgucgccacaugcgcucugaaccagugggcacucgacuucgaggggaaucuucaaaggauccugaaaagcauugaaauagccaagaaccggggagcgcgcuaccgauugggucccgaguuagaaaucuguggcuaugggugcugggaucacuacuaugaguccgacacucugcuacauucuuuucagguucucgcugcccugguggaaucaccuguaacgcaggauauuaucugugacgugggaaugccagucaugcaccguaaugugagauacaacugcaggguuauuuuccuuaaucggaaaauccuguugauacgcccgaagauggcacucgccaacgagggcaauuauagagagcugaggugguuuacccccuggagucggagccgccauacagaagaguacuuccugccucgaaugauccaggaucucacuaaacaagaaaccgugccauuuggugacgcugucuuagugacaugggauaccuguauuggguccgagaucugcgaggaacuguggacuccccacucuccucauauugacaugggacuugauggcguagagaucauaacaaacgcaucgggcucacaccagguuuugagaaaggccaauaccaggguggaccuggucacgauggugacuagcaagaacgggggaauuuaucuacucgcuaaucagaaagguugugauggcgaccggcuguacuacgaugggugcgccaugaucgcgaugaacggaaguguguucgcacagggcucccaauuuucucuugacgacgucgaaguucugaccgccacauuggaucucgaggacgugcguagcuaucgcgcugaaauuuccucaagaaaucuggccgcaaguagggcuagcccauacccccggguaaagguggauuucgccuuaucuugucacgaggaccugcucgcgccuaucuccgagccaaucgaauggaaauaucauucaccggaggaagagauuagccuuggucccgccugcuggcugugggacuuuuugcgacgcagucagcaggcaggguuccuacugccucucucuggaggcgucgauuccgcugccacugcuugucugauauacagcaugugcugccaggugugugaagccguuagaucgggcaacgaggaggugcuugcagaugucaggaccaucgugaaucaaauuucuuauacaccacaggacccccgggaucugugcgggcgcaucuugaccacguguuacauggccuccaagaacucaagucaggaaacuugcacaagagcuagggagcucgcgcaacagauaggaagccaccauauuucccugaacaucgacccugcaguaaaagccguuauggguaucuuuucuuuagugaccggcaagagcccacuguucgcugcccacgggggaucaagucgugaaaaucuagcacuccagaacguccaggcccggauucgaauggugcuggcuuaucuuuuugcccaauugucccuguggagcagaggcguccacggugggcuccuggugcuuggcucugcaaauguugaugagucacuguugggauaccucacuaaguacgacuguaguagcgcggacaucaaccccauuggcgggauauccaaaacagaucugagggcuuucgugcaguucugcauccagcgcuuucaguuaccggcccugcaaucuauucuacucgccccugcaaccgcugaacuggagccccuugccgacggacagguaucgcagacggaugaggaagacauggguaugaccuaugcagaguugagcgucuacggcaagcugcggaaaguggcuaagauggggccauauuccauguucuguaaacuccugggaauguggagacauaucugcacaccuaggcagguugccgauaaggugaaacgcuuuuucucaaaguacaguaugaaucgacacaagaugacuaccuuaacacccgcguaucaugccgaaaacuacucuccagaggacaaucgguuugaucugcgucccuuccuuuauaacacuagcuggccuuggcaauuuagauguaucgagaaucaggucuugcagcucgaaagggcugagccacagucccuggacggcguggauuga

SEQ ID NO: 59474 - RNA, 1587 nt, Artificial Sequence
  derived and/or modified sequence opt3 from NAE1__Homo_sapiens__NP_001018169
auggacgcccagcaaaccaagacaaacgaggcuagacuguggggcgaucacgggcaggaagcacucgagagcgcccaugugugccuuaucaaugcgacugcuacgggaaccgaaauucugaaaaacuuggucuuacccgguauaggcuccuucacaaucauugacgggaaucagguuucuggagaggaugccggcaacaacuuuuuccugcagaggucaaguaucgguaagaaucgggcagaagccgcuauggaguuucuacaagagcucaauagcgacguguccgggucuuucguagaagagucgccugaaaaccugcuugauaaugacccaucauuuuucugucgcuuuacuguggucguggcaacccagcugccggagagcacaaguuugcgacucgccgauguucuguggaacucccagauuccccugcucaucugccguaccuacggauuagugggcuauaugagaauaaucauuaaagagcacccugucaucgaaucucauccagacaaugcucuggaggaucuuagguuggacaagcccuucccugaacugcgggagcacuuucagagcuacgaucuagaccauauggagaaaaaggaucacucccacacuccauggauugugaucauagccaaguaucucgcgcaaugguacucagaaacaaacggccgcauucccaaaaccuauaaggagaaagaagacuucagagaccugaucaggcaggggauucuuaagaaugagaacggagcaccugaagaugaggaaaauuuugaggaggccaucaaaaacguaaacacggcucugaauacuacccagaucccaaguagcauugaagacauauucaacgaugaccgguguaucaauauuacaaagcagacuccgucuuuuuggaucuuggcccgcgcacucaaggaguucguugcuaaagaaggucaaggcaaccugcccgugcgagggaccauaccugauaugauugccgacuccggaaaguacaucaaauuacagaaugucuauagagagaaggcgaaaaaggaugccgcagcugugggcaaccauguggccaaacugcuccagucaaucggucaagcuccagaaagcauuagugagaaggagcuuaagcuguugugcucuaauuccgccuuccuaagggucguucggugucguagccuggcagaagaguacgggcucgacacaaucaacaaagaugaaauuauaucgucuauggacaaucccgauaacgagaucgugcuguaccuuaugcugcgcgccguagacagauuucacaagcagcagggaagguauccuggcguguccaauuaccaggucgaggaagacauuggcaaauugaagucaugccucaccggguuccugcaagaguauggauuaagugugaugguuaaagaugacuacgugcaugaauuuugucgguauggugcugcggagccacacacgaucgcagccuuccugggcggggcugccgcacaggaagucaucaagauuauaacuaagcaguuugugaucuucaacaauacauacauuuauagcggaaugucccagaccucugccacuuuucaacuauga

SEQ ID NO: 59475 - RNA, 1170 nt, Artificial Sequence
  derived and/or modified sequence opt3 from NAF1__Homo_sapiens__NP_001122403
auggagguggucgaagccgcugcagcccagcuggagacccucaaguucaacggcacagacuuugggguuggagaaggucccgcggcuccuagcccaggcuccgccccggugcccgggacucaaccuccacuucagucuuucgagggaucacccgaugcaggccagacgguagaagugaaaccugccggugagcagccacugcaacccgucuugaaugcuguggcagccgggaccccugcuccacagccgcagcccccugccgagaguccagcgugcggagacuguguuacaagccccggcgcagccgaaccugcuagagccccagauuccuuagagacuucugacucggauucagacagcgauagugaaaccgacuccgauucuagcuccucaaguucuagcuccucaagcaguucuuccagcucgucuuccucaugcaucagucugcccccggugcuaagcgacggcgaugacgaucuccagauugagaaggagaacaaaaauuuuccucugaagacaaaagacgaacuucuguugaacgagcuccccuccgucgaggaacugaccauaauccugccagaagacauugagcucaagccuuuagggauggugucuagcaucauugagcaacugguaaucauagaaucaaugacuaaucuucccccaguuaacgaggaaacagugaucuucaagagugauaggcaggcagcuggaaaaauuuuugagaucuucggucccgucgcccacccuuuuuacguguugcgguucaauuccagcgaccauauugaaucuaagggcaucaaaauaaaggagaccauguauuuugcgccaucaaugaaagauuucacgcaguacauuuuuacugagaagcugaagcaggacaaagggagugaugccagcuggaagaacgaccaagaaccgcccccugaggcacuagauuucuccgacgaugaaaaagagaaggaagcuaaacagcgcaagaaaucucagauccaaggacgaaagaagcucaaaucggaguuuaaugagccaggcaccgguauuagccaccguuauugugggcugggauccagaccccuucagucaagugaaucucauaagcuguucggcuuccagaugcacaucaaagugacauuuacuugcuacuucagcuugcucuccaugcaguga

SEQ ID NO: 59476 - RNA, 1236 nt, Artificial Sequence
  derived and/or modified sequence opt3 from NAGA__Homo_sapiens__XP_005261673
augcugcucaagaccgugcuucuguugggccacgucgcccagguuuuaaugcuggacaacgggcuacuccaaacacccccuaugggauggcuggcuugggagagauucaggugcaauaucaacugugaugaagacccaaagaauugcauuagcgagcagcuuuuuauggaaauggcagaucggauggcccaggacgguuggcgcgauaugggcuacacuuaucugaacauagacgauuguuggaucgggggacgagacgcguccggccguuugaugccggaucccaagagauucccucaugguauuccauuucucgcugacuacgugcacucucuggggcugaaacucggaaucuaugccgauaugggcaauuucacgugcaugggcuaccccgggaccacauuagacaagguagugcaggaugcacaaacuuuugccgaguggaaagucgacaugcugaaacuugacggauguuucucaaccccugaagagagggcucaggguuauccaaagauggcagccgcuuugaacgccacaggccggcccauugcguuuaguugcagcuggccugcauacgaagggggacugccaccgcgcgugaauuauucccuacucgccgauaucuguaaccuguggagaaauuacgacgauauacaggacucuugguggucgguucuuucaauccugaacugguucguggaacaucaggauauuuugcaacccgucgcuggcccuggucacuggaaugacccagauaugcuccugaucgggaacuuuggauuaagccuggagcagaguagggcccagauggcacucuggaccgugcuugcugcgccccuguugauguccacugaccuacggacaauuucugcccagaauauggauauccugcaaaacccucucaugauaaaaauuaaucaggacccacugggcauccagggccgccgaauccauaaggagaaaagccuuauugagguauacaugagaccccuguccaacaaggccucagcauugguuuucuuuaguugcaggaccgauaugccguaucgguaccacagcucucucgggcaacugaacuucacgggauccgugaucuaugaggcucaggacgucuacucaggugacauuauaagcggcuuacgugaugaaacuaauuuuaccgugaucauuaacccuagugggguggucaugugguaucuguaccccaucaaaaaucuagagaugucucagcaguga

SEQ ID NO: 59477 - RNA, 1173 nt, Artificial Sequence
  derived and/or modified sequence opt3 from NAGK__Homo_sapiens__NP_060037
augagaaccaggacaggcagccagcuggccgcucgggaggugacuggguccggagcagucccccgccaacucgaaggucgacguugccaggccggcagagacgcgaacgggggaacgucuucagauggcaguagcuccauggcugccaucuacggugggguugagggaggcggcaccaggucugaagugcuucugguaucggaggacgggaagauuuuggcagaagccgauggauuaucaacaaaucacuggcugauagguacugacaaauguguggagcggaucaacgagauggucaaucgcgcuaagagaaaagcaggcguggauccucuaguuccacucaggagccuggggcuuagucuguccggaggcgaccaggaagaugccggucggauuuugaucgaggaacuccgcgaccgauucccguaucugucugagagcuaccugauuaccacagaugcugccggguccaucgcgaccgcaacucccgacggaggcgugguccucauaucaggcacagggaguaacugcagauuaaucaauccugauggaagcgagucugguuguggcggguggggacauaugaugggcgacgaagguuccgccuauuggauugcucaccaggccgugaagaucguauuugauucaauugacaaccuggaggcagcuccacaugacaucggguacguuaaacaagccauguuccacuauuuucaggugcccgauaggcuuggcauauugacccaucuguaccgggacuucgauaagugccguuuugcgggauucugucgcaagauugccgaaggcgcacagcagggggacccucuaagcagauauaucuuuaggaaagcuggagagaugcucggucggcacauugucgccgugcugccagaaaucgaucccgugcuuuuccaaggcaagaucgggcugccuauuuugugcgucggaaguguuuggaaaucuugggagcuccugaaggagggcuuuuuacuggcucucacgcagggucgagaaauacaggcccagaauuucuuuuccagcuucacucuuaugaaacugcgccacucgucugcacucgggggcgccucccuaggagcuagacauaucggccaccuguugccaauggacuacucagcgaacgcaauugccuuuuacaguuauaccuucagcuga

SEQ ID NO: 59478 - RNA, 2232 nt, Artificial Sequence
  derived and/or modified sequence opt3 from NAGLU__Homo_sapiens__NP_000254
auggaggccguggcugucgcagccgcgguuggcgugcugcuccuugcuggggccggaggugcagccggcgacgaagcuagagaggcagccgcuguaagggcccugguggcgcgguuguuagggcccggaccugcagccgauuucagcgucuccguggaacgcgcucuggccgcaaagccaggccuagacaccuacucucucggugggggaggcgcugcccgaguucgugugagaggcucaacaggggucgcggccgcagcuggacugcacagguaucuucgggauuuuugcgguugucauguggccuggaguggcagccagcugcgcuugccgagaccccucccugcuguaccaggggagcugacugaagccacgcccaacagguaccgguauuaccaaaauguuugcacccaguccuauucuuucguguggugggacugggcacgcugggagcgagagaucgauuggauggcccugaacggaauuaaucucgcuuuagcguggucgggccaggaagcaauauggcagagagucuaccuggcccuugguuugacacaagcugagaucaacgaauuuuucacugggccugccuuucuggcauggggaaggaugggcaaucuacacaccugggacggcccacuucccccuucauggcauauuaaacagcuguaucuucagcaccgggugcuggaucagaugcguagcuucgggaugacaccaguguugccggccuuugcuggacauguccccgaggccguuacccgcguguucccucaaguaaacgugacuaagauggguaguuggggccacuuuaauuguuccuacucuugcagcuuccuccuggcaccagaggaccccaucuuuccuauuaucggguccuuauuccugagagaacucauaaaagaguuuggaacagaucacaucuacggcgcggacaccuucaacgaaaugcagccacccucaagugagccgagcuaucuugcugccgcaacgacugccgucuacgaagcuaugaccgccguggauacagaggcaguuuggcuguugcaggguuggcuauuccagcaucaaccucaguuuugggggcccgcucagauuagggccgugcugggcgcggucccacggggacgacuccuggugcuugaccuguucgccgagucucaaccuguauauacucgcaccgcuuccuuucagggccagcccuucaucugguguauguugcacaauuuugggggaaaccauggucucuucggcgcacuggaagccguuaaugggggaccagaggcugccagauuauuucccaacucaacaauggugggcaccgguauggcaccugaagggauuagccagaaugaggucguguacagucugauggcggaacuaggcuggaggaaggauccagucccggaccucgccgcuugggugacgucuuucgccgcacggcgcuauggaguuucccaccccgacgcuggcgccgcauggagacugcuuuugaggagcguguacaacugcucgggggaggccugucguggacacaaucggucuccucugguacgaagaccaucccuccaaaugaacacuucaaucugguauaacaggagugaugucuuugaggcuuggcgccugcuucugacaagcgcgcccuccuuggccaccucuccugcauuccgguacgaccuccuggauuuaacuagacaggcugugcaggaacugguuagccuauacuaugaggaagccaggucagccuaccucaguaaagagcuggcuucccuuuugcgcgcugguggcgugcuggccuaugaacuccugccagcguuagacgagguccuggcuagcgauucucgauuucuuuuggggucauggcucgagcaggcccgggcagccgcugugagugaagcagaggccgacuucuacgaacaaaauagccguuaucagcugacacuauggggacccgagggcaacauacuggauuacgcgaauaagcagcucgcuggucugguagccaacuauuacaccccgagauggaggcucuuuuuggaggcacugguggacuccguugcccaggggauuccuuuccaacagcaucaguucgauaagaaugucuuucaguuagaacaagcauucgugcucucuaaacagcgcuacccaucgcagccccggggcgacacgguggaucuggccaagaaaaucuuucuuaaguauuacccuagaugggucgcaggaagcugguga

SEQ ID NO: 59479 - RNA, 1548 nt, Artificial Sequence
  derived and/or modified sequence opt3 from NAGPA__Homo_sapiens__NP_057340
auggccaccagcacaggcagauggcugcuccuuaggcuggcuuuguucggguuuuuaugggaggcauccggaggucuggacucuggcgccucacgggaugacgaucuacuccugcccuacccucgcgcgcgagcucgucuuccaagagacugcacuagggugcgggccgggaaccgcgaacacgagaguuggccgcccccuccagcaacgcccggagccggcggucuggcugucagaaccuucguuagccauuuuagggaucgggcaguggccgggcacuugacacgcgcuguagaaccucuccgaacuuucuccgugcuggagccaggaggccccggcgggugugccgcgagaaggcgggcaaccgucgaagagacagcccgugcugccgacugccgcguggcacagaauggaggcuuuuucagaaugaacucuggugagugucuggggaauguugugucggaugaaaggcgggucucaagcaguggaggccuccaaaacgcucaguuugguauccgacgcgacgggaccuuagugacuggauaucuguccgaggaagagguacuugauacagagaauccuuucguucaguugcugucuggcguggucuggcuaauuagaaacggcagcauauacaucaaugaaucccaggccaccgagugcgacgaaacgcaagagacugggucauuuaguaaguucgugaacgugauuagcgcgaggaccgccaucggacaugaucggaaaggucagcucguccuguuucacgcagacggccagacagaacagcgcgggauuaaucuuugggagauggcugaguuccuguugaagcaagauguugugaacgccaucaaucucgacggaggcgguucugcuacuuuuguacugaacgggaccuuagccuccuauccaucagaccauugucaggauaauauguggagaugcccgcgucaggugagcacagucguguguguucacgaacccaggugccagccuccagacugucacggccauggaaccugcguggauggccacugucaaugcacggggcauuucuggcggggacccgguugcgacgagcuggauuguggcccuaguaacugcucucagcacgggcucuguacugaaacaggaugccgaugugacgcaggcuggaccgguuccaauugcagcgaggaauguccacuuggguggcacggccccggaugccagagaccguguaaaugcgagcaucacuguccuugcgaucccaagacuggcaacugcucggucucuagggugaaacaaugucugcagccaccugaggccacauugcgcgcuggggaacuauccuucuuuacccggacggcguggcuggcacucacccuggcccuugcuuuccuguugcucauaucaacagccgcaaaccugaguuuacugcuaagcagagccgagaggaaucgccgacuccauggagacuacgcuuaucacccccugcaggaaaugaacggugagccacuugccgcagaaaaggagcagcccggcggggcgcauaauccuuuuaaggauuga

SEQ ID NO: 59480 - RNA, 1605 nt, Artificial Sequence
  derived and/or modified sequence opt3 from NAGS__Homo_sapiens__NP_694551
auggccaccgcucugauggcagugguccucagagccgcggcuguugcccccaggcuucggggccgcgggggaacagguggcgcacgacgucugagcugcggggccagaaggcgggcugcacgcggaacuuccccuggcagaagguugucuacggccuggucacagccacaaccgcccccugaggaauacgcuggugccgacgaugugagucagagcccaguagcggaggaacccuccugggugccuucuccacggcccccugucccacacgagucgccggaacccccuucagggcgcagcuuagugcagcgagacauccaggcauuccugaaccaauguggagccaguccaggcgaggcuagacauuggcuaacccaguuucagacaugccaccauuccgccgauaagcccuucgcaguuauugagguggacgaagagguccucaaaugucagcaaggcgugucuagccuggcuuuugcccuugcguuccugcagaggauggauaugaagccuuugguaguucucgggcugccagcccccacugcaccguccggaugccugucauuuugggaagcuaaagcccagcucgcuaagaguuguaaaguguuagucgacgcccugcggcacaaugcagccgcugcggugccuuucuuugguggcgggagcgugcuucgugcagccgagcccgcuccacaugccucuuauggaggcauagucuccguugagaccgauuugcugcaguggugccuagaaucagguagcaucccuauucucugucccaucggggagacagcagcccgcagaagugugcugcuugacucucuggaaguaaccgcuuccuuggccaaggcacucaggccaacuaagauuaucuuccugaacaauacaggaggcuuacgggauagcucgcacaaagugcugucuaacgucaaucuccccgcggaccuugaucuggugugcaacgcugaguggguuuccaccaaggaacgacaacagaugcgcuugauaguggacguccuaucaagacugccucaccauaguagcgccgugaucacggcagccuccacucuccugaccgagcuguuuucuaauaaaggcagcgggacacuguucaagaacgcugagaggauguugcggguacgcucacucgauaaacuggaccagggaagauuaguugaccuggugaaugccaguuuugguaagaagcuaagggaugacuaccucgcaucccugcguccacggcuucacagcauuuaugucucugaaggcuacaacgcugccgcgaucuugacuauggagccggugcuugggggaacccccuaucucgauaaauucgucgugucaaguagccgacaaggccaggguuccgggcagaugcugugggaaugucuuagaagggaccugcagacauuguuuuggcgcucucggguuaccaauccuauuaacccaugguacuucaagcauucggauggcagcuucuccaauaaacaauggaucuuuuucugguuuggacucgccgacauaagagauucauaugagcuggugaaccacgcuaagggcuuacccgacaguuuccacaaaccugcaucugauccagggagcuga

SEQ ID NO: 59481 - RNA, 4212 nt, Artificial Sequence
  derived and/or modified sequence opt3 from NAIP__Homo_sapiens__NP_004527
auggccacccagcaaaaggcuagcgacgagagaaucucccaguucgaucacaaccugcuccccgaacuuucugcacuguugggcuuagacgccgugcagcuggcgaaagagcuagaagaggaggaacagaaggagagggcuaaaaugcaaaagggguacaauucacagaugcggagugaagccaaacgccucaagacauuugucacuuaugagccuuacagcuccuggauuccacaggaaauggcagccgcuggauucuauuuuacggguguuaagucuggcauacagugcuucuguugcucgcugauccuuuuuggggcaggacugacccgauugccgauugaggaucauaaacguuuccaccccgacuguggcuuucuccugaacaaggauguggguaauaucgccaaauacgacauuagaguaaagaaccugaaaucaaggcuccggggaggaaagaugcgcuaucaagaggaagaggcuagauuagccagcuucaggaauuggccuuuuuacgugcagggcaucaguccaugcguccuguccgaagcgggcuucguguuuacagggaagcaggauacuguucaguguuucucuugcggagguugucuuggcaacugggaggaaggggacgaucccuggaaagagcaugcaaagugguuuccuaaaugcgaguucuugcggagcaagaaauccucagaagagauaacccaauauauccagaguuacaagggauucguggacauuacaggcgaacacuuugucaauagcugggugcagcgcgagcugccaauggccucugcuuacuguaacgauuccaucuucgccuaugaggaacuacgacucgacucauuuaaagauuggcccagagagagcgcaguagguguugcugcccuggcgaaggccgggcuuuucuacaccggaauuaaggacaucgugcaaugcuuuaguuguggcggcugccuggaaaaauggcaggagggggacgauccuuuggacgaucauacuaggugcuucccaaauuguccguuucuccagaacaugaagucuuccgcagaagucacacccgaccugcagagccggggagaguuaugcgaacugcucgagaccacgucggagucuaaucuugaagauuccauagcuguggguccuauugugccagagauggcccaaggcgaagcucagugguuccaggaggccaaaaaccugaaugagcaguugcgugcagccuauacuucagcuaguuuucgccacaugagccuacuggacaucuccucugaucucgcgaccgaccaucugcuugggugugaucugagcauugcaucaaagcacaucaguaaacccguccaagaaccuuugguucucccagagguguucggaaacuuaaauuccguaaugugcguggaaggcgaggccgguagcgggaagacaguccugcugaagaaaaucgcuuuucuaugggccucuggcuguugcccccuccugaacagauuccagcuuguguuuuacuugucacugaguagcacuaggccggacgaaggacucgcauccauuauaugugaucagcugcuugagaaggagggcucuguuaccgaaaugugcgugcggaacaucauucagcaacugaaaaaucaggucuuguuccuccuggacgacuauaaggagaucuguucgauaccucaggugauugggaaauuaauccagaagaaccaccugagccgaacaugccuacucaucgccguacgcaccaauagagcuagggauauucggcgcuaccuggaaacgauccuugagauuaaggccuuccccuuuuauaacacuguuuguauauugagaaaacuguucucccauaauaugacaaggcuccguaaguuuaugguguacuucgggaaaaaccaaucacugcagaagauccagaaaaccccauuauuugucgcagcgauuugcgcucacugguuccaauacccuuuugaccccaguuucgaugacguggccgucuuuaagucuuauauggaacggcugagccuucgaaauaaggcaacugccgagaucuugaaagcuacaguguccucaugcggugagcucgcccugaagggcuucuuuagcuguugcuucgaauuuaacgaugacgaucuagcagaggcugggguugacgaagaugaggaccugaccaugugucucaugucuaaauucacggcccagagacugaggccauucuaccgcuuucuuucccccgcguuccaggaauuuuuggccggaaugcggcugaucgaguuacucgauagugacagacaggagcaccaagaucugggccuuuaucaucugaagcagauuaauagcccuaugaugaccgugucugcuuacaacaauuucuugaacuauguauccucacucccaaguacaaaagcagguccgaagauagucagccaucugcuacaccugguggacaauaaagaaucgcucgagaacaucuccgaaaaugacgauuaccugaagcaccagcccgagauuucucuucagaugcaauugcugaggggguuauggcagaucugcccucaggccuauuuuagcaugguuucagagcaucuccuggugcuugcucugaagacugccuaccagaguaacaccgucgcagcguguuccccauucgugcuacaauuucuccagggccgcacacugacuuugggagcccugaacuuacaguacuucuuugaccaccccgaaucucucagccugcuucgauccauucacuucccuauccggggcaauaaaaccucaccacgugcucauuuuagcguacuggagacaugcuucgauaagagucaagugcccaccauagaccaggauuaugccucugcauucgaaccgaugaacgagugggaaagaaauuuggcugagaaagaggacaacguuaaguccuacauggauaugcagaggcgcgccagcccugaccucucgacuggguauuggaaacugucaccaaagcaguacaagauccccugucuagaagucgaugugaaugacauugauguggucggacaagacaugcuggagauccuuaugacgguguuuucugcaagucagcggauugaacuccaccugaaccauuccagagguuucaucgagagcauaaggccugccuuggaacugucuaaagcuagcguuacaaagugcuccauuucaaaauuagagcucagugcggccgagcaggaacugcuucugaccuugcccagccucgagucucuggaaguguccggcacuauccagucacaagaucagauuuuuccaaaucuagacaaguuccugugucuuaaagagcucaguguagaccuggaagggaacaucaaugucuuuagcgugauaccugaggaguuccccaacuuucaccacauggaaaaguuguuaauccagauuuccgcagaguaugauccaucuaagcugguuaaacucauccaaaauucgccgaaccugcauguguuccaccuuaagugcaacuuuuucagcgacuuuggaucacugaugaccauguuggucuccuguaaaaagcuaacagaaauuaaauucagugauagcuuuuuccaggcugugccuuucguugccucucugcccaauuuuaucucccucaagauacugaaucuugagggccagcaguucccagacgaggaaaccucagagaaguuugccuacauuuuagguucucugagcaaccucgaagaguugauccugcccacuggggauggcaucuaucgaguggcuaaacucauuauccagcaaugccagcagcugcauugccuucgcguacugaguuucuuuaagacauugaacgacgauuccgucguggaaauugcaaaaguggccauaagcggaggcuuccaaaagcuagagaaucugaaacucucuaucaaccacaagauuacggaggaaggguaccggaacuuuuuccaggcguuagacaauaugccuaaucugcaggagcuugauaucucaagacauuuuaccgaauguauuaaagcucaggccacuacagucaagucccugagucaaugcguucucagguugccacgucugauccgccucaacaugcugagcuggcuucuagacgcagaugacauagcccuguugaaugugaugaaggagcggcacccccagucgaaauacuuaaccauccugcagaaguggauucucccuuucucuccgaucauucagaaauga

SEQ ID NO: 59482 - RNA, 5274 nt, Artificial Sequence
  derived and/or modified sequence opt3 from NALCN__Homo_sapiens__XP_011519369
augcagagcgccgugcaaaccgucguucugugccuccuuacaaaggcuaaucuguccauguugaaaagaaagcagucuucaaggguggaggcacagcccguaacugacuucggcccugaugaaaguuuaagcgacaaugccgauauccuguggauuaacaaaccuugggugcacucccuucuccggauaugugcgaucauuucugucaucucggugugcaugaauacgccgaugaccuuugagcacuaucccccucugcaguacguuacauucacucuugacacccuguugauguuucucuacacagcugaaaugauugccaagaugcacauccgcgggauagugaaaggagauucaagcuaugucaaggaccgaugguguguguucgaugguuuuaugguauucugccuguggguuagucuggugcuccaagucuuugagaucgcagacauuguggaucagauguccccauggggcauguuacguauccccagaccucugauuaugaucagggccuuccggauauacuuucgcuucgaacuuccaagaaccaggauuacuaacaucuugaagcggucuggggagcagauuuggagcguguccaucuuucugcuauucuuucuccugcuuuauggaauccugggcguccagauguucgguacauucaccuaccauuguguugugaaugacacgaaacccgggaacguaacuuggaacucauuggcuauuccugauacccacugcaguccagagcucgaagagggauaucaauguccgcccggcuuuaagugcauggaccuggaagauuuaggccugagccgccaggagcucggguacucuggauucaacgagauagguacauccaucuuuacuguguacgaagcagccucacaggagggcugggucuuccuuauguaucgagcuauugacagcuuuccuagauggaggaguuacuucuauuuuaucacccugauauucuuuuuggccuggcuagugaaaaauguuuucauugcggugaucaucgaaacauuugcagagauucggguccaguuccaacagaugugggggucucguuccagcaccacgucgacugccacaacccagauguuucaugaagacgcugccggaggcuggcaacugguggcaguagauguuaacaagccacagggucgcgcucccgccugucuccagaaaaugaugagaucuuccguguuccacauguucauccugucaauggucacuguggacgucauuguggcggccaguaauuacuauaagggggagaacuuuaggcggcaguacgaugaguucuaucuugcagaaguugcuuuuacagugcuguucgacuuggaggcccuccugaagauauggugcuuaggauuuaccggcuacaucagcuccucucugcacaaauucgaacuacuccugguaauuggcacgacccuucaugucuacccugauuuguaucacagccaauuuacauacuuccaggugcugcgaguugugcgccucaucaagaucucaccagcucuggaggacuuugucuauaaaauuuucgggcccggaaagaaacuugguagucuggugguauuuacugccuccuugcucauagugaugagcgcaaucucucugcagauguucuguuuuguugaagaguuagauagauucaccacauucccgagggccuuuaugucaauguuccagauucugacucaagagggcugggucgacgugauggaucagacccuaaaugcuguggggcauaugugggcgccugucguugcaaucuacuuuauucucuaucaccuguucgccacacuuaucuugcugagucucuuuguggcugugauacuggacaacuuagaacuggaugaggaccuuaagaaauugaagcagcucaagcagagcgaagccaaugcagacaccaaagagaagcugccccuacggcugcgcaucuucgaaaaauuuccaaacagaccucaaaugguaaagauuuccaaacuccccucugauuucacugucccaaagaucagggagucguuuaugaagcaguucauugaccgucagcagcaagauacgugcugccugcuucggagcuugcccacaaccuccucaaguucuugugaccacagcaaacgauccgccaucgaggauaacaaguacauagaccagaaacugagaaagucaguguuuagcauuagggcucgcaauuuacucgaaaaagagacugccguuaccaagauccugcgggcaugcacaagacagaggaugcuuucuggauccuucgaaggccaaccugcgaaggagcgcaguauucugagcgugcagcaucacauccgacaggagcggcguucuuugagacaugguuccaacucacagaggauaagucgcgggaaaagccucgaaacccugacucaagaucacucgaauacaguccgguauagaaacgcucagagggaggacuccgaaaucaagaugauucaggagaaaaaggaacaggccgagaugaaacgaaaggugcaagaggaggaacugcgcgaaaaucauccauacuucgauaagccgcuguuuaucguuggccgggagcacagauucaggaacuuuugucgugugguaguccgcgcacgguucaaugccucuaaaacggaccccgugaccggagcugugaagaacacuaaauaccaccagcucuaugaucugcuuggcuuggucacauaccuggacuggguuaugauuaucgugaccauaugcagcuguauuucaaugauguuugaaaguccuuucagaaggguaaugcaugccccaacauuacagaucgcagaguauguguuugucaucuucauguccauugagcucaaucugaagaucauggcugaugggcuauuuuucacucccaccgccgugauucgagacuuuggagguguuauggacauauucaucuaccuggugucucuaauuuuucucugcuggaugccucagaacgucccagcggaaagcggcgcccaacuguugauggugcugcgguguuuacgcccccucagaaucuucaaacugguuccgcagaugaggaaggugguccgggagcuuuucuccggguuuaaagaaauuuuccugguaucaaucuugcuccugacgcuaaugcugguguuugcuagcuucggaguucagcuuuuugcaggcaagcucgccaagugcaaugauccuaacauaauccgaagagaggacuguaaugguauuuuccgcaucaacgugagugucucuaaaaaucugaacuugaagcugaggccaggggagaaaaagcccggcuuuugggugccucguguaugggcuaacccccggaauuucaacuuugauaaugugggaaacgccauguuagcacucuucgagguccugucccuuaaaggcuggguugaggugagagacgugauuauccacagggucgggccaauacauggaauuuauauccacguguuuguuuuccuggguugcaugaucggcuugacccucuuuguagggguggucauugcgaauuucaacgaaaauaagggaacagcccugcuaacuguggaucaacgccgaugggaggaccuaaagagcagacuuaaaauagcucagccucuccaucugcccccacggccggauaacgacggcuucagggccaagauguacgauaucacccagcauccauuuuucaaacgcacaauugcauuguuaguucuggcucagucggugcuccugucagucaagugggacguggaagaucccguaacugucccacuugccaccaugucugugguuuuuacguucaucuuugugcuggaggucacaaugaaaauuaucgcaaugagucccgccgguuucuggcaaucccguagaaaucgguaugacuugcuagugaccagccuggggguugugugggucgugcuccacuuugcucugcuuaacgcguacacuuacaugaugggcgccuguguaauaguguucagguuuuucucuaucugcggaaagcauguuacauuaaagaugcugcucuugaccgucguggugagcauguauaaauccuuuuucauuaucgucggcauguuucugcuccugcuuugcuacgcauucgcugggguagugcuguucggaacuguuaaguauggcgagaauauuaaccgccacgccaauuuuucaagugccgguaaagcuaucaccguguuguuccgaauagucacaggggaagauuggaacaagauuaugcaugacuguauggugcagccuccauuuugcacgcccgacgaguucaccuacugggcaacugauuguggaaauuaugccggcgcgcuaauguacuuuugcagcuucuauguuaucaucgcuuacauuaugcugaaccucuuaguggccaucauagucgaaaacuuuucucuguucuacuccacagaggaagaccagcuucugucauauaaugaucucagacacuuucagauuaucuggaacaugguggacgauaaacgggaggguguaauuccuaccuucagggugaaguuuuugcugcgccuccugagaggcaggcuugagguugaccuagauaaggacaaacuguuguucaagcacauguguuacgaaauggagcgguuacauaaugggggagaugucacauuucacgacgugcugaguaugcucagcuaucguuccguggauauccgcaaaucucugcaacuugaagaacugcucgcacgagaacaguuggaguacacuauagaggaagaggucgccaagcagaccauuagaauguggcugaaaaagugccuaaaaaggauccgggcuaagcagcaacagucguguagcaucauucauucacugcgcgaaucccagcagcaagagcucaguagauuccuuaacccgccaucuaucgaaacgacacagcccagcgaggacaccaaugcaaacucccaggacaauucaaugcaaccugagacuucuagccagcagcagcuguuaaguccaaccuuguccgauaggggcgggagccggcaagacgccgcggaugcuggaaagccccagcgaaaauucggccaguggagacugccuucugccccgaagcccauuucacacuccguuaguagcgugaaccuccgcuuuggugggaggacaacuaugaaaucgguagugugcaagaugaauccaaugaccgacgcagccucuuguggauccgaagucaaaaagugguggacacggcagcugacgguggagagcgaugaaucaggcgacgaucuucuggacauauga

SEQ ID NO: 59483 - RNA, 1476 nt, Artificial Sequence
  derived and/or modified sequence opt3 from NAMPT__Homo_sapiens__XP_005250157
augaaccccgccgcugaggcagaguucaauauccugcucgccaccgacagcuacaaggugacacacuauaaacaguacccuccaaacacuuccaaggucuauucuuacuuugagugcagagaaaagaagacggaaaauucaaaacuuaggaagguuaaguaugaagagaccguguucuacggccugcaauauauuuugaacaaauacuuaaaggggaaaguagugacaaaggagaaaauacaggaagcgaaggaugucuacaaggagcauuuucaggacgauguguucaaugaaaaaggauggaacuauauccuggagaaguacgacggucaccuaccgauugagaucaaagcuguucccgaaggcuuugugauuccucgggggaauguccucuucacuguggagaacaccgauccagaauguuauuggcugacaaauuggaucgagaccauacuuguacagaguugguaccccaucacuguugccacaaacagccgcgaacaaaagaaaauucuggcaaaguauuugcucgagaccuccggaaaucuggacggccuggaguacaaacuccaugauuuugguuaucgaggggugucuucgcaggaaacggccggaaucggcgcuucagcacacuuagucaacuucaagggcacugacaccguggccgggcuggcucuuauuaagaaauacuacggaacaaaggauccugugccagguuauagcguccccgccgcggagcauaguacuaucaccgcauggggcaaagaccacgaaaaggaugccuuugagcacauaguuacacaguucuccucugugccuguaagcguggucuccgacucauacgauauuuauaaugcuugcgagaaaaucuggggagaagacuugcgucaucugauugugaguagaagcacccaggccccacuaaucaucaggccggacucugggaacccccucgauacgguucugaaggugcuugagauucugggcaagaaauuuccugucacugaaaauuccaaggguuacaaauugcucccacccuaucugcgggugauacaaggggacggaguagauaucaacacauuacaggagauuguugaaggcaugaagcagaaaauguggucaaucgagaacauagcauucggcagcgggggaggucugcuccagaaacuuacccgcgaccuguugaauuguaguuuuaagugcucuuacguggucacuaacggccuagggauuaauguguucaaagauccugucgcugacccaaacaagagauccaaaaagggaaggcugagccuccaccggacacccgccggcaauuucgugacccuggaagaggguaaaggggaucuugaggaauauggccaagaccuguugcauacgguuuuuaagaacggaaaggugaccaaaucguacucuuucgaugagauccgcaagaaugcgcagcucaacaucgaacuggaggccgcacaccacuga

SEQ ID NO: 59484 - RNA, 870 nt, Artificial Sequence
  derived and/or modified sequence opt3 from NANOG__Homo_sapiens__NP_001284627
augagcguggaccccgccugcccucagucccugccauguuucgaggcuucugauugcaaggaaucaaguccgaugcccgucaucuguggcccugaggaaaacuacccaagccuccaaauguccucugcagagaugccccacaccgaaacaguuucgccucuuccaucaagcauggaccuguugauucaggauagucccgacuccucuacuagcccuaaagggaagcagccaacguccgccgagaaaucaguggcgaagaaagaggauaagguaccggugaagaaacagaagaccagaacagucuuuaguagcacucaauuaugcgugcugaaugacagguuccagcggcagaaauaucuaucucuccagcaaaugcaggaacuguccaacauacuuaaucugucauacaagcagguuaaaaccugguuucagaaccaacgcaugaaaagcaagcgauggcagaagaauaacuggcccaagaauaguaacggagugacacaggguuguuuggucaauccuaccggcaaccucccaauguggucuaaucaaacuuggaacaauuccacauggagcaaccagacccagaauauccagucguggucuaaccauuccuggaacacgcaaacuuggugcacccagucauggaauaaccaggcuuggaauagucccuucuauaacuguggggaggaaagccugcaguccugcaugcaauuucagccuaauucuccagccagcgaucuggaggcagcccucgaggcugcaggagaaggcuuaaacgugauucagcagacaacucguuacuucucaacaccccaaaccauggaccuguuucuuaauuauaguaugaacaugcagccggaggauguauga

SEQ ID NO: 59485 - RNA, 879 nt, Artificial Sequence
  derived and/or modified sequence opt3 from NANOS1__Homo_sapiens__NP_955631
auggaggccuuccccugggcuccuagaagcccaaggcggggccgcgcaccgcccccuauggcccuggugccauccgcgcgauacgucucugcucccgggccugcccacccacagcccuuuucaaguuggaacgacuaucucggacuugcaacccugaucacaaaggccguugauggugaaccucguuucggcugcgcuagagggggaaauggcggugggggaagcccaccguccucuucgucaagcaguuguugcucuccccauacuggcgcaggcccuggggccuugggaccagcuuuaggucccccugacuacgaugaggacgaugacgaugacuccgaugaaccaggcagcagggggcgguaucugggauccgcccuagagcuccgcgcgcuggaacuuugugcaggccccgccgaggcuggucuguuggaggaaagauuugccgagcucucaccguucgcagggagggcugccgcggugcugcugggaugcgccccugcagcugccgcugccgcaacgaccacaagugaagccacuccccgggaggagcgcgcuccagcgugggcagccgaaccucgacuccacgcugccagcggcgcagccgcugccagauuacugaaacccgagcuucaaguauguguguuuugcaggaacaauaaggaagcaauggcguuguacaccacacauauucugaaaggcccagacgggcggguccuaugucccgugcuccgucgcuauaccugcccucuguguggagcuucuggugauaacgcccacacuauaaaguacugcccacuuuccaaaguuccgcccccuccagcaagacccccuccaaggucagcccgggacgggcccccgggcaagaagcugcgauga

SEQ ID NO: 59486 - RNA, 417 nt, Artificial Sequence
  derived and/or modified sequence opt3 from NANOS2__Homo_sapiens__NP_001025032
augcagcugcccccuuucgacauguggaaggauuacuuuaaccucagccaaguggucugggcccuuaucgcuuccagaggccagaggcuggagacccaggaaauugaggaaccaucuccggggcccccuuugggacaggaccaagguuuaggcgcaccaggggccaauggaggccuggguacacuaugcaacuucuguaaacacaauggggagucacggcauguuuauaguagccaccagcucaagacucccgauggagugguagugugcccuauacugcgccauuacgucuguccagugugcggcgcgacgggcgaccaggcucacacccuuaaauauuguccccugaacgggggacagcaauccuuguaccgacguucugguagaaauucggccggcaggcggguuaagcgcuga

SEQ ID NO: 59487 - RNA, 579 nt, Artificial Sequence
  derived and/or modified sequence opt3 from NANOS3__Homo_sapiens__NP_001092092
augggcaccuucgaccuguggacagauuaccucgggcuugcccaccuggugagagcuuugagcggaaaggagggucccgaaacuagguuauccccucagccagagccggaacccaugcuggagccugucucugcacuagaaccaaugcccgccccugagucaguuccagugcccggcccuaaagaccaaaagcggagucucgagagcuccccagcgccggaacgccugugcucuuuuuguaaacauaauggggagucgcgagcuaucuaucagucacacguacuuaaggaugaagccggacgugugcugugccccauuuugagagacuacgucuguccucagugcggcgcaacgagggagcgggcccauacccgcagauucuguccacucacaggucagggguauacuagcguguacagucacaccacaaggaacuccgcuggcaaaaagcugguucggcccgauaaggcaaaaacccaagacacuggacaucgccgaggcgggggagguggcgccggguuuagaggagcuggcaagucugagccuagcccauccugcucacccaguaugagcacauga

SEQ ID NO: 59488 - RNA, 1080 nt, Artificial Sequence
  derived and/or modified sequence opt3 from NANS__Homo_sapiens__NP_061819
augccccuggagcucgaacuuugcccuggcagaugggugggaggacagcacccauguuucaucauugccgagauaggucaaaaccaucagggcgaccuggaugucgcuaagaggaugauccggauggcaaaagaaugcggggccgacugugcgaaguuucagaaaagcgaguuggaauuuaaguuuaaucgcaaggcuuuagagcgaccguacaccuccaagcacucuuggggaaagacauauggcgagcauaaacgucaccuggaguucucacaugaucaguacagagaacuacaaagguaugccgaagagguugguauuuucuucacugcaagugggauggacgagauggccguggaauuucuccacgagcugaacguacccuucuuuaaggugggaagcggcgauacgaauaacuucccuuaccuugagaaaaccgcuaagaaaggccggccaauggucaucuccucugggaugcagucgauggacacaaugaaacagguguaucagauuguuaagccccugaauccuaacuuuugcuucuugcaauguacuucagcauacccacuccagcccgaagaugugaaucugcgcgucaucagcgaauaucagaaacuguuuccugacauaccaaucggauacaguggucacgagaccggcauugccaucuccguggcugccguagcgcucggggcaaagguuuuagagagacauauuacacuggauaaaaccuggaagggaucugaccacagcgccucccuugaaccgggcgaguuggcugaacuggugaggucaguccggcuaguggagcgcgcccucgguagucccacuaaacagcugcuuccuugcgaaauggcauguaacgagaagcuggggaaaagcguggucgcuaagguuaagaucccagagggaacaauauugaccauggauaugcucacggugaaaguaggcgaacccaagggcuacccuccagaggacauuuucaaucugguggggaaaaaggucuuagugacuguugaagaggaugacaccaucauggaggaacugguggacaaccaugggaaaaagauuaagucuuga

SEQ ID NO: 59489 - RNA, 1176 nt, Artificial Sequence
  derived and/or modified sequence opt3 from NAP1L1__Homo_sapiens__NP_004528
auggccgacaucgauaacaaggagcagagcgaacuggaccaagaucucgacgauguggaggaagucgaggaagaggagaccggcgaagagacaaaacuuaaggcuagacagcugacuguucagaugaugcagaauccccaaauuuuggcagccuuacaggaaaggcuggacgggcuaguggagacgccuaccggauacauagagucccucccacggguagugaaacgccgagucaacgcgcugaagaaucuucaggugaaaugcgcucagaucgaagccaaguucuaugaggaaguucacgaucuggagcguaaguacgcaguguuguaucaaccgcucuuugacaaaagauucgaaauuaucaacgccauuuacgagcccacagaggaagagugugaauggaagccugaugaggaagacgagaucucugaggaacugaaagagaaggcuaaaauagaagaugagaagaaggacgaagagaaagaggauccaaaggguauccccgaauuuuggcugacugucuucaaaaauguggaccucuuaucagacaugguacaggagcaugaugaaccuauucugaagcaccuuaaagacaucaagguuaaauuuagugaugcaggccagccaaugagcuucguguuggaguuucauuucgagcccaacgaauauuuuaccaaugagguccugacaaagaccuacaggaugcgguccgaaccugacgauucugacccauucucguuugaugggccggagauuaugggaugcacuggcugucagaucgacuggaagaaagguaagaacgugacacuaaaaaccauaaagaaaaagcaaaagcacaaagggcgcggaacggugagaacugucaccaagacaguuucaaaugauagcuucuuuaacuucuucgccccaccugaagugccagagaguggcgaccucgaugacgacgcugaggccauucuggcggcagauuuugaaaucggccauuuccuuagggagcggauuaucccccgcuccguacuguauuuuacuggggaagccaucgaggacgaugacgaugacuacgaugaagagggagaggaagcugacgaggaaggugaggaagagggcgaugaggaaaaugacccugauuacgaccccaaaaaggaucagaaccccgccgagugcaaacagcaauga

SEQ ID NO: 59490 - RNA, 1521 nt, Artificial Sequence
  derived and/or modified sequence opt3 from NAP1L3__Homo_sapiens__NP_004529
auggccgaggcugacuucaagauggugagcgaacccgucgcacacggcguugccgaggaagagauggcguccucuaccucagauaguggggaagagagcgacuccucuucgucaagcaguuccacaucugauagcuccucaaguagcucuacuuccggaucaagcagugguucuggcuccagcucgucuuccucagggaguacgagcuccagaucuaggcuguaccggaaaaagcgcgugccugagccaagccgacgugcuagaagggccccgcucggaaccaacuuuguagaccggcuuccccaggcagugcgcaauagaguccaagcccugaggaacauccaggaugaaugcgacaaaguggauacauuguucuuaaaggcuauucaugaccuggagcggaaauaugcagaacuaaauaagccucucuacgaucgccgauuucagauaaucaacgccgaguaugagccaacugaagaggaaugugaguggaacucagaagacgaggaguucaguuccgaugaagagguucaggacaauacccccagcgaaaugccuccacuggagggcgaagaggaggaaaaucccaaggagaacccugaagugaaagcugaggaaaaggaggucccaaaagagauuccggaagugaaggaugaggaaaaagagguacccaaggagaucccugaaguuaaggccgaggaaaaagcggacucuaaggacugcauggaggcaacaccagaagugaaagaggaucccaaggaggucccucaagugaaagccgacgauaaggaacagccaaaagcuaccgaggccaaggcaagagcugccgugagggaaacucacaagcggguccccgaggaacgucuucaggacucaguugaucugaaacgcgcgagaaaggguaaaccgaagagggaggacccuaaagggauucccgauuacugguugaucgugcucaagaauguagacaagcugggaccaaugauacagaaauaugaugagccuauccugaaguuucucagugacgugagcuuaaaauucuccaagcccggccaaccagucucuuacacauuugaguuccauuuucugcccaacccuuauuuccggaaugaagugcuuguuaaaaccuacauuaucaaggccaagccagaucacaacgacccguuuuucucguggggcugggaaauugaggacuguaaagggugcaagaucgauuggcgacgcggaaaagacgugacggucacuaccacacagagcagaacuaccgcaacaggugaaauagagauucagcccagggugguaccuaaugcuuccuuuuucaacuucuuuucaccacccgagaucccuaugauuggcaaguuggaaccacgggaggaugccauccuggacgaagauuucgagaucgggcagauucuacaugacaauguuauacucaaaaguaucuacuauuacaccggagaggugaacggcacguauuaccaauuugguaagcacuaugggaacaagaaauaccgcaaguga

SEQ ID NO: 59491 - RNA, 1128 nt, Artificial Sequence
  derived and/or modified sequence opt3 from NAP1L4__Homo_sapiens__NP_005960
auggccgaccauagcuucuccgauggcgugcccucugacucagucgaggcugcaaagaacgccaguaauaccgaaaaacugacagaucagguuaugcaaaacccuagagugcucgcggcccuucaggagaggcuggacaauguaccacauacuccgagcuccuacaucgaaacguugcccaaggcugugaaacggcgcauuaacgcauuaaagcagcugcagguccgaugcgcccacauagaggcuaaauuuuaugaagaggugcaugaucuagagcguaaguacgcagcccucuaucaaccucuguucgacaagagaagggaauuuaucaccggggauguugagccaacagacgcugaaucugaguggcacucggagaaugaagaggaagagaaacuugccggagauaugaagucaaaaguggucgugacugaaaaggcggcagccaccgcugaggagcccgacccuaaagguauuccagaauuuugguuuacaaucuuccggaacguagauaugcugagcgaguugguucaggaauacgacgagcccauucucaagcaucugcaggauaucaaggugaaauuuagugacccuggccagccaauguccuucguccuggaauuucacuucgagccgaaugacuauuuuaccaacucugugcucacuaagacauacaaaaugaaaagcgagcccgauaaggccgacccuuucuccuuugaagggccagagauaguggauugugacggaugcaccaucgauuggaagaaaggcaagaaugucacgguuaagacuauuaaaaagaaacaaaagcacaaaggucgcgggaccgugagaacaaucacuaagcagguacccaacgaaucauucuucaauuucuucaacccuuuaaaggcaaguggagacggcgagagccuggaugaagacucugaguuuacccuugcuuccgauuucgagauuggccacuuuuucagggaacggaucgugccacgcgccgucuuguauuuuacaggggaggcgauagaagacgaugacaauuucgaggagggagaagagggugaagaggaggaacuggagggcgacgaagagggggaagaugaggacgaugccgaaauuaaccccaaaguguga

SEQ ID NO: 59492 - RNA, 549 nt, Artificial Sequence
  derived and/or modified sequence opt3 from NAP1L5__Homo_sapiens__NP_715638
auggccgacagcgagaaccagggccccgcugaaccuucccaagcagccgcggcugccgaggcagccgcugaagaggugauggcagaagggggagcccaggguggcgauugcgacucugcugccggggauccagacucagcggcaggacagauggccgaggagccgcagacccccgcugaaaaugccccuaagcccaaaaacgauuucaucgagagucugccaaauagcgucaaguguagaguucucgcacuuaaaaagcugcagaaaaggugcgacaagauugaagcuaaguuugauaaagaguuccaagccuuggagaagaaauacaacgacauauauaagccuuuacuggcgaaaauccaggaacuaacaggcgagauggaagguugugccuggacucucgagggggaagaggaggaagaggaagaguacgaagaugacgaggaggaaggagaggaugaagaggaagaggaggcagcugccgaagcugccgcaggcgccaagcacgacgaugcucaugcggagaugccagacgacgcaaagaaauga

SEQ ID NO: 59493 - RNA, 888 nt, Artificial Sequence
  derived and/or modified sequence opt3 from NAPA__Homo_sapiens__NP_003818
auggacaacagcggcaaggaggccgaagcuauggcacugcucgccgaggcggaaagaaaagugaaaaauucccagucuuucuuuucagggcuuuucggagguaguagcaagaucgaggaggcuugcgagauuuacgccagggcagccaacauguuuaagauggcuaaaaauugguccgcagccggcaacgcuuucugucaagccgcgcagcugcacuugcaguuacagucuaagcaugaugcagcuaccugcuuugucgacgcugggaaugccuucaagaaagcagauccccaagaggcuauaaacugucugaugcgggccaucgaaauuuauacagacaugggacgcuuuacuaucgcggccaagcaccauauuucgaucgcagagauauacgaaacggagcuaguugauaucgagaaagcuauugcccacuaugaacagucagcugacuacuauaagggcgaggaaagcaauaguuccgccaacaaaugccuccugaagguggcagguuacgccgcccuucuggagcaguaucagaaggcgaucgauauuuacgaacaaguagggaccaaugcaauggacucuccuuugcucaaauacagcgccaaggauuauuucuuuaaagcugcccugugucauuucugcaucgacaugcugaacgcaaagcucgccgugcagaaauacgaggaguuauuuccagcuuucuccgauucacgagaauguaagcugaugaaaaaguugcuugaggcccacgaagaacagaaugucgacaguuauacagaaagcgugaaggaguacgauucuauaucccgucuggaccaguggcuaacuaccaugcuccugagaauuaaaaagacaauccaaggagacgaggaagaucuuagguga

SEQ ID NO: 59494 - RNA, 1182 nt, Artificial Sequence
  derived and/or modified sequence opt3 from NAPEPLD__Homo_sapiens__XP_006725119
auggacgagaacgaaagcaaucagucccugaugaccucuucacaauaccccaaggaggccgugagaaaaaggcagaacagugcucggaauagcggcgcauccgauucuucgcgcuucucacgaaagagcuuuaaacucgacuaucgucuugaagaggaugucacaaagaguaaaaaggggaaggacggaagauucguuaacccuuggccaacuuggaaaaauccguccauccccaacgugcugaggugguugauuauggaaaaggaucacucuagcguaccuuccucaaaagaggaguuagacaaggaacugccagugcuaaaacccuacuuuauaacgaauccugaggaagccgguguccgggaggcgggccuccgcgugaccuggcuggggcaugcuacaguuaugguggagauggaugaacuuaucuuccugacugacccaauuuuuaguagcagagccucucccucccaguauaugggaccuaagagguuccggcgcucaccaugcaccaucagcgaguugccgcccauugaugcaguccucaucagucacaaccauuacgaccaccuggauuauaauucugugauagcccugaacgaacgauuuggcaaugagcucagaugguucguaccuuuaggucugcuugacuggaugcagaagugugggugcgaaaacguuaucgaguuggauuggugggaggaaaauugugugccaggacaugacaaagucacauuuguguucacccccucccaacacuggugcaagaggacucugauggacgauaacaaagugcuauggggcagcuggucgguccucggcccuuggaaucgguuuuucuuugcuggggacacaggauacuguccagcauucgaggaaauugguaagcguuucggccccuuugaucuggccgcuaucccgauuggggccuaugagccucgcugguucaugaaauaccagcacguugaccccgaagaggcggugagaauccauaccgauguacagacgaagaaaucuauggcaauacacuggggaacuuuugcccuugcuaacgagcauuaccuggaaccaccugugaaguugaacgaggcccucgaaagguauggccugaaugcagaggacuucuuugucuuaaagcacggugaaucccgguaccugaacaaugaugacgagaacuucuga

SEQ ID NO: 59495 - RNA, 939 nt, Artificial Sequence
  derived and/or modified sequence opt3 from NAPG__Homo_sapiens__NP_003817
auggccgcucagaagauaaacgagggccuggaacaccucgcaaaagccgagaaguaccuuaaaaccggguuccugaaguggaaacccgacuaugauagcgcggcuuccgaauacggaaaggccgcaguggccuuuaagaaugcuaaacaauucgagcaggcaaaggacgccugcuugagagaagcugucgcccaugagaacaauagggcguuauuucacgcagccaaggcuuaugagcaggccgguaugaugcugaaggaaaugcagaaacuaccugaggcaguucaacucauugaaaaggcuucuaugauguaccuggagaacggcacaccagauacugccgcgauggcccuugagcgggcagggaagcugauagaaaauguggacccggagaaagcuguacaguuguaucagcagacggccaacguguucgaaaaugaggaacgccuccgacaagcugucgagcugcugggaaaggccucacgucucuuagugagaggcaggcgguuugaugaggcagcccugaguauccagaaagaaaagaacauuuacaaagagaucgaaaauuaucccaccuguuacaagaaaacaauugcucagguucuugugcauuugcaccgcaacgacuacgucgcggcagagagaugcgugagggaaagcuauuccaucccugguuucaaugggucugaggauugugccgcucuggagcagcuacucgaaggauacgaccaacaggaucaggaccaaguaucggauguuugcaacucaccacuguuuaaguauauggacaaugauuacgccaaacuuggccugagcuuggugguccccggcgggggaaucaaaaagaaaaguccugcaacuccacaggccaagcccgacggugugaccgcuacagccgcagacgaggaagaggaugaauauuccggcgggcucuguuga

SEQ ID NO: 59496 - RNA, 1578 nt, Artificial Sequence
  derived and/or modified sequence opt3 from NAPRT__Homo_sapiens__NP_001273758
auggccgcugagcaggaccccgaagcaagagccgcggcuaggccucugcucaccgaucuuuaccaagccacaauggcacugggcuauuggcgggccgggcgcgcucgagacgcagccgaguucgaauuguuuuuccguagaugcccauuuggaggugcuuucgccuuagcggcaggccugagggauugugugcgguuucuacgcgccuucagacucagggacgcugauguccaguuucuggccagcguucuuccgcccgacacugauccugcauucuuugagcaucugcgggcuuuggacugcuccgaagugacgguacgcgcccucccagaggggucucuggcguuccccggagugccucugcuccaggucucaggcccauuacuggugguucagcuuuuggagacaccccugcuaugucucgugaguuacgccagccuggucgcaaccaacgcugcccgacuuagacugaucgcugguccugaaaagagguugcucgagauggggcugcggcgugcccaaggaccagauggcggcuuaacugcauccaccuauucuuaccucgggggauuugacucgucaagcaaugugcuggccggucagcuucgcggcguaccgguugcugggacacuggcgcacaguuucgugaccuccuuuucuggaagcgaagugcccccugauccaauguuggcacccgccgcuggcgaggguccuggggucgaccuagccgcaaaagcccagguguggcuggagcaggucugcgcucaccucggacugggcguucaagaaccacaucccggcgagagagccgcauucguggcguaugcucuugccuucccgagggcauuucaggggcuguuggauacuuacuccguauggcggucaggacucccuaacuuccuggccguggcuuuagcccugggugaacuaggcuaucgagcagucggggugcgccucgacaguggagaccugcuucagcaggcucaagagauuagaaagguuuuuagggccgcggccgcucaguuccaggugcccugguuggaaagcguccugauagugguaucuaauaacaucgaugaggaggcacucgcccggcuggcucaagaaggcuccgagguuaaugugauugguaucgggacaucagucgugaccuguccacagcagccuagccuuggcggagucuacaaacugguggccguuggcgggcagccccgcaugaaguugacggaagacccagagaaacaaacucuccccggaaguaaggcagcguuuagacuguuagguucugauggcuccccucugauggacaugcuacagcucgccgaggaaccagugccgcaggcugggcaggagcugaggguauggcccccuggagcccaagaaccaugcaccguccgucccgcacagcuuugugagccuuugccaagccuggcugaaucgcgggcccucgcacagcugucuuuaucccgacugucacccgagcacagaaggcuucgcaguccggcccaguaccaagugguuuugagcgaacggcuccaggcucuggugaacucccuaugcgcgggccagucuccuuga

SEQ ID NO: 59497 - RNA, 1263 nt, Artificial Sequence
  derived and/or modified sequence opt3 from NAPSA__Homo_sapiens__XP_011525842
augucacccccuccacugcuccagccgcuucuguuguuacugccccuacucaacguggagccuuccggcgccacccugauccggauuccacuucacaggguccaacccgggcggcgcauacugaauuugcuccgaggauggcgugaaccugcugagcugccaaagcugggugcacccucuccuggcgacaaaccaaucuucguuccgcucucaaacuacagagaugugcaguauuuuggggaaauuggauuaggcacacccccucagaauuucacuguagccuuugacacggguaguagcaaccugugggugccauccaggcggugccauuucuuuucuguccccuguuggcuucaccaucgcuucgauccuaaggcgucgagcagcuuucaggcuaaugggaccaaauucgccauccaauacggaacaggcagaguggacggcauuuugagugaggauaagcugacuaucgggggaauaaaaggugcauccguuaucuuuggcgaagcccuaugggagccaucucucguguucgcuuuugcacacuucgacgggauucugggacuuggcuuucccauccugagcgucgagggugugaggccgccuauggauguauugguugaacaggggcuccuggacaagcccguguucuccuucuauuuaaaccgggauccagaggaaccugacggaggcgagcugguccucggcgggucagaucccgcccauuacauuccaccccuuaccuuugugccugugacagucccagcuuauuggcagauccacauggagcgcguuaaggugggaccgggucugaccuugugcgccaaaggcugugcggcaauacuagacacugggacaagucugauuaccggacccacggaagagauccgagcccuccacgcugccauuggcgguaucccucugcuugcaggggaauacaucauucugugcagcgagauaccaaaguugcccgcuguaucuuuccuccugggcggagugugguuuaauuuaacugcccaugauuaugucauccagaccacaagaaacggcgugaggcugugucuauccggguuccaagcgcucgacguuccuccacccgccggaccguuuuggauucugggugacguguuccuuggcacuuacgucgcaguguuugauagaggggacaugaaaucaagcgcucguguaggauuggcccgcgcuagaaccaggggcgccgaucuggguuggggcgaaacagcacaggcccaguucccuggguga

SEQ ID NO: 59498 - RNA, 1125 nt, Artificial Sequence
  derived and/or modified sequence opt3 from NARFL__Homo_sapiens__NP_001291728
auggccgcucccagccagcaaagacugguggucguuuccgugucuccucagucaagggcaagucucgccgcgcgguuccagcuuaacccaaccgacacagcucgcaagcugacuagcuuuuucaaaaagaucggcguacacuuuguguucgauacggccuuuucccgacauuucucuuuguuagagucgcagcgugaauuugucagaagguuccgggggcaagcagacugccgccaggcccugccgcuacucgcuucagcaugucccggauggauuugcuacgccgagaaaacccacgguagcuuuauacugccucauaucaguacagcuagauccccacaacaggugaugggcucucuuguuaaggauuucuuugcccagcagcagcaccugacucccgacaaaauuuaucaugugaccgucaugccuuguuacgauaagaaguuggaagcgagcaggccagacuucuuuaaucaggagcaccaaacacgggauguggacugcguacucaccacuggggaaguuuuccgccugcuggaggaggaaggagugucccuccccgauuuagagccugcaccacuggacucacuuuguaguggcgccagcgcugaggaaccgacaucucaccgaggugggggauccggcggcuauuuggagcaugucuucagacacgccgcaagggaacuguuugggauccauguggcugaggugaccuacaaaccccuacggaacaaggauuuccaggaagucacgcucgagaaagaaggacagguucugcuucacuuugccauggcguaugguuuccguaauauucaaaaccuggugcagcgcuugaagagagggaggugcccuuaccacuauguagaggugauggccuguccaucaggcugccucaauggaggcggucagcugcaggcacccgaccggccuagccgagaguuacugcaacaugucgaacgccucuacgggauggugagagcugaggccccagaagaugcucccggaguucaggagcuuuacacucacuggcugcagggcaccgacagugaaugugccggcagguugcuacauacacaguaucacgcaguggagaaagccucuacugggcugggaauccggugguga

SEQ ID NO: 59499 - RNA, 597 nt, Artificial Sequence
  derived and/or modified sequence opt3 from NARR__Homo_sapiens__NP_001243210
auggugggccagccccaaccuagagacgaugucgggagcccaaggccgcggguuaucgugggaaccauucgcccccgaguaauaguggguacaauccguccuagagucauugugggcuccgccagggcucggccacccccugacgggacuccacgcccccagcuggcagccgaggaaucuccuagaccaaggguuaucuucggaacgccgcgggcgcgcgugauucucggcucaccccgaccuagagucaucgugaguagcccauggcccgcuguaguuguggccuccccuaggccacggacccccgucgguucuccguggccucgugugguggucgggacaccccgcccaagaguuauagugggaucgccuagggcacggguagccgaugcugaccccgcaucagccccaagccagggcgcccuucagggccgacgccaagaugagcacagugggacuagagcugaaggauccaggcccgguggcgcggcaccugugccagaggaagggggacgguuugcccgcgcucagagacugccgcccccuaggcauuugcguuuaccaggcgcccccgaccggcaccgaggucagaucuga

SEQ ID NO: 59500 - RNA, 1647 nt, Artificial Sequence
  derived and/or modified sequence opt3 from NARS__Homo_sapiens__NP_004530
auggugcuggccgagcucuacgucagcgacagagaaggcuccgaugcuaccggggacggaacaaaggagaaacccuucaagacuggucuuaaagcacugaugacgguuggcaaggaaccuuuuccaaccaucuauguggauucucagaaagagaacgaaagguggaauguaauuucaaagagucaauugaagaacaucaaaaagauguggcaccgggagcagaugaaaagcgagucccgcgaaaagaaagaggccgaagacucuuuacgacgugagaagaaucuggaggaagcgaagaaaauaacaauuaagaacgauccgucgcuacccgagccuaaaugcgugaagaucggggcucucgaaggauacagaggccagagggucaaaguguucgguuggguucaucggcugcgcagacaggggaagaaucuuauguuucugguguugagggacggaacuggcuaucuccaauguguccuggccgaugagcugugccaguguuacaacggcgugcucuuaucaaccgaaagcaguguagcaguuuaugggaugcugaaucuuacaccaaaaggaaagcaggcccccgguggccacgaguuguccugcgacuucugggagcugauugggcuagcuccugcaggaggcgccgauaaccucaucaaugaagagucugacguggauguccagcugaacaaucggcauaugaugauacgcggugaaaacaugagcaagauccuuaaagcucgauccauggugaccagauguuuuagggaccacuucuuugaucggggguacuaugaggugacuccacccacacugguccaaacccagguugaaggaggcgccacguuguucaagcucgacuacuuuggcgaggaggcguuccugacucagucaagucaguuauaccuggaaaccugccucccugcacuuggggacguguuuuguauugcccaaagcuaucgugcugagcagucucgcacaagaaggcaucuggccgaauacacucacguagaggcagaaugcccauucuugaccuuugaugaccuacugaaucggcucgaggaucuggugugugacgucguggaucgaauccuuaaauccccggcuggaucaauuguucacgagcugaaccccaauuuccagccuccaaagcgccccuucaaaagaaugaacuauagcgacgccaucgugugguugaaggaacaugaugucaagaaagaggacgguacauuuuacgaguucggcgaagauauaccugaggcgccagaaaggcucaugaccgacacgauuaacgagcccauccuguuaugccgguuuccgguggaaauuaagaguuucuauaugcaacgcuguccugaggauucuagacugacugaauccguagacguucuaaugcccaaugugggggagaucgucggaggcagcaugaggaucuuugacucggaggaaauucucgccgguuacaaacgugaggggauagauccaacaccuuauuacugguacaccgaccagcggaaguauggcacuugcccccacggaggcuacgggcugggacuugaacgauucuugacauggauccugaacagauaucauauuagggaugugugccucuacccacgcuuuguccagcgguguacccccuga

SEQ ID NO: 59501 - RNA, 3078 nt, Artificial Sequence
  derived and/or modified sequence opt3 from NAT10__Homo_sapiens__XP_011518499
augcacagaaagaaaguggacaacaggauccggauucugauagagaauggcgucgccgaacgccagcgaagccucuucguugugguaggggaucguggaaaggaccaaguggucauccuucaucacaugcuguccaaagcuaccgugaaggcaagacccucuguuuuguggugcuacaaaaaggaguuagguuuuucaagucauaggaagaaacggaugcgccagcugcagaagaaaauuaagaacggcacacuaaauaucaaacaggaugacccuuucgaacucuuuauugccgcgacuaacaucagauauuguuacuauaaugagacgcacaagauacuggggaacaccuucggaaugugcgugcuucaagauuuugaagcucugacaccaaauuugcucgccaggacugucgagaccguggagggcggugggcugguaguuauccugcuccggacaaugaacagcuuaaagcagcuguacaccgugacuauggacguccauucccgcuaucgaacagaagcacaccaggauguggugggaagauucaaugagagguuuauucuuucuuuggccucguguaaaaagugccuggucaucgacgaucagcuaaacauucucccgaucucaagccacguugcuaccauggaagcacugcccccucaaacgccagacgagagucuuggccccuccgaucuggaguugcgggaacucaaagagucucugcaggacacucagccugugggcguauuaguggauuguugcaagacccuggaccaggccaaagcuguccucaaguucauagaagggauuagcgagaaaacacuucguuccacuguggcccugaccgcggcacgcggaagagguaagucagccgcuuugggccuagccaucgcaggggcuguugccuuuggauacaguaauauuuucgugacaagcccaucucccgacaaccugcauacccucuuugaguucgucuuuaagggcuucgaugcgcugcaauaucaggaacaccuugacuacgagaucauccagucccugaauccugaguucaacaaagccgugauuaggguaaauguuuuucgggaacaucgacaaacgauacaguacauccacccagcagaugcugugaaguugggucaggccgaacucgucgugauugacgaggcugccgcaaucccgcugcccuuagucaaaucacugcuagggccuuaucucguguucauggccagcacuauaaacggauacgaaggcacaggccgcagucugucucuuaaguugauucagcaacugagacagcaguccgcucagagccaaguuucgaccacugcggagaacaaaacaaccacgaccgcaaggcucgccucugcucggacacuguaugaggugucccuucaggaaucaauccgcuacgccccaggggaugcaguagagaaguggcugaaugacuugcucugucuggauugcuuaaacaucacuagaauugucaguggauguccccugccugaagccugcgagcuauauuacgugaauagggacacccucuuuuguuaucacaaggcuagcgaaguuuuccugcagcgucuuauggccuuguacguggcaucccauuacaaaaacucuccaaaugaucugcagaugcucagcgacgcgcccgcucaccaucuguuuugcuuacugccgccugugcccccaacacaaaacgcccuuccugaggucuuggcaguaauccaggugugccucgagggugaaauuucacggcagaguauacuuaauucccuaagccgaggcaagaaagccucuggggaucugauccccuggacuguuucagagcaguuccaagacccagacuuuggaggccucaguggugggagagucgugaggauugcugugcaccccgauuaucagggcaugggauacggcagccgcgcccugcagcuuuugcaaauguauuacgaagggcgguucccuugucuggaggagaaggucuuagaaaccccacaggagauccauacaguuuccucugaagcagugucgcuccuggaggaagugaucaccccgagaaaagaccuucccccucuguugcucaagcugaacgagaggccagcugagcgccuagauuaucugggaguaagcuacggucucacuccccgacugcuuaaguuuuggaaacgggccggcuucgucccuguguauuugcgucagacgccaaaugaccugacaggggaacacuccugcauuauguuaaagacccucacugaugaggacgaagcggaucagggaggcuggcuggccgcuuuuuggaaagacuucagaaggcgcuuucuugcacugcuaucauaccaauucaguaccuucucucccagccucgcccugaacauaauccagaaucggaacauggguaagccggcucagccugccuuguccagagaggaacuggaggcauuauuucucccauacgaucugaaaaggcuugagauguauucacgaaauaugguugacuaccaccugauuauggauaugauccccgcgauuagccgcaucuauuucuugaaccagcucggggaccuggcccuaucugcugcccaauccgcacugcuucucggcauaggacugcagcauaagaguguggaucaguuggaaaaggagaucgaacugccuagcggccaguuaauggggcucuuuaaucggauuaucagaaaagucgugaagcuguucaacgagguucaagaaaaagcuauugaggagcagaugguggccgcaaaggacguagucauggaacccacaaugaaaacccuuucugacgaucuggacgaggccgcuaaggaauuucaggagaaacacaagaaggaggugggaaaauugaaguccauggaucucucagaauacaucauaaggggugacgaugaggaauggaacgaggugcugaauaaagcgggcccaaacgccaguauuaucagccuaaagucggacaaaaagcguaagcuggaagcaaaacaagagccuaagcaguccaaaaagcugaaaaaucgcgagacuaagaacaagaaagauaugaagcucaaacggaagaaauga

SEQ ID NO: 59502 - RNA, 621 nt, Artificial Sequence
  derived and/or modified sequence opt3 from NAT14__Homo_sapiens__NP_065111
auggcccccagccaccuguccgugagagagaugagggaagacgagaagccucucguccuugaaaugcugaaagcuggcguuaaggauaccgagaaccggguggcauugcaugccuuaacacgcccaccggcgcugcuacuccuggcugccgcaucuucagggcuucgauucguacuggccaguuuugcuuuggcacuccugcugcccguguuccucgccgucgcugccgugaaauuaggacugcgugcgagaugggguagccuuccuccacccggcggguugggaggcccuuggguugcagugagggguuccggggacgucugcggagugcuggcccuagcuccaggcacuaaugccggcgauggggcacggguaacgcgccucucuguuucgagauggcacaggcggcgcggagugggucgaagacugcuugcuuuugccgaagcgagggcccgggcaugggcuggcgggaugggagagccccgugcccgccuggucgugccuguggcugucgccgcauggggcguuggugggauguuggagggauguggcuaccaggccgaaggcggguggggaugccucgguuauacccuggugagagaguucucaaaggacuuauga

SEQ ID NO: 59503 - RNA, 873 nt, Artificial Sequence
  derived and/or modified sequence opt3 from NAT1__Homo_sapiens__NP_001153646
auggacaucgaggccuaccuggaaagaauuggcuauaagaaaagcaggaacaagcucgaucuugagacccugacagacauauugcagcaccaaauccgggcugugcccuucgaaaauuuaaacauucauugcggggaugcaauggaccugggacuagaggccaucuuugaucaggucguucgccgaaaucgugguggcuggugucuccaggugaaccaucugcuuuacugggcgcugacuacgauuggguucgaaaccacaauguugggaggcuauguauacuccacuccugcuaaaaaguauucuaccgguaugauccaccuccugcuccaggugacaauagacgggagaaauuacaucgucgaugccggauuuggcaggucauaucaaauguggcagccacuggaguuaauuaguggcaaagaccagccccaggugccgugcguuuuccggcugaccgaggaaaacggguuuugguaccuugaucaaauccgcagagagcaguacauuccuaaugaagaguucuugcacagcgaccugcuagaggauuccaaguauaggaagaucuacucuuuuacucucaaaccacggacaauagaagacuucgagucgaugaacaccuaucugcagacgucacccagcaguguguuuacuuccaagucuuucuguagccuucagaccccugauggaguccauugccugguggguuuuacauugacucaccgccgauucaauuacaaagacaacaccgaccucauugaauuuaagacacuguccgaggaagagaucgagaaaguauuaaagaauauuuucaacaucucacugcaaagaaagcucguuccaaaacacggcgauagguucuuuaccaucuga

SEQ ID NO: 59504 - RNA, 873 nt, Artificial Sequence
  derived and/or modified sequence opt3 from NAT2__Homo_sapiens__XP_011542660
auggacaucgaggccuacuucgaaagaauuggcuauaagaacagcaggaauaaacuggaucucgagacccuuacagacauacuggaacaccagauccgggcugugcccuuugagaacuugaauaugcauugcgggcaagcaauggaauuaggacuggaggccauuuucgaucacaucguccgccgaaaccgugguggcuggugucuacagguuaaucagcuccuguacugggcgcuuacuacgauuggguuucagaccacaaugcugggaggcuauuucuacaucccuccagugaacaaguauuccacugguaugguacauuugcuccugcaagugaccauagacgggagaaauuacaucgucgaugcuggaucuggcucaaguagccagauguggcagccgcuggagcucauuuccggcaaagaccagccccaagugccuugcaucuuuuguuuaacagaagagagggggauuugguaucuggaucagauccggcgcgaacaguacauaaccaacaaggaguuccuuaauucucacuugcugcccaaaaagaagcaucagaaaauuuaccuauuuacucucgagccaagaacaaucgaagacuucgagucgaugaacaccuaucugcaaacgucaccuacuagcaguuuuauuaccacauccuucugcucucuucagacuccagaaggaguuuacugucugguggguuuuaucuugaccuauaggaaguucaauuacaaagauaacacagaccucgucgaguuuaagacccugacggaagaggagguggaagagguauuacggaauaucuucaaaauuagccugggccgcaaccucguucccaagccuggggauggaucccuuacuauauga

SEQ ID NO: 59505 - RNA, 861 nt, Artificial Sequence
  derived and/or modified sequence opt3 from NAT6__Homo_sapiens__NP_001186947
auggagcugauccucagcaccucccccgccgaacuuacacuggacccugcuugccagccaaaguugccguuagauucuacuugucaacccgagaugacguucaacccuggcccaaccgaacugacacuagaccccgagcaccagccugaagagacuccagcacccucacucgccgagcugacccuugaaccugugcauagaaggccagagcuguuggaugcgugcgcugaccucauuaaugaucaguggccgcggagucgcacaagccgacugcacucccuggggcagucuucggacgccuuuccccucuguuuaaugcugcuuucaccucauccaaccuuggaagcagcccccgucguugugggacacgcucgucugagcagaguacuaaaccaaccucagagucuccugguggagacugucgugguugcaagggcccuucggggucgcggcuucgggagaaggcugauggagggauuggaaguguuugcucgggcccgcggcuuccgaaaacuccaucugacaacccacgaucagguccacuuuuacacgcauuuagguuaucagcugggggagccagugcaaggacucguauucacuuccagaaggcuucccgcgacccuguugaaugcauuuccgacagccccuucuccccggccaccucguaaggcucccaaccuaacugcccaggcagcuccacgcggccccaaaggcccuccacugccgcccccuccaccccucccugaaugccugaccauaagcccacccguuccguccgggccuccaucaaagagucuucuggagacacaguaccagaaugugagaggaaggcccaucuucuggauggaaaaagacauuuga

SEQ ID NO: 59506 - RNA, 684 nt, Artificial Sequence
  derived and/or modified sequence opt3 from NAT8B__Homo_sapiens__NP_057431
auggcccccuaccacaucagaaaguaucaggagagcgacaggaaauccguggucggccugcucucucgggggauggcugaacaugcuccugccaccuuccgccgacuucugaaguugccacguacauuaauucugcuacucggaggugcgcuggcacuucuguugguuucaggcaguuggauacucgcccugguguuuagccugucccucuuaccggcacugugguuccuugccaaaaagcccuggacuagauacguagauaucgcuuugaggacggacaugucugauauuaccaaaucguaucugucagagugcgggagcuguuuuugggugggagaaagugaggaaaaggucgugggcacaguuggugcacuaccuguggacgauccaacucuccgggagaagcgccugcaacuuuuccaccuguccgucgacaacgagcauagagggcagggaaucgccaaagccuuggugaggaccguacuccaguuugcucgggaucagggcuacucugaaguugugcuggacacaagcaauauucaauuauccgcgaugggccuguaucagucacucggguucaagaaaaccggacagagcuuuuuccacgucugggcacgccuuguggaucugcauacugugcacuuuaucuaccacuugcccagugcccaggcuggucgacuauga

SEQ ID NO: 59507 - RNA, 684 nt, Artificial Sequence
  derived and/or modified sequence opt3 from NAT8__Homo_sapiens__NP_003951
auggcccccugccacaucagaaaguaccaggagagcgacaggcaauggguggucggccugcucucccgggggauggcugaacaugccccugcaaccuuccgccagcuucugaaauugccacgaacauuaauucugcuacucggagguccgcuggcgcuucuguugguuucuggcucauggcuccuggcucugguguuuaguauaagccucuuccccgccuuaugguuucuggcaaagaaaccuuggacugaguauguagauaugacgcuuuguaccgacauguccgauaucacaaagucuuacuugucggaacgugggucaugcuucuggguggccgagagcgaagagaaagucgugggaaugguuggcgcucugccaguggacgaucccacucuaagagagaagaggcuccagcuguuucaccuuuucgucgacagugaacaucggcgccaggguauugcaaaggcccuggugagaaccguauugcaauuugcuagggaucagggguauuccgagguuauccucgacacaggaaccauucagcugucugccauggcguuauaccagagcaugggcuucaaaaagacuggccaauccuuuuucugugugugggcacggcuggucgcccuccacacagugcauuuuaucuaucaccuuccuucaaguaaaguggggagccuguga

SEQ ID NO: 59508 - RNA, 909 nt, Artificial Sequence
  derived and/or modified sequence opt3 from NAT8L__Homo_sapiens__NP_848652
augcacugcgggcccccugacauggugugugagaccaagaucgucgccgcugaagaucaugaggcacugccaggcgccaagaaggacgcgcuccuugcugccgcaggagccauguggccgccccugccugcugcaccaggucccgccgcugccccuccagcgcccccuccagcaccgguugcccagccccacggcggggcuggaggcgccgguccuccagggggaagaggcgugugcauuagggaguuccgggcagcugaacaagaagccgcgcgccgaauauuuuacgauggcaucauggagcguauucccaacacagccuucagaggguugaggcagcauccucgggcacaguuacuguaugcucuacucgccgcucuguguuuugccguaagccgcucccuucuguugacuugccucgugccagcagcccugcugggacucagauacuauuacucuaggaaagucauccgggcuuauuuagagugugcgcugcacacggacauggcagauauugaacaguacuauaugaagcccccggguucaugcuucuggguggccguucuugacggcaauguggucgggaucguggcugcccgcgcacaugaggaagauaacaccguagaguugcugcgaaugaguguugacagcagauuuaggggaaaaggcauagccaaggcucuaggucggaaggugcucgaguucgccgucgugcacaauuacuccgcagugguccuggggacaacugcgguuaaaguggcugcccacaaacuuuacgaaucucugggauuucgucauaugggcgcaucggaucacuauguauugccuggcaugacccucucacuggccgagcgcuuauucuuucaagugagauaccauagguaucggcugcagcuccgagaagaguga

SEQ ID NO: 59509 - RNA, 4452 nt, Artificial Sequence
  derived and/or modified sequence opt3 from NAV1__Homo_sapiens__NP_001161210
augcugcaccucccccuuccuagaagcggcaggaccgugaacuucccacgguccugggacgagucuucaaguaucagcuccgggcugucugaugccucggacaauuugucaagcgaagaguuuaacgcuaguuccucuuuaaauagccugccguccacacccacugcaucacgccgaaacaguacgauuguccuacguaccgauagcgaaaagagaucucucgccgaguccggacugucaugguucagcgaaagugaggagaaagcgccuaagaaacuugaauacgacucugguucccugaagauggagccaggcacaagcaaauggaggcgggaacgccccgagucgugcgaugacucuuccaaagggggagaguugaagaaaccuauaucacucggccauccagguagucugaagaaagggaagacucccccuguugcugugaccagcccaaucacacacaccgcccaguccgcacugaaaguagccggaaagccggaaggcaaggcuacugauaaaggcaagcucgcagugaaaaauacaggguuacaaagaucuagcucagacgccggaagggaucggcugagugacgcuaagaaacccccuuccgguauugcccgcccaagcaccucuggcucauuuggguauaagaaacccccuccagcgacgggaacugcaaccgucaugcagacaggcgguagugccacucuuagcaagauccagaaguccucugggauucccgugaaaccgguuaacggacgaaagaccucguuggaugugagcaauuccgcugagccuggcuuccuggcccccggcgcaagaucaaacauccaguacaggagucuaccacggccugcuaaaucuagcuccaugucagucacagggggacgugguggcccccgcccagugucuagcuccauagaccccagucuccugagcaccaagcaagggggacuuacgccuucuagacugaaagaaccaacuaagguagccuccggcaggacaaccccggcgcccguuaaucagacugaucgggagaaggaaaaagccaaggcaaaagcuguggccuuggacucagacaacaucagucucaagagcauugguucgccugaguccacaccaaagaaucaggcuucucaucccaccgccacgaagcuggcagaguuaccuccaacaccccugcgagccaccgcuaagagcuuugucaaaccgccuucacucgcgaaccuugauaaggugaauaguaacucccuggacuugccaucuagcuccgauacuacccacgcaucaaaagugcccgaccuacaugccacaagcagugcuucugggggcccucugcccuccuguuucacuccaagcccugcccccauccucaauauuaacucggcaucauuuucucagggacuggaacuuaugaguggcuucuccgucccaaaggagacccgcauguauccgaaacugagcggguugcacagaucuauggaaagccuccaaaugccuaugucccugcccucagccuuuccaaguagcacacccguuccuaccccacccgcuccuccggccgcaccaacugaggaagagacggaggaauuaacauggucuggaucccccagggcgggucagcuggauucaaaccagcgggaccgcaauacccuaccuaagaagggccucagauaccagcugcaaagucaggaggaaacuaaagagaggcgucacagccauaccaucgggggacuuccagaauccgaugaccagucugaguugcccucgccuccggcucugcccaugagccucucagccaagggccaacugacaaacauaguguccccaaccgcagccacuacaccucggauuacgcgaaguaauucuauccccacccacgaggcugccuucgaacuuuauagcgguucccagauggggucaacucugucuuuggcagagagaccaaaaggcaugauuaggagcggaaguuuucgcgauccuacagacgauguacauggcuccgugcucagccuggcuucuucagccuccaguaccuacagcucggcggaggaacggaugcagucugagcagaucagaaaguuaaggcgcgaacuggaguccagccaagaaaaagucgccacacuaacuucacagcucagugcuaacgcaaaucugguggccgcuuucgagcagucucuuguuaacaugaccucccgauugcggcaccuggccgaaacggcagaggagaaggacaccgaacuccuggacuuacgugagacaaucgauuuucugaaaaagaagaauagcgaagcgcaggccgugauucaaggggcucuuaacgccucagagacuacccccaaagaauugagaauaaagaggcagaauaguagcgacuccaucucuagccucaacuccauuacaucacacucuaguaucggaucgagcaaagaugcagacgcuaagaaaaagaagaaaaaguccuggcugcggucuucauucaauaaagccuucagcauaaagaaagguccaaaguccgcaaguucuuauagcgauauugaggagaucgccacuccggacucauccgcuccuaguagccccaagcuacagcauggcucuaccgaaacggcguccccaucaaucaaaagcucgacaucuaguuccgucgggaccgaugugacugagggacccgcccacccugcaccacauacacgccuguuucacgcuaacgaagaggaggaacccgagaagaaagaaguaagcgagcucagaucagaacugugggagaaggagaugaaacuuaccgacauuagguuggaagcccuuaauuccgcccaucaguuagaucaacuccgagagacuaugcacaacaugcagcuggaaguugaccuucugaaggcugagaaugaucgcuugaagguggcaccuggcccgucuagcgguaguaccccagggcagguccccggcuccagcgcccucucuucaccucggagaagucugggacuagcgcugacacacuccuucggccccagccucgcugacacggaucugucuccaauggacgggaucucgaccugcggaccuaaagaagaggugacucuuagggucgugguucguaugcccccacagcauauuauaaagggcgacuugaaacaacaggaguuuuuccuggguuguucaaaggugagcgggaaaguagauuggaagauguuagacgaagccgucuuucagguguucaaagauuacaucuccaagauggacccugcaaguacacucggacugucuaccgagagcauucacggcuacuccaucucacauguuaagcgcgugcuugaugccgaaccgcccgagaugccaccuugccggagaggugucaacaacaucagugugucucugaaaggccuaaaggaaaaauguguagacagccucguguuugagacacugauucccaagccaaugaugcaacacuauauauccuugcuguuaaaacacaggcgacucguucugucagggccuagcggaacuggcaagaccuaccuuacgaaucggcuggcugaguauuuggucgaacgcucugggagagaggugacagaaggaaucguguccaccuucaacaugcaucagcagaguugcaaggaucuccagcuguaccuaagcaaucuggcaaaccaaauugacagggagacuggcaucggugaugucccccuuguuauucuccuggacgauuugucggaagccggguccaucucugagcuggugaauggagcguuaaccuguaaauaucacaagugcccguacauaaucggcacaacuaaccagccagugaaaaugaccccuaaucauggucuccaccugucauuucggaugcuuacauucagcaacaauguagagcccgcuaacggcuuucugguccgauauuugagacgcaagcucguggaaagugacuccgauauuaaugccaacaaagaggaacugcuaaggguucuggacugggugccaaagcugugguaccaucuccacacguuccuggagaagcacucuaccagcgacuuuuugaucgggcccuguuucuucuuaucaugcccuauuggaaucgaggauuuucguacuugguucauagaccuguggaauaacuccauuaucccguaccuccaggaaggcgcaaaagaugggauuaagguccauggacagaaagccgcuugggaggaccccguggaauggguucgggauacacugccauggccuagugcccaacaggaccagagcaaacuuuaucaucugcccccuccaaccgugggcccccacucuaucgcaucaccuccagaggauagaacuguaaaggacuccacacccagcucuuuggauagugacccgcuaauggcuaugcugcucaagcugcaggaagccgcgaauuacauagagucgccugauagggagaccauccuugacccaaacuuacaagccacgcuguga

SEQ ID NO: 59510 - RNA, 7098 nt, Artificial Sequence
  derived and/or modified sequence opt3 from NAV2__Homo_sapiens__NP_001104488
auggaaagcguguccgaaucuucacaacaacagaagcgcaaacccgucauccacggccuggaggaccagaagaggauuuacaccgauugggccaaccauuaucucgcuaaaagugggcacaagcggcuuauacgcgaccugcagcaagauguuacagacggaguguuguuagcacagaucauucagguaguggccaaugagaaaaucgaggauauuaacgguugcccuaagaaucgaagccagaugaucgaaaacauagacgcgugucugaauuucuuggcugccaagggcaucaacauucaagggcucuccgcagaggagauccguaauggaaaccugaaagccauucuuggccuguuuuucucuuugucgagauacaagcagcagcagcaacagccacagaaacaacaucucucaagcccgcugcccccugcugucagucagguggccggugccccaucccagugccaggcugggacuccccaacagcagguuccugugacgccacaggcccccugucaaccucaccagccagcgccgcaucagcagucuaaggcacaagccgaaaugcagagcaggcugcccggaccuaccgcucgggucuccgccgcaggcucagaggcuaaaacacgcggcgggaguacuaccgccaauaacagaaggagccagucuuuuaauaacuaugauaaguccaagccagugacaucacccccuccacccccgagcagucacgaaaaagagccucucgcgucuuccgccagcucgcaccccggaaugucugacaaugcaccagcuuccuuagagucagguaguagcuccaccccuacuaacugcucuacaagcucagccaucccccagccaggcgcugccaccaagcccuggcggaguaaaucccugagcguaaagcauucugcaacgguuucaaugcuuagugugaaaccuccagggccggaagcaccccgcccuacuccagaggcuaugaagcccgcgccuaauaaccagaaaucaauguuggaaaagcugaagcuauucaacuccaaaggaggcucuaaggccggugaagggccaggaucgcgagauaccagcugugaaagacucgagacacugcccuccuuugaggaaucagaggaacuugaggcagcuaguaggaugcugacuaccgucggcccggccucuagcuccccuaaaauagcauugaagggcauugcccagcggacauucucacgugcucucaccaauaaaaagagcucucugaaggggaacgaaaaagagaaggagaaacagcaacgcgaaaaggacaaagagaaguccaaggauuuagccaaaagagcaagugugacggaaaggcuggaccucaaggaggaaccaaaagaggaucccagcggagcggcugugccugagaugcccaagaaaucuuccaagaucgccucauuuauuccaaaggguggcaaacuuaauagugcaaagaaagaaccuauggcccccagccacucggggaucccaaagccgggaaugaaauccaugccuggcaagucucccagcgcuccagcccccucaaaagagggugaacggagucgauccgggaagcugucuagcggcuugccucagcagaagccacagcuagacggacgccauuccucaagcaguucuucccuggcaagcucggagggcaaagggcccggagguacuacacucaaccacucaaucucuagucaaaccgucuccggcagcguugggacuacacagaccacgggaucuaauaccgugagcguacagcugccucagccgcaacagcaguacaaccacccaaauacagcuacuguggcccccuuccuuuauagaucccagaccgacacagagggcaacgucacugcggaaucaaguagcaccggugugucuguugagccuucccauuuuacaaagaccgggcaaccagcccuggaagaguugacuggcgaagaucccgaggcuaggcggcuccgcacggugaaaaauauugcagaccugagacagaacuuagaggaaacaaugucaagucugaggggaacccaggucacucacagcacccuagagacaaccuucgauacuaaugugacaacggaaauguccggccguucuauacucucgcugaccgggcggccuacuccgcuuagcuggcgauugggacaaucaucccccagacugcaggccggugacgcuccaaguaugggcaacggguacccucccagggccaaugcaucucgcuuuaucaacacagagagcggacgguauguauacuccgcgccacucagaaggcagcuggccucacgcggcucuagcguuugccauguggaugucagugacaaggcuggugaugaaauggaccuugaggggauuuccauggaugccccuggcuacaugagcgacggagaugugcugucuaaaaauauccgaaccgacgacauaacaucaggcuauaugacugaugggggauugggccucuacacccggcgucugaacagauuacccgacgguauggcagucgugagggagacgcugcagcgcaacaccucccuagggcucggagaugcugacaguugggaugacagcucgucuguuuccagcggcauuucagauacaaucgacaaucugaguacugaugacaucaacaccucuuccagcauuucaaguuaugccaauacaccagcaagcucccggaagaaccuugaugugcaaacugacgccgaaaagcacucucagguagagagaaauagcuugugguccggugaugacgucaaaaagucagacggcgggucugauaguggaaucaaaauggaaccgggcucgaaguggaggcgaaacccuagcgacguguccgaugagucugacaaaucaaccagcgggaagaagaaucccguuauuucccagacgggaaguuggcgccggggcaugacagcucagguggguauaaccaugccaagaacuaaacccucugcgccugccggggcacugaagacaccaggaaccggcaaaacugaugacgcuaaggucagcgaaaaagguaggcucucacccaaggccucccaagugaagcguaguccuagcgaugccggcagaucuuccggggacgagagcaaaaagccgcugccaagcucgucucggacccccacagcuaacgcaaauaguuucggauuuaaaaagcaguccggcagcgccgcgggguuagcuaugaucacggccucaggaguaaccgugacuuccagaucugcaacacugggcaaaauuccuaagagcagugcccuuguuuccaggagcgcuggucgaaaaucuucaauggauggggcacagaaccaggacgauggauacuuggcccucaguucccggaccaaucugcaauaucgcagccuacccagaccaucuaagucgaacucaaggaauggcgcggguaaccggagcuccacaaguucuaucgacagcaauaucuccucaaagagugcuggccugccuguccccaaacuccgagagccaucuaagacugcccuggggagcucccuuccuggauuggugaaccagaccgauaaagaaaagggcauuucaagcgacaacgagucuguggcauccuguaauagugucaaaguuaacccggccgcucagcccgugagcucgccagcccagacgucccugcaaccuggggcaaaguaccccgacguggcuucuccaacauuaagacgccucuucggaggcaagccuaccaaacagguacccauagccacugcggaaaauaugaagaacucagucgugaucagcaauccgcaugccaccaugacacagcaagguaaccuggauaguccauccgggucuggaguucuuagcucaggcuccaguagcccucuguauucuaaaaauguggacuugaaccagucaccccucgcauccagcccaucuagugcucacucggcccccuccaauagccugacuuggggcaccaacgcuucaucuagcuccgcagucaguaaggaugggcuaggauuccagucagugucuagccugcacacauccugcgagaguauugacaucagccucuccucugguggcguuccuucacauaauagcucgacggggcugauugccuccaguaaagaugacucucuuaccccguuugugaggacuaacagcguaaagacaaccuugucagagagcccccugucuaguccagccgcuagcccuaaguucugucguuccacuuuaccccggaaacaggauucagacccucaccucgauagaaauacacugccaaagaaaggacuuagguacacccccacgagccaacugcgcacucaggaagacgcgaaggaguggcuacgaucucauagugcaggcggucuccaggauaccgccgcuaacuccccuuuuagcucagggucuuccgucacaucgccaagcggaaccagauucaauuuuagucagcuggccucucccacuacagugacccaaauguccuugagcaacccgacaaugcugcggacucacucauuaaguaacgcagacggccaguacgacccuuauaccgauuccagguuccgcaauagcucuaugucacucgacgagaaaucccguacgauguccagaucuggcaguuuucgggauggguucgaggaagugcacggaucgagccugucccuugucucaucuacaagcaguguuuacuccaccccagaggagaagugccagucagaaaucaggaagcugcgccgagaguuggacgccucucaggaaaaagugagcgcucucacuacccaacugacagcgaacgcccaucuaguagcagcuuuugagcagucccuggguaauaugacuauaagacuucagagucucaccaugacggccgaacaaaaggauagcgagcugaacgaguugcggaaaacaaucgaacuguuaaagaaacagaaugcagccgcucaggccgcgauuaacggcgugaucaauacccccgagcucaacuguaaggggaauggaacugcacagucugccgaccugaggauucgcagacaacacucauccgauagcgucaguucuaucaacuccgcuacaucgcauagcucagugggcuccaauauagaaucugacaguaagaaaaagaaaaggaagaacuggcuucggagcucauucaaacaggccuuugguaagaaaaaguccccuaagagcgcuucuagucacuccgauauugaggaaaugaccgacagcucacugccaucuucgcccaaauugccgcauaaugggagcacuggauccacaccucuccugcguaacagucacucuaauucacuaaucagcgagugcauggauuccgaggcagaaaccguuaugcagcugcgcaacgagcuucgagacaaggaaaugaaacucacggauauuagacuggaggccuugaguucugcucaccaguuagaccaacugagggaggccaugaaucggaugcagagcgaaaucgagaagcucaaagcagaaaacgaccgccugaaguccgagucacagggcagcggcugcucuagagcgcccucccaggugaguauaucagccagcccaaggcaaucgauggggcuuucccagcauucucugaacuugacugaaaguaccagccuagauaugcugcucgacgauacaggagaguguucagcucggaaggaggguggccgacacgucaaaaucgugguuuccuuccaggaagagaugaaguggaaagaagacucuagaccucaucuguuucuuauugggugcaucggagugagcggcaagaccaaaugggaugucuuagacgguguagugcgcaggcuguucaaggaguauauuauccacguugaucccgugagucagcucgggcuaaauuccgacagcguccugggauacucuauaggcgaaauuaagcggucaaacacauccgagacuccagagcuccugcccuguggcuaucuugugggggaaaauaccacgaucagcguaacagugaaaggacuggccgagaacaguuuggauucucuagucuucgaaucacugaucccuaagccaauucuccaacguuacguuuccuuacugaucgagcauagaaggauuauacuuagcgguccgucgggcacugggaaaaccuaucuggcaaaucgccucucugaauacaucguguugcgggagggacgagagcugacagacggcgugauugcuaccuuuaacgucgaucacaagaguuccaaagaacucagacaguaccugagcaaucuugccgaccagugcaacucagagaauaacgcaguggauaugccccuaguuaucauucuggacaauuugcaccauguaucuagcuuaggugaaaucuucaacgggcugcucaauuguaaguaucacaagugcccuuacauaaucggaacuaugaaccaagccaccuccaguacaccaaaucugcagcuucaucacaacuuuaggugggugcugugugcuaaccacacggagcccgucaaaggcuuccucggccgcuuuuugcggagaaagcugauggagacugaaauuucagggcgugugaggaauauggagcuaguuaaaaucauugacuggaucccuaagguguggcaucaccugaaccgguuccucgaagcgcauagcuccucugaugucaccauaggaccacgccuuuuucugaguugccccauugacguggaugguagccgaguaugguucacagacuuauggaauuauuccaucaucccuuacuugcuggaggccgucagagaaggccuccagcuguaugggaggcgggcaccgugggaggauccagcuaaaugggugauggacaccuaccccugggccgccucaccucagcaacacgaguggcccccacuucugcagcuccgcccugaagauguuggauuugacggcuauucuaugcccagagaggguucgacuagcaagcagaugccaccguccgaugcagaaggggacccuuugaugaacaugcugaugagguuacaggaggcugccaauuacaguucuccccaaagcuacgauucagacuccaacagcaauucucaucacgacgauauucuagacaguucccuggaaucaacacucuga

SEQ ID NO: 59511 - RNA, 7158 nt, Artificial Sequence
  derived and/or modified sequence opt3 from NAV3__Homo_sapiens__NP_001019554
augcccgugcugggcgucgccagcaagcucagacagccugcuguuggguccaaaccagugcacaccgcacuuccgauccccaaccugggaacaacugguucucaacauugcucaaguaggccuuuggaguuaacggaaaccgagagcuccaugcugucuugucagcuagcccucaagucgacaugcgaauucggcgagaaaaagccacugcaggggaaagcgaaggaaaaggaggacucaaaaauuuacacugauugggcuaaucacuaucuugccaagagcggacauaaacggcugauaaaggacuugcagcaagauaucgcagacggcguacuccuggccgagauuauccagauuaucgcuaacgaaaaaguggaggauauaaaugguuguccccgcagucagucccagaugaucgaaaacgucgacgugugccugucuuuucucgcagcccgagggguuaaugugcaaggauuaagcgcugaggagauucguaacggcaaucugaaggccauccuuggcuuguucuuuucccugucaagauacaagcagcagcagcaccaucaacagcaguauuaccaaagucuagucgaacuccagcagagggugacccacgcgagcccuccaucugaggcaucccaggccaaaacacaacaggauaugcagucaagccuggcugcccgguaugcaacccagaguaaccacucugggauugcuacuucccaaaagaaacccacacgccuuccuggaccaagcagaguaccggccgcggguucgucuuccaagguucagggcgccucaaaucugaacaggcggagucagagcuucaauuccaucgacaaaaacaagcccccuaauuacgcaaacgggaaugaaaaagauucuagcaagggaccacagucaaguuccggcgugaacgguaacguccaacccccuagcaccgcugggcagccacccgccucugcuauaccgucaccuagugccagcaagcccuggcgcuccaaaucuaugaaugugaagcauucggcaacgagcacuauguugaccgugaaacaguccucaacagccacuaguccaaccccuucuagcgaccgacucaagcccccagucuccgagggaguuaaaacagcucccucaggccagaagagcaugcuggaaaaguuuaaauuagugaacgcgagaaccgcacugaggccuccacaaccgcccucuuccggcccuagugaugggggaaaggacgaugacgccuucagcgagucuggugagauggaaggcuuuaauuccgggcucaacucaggaggcaguacgaauagcucgccaaaaguaucccccaagcuugcuccuccaaaagccgguucuaagaaccugagcaauaagaaaucauugcuacagcccaaggagaaagaagagaagaaccgggacaaaaauaagguguguacugaaaagccggucaaagaggagaaggaucaggugacagaaauggcaccuaaaaagaccaguaaaauugccucccugaucccaaaggggucuaaaacuacagcugccaagaaggagagccucauucccuccucaagcggcaucccuaaacccggaaguaagguuccaaccgugaaacaaacgaucucuccuggcuccaccgcaagcaaggaaucggagaaauuccguacaacuaaggggucacccucucagagucuguccaagccaauuaccauggaaaaagcgagcgcuucuagcugcccggccccucuugagggacgcgaggcaggucaggccucccccucaggcaguuguacaaugacugucgcucagagcucugggcaauccaccggaaacggcgccgugcagcugccacagcagcaacagcacucacaucccaauacagcaaccguagcuccuuuuauauauagagcccacagugaaaacgaggguacugcguugccaagcgccgacuccugcacgucucccacaaagauggaucucucguacagcaaaaccgcuaagcagugucuggaagagaucucaggggaggacccugaaacuaggcggaugcgaaccguuaaaaauauugcagauuuacgccagaaccuggaggaaacaauguccagucuaagaggcacccaaaucucucacagcacucucgagacaacguucgacuccaccgugacuacagaagucaauggaaggaccauaccgaaccugacaucacggccaacucccaugaccuggcgccuuggccaggccugcccuagauugcaggcuggggaugccccaucucugggagcagguuaccccaggagcggcacgagucguuuuauucauaccgacccuucccgguucauguauacaacuccgcuccgaagagcggccgugagcaggcuggggaacaugucucaaaucgauaugucagagaaggcuuccagugaccuugauaugagcucggaggucgacgugggaggcuacaugucugacggugauauccuggggaaguccuugcgcaccgacgauauuaauagcggcuauaugacagacggaggccucaaccuguacacucggucauuaaauagaauccccgauaccgccacgaguagggacauuauacagcgcgggguucacgaugugacaguagacgcagauucuugggacgauuccagcucagucaguagcggacuguccgacacccuagauaacaucucuacugacgaccucaauacaaccagcuccgugucaucuuauaguaacauuacuguuccaucgcgaaaaaauacccagcugcggacagauagcgaaaagcguuccacgaccgacgagacuugggauucuccugaagagcuuaaaaagcccgaagaggacuuugauucacauggcgacgcuggugggaaauggaagacagugagcuccggauugccagaggauccugaaaaggccggccagaaagcaagucugucugucagccaaaccgguucauggagaaggggcauguccgcccaggggggagcucccagucgccagaaggcgggcacaagcgcccucaaaacuccagggaagaccgacgaugcaaaagcuucugagaagggaaaagccccgcugaagggcuccucauuacagcggagcccuucggacgccgguaagucuaguggggaugaaggaaaaaagcccccauccggcaucgguagaagcacggcuacaucauccuucggcuucaaaaagcccucuggggugggaagcagugcaaugaucaccuccagcggcgccacuauuaccucugggucagcgacacugggaaaaauaccuaagagugcugccaucggcgguaaguccaacgcagggaggaaaacuagccuugacggaucucaaaaucaggaugacguaguguugcacguuucgucaaagaccacacuccaguaccgaagccugccacgccccuccaaaaguucuacgagcggcauuccuggucggggcgggcauagauccucaaccaguucuaucgacagcaacgucuccucaaagagcgccggagcuacuacaucuaaacuaagggagccgaccaagauuggcuccgggcguaguagcccagugacugugaaucagacagauaaggaaaaagagaaggucgcaguuucggacuccgagucugugucacugagcggaagucccaaauccucuccuaccagcgccucagcguguggcgcucaaggucuccgccagcccggguccaaguauccagauaucgccaguccuacguuucggagacuguucggagcaaaagccggcggcaagagcgcuucugcccccaacacugaaggggugaagucauccagcguaaugccaucuccuaguaccacacuugcaaggcagggaucguuggaguccccgagcucagguaccggcucuauggggagcgcuggaggccuguccgguaguucaucucccuuauuuaauaaaccaagcgaccucacuacagaugucauaucccugagucacagccuugccuccucuccugcgucagugcacagcuucaccucggggggacugguuugggccgcaaacauguccaguucuagcgcuggcucaaaggacacacccuccuaccagucuaugacuaguuugcauaccagcuccgaaucaaucgaucucccacugagccaccauggcucucuaagugggcugacgacaggaacccacgaggugcaaucccuccugaugcgaacugguagcguccggucaacccuuucugaguccaugcaguuggaccgcaauacacugccuaaaaagggcuuaagauacacucccucgagcaggcaggccaaccaagaagaggggaaagaauggcuccggagucacucuaccggaggccugcaggauacggguaaccaguccccgcuugugagcccaucagcuaugaguuccagcgcagccgggaaguaucauuuuucuaaucugguuucaccuacaaaccuaagccaguucaaucuccccggaccauccaugaugcgaucuaacaguauucccgcccaagacucgagcuuugaucuguacgacgacucccaguugugcggcucagcuaccucucuggaggaaagaccucgcgcgaucagccacaguggcuccuucagggauucaauggaggaggugcaugggucuagcuuaucccucguaaguagcacuucuucacuguauuccacagcagaagagaaggcccacagcgaacagauucauaaacuucgucgggagcuggucgcuagucaggaaaagguggccaccuugacuucucaacucuccgcaaaugcccaccugguggcugcguuugagaaaucgcuaggaaacaugacagguagacugcagagccuuaccaugacggccgagcagaaggaaucagagcucaucgaacugagggagacuauagaaauguugaaagcacagaauuccgcugcccaagcagccauucagggcgcucugaacgggccggaccaccccccaaaggauuuacgcauccgaagacagcauucuagugagagcgucucauccauuaauagcgccaccucucacaguuccaucggaagcggcaacgacgcggauucaaaaaagaagaaaaagaaaaauuggguuaacucucgggguucggagcucaggagcuccuucaagcaagcauuugggaaaaagaagaguacaaaaccucccucuucacauagcgacauagaagagcugaccgauuccagucuuccugccucuccaaagcugccccacaaugcuggagacugcggcagcgccuccaugaaaccuucacagagcgcuucugcauccccauugguguggcccccgaagaaacgccagaacggcccuguaaucuacaagcaucguaguagaauuugugaaugcacagaggccgaggcugaaaucauucuccagcugaagucagagcuacgggaaaaagagcugaagcuuacugauaucaggcucgaagcccugagcucggcacaccacuuggaccaaauacgcgaggcgaugaaucgaaugcagaacgagauugaaaucuuaaaagccgagaacgauagacugaaggcugaaaccgggaauacggccaaaccaacacggcccccuuccgagucuaguagcucaacuuccucuagcaguuccaggcagagccucggacugucucuuaacaaucugaacaucaccgaagcagugucauccgacauuuugcuagaugacgcuggugacgccacaggccauaaggaugggcgcagcgucaagaucauugugaguauaucuaaaggauauggcagagcaaaggaccagaaaucacaagccuaccugaucgguuccauugggguuagcggaaagaccaaaugggaugugcucgacggcgucaucaggcggcuguucaaggaguauguguuucguauugauacuucgaccucucuuggcuuaaguuccgacuguaucgcuagcuacugcauaggggaucugauccgcucacacaaucucgagguuccagaauugcugcccuguggauaccucgugggugacaacaauauuaucacagucaaccugaaaggcguagaggaaaauucucuugauagcuucguguucgacacgcugauuccgaagccuaucacucagcgauauuuuaacuugcuaauggagcaucacagaauaauucuguccgggcccaguggaaccggcaagacauaccucgcgaauaaauuagccgaauauguuaucaccaagucagguaggaaaaagacugaggaugcaaucgcuacauucaacguggaccacaaaagcuccaaggagcugcagcaguaccuugccaaucuggccgaacaaugcucugcagauaacaauggggucgagcucccagugguaauuauauuggacaaccugcaucacgugggcagucucagcgacaucuuuaauggauuccugaacuguaaguauaacaaaugcccuuacauuaucggcaccaugaaucagggggucuccucaucucccaaccuugaacuacaucacaauuuucgguggguucugugugcuaaccauacggagccagugaagggauucuugggucgcuauuuaagaaggaaacugauugagaucgaaauagagcggaauauccgaaacaaugaucucgugaagauuaucgacuggauucccaaaacuuggcaccaccugaacucguuucuugaaacacauagcuccagugaugucaccaucggcccuagacuguuccucccaugcccgauggacguggaggggucucgcguuugguuuauggauuuguggaauuacagccugguacccuacauacuagaagccgugagggagggacugcagauguauggcaagcggaccccuugggaggacccaucaaaguggguccucgauacuuaccccugguccagcgcgacacuuccucaggaaucuccagcucuguuacaauugcgucccgaggacguggguuaugaaaguuguaccuccacaaaagaggccacuacgucaaagcacauuccucagaccgauacagaaggggacccgcugaugaacaugcucaugaaacugcaggaggcagccaauuacagcucuacucaaucgugcgauuccgagaguaccagccaucacgaagacauccuugacucaucucuggaguccacacucuga

SEQ ID NO: 59512 - RNA, 7116 nt, Artificial Sequence
  derived and/or modified sequence opt3 from NBAS__Homo_sapiens__NP_056993
auggccgcucccgagagcggcccugcacuguccccagggaccgccgaaggagaggaagagacaauccucuacgaccuucuggugaacacugaauggccgcccgagacggagguccagccuagagguaaucaaaagcacggcgcgucuuucauuauaaccaaagcuaucagggaucgguuguuauuucugcgccaguauauuugguacucaccagcccccuuccuacucccugacgggcugguucgacuugugaacaagcagaucaauuggcaucugguauuggcaaguaacggaaaacuccuggccgcugugcaggaucaaugcgucgaaauucguagcgcaaaggacgauuuuacauccaucauaggcaaaugucaggugccaaaggaccccaagccucaguggagaaggguugccuggucuuaugauugcacucugcucgcuuacgccgagucgaccgguacagugcgggucuucgacuuaauggggucagaacuguuugugaucagcccagcgaguuccuucauuggagaucuuucuuaugcaaucgccggcuugauuuuucuggaguacaaagcuagcgcccagugguccgcagagcuacucguaaucaauuaucgcggcgaacugagaucauaccuuguuaguguggggaccaaccaaagcuaccaggagucucacuguuucuccuuuucaagccauuauccgcacggaauaaauacugcuauuuaccaucccggucacaggcuguugcucgucggcgggugcgaaacagccgaggugggaaugaguaaggcgucuuccuguggccugagcgccuggcggguguuaucggguucuccuuauuacaaacaggucaccaacgggggagacggcguuacggcagugccaaagacucugggccuccuucgcaugcuguccguaaaauucuauucacgacaggggcaagaacaggauggaaucuuuaagaugaguuugagccccgacgguaugcuacuggcugccauucacuucuccggcaagcucucuaucugggcuaucccuagccugaaacagcaaggggaguggggacagaaugagcagccaggcuacgaugaccuuaaccccgacuggagacugucaaccgaaaagaggaaaaagauuaaagauaaggagaguuuuuauccguugauagacgugaauuggugggccgauuccgcagucacacucgcccggugcagcggugcucugacugugucuucaguuaaaaccuuaaagaaccugcuagggaagaguugugaaugguucgagccuagcccccaggugacagcgacccaugacggcggauuccucucccuggaaugcgagaucaaacuugcaccaaagcguucucgcuuggagacgagagccggcgaagaggaugaaggggaggaagacucggauagcgacuacgagauuuccgcuaaagccagguacuuuggauauaucaagcaaggucuguaccucgucacugagauggaacgguucgcaccuccccgaaaacgcccaagaacaauaaccaagaauuauaggcuggugucacuucggaguacuacacccgaggaacuguaccagcgcaagauugagucugaggaauaugaggaagccuugagccucgcucacaccuacggccuggauacggacuuaguauaucagagacaguggaggaaauccgccguuaacguggcaucaauccaaaauuaccugagcaagaucaaaaagcguucuuggguccuacaugagugucucgaacgggugccugagaacgucgaugcggcuaaagagcugcuucaguacggguugaagggaaccgaccuggaagcccuccuggcaauuggcaagggugccgacgaugggcgauuuacauuaccaggcgagaucgacauugauuccauaaguuaugaagagcugagcccgcccgacgaagagccugcuaaaaacaagaaagagaaggaacuuaaaaagagacaggaguugcucaagcuggugaauuucucuaaacuaacucuggaacagaaggagcucugcaggugucgccggaaacugcuuaccuacuuggauagacuggccacauaugaagagaucuuaggaguuccacacgcauccgagcaaagguacgacgcugaauuuuucaagaaauuucgcaaccagaauauugugcucucagcccgaacuuaugcgcaggagaguaacguacaggcccuggaaauccuuuucaccuaccacggcagcgaucuguugccccaucggcucgcuauccugucgaauuuuccugagacaaccuccccacacgaguauucuguccuacugcccgaagcaugcuucaacggggacagccucaugauuauaccguggcaugagcacaagcaucgugccaaagauuggugcgaagagcuggcuuguagaauggugguugaaccuaaucuucaagacgagucagaguuuuuguacgccgcacagccagaacuguuaagguuccgcaugacucagcucacgguggagaaggucauggauugguaccaaacacgggcggaagagaucgaacacuaugccagacagguggacugcgcucugagucuuauuaggcugggaauggagcgaaacauccccggucuacucguacugugugauaauuuggugacccuggagacuuuaguuuacgaagcccgcugcgacgucacccucacacugaaggagcuucagcagaugaaagacauugaaaagcugcgguugcucaugaacuccuguucugaggauaaauaugugaccagcgcauaccaauggauggugccuuuucugcacagaugcgaaaagcagucccccggcgucgcuaaugagcuacugaaagaguaucuuguuacucucgccaagggggaccugaaguucccauugaaaaucuuccagcauucaaagccugaucugcagcaaaaaauaauccccgaccaggaucaguuaauggcaauugcccucgaauguaucuacacaugcgagaggaacgaccagcugugucuuugcuaugaucuguuggaaugucucccagagcguggauacggcgacaagacggaggcuaccacuaaacugcacgauaugguggaccaacuagaacagauucugagcgugagugagcuucucgaaaagcauggucuggagaagccgaucucuuuuguaaaaaauacacaguccagcucggaagaggcgcgcaaguugaugguccgguuaaccagacacacagggaggaaacaaccucccgugucagagucucacuggcgaacucugcuccaggauaugcugaccaugcagcagaacguuuacacgugccuugacagugaugccugcuaugaaauauucaccgagucccuguuguguagcucucggcuagaaaauauucaucuggcaggccaaaugaugcacugcagcgcuuguuccgagaacccacccgccggaaucgcccauaagggcaaaccucacuaccgcgugucauaugaaaagaguauugaccucguccuggcugcaagcagagaguacuuuaacucuuccacaaaucuuacugacucaugcauggauuuagccagguguugccugcagcucaucaccgaccggccacccgcgauacaggaggaauuggaucugauccaggcuguggggugucucgaggaauucggaguuaagauucugccucuucaagugcgacugugcccggacagaaucaguuugauuaaagaguguaucagccaguccccaacaugcuauaagcagucuacuaaacuacugggccucgccgaauuacugcgcguagcaggugagaaccccgaggaaaggcgugggcagguccuuauacugcucguggagcaagccuugcgguuucaugauuacaaggcugcaucgaugcacugucaggaacugauggccaccggauauccuaaaagcugggacgugugcucacagcucggccaguccgaggguuaccaagaucuggcgacgagacaggagcuuauggcuuucgcccuaacacacugcccacccaguucuauugaacuguuguuagcagccagcuccucacugcagaccgagauccucuaccaaagggucaauuuucagauccaucacgaaggcggggagaacauuucugcuagcccucugacuaguaaggccguucaggaagacgaggugggaguaccgggcuccaauagcgcagaucuucugcgcuggacaaccgcuacuaccaugaaagugcucucuaacacaacgaccacuacaaaggccgucuugcaggcggugucagacgggcaaugguggaagaaaucccugaccuaucuacgaccccugcagggacagaaguguggcggugccuaccagaucgggacaacugcaaaugaggaucucgaaaaacaaggaugccauccauucuaugagaguguuauuagcaacccuuuuguggcugaaucggagggcaccuacgacacguaucagcacguccccguggaaucuuucgccgagguucuucugagaacagguaaguuagcugaggcaaaaaauaagggcgaaguguuuccaaccacugaggucuugcugcagcucgccuccgaagcccugccuaacgacaugacccuugcucuggcguaccucuuggcacugccccagguauuagaugccaaucgguguuucgagaagcaaagcccaucagcucuaagucugcagcucgccgcauauuacuacucucuucagauauaugccaggcuggcuccgugcuuucgcgacaaaugucauccuuuguaccgugcggaucccaaggaacugaucaaaauggugacaagacacguuacucggcacgagcaugaggccuggccagaagaccucauuucccugaccaagcaacuucacugcuauaacgagaggcuccuggauuucacacaggcacagaucuugcaggggcugcgcaaaggaguggacguccaacgauucacggcugaugaccaguacaagagagaaaccauuuuaggccuagccgagacucuggaggaaagcguguauucaaucgcaauaagucucgcccagcgguacagcguauccaggugggagguguuuaugacacaucuugaauuccuguuuaccgauucuggguugagcacucuggagaucgaaaaucgcgcucaggaccuccaccuguucgagacacuuaagaccgaucccgaggccuuucaccaacauauggucaaauauauuuacccuacgaucggaggcuucgaccacgaaagauuacaguacuauuuuacucugcucgagaacugugguugcgcggauuuggggaauugugcaauuaagccagaaacccauaucaggcugcuaaaaaaguucaaaguuguggccuccggacugaacuacaagaagcucacagacgagaacaugucaccccuugaagcucuggagccuguguugucuagucagaauauacugucgauuagcaaacucgucccgaagaucccagagaaagacggccagaugcugucccccucuucauuauauaccaucuggcuucaaaagcuguuuuggacuggugauccucaccucauuaaacaggugcccggcagcuccccagaauggcuacaugccuacgacguuugcaugaaguauuucgaucggcugcacccuggggacuugauaacaguaguggaugcugucaccuuuagucccaaggcagugacaaaacugucuguugaggcccguaaggaaaugacucgcaaagcuaucaagaccgugaaacacuucauugagaagccacgaaaaagaaacagcgaagacgaggcccaggaggcaaaggauucaaaggucacguacgcggacacacucaaucaucuugaaaaaucccuggcccacuuggagacccugagucauagcuucauccucucuuuaaagaacuccgaacaggagacucugcaaaaauauucacaccuuuacgaucugagcaggucggagaaggaaaaacuacacgacgaggcuguggccauuugucucgauggacagccucuggcaaugauccagcaauugcuggaaguagcugucggcccgcucgacauaucucccaaggauaucgugcagagugccauuaugaagaucauuuccgcacuuagcgggggaucagccgaccugggcgguccacgggacccuuuaaaaguucuggaggggguggucgcugcggugcaugccuccguugauaagggagaagaguuggugucucccgaggaccuccuggaauggcuacgcccauuuugcgcagaugacgcuuggccugucagacccaggauccacgugcuucagauacugggccagagcuuccaucucaccgaggaagauaguaaacuguugguauuuuuccggacagaggccauucugaaggccuccuggccgcaacgacagguggacaucgcagauaucgaaaaugaggagaacagauacugccucuuuauggaacuucuggagagcucucaccaugaagcugaguuccagcacuuaguucuguugcuccaggccuggccaccuaugaaaucagaauaugucauuacuaauaaccccugggugcgccuggcgaccgugaugcuaacgagguguacaauggagaauaaggagggccuugggaacgaaguccugaagaugugccggagucucuacaauaccaaacaaaugcugccagcugagggaguaaaggaauuguguuuacugcuccuuaaccagucccugcuacugcccagccucaaauugcugcuugagucucgugacgagcaccugcaugaaauggcccucgagcagaucacugcagugacaaccguuaaugauucgaacugcgaccaggaauuacugucauugcugcucgaugccaagcuucuggugaaaugugucagcacuccuuuuuauccgagaauaguggaccaccuacuggcuucccuccaacaggguaggugggacgcagaggaauugggccgccaucugcgggaggccgggcacgaggcggaagcuggaagucuucuguuagccguucgaggcacacaccaggcauucagaaccuuuucuacggcccucagggcugcccaacauuggguguga

SEQ ID NO: 59513 - RNA, 2220 nt, Artificial Sequence
  derived and/or modified sequence opt3 from NBEA__Homo_sapiens__NP_001191126
auguucagcgagaucagagccguguuuuccaggcgguaccugcuccagaacaccgcucuugaagucuucauggcaaaucgcacaucuguuauguuuaacuuccccgaccaagccacugugaagaaaguaguguauucacugccucgagucggcguggggacgaguuacggauugccacaggcgcguagaauuagcuuagcuaccccgaggcagcuguauaaguccucuaauaugacacagcgguggcaacgcagagagauaucgaacuuugaauaccuaauguuccucaauacuaucgccgguaggaccuauaacgaucugaaucaguaccccguuuuuccuugggugcuuacaaacuaugagucagaggaacuggacuugacccucccaggcaauuuccgggaucugagcaaacccauuggggcacugaacccuaagcgcgccgucuuuuacgcugagcgauacgaaacuugggaggacgaucagaguccacccuaucacuacaauacacauuauuccaccgcaacgucuacucucagcugguuagugagaaucgaaccuuucaccacauuuuuccugaacgccaaugacggaaaauuugaucacccagacaggacuuucuccucaguagcucggaguuggcguaccagccagcgcgauacaucugacguuaaggagcuuauuccggaguucuacuauuugcccgaaauguuugugaacuccaauggcuacaaccugggugucagagaggaugaagugguggucaacgacguugaucuaccuccaugggccaagaaacccgaggacuucgugaggaucaaucggauggcgcucgaaucagaguuuguaagcugccaacugcaucaguggauagaccuuaucuucggguauaagcagcgaggaccugaggcagugcgcgcccugaacgucuuucacuacuugaccuacgaaggcagugugaaucucgauucuauuacggacccaguucugagagaggcuauggaagcccagauccaaaacuucggccagacucccucccaguuacugauugagccgcauccucccaggagcucggcaaugcaccucuguuuucuuccacaaucuccucugauguucaaagaucagaugcagcaggacgugaucauggucuugaaguuucccuccaauucaccagugacacacguagcugccaacacccuaccccaucugacuauaccugcgguugugacagugaccugcagucggcuguucgccgucaaucgcuggcacaacacggucgggcugagaggagcaccagguuauagccuugaucaagcucaucaccucccgauugaaauggaccccuugaucgccaauaacuccggcgugaauaaaaggcagauuaccgaucucguugaccagucuauccagaucaacgcucacuguuuugugguaacagccgauaaucguuacauucugauaugcggguucugggacaagagcuuucgggucuauucaacugagaccggaaaguuaacacaaaucguguucggccauugggauguugugacuugucuggcacgaagugaguccuacauugguggggacugcuauaucgucagcggaucuagagacgccacccuacuccugugguacuggucaggcaggcaccauauaauuggcgauaacccuaauaguagcgacuauccagcuccccgcgcggugcuuacagggcacgaucaugaaguaguguguguuuccgucugcgcagaguugggacuggugaucucuggugccaaagaaggcccuugucucgugcacaccaucacuggggaccugcuucgggcucuggagggaccagaaaacugcuuguuccccagacucauuucggucagcuccgagggccacuguaucauuuacuacgagaggggucgcuuuucaaacuucaguauaaaugggaagcuguuagcccagauggaaaucaacgauucuacgcgagcaauucugcuaagcuccgacggccagaaucucguuacaggaggcgauaacggggugguggagguauggcaggccugcgacuuuaaacaacuguauaucuacccgggaugcgaugcugguauccgggccauggaccuuucacaugaucagcguaccuugauuacuggcauggcaagcgggucuauagucgcguucaauaucgacuuuaacagauggcacuaugaacaucagaauagguacuga

SEQ ID NO: 59514 - RNA, 8085 nt, Artificial Sequence
  derived and/or modified sequence opt3 from NBEAL1__Homo_sapiens__NP_001107604
auggccagcagagagaggcuguucgaacucuggaugcuuuauugcaccaagaaggaccccgauuaucugaaguugugguuagacacauuuguguccucuuacgagcaguuccuggaugucgacuuugaaaagcugccuacucggguugaugacaugccaccgggcaucucacuccugcccgauaacauucuucaagugcugcgcauacaguugcuccagugugugcagaagauggcugacgggcuggaggaacaacagcaggcucugaguauccucuuagugaaauucuuuauuauccugugccgaaaucuuagcaacgucgaggagauuggaacguguuccuauaucaauuacgugauaaccaugacaacuuuguauauccagcaacugaagucuaagaaaaaggaaaaagagauggccgaucagaccugcauugaagaguucguuauccacgcgcuagcuuuuugugagucgcucuacgacccuuaucguaacuggagacauaggauuucaggucggauccugagcacaguggaaaagagucgccagaaauacaagccagccucccuuaccgucgaguucgugcccuuuuucuaccagugcuuucaagaaucugagcaccugaaggaaaguuugaaauguugccuccugcauuuauucggcgcaauaguagccgggggacagagaaaugcucugcaggcaauuuccccugccacuauggagguucucaugagggugcuugcugauugugacucaugggaggauggcgacccagaagaggucggucggaaggccgaacugacauugaaaugccuaaccgagguggugcacauccugcucaguagcaacucugaccaacgccaggucgaaacguccacuauucuggagaauuauuuuaaacuucugaacucagaucauagcgcguugcccaaucagcgaagaaguaggcagugggagaaccgguucaucgcacuccaaaucaaaaugcugaauaccauuacagccauguuagacuguacugaucguccuguucugcaggcuauauuccuaaacucuaauugcuuugaacaccucauccgccugcuucagaacugcaagguguuccaggggcaauuggacugucuggccauuuccaccauccaggcacucacagcuguaaugaauaaaagcccagccgcgaaggagguguuuaaggaaagaauaggauacacccacaugcuggagguccuuaaaucgcugggccagccgcccuuggaacuccugaaggaguuaaugaacauggccguggagggcgaucauacgucuguugggauucugggaaucuccaacgugcagccucuacuccugcuuauccaaugguugccagaacugcagucacacgaccuccagauuuucaucagugauuggcugaaaaggauuugcuguauaaaucggcagagccgaacuacaugcgucaacgcaaauauggguauccgcauuaucgagaccuuagaccugcauuccucucuucaccaaacuugugcugaaaacuugaucgccauucacggcagccucgggucacagaguguguccagcgaggagauaagaaggcugcuacggcugcuccgcguagaugaaucugagucaguucaucccuaugugacaccugucaccagagcuauccugacgauggccaggaaacuuaguuuggaaagcgcacugcaguacuuuaauuuaucccacucuauggccggaauuucggugccacccauccaaaaauggccgggcagcgcuuucuccuuuucagcgugguucugccucgaccaggaucagcugacccuugguauugcaaacaaagggggaaagcguaaacagcuguauagcuuuuucacaggcucuggcaugggguuugaggccuucaucacucauagcggaauguuggucguggcuguuuguaccaagcgggaauacgccacagugaugcucccugaccacuccuuuugcgacucacuguggcauaauauaacuguaguccacaugcccgguaaacgaccauucggccaaaguuucguguauaucuacgauaacgggcagcagaagguuucugcaccucuaagauuucccgccaugaaugagccauucaccuccuguugcauuggaagugcuggccagaggacaaccacucccccuccaagccaaaucccggacccaccuuuuucuuccccaauuacgccccaccgcacaucauucggugggauccugaguagcgccucguggggcggaaccauagagaaauccaagcucauuacuaagcugaucucugcaggcacccaggauagcgaauggggguguccuacaucacuugagggacaguuggguagugugauuaucuuuuacgaaccacugcagcccccgcaagucaaagcguuauaucucgcuggcccuaacugccuguccccauggaagugccaggagucugacauggccgaucuucccgggaauauacugcuauacuauaccgcaaaagccuguaagaacagcaucugccucgaccuguccacuaauuguuugcauggacggcugacaggcaacaaagugguaaauugggauauuaaggacaucauuaacugcaucgguggguuaaacguacucuucccucugcuugaacagauaucacacuuuagcgagggccaaauucccgaggaaaagaaugagaguacgguuccagaaucugucaccccuguggagggagauuggcugguguggacuuccacaaaagcuagcgaaucgagauuggagaggaaccucgucgccaccuucauccugaucguuaagcauuuuauucagcgccaccccaucaaucagggcaaccuaauucacucacaugggguggcaacacugggagcacuucuccagaaagugccaucuacucugauggacguaaaugucuugauggccgugcaacuguuaauagagcagguuagucucgaaaagaacaugcagcugcuucagcaaauguaccaguaucuguuguucgauuuucgaaucuggaaucggggugacuucccguuucguauuggccacauccaguaccucuccaccauuaucaaagauagcagaaggguguuccgcaagaaauaugggguccaguuccugcuagacacgcugcggauauacuacggaaacggcuguaaguauaaugagcuuucucucgacgauaucagaaccauuaggacaagccuguacgguuugaucaaguacuuuuuaugcaaagggggcucccaugaagagauucaaucaaucaugggauacauagcggccacuaacgaggaagaacagcuguucggcauucucgacgugcuguuuagucuucugcgaaccagcccuacacgcgggcaguuguuccuacugcucuuugaacccggaaaugcugauauccuguaugcacuuuuacugaaccagaaguacucugaccggcucagagagaucauuuucaaaauaauggaacaaauguugaaguguacuaauguuuaugagagguccaaacagcacauccgucugcgcgaggugggcuacucaggucucgggcugcuucugaacgaagccuugguaaauaccagucuaauuaagaaccugacgcaucagaucauuaacacagauccagucaucaauuuuaaggaccucuuaagcgugguguacauaucccaccgggcucacaucaacgucagaguugccauuugcaggaaagugcugcaaauccuucaguuccagcccgaugcagcgcaucagauuucucaacagguaggauggcaggacacccuggugcgacucuuuuugaaggccaaauucgagaauggcaacacucugcacaagcauucgcgggcuguccucaugaaagauaaugacaagaacaugagcacagaagauaccaagaaaaauucagacgagaagacugaugaagagaaaaucaccuccuuugccagugcaaacgugucuagcgaccaguggucccuggaggaccgccacucacuugauucuaauacaccucuauucccagaagacagcaguguuggugagcuguccuucaagagcgaaaaccaagaggaauuuuggcauucuaaucccucacacuuguccuuagaucugaguggcauagacagcugugagaugucggauucugggucccaggugccugacagccucccgucaacgccaagucccgucgagucuaccaaauccuucagcgugcacucagauagagaaaguagcauuacuaacgacaugggauuuuccgaugacuucucucugcuugagagccaggaaaggugcgaggaggaacugcuccaguugcugacacauauccuaaauuauguuauguguaagggccuggagaaguccgaugacgacaccuggaucgaacgggggcaaguguuuucagcucucucuaaaccuggaauuaguucggagcuucugcgaccaagcgaugaaaucaaguuaacauugcugcagaaaaugcucgagugggccauauccgagaacagagaagcaaagacuaaucccgucaccgccgagaacgcuuuccgccugguacuuauuauccaggacuuucugcaaucugaaggccucgugaacucaaauauguggacggagaaauugcuggaagauaugauguuacuauucgacugccugagcguuugcuacuccgagaguccugugugggucaagcucucucagauucagauccagcuucuguuggguuuuauagggaggggaaaccugcaagugugugcgauggccagcgcaaaacucaauacacugcuucagaccaagguaauugagaaccaggaugaggcuugcuauauccucggcaagcuggagcacguguugucacaguccaucaaagaacaaacugagauuuacaguuuccugaucccguuaguccguacccuaguuagcaagauuuaugaacugcucuuuaugaaucuucaucugcccucuuugccauucacaaacgguuccagcucauuuuucgaggacuuccaggaguacuguaauucgaacgaauggcaaguguauauagagaaauacaucgugccuuacaugaagcaguaugaagcccacacuuuuuacgauggccacgagaauauggcccuguauuggaaagacugcuacgaggcucucauggucaacaugcauaagcgggauagagaagggggagagucuaagcugaaauuccaggaacuuuuuguggagcccuucaauaggaaggcacgccaggaaaacuuacgauauaauaacaugcugaaacagcucaguucccagcaauuggccacccugagacgguggaaggcgauucagcuauaccugacaugugagaggggcccaugggcuaaacgcaagcagaauccuauccacuggaagcucgccaacguugagaauuauagccguaugagacuuaaacugguacccaacuacaacuuuaagacgcaugaagaggcaucagccuugcgggacaaucuggggauccaacacucccagccaucuagcgauacccuccuguuagaaguggucaaacaggugaagguuagugacaugguggaggauaaacuugaccugccggaagaggacauuacugcuagggucaacguggaugagaaggaagaacaggaccaaaaggaaaaacucguacuaauggaggauugcgaacugauaacaaucauugacgucaucccuggacgcuuggagauuaccacucagcauaucuacuucuaugauggcuccauagagaaggaagacggugugggguuugauuucaaauggccccacagccagauccgagagauucaccugagacgguacaaucucaggcgcucugcacuugaaaucuuucauguugaccagucaaacuauuuccugaauuuuaagaaagaggugagaaacaagauuuacaguagguugcugucccuccacagcccaaauucuuauuacggaucgcggucaccccaagaguuauucaaggccagcggccugacacagaaaugggucaaccgugaaaucuccaauuuugauuaucuuauacagauuaacaccauggcgggucgcacguacaaugaccuggcucaguacccuguguucccauggauccuacaagauuauaccagugaggaacucgaccugaacaaucccgccguuuuccgagauuugucuaagccuauuggcguggucaacgagaaaaaugcaaaggccaugagagaaaaauacgagaacuuugaggacccgauggggacuaucgacaaguuccauuauggaacacacuacagcaacuccgcuggcgugaugcacuaucugauaaggguagaaccauuuaccacucuccauauccagcuucagucagggcgguucgauugugccgaccgccaauuucacaguauucccgcaacauggcaggcucugauggauaauccuuacgacgugaaagaguuaauccccgaguucuuuuauuucccagaguuucuggaaaaccagaaucaguucaacuugggaagacuccaaauuucuaaggagcugguuaaugaugucauccuaccuaagugggccaaaagcgcggaggacuuuauauacaagcauaggaaagcccuugaauccgaguacgugucagcacaucugcacgaauggauugaucucaucuucggcuauaagcagcggggucccgcugccguggaggcucugaacgucuuuuacuauugcagcuacgaaggggcaguagacuuggaugcccugaccgacgagaaagagcgaaaggcccucgaaggaaugaucaauaacuucggccagacaccaugucagcuucugaaggagccucacccgcccagauuaucugcugaagaggcggugcaaaaaccaacuaagauugauaccuccacgcugaauuuguuccagcaccucccugagcugaaaucguuuuucaucgaaggcauaagcgacgggauuccccuacuuaaggcaacaauccccaagaaccaguaucgcagcuuuaugucccagggaucuccugagcugcucauuaccaucucaaugaauuacguuauagguacucauggcuggcugcccuaugacaggaacaucagcaauuacuucaccuuuauuaaggaucaaacagugacuaacccgaagacccagcggaguaucaauggguccuucgccccaggauuggaaauuacgucuaaauuauuugucgugagccacgacgcuaagcuacucuucucagccggcuacugggauaacuccauccagguuaugagucuuacaaaagguaagauuaucagccauauaauucgucacauggacaucgugaccugccuggcaacugauuauugugggauccaccuaauuucuggaucaagagacacaaccugcaugauauggcaaaucacucagcagggcggcgucccuguggggcuggccuccaaacccuuucagauucucuacggacauacaaacgagguauugagcguggguaucucuaccgaacuggauauggcuguuaguggcucgagggacgggacggucauuauccacacuauacaaaagggacaguauaugcgcacccuucggccacccugcgaguccagccuguuccucacaaucccuaauuuagcgauuucaugggagggccauaucgugguguacucuagcaccgaagagaagacaacucugaaagauaagaacgccuugcaccuguuuuccauuaaugguaaauaucucgggagucagauccuuaaggaacaggucucagacauauguauuaucggagagcauaucguuaccggcucuauucaaggcuuccugagcauacgagaucuacacucccugaaccucaguaucaauccguuggcaaugagacugcccauucacugcguguguguaacgaaagaauacagccauauccuuguggggcuggaggacggaaaguuaauugucguggguguuggcaaaccagcugagaugagguccgggcagcucucucgcaaguuuuggggaucaagcaagcggcugucgcagaucuccgccggcgaaacagaguauaacacucaggauaguaaauga

SEQ ID NO: 59515 - RNA, 8265 nt, Artificial Sequence
  derived and/or modified sequence opt3 from NBEAL2__Homo_sapiens__NP_055990
auggccgcuagcgagcggcuguacgaacucuggcuucuguauuacgcacaaaaggacuugggcuauuuacaacaauggcugaaagccuucgugggggcguuuaagaaauccaucucuuuaucaagucucgagcccaggcggccugaagaggcuggagccgaagucccacugcuuccgcuggaugaguugcacguucucgcagagcagcugcaucaggccgaccuggaacaagcucucuuacugcuuaaguuguucauuauacugugccgcaaucuggagaauaucgaagcaggucgaggccaggugcucgugccccgugugcuggcccuucugaccaaauuggucgcugagcucaaggggugcccuccaccccagggaagaggcacacagcuggagaacguggccuuacacgcgcugcuccuuugcgaaggucuguuugauccuuaccaaacuuggaggcggcagcgcagcggggagguuauuuccucuaaggaaaaaucgaaguauaaauucccacccgcagccuugccucaggaguuuucagcuuucuuucaggaaagccuacaaaaugccgaccaucugccaccgauccuccugcuuagacugauucacuuguucugugcagugcucgcuggaggcaaggagaacggccagauggccgucagugauggguccgugaaaggacuguuaucuguuguuagggguuggagccggggccccgcgccugacccaugccuggugccccuagcccucgaggcacuggucggggcugugcaugugcuucacgccucccgcgcuccuccacgaggacccgaauugagagcccugcucgagucauacuuucacguccugaaugcagauuggccggccggccuuaguagcgguccugaagaggcucugguuacguugagggugucuaugcucgacgcgauccccaugaugcuggcaugugaagaucggccaguauuacaggccaccuuccuguccaacaauugcuuugagcaucuaacacgucucauacaaaacucaaagcuguaucuucagagccgcgcuccucccgagggggacagugauuuggccacuagacugcucaccgaaccagacgugcagaagguccuggaucaggacacagacgcaaucgccgugcacguugugagggucuuaaccuguauuaugucugauucccccagcgcuaaagagguguucaaggaacggaucggauacccucaucugcaagagguacuucagucgcacggcccaccgacucaccgauugcuccaggaacugcuaaauauggccguugagggcgaccauucuaugugucccccuccacccauucgcaacgagcagccugugcugguccucgcacaauggcugccaucccuucccacagcggaauugagacuguuuuuagcucagaggcuccgguggcugugugauucaugcccggccagucgcgcaaccugugugcaggccgggcuugucggaugccuguuggagacgcucagcacuggucuggcucuagaagccagaugccaggagcaacugcucgcacugcuucaggcuuugggcaggguguccauccguccuauggagcugcggcacuuacuccgaccaagacccgggcuggacucugaaccuggaggcgccgaggcggguaaagccaggcaugcuggggcaguuauacgcacccuuagcggcauggcccggcaccagggacccgcuagagcccugagguacuucgaucuaacaccaucaauggcaggcauuauggugccucccguacagcgcuggccagggccgggauucacuuuucaugcguggcucugucugcacccuauggacaccgcccccacaccagcucccacccgaccuuugcaacggaagcagcuguauaguuucuuuacguccagcgguucuggcuucgaagccuuuuucacugcagcugggacauuagucguggccguuugcacccguaaagaguaccucacuaugucacugccagaagugaguuuugcagauagcgccuggcacugugucgcuaucgugcauguacccggaagaaggccuuucucccagaaucuugugcacguuuauaaggacggccaucuggucaaaacagcgccguugcgcugcccaucucucucggagcccuuuagcuccuguugcauugguucagccggguaccggaccacgaccacaacuaccggccugccuacaccacccgugccugcaacucuagcuuauacccacccggcccugacaagaagucaaucugugcccgccagcaccggacuuggcuggggguccggacucgucgcuccacugcaggaggguucaaucgauagcacuuuggcaggcacgcaggacacaaggugggggucuccuaccucccuggaaggagaguuaggcgccguugcgaucuuccacgaagcucuccaggccacugcacugcgaacccuuuguacacugggucccaacgagaccgccccauuuaagccugaaggggaguugcaugagcucaguacucgccugcuacugcacuacagcccccaggcuugcaagaauaacauuugucuugaucucucuccaucccauggccuggacggacgguugacaggccacagaguggaaacgugggacgugaaagauguagucaauugcguaggcgggaugggggcauuacugccgcuccuggagaggguugccgcgcagccuaaggaagcugaggccggucccgcagaaacccaugaccuuguggggccagagcugacuucaggacacaacacacagggcuugguccuaccccuggguaaaaguagcgaggaacguauggagcgcaacgccguggcugccuuccuccugaugcuucggaacuuuuuacagggccacaugguuaaccaagaaucgcuggugcagugucaggggccugcaauaaucggagcucucuugagaaagguaccauccugggccauggauaugaauguccugaugucugcgcagcuccugauggagcaaguggccgcagagggcagcgggccccuucuguauuugcuauaccagcaucuacucuucaacuuccacuuauggacccugucagacuuugcugugaggcuuggacauauucaguacaugaguuccaucguccgagaacaccggcaaaaacugcgcaagaaguauggcguucaguucauacucgaugccuugagaacacauuacucuccucagagggagcggccgcuggcugcagacgaucuccgaacugugcagaccagccugcuuggucuagccagagaauuucugguacgcuccuugucagccgacgaugugcaagucacgcagaccaugcuaucauuccuggcugcgacaggggacgauggacaggcagugggcgcccucgaccugcuucuggcucucuugcacgguagucugguucaggagucucuagccguguuucugcucgaaccaggcaaucuugagguccuguuagcauugcuggugaggcccgggucccucccucugcuucccgaucguguuugcaaaauucugcggagacuccaacagaacgagagguugccagaacgcagccgacagagacugcgguuaagggagugcggacuacagggccugguggccugucucccugaagggacugucucgccccaacuuugccagggacuguauaaguuguuccugggcgcugacugucucaaucugucagaccuucucgcgguagugcagcugucuuugcaggccgaucugaguguucgcuuagacaucugccgucaacuauuucaccugaucuacggucagccagauguggucagacuccuugcacggcaggcuggguggcaagacgugcugaccagguuguauguacuggaggccgcaacagccggauccccuccgcccagcucuccagaaagcccuacuucccccaaaccagcuccucccaagccgccaaccgagagcccugccgagcccagugauguguuccucccaagcgaagcgcccuguccugacccggauggcuuuuaccaugcacugucucccuucugcacgccauuugaccuugguuuagagcgcuccucagucggcagugggaacacagccggaggcgggggaagcuccggcacccugacuccugcuucucagcccgguacaccuucgccacucgaugggccccgaccuuucccagccgcucccggaagacacagcucauccuugaguaauguucuggaagacggcucucuaccggagccuaccauuagcggcgaugacacuuccaacaccucaaauccacagcagacaucugaagaggagcuguguaaccuccuuacgaaugugcuguuuagcgugaccuggagaggggucgaaggaagugaugaggcagccuggagggaacgcggucaaguguucuccguuuugacucagcugggcgcuagcgccacacucguaagacccccugacugcaucaaaaggucucuguuagagaugaugcuugagucagcacugaccgacauuaaggaagcgccaguggggguccucgccucccuaacacagcaggcucugugguugcugcggcuccuucaagauuuccugugugccgagggacauggcaaccaggaauuguggagugagaagcuguuugaaggugugugcagccucuuagaccgucugggggcauggccccaccuugcuaauggaacugccgaucugcgcgagauggcacagauaggccuacgacucguucugggcuauaucuugcuggaggacccgcagcuccacgcccaggcuuacgugagacuucauaugcuguuacagaccgcggucccugccaggcgggaagaggcauguuacgugcugucgaaauuggaagcugcccucgggcgcguacugaacacgucuucccuagagagcgccacagaugaagcaggaucaccccuugcugccgcggcugccgcagccgcugcagagagaugcaguuggcuggucccacucgugaggacccuguuggaccgggccuaugagccucugggucuccaguggggccuucccucucugccacccacuaacggguccccuaccuucuuugaagauuuccaagcguuuugcgcuacaccagaguggcgacacuucauugacaagcagguucagccgacuaugagccaguuugaaauggauaccuacgccaaaucacaugacuuaaugaguggauucuggaaugcauguuaugauaugcugaugagcuccggccaaagacgccagugggagagggcccagucucggcgugcuuuucaggaauuggugcucgagcccgcccaaagaagggcacgccuggagggucuacgguacacagcuguccuuaagcagcaggccacgcagcacagcauggcgcugcuccauuggggagcccuguggcgacaauuggcauccccuugcggagcuugggccuuaagagacaccccaauccccagguggaaacugucaucugcagaaacuuauagucgcaugcggcucaaacuugugccuaaccaccacuucgacccacaucuggaggcuucggcccuaagagauaaucugggcgaaguuccccucacaccuaccgaggaggccagcuugccgcuggcggugacuaaggaagcuaaagucuccacaccacccgagcuucugcaggaagaccagcucggcgaggaugaauuagcagagcuggagaccccuauggaagccgcugaguuggacgaacagcgugagaagcuggugcucucugccgaaugucaacuuguaacggugguugcagucgugcccgggcugcuagaggugacuacccagaacgucuacuuuuaugauggaucaacagagaggguagaaaccgaggaagguaucggcuacgacuuccggcgcccacuggcccagcuccgagaggugcacuugagaagguucaaucugcggcgcagcgcucuugaacuguuuuucauugaucaagcgaacuacuuuuuaaauuucccuugcaaaguugggacuacacccguguccaguccaucucagaccccgagaccucagcccggaccaauacccccucauacacaggucaggaaccaaguguauagcuggcuccugcgauugcggccacccucacagggcuaccuguccagucguagcccucaggagaugcucagagccucuggucuuacucagaaguggguucaacgcgagaucuccaauuuugaauaucugaugcagcuaaacaccauugcagggaggacguacaaugaccugucacaguauccgguguucccauggguccuccaggauuacgugagccccacauuggaccugucgaacccugcuguauuucgggauuuaucuaaaccaaucggagugguuaaucccaagcacgcccaacuugucagagagaaauaugaaaguuucgaggacccugcaggcaccauugauaaguuucacuacggcacucauuacuccaacgccgcuggggugaugcacuaucugauccgcguggagcccuucaccagccuccauguccagcugcagucaggaagguuugacuguuccgaccgacaauuccacucuguugccgcggcauggcaggcccgguuggaaagcccagcugaugugaaggagcugauaccggaauuuuucuacuucccugacuuucucgagaaucagaacgguuucgaucuuggcugccugcagcuaacaaacgaaaaaguaggggacgugguccugcccccaugggccaguuccccugaggauuuuauccaacagcauagacaggcauuagagagcgaauaugugucugcucaccuccacgaguggauugaccugaucuucggauacaagcagaggggccccgccgcugaagaggccuugaauguauuuuauuacuguacuuaugaaggugcaguggaucuugaccaugucaccgaugagcgcgagcguaaagcgcuggaagggauuaucucaaacuucggacaaacgccaugccagcuccugaaggagccucaccccacacgguugagugccgaagaggcugcccauagacuggcaaggcuagacaccaauuccccgagcauauuucagcaccucgaugaacuuaaggcuuucuuugccgagguagugucugacggcguuccacugguguuagcacuggucccucaccgccagccccauucguucauuacucaaggcucaccagaucuccuggugacagucagcgccuccggguugcuuggaacccacaguuggcugcccuacgaccgaaacaucucuaauuacuuuagcuucuccaaggacccuacuauggguucacauaagacacagcggcuccugaguggcccgugggugccagggucuggaguuagcggccaggcgcuagcuguggcccccgaugguaaauugcuguuuuccgggggccacugggacggaucacucagaguaaccgcacuuccuaggggcaagcuguuaagccaacugucuugucaucucgauguggucacgugccuggccuuggacacuugugggauuuaucuuaucuccggaagucgcgauaccacaugcaugguuuggagacugcuccaccaggguggccugagcguggggcuagcucccaaaccaguccagguguuauacggacacggcgccgcaguaucgugcguggcuauauccaccgagcuggacauggccguuucugguucagaagaugggacagugaucauucauacuguccggaggggccaguucguggcggcuuugcguccucucggagccaccuuccccggcccaaucuuucaccuggcacuugggagcgagggacaaauugucgugcagaguuccgccugggaacgaccuggugcucagguuacguauucucugcaucucuacagcguaaacggcaagcugcgcgcaucauugccgcuugccgagcagcccacagcgcugacugugaccgaggacuucguccuacucgggacagcccaaugugcucugcacaucuuacagcugaauaccuugcucccagcagccccuccccugccaaugaaaguggcuauaagauccguugccgugacuaaggaacggagucauguccuugugggacuggaggauggcaagcucauuguagugguugcaggucagccuagcgaagucaggucuucacaguuugcucgcaaauuguggagauccagccggaggaucucucaagugaguucgggggagaccgaauauaaccccacagaggcccgauga

SEQ ID NO: 59516 - RNA, 2265 nt, Artificial Sequence
  derived and/or modified sequence opt3 from NBN__Homo_sapiens__NP_002476
auguggaagcugcuccccgccgcuggcccugcagggggagagccauacagacuucugaccgguguggaauaugucguuggcaggaaaaacugcgccaucuugauugagaaugaccagagcauaucccggaaccacgcgguguuaacagcuaauuucucuguaacuaaccugucacaaacggaugaaaucccggugcuaacccucaaggacaauaguaaauacgggacauuugucaacgaggaaaagaugcagaauggauucagccgcacucugaaauccggcgaugguauuaccuuugggguguucggaucuaaguuucgaaucgaguaugagccccuuguugccuguucgucaugccuggacgugagcggcaagacagcauugaaccaggccauucuccagcugggcggguucaccgucaauaacuggacugaagaguguacacaucuggugaugguaaguguuaaagugaccaucaagacgauaugcgcucucaucuguggacguccuauugucaaaccagaauacuuuacugaguucuuaaaggcaguggaguccaaaaagcaacccccucagaucgaaucuuuuuauccaccccuggaugagccuagcauugguuccaagaauguggaccuuucaggcagacaggaaaggaaacagaucuucaaggggaaaaccuuuauauucuugaacgccaagcaacacaaaaagcugaguagcgcugucguuuuuggaggcggugaggcccggcuaauuacagaagagaaugaggaggaacauaacuucuuccucgcgccagggacuugcgugguagauaccggaaucacaaauucucagacccugauuccggacugucagaaaaaguggauccaguccaucauggauaugcuucaacgccagggccugagacccauuccugaagcagagauaggcuuggccgugaucuuuaugacgacuaagaacuacugcgacccacaggggcaccccucaacaggacucaaaaccacuacaccugguccaagccugagucaaggcgucucuguggaugaaaaguuaaugcccuccgcuccgguuaacaccacgaccuauguggccgacacagagagcgagcaggcagauacuugggaccugucggaaaggccuaaagagauuaaggucucuaaaauggaacagaaguuccggaugcucucccaggacgcucccaccgugaaggagucauguaaaacaaguagcaauaacaauuccaugguaucuaacacucuugccaagaugcgcaucccaaauuaccaacugagcccuaccaaauugcccucaauaaacaagaguaaagaucgagcgucccagcagcagcaaacaaauagcauuagaaacuacuuucagccaucuaccaagaagagggaacgggacgaggagaaucaggaaaugucaaguugcaaaagcgcccguaucgagacuuccuguucucuacuggaacagacgcaacccgcaacaccuucgcucuggaagaacaaagagcagcaucugagcgagaaugaaccaguugauaccaacuccgacaauaaccuuuucacugauaccgaccugaagucaaucgugaaaaauagugcuucuaagagccacgccgcugagaaguugcgcuccaacaaaaagagagaaauggaugacgucgccauugaggaugaagugcucgagcagcuguuuaaagacacaaagccggaguuagaaaucgaugucaaagugcagaagcaagaggaagacguuaacgugaggaaacggccccgaauggacauugagaccaaugauacuuucucagacgaagcaguaccugagagcucuaagauaucccaggagaacgaaaucgggaagaaacgcgagcugaaggaagauagucuauggagcgccaaagagauuucuaauaacgacaagcuccaggaugacuccgaaaugcugccaaagaaacuuuugcugacagaguuuagaucacucgucaucaagaauaguacgagcaggaaccccucgggaaucaaugaugacuauggccaacugaaaaacuucaagaaauuuaagaaagugaccuacccuggugcugggaaacuuccacacauuauaggcggauccgaucugaucgcgcaucacgcacggaagaauacugaguuggaagaguggcuccgccaggaaauggagguucagaaccagcaugccaaggaggaaucucuggcugacgauuuauucagauauaaucccuaccugaagaggcgucgguga

SEQ ID NO: 59517 - RNA, 1734 nt, Artificial Sequence
  derived and/or modified sequence opt3 from NBPF3__Homo_sapiens__XP_011540583
augguggucagcgccggccccugguccggggagaaggcugaaaugaacauccuggagauuaauaaaaagucuagaccucagcucgcagaaaacaaacaacaguucaggaaucuuaagcagaaaugccugguuacccagguggccuacuuuuuggcgaaccggcaaaauaacuaugacuacgaggauuguaaggacuuaauaaagucaaugcugcgcgaugaacgacuacucacagaggagaaacuggcugaagaacuuggacaggccgaagaacugcgucaguauaagguauuggugcacagucaggagagagaacucacucaacugagggagaaacugcaggaaggucgggacgcaagccgcucccucaaucagcauuuacaggcccugcuuacgccagaugagccggacaacucucaaggcagagauuugagggaacagcuggcugaggggugccggcuagcacagcaccucguccaaaagcugucgcccgagaaugacgaugacgaagaugaggacgugaaaguugaagaggccgaaaaggugcaggagcuuuacgcuccucgcgagguccagaaggccgaagagaaagaagugccagaggauucacuggaagagugugcgauuaccugcagcaacagucaucaccccugugaguccaaucagccuuauggaaacacacgaaucacuuucgaagaggaccaaguagacucuaccuugaucgauagcuccucacaugacgaauggcucgaugcaguuugcauuaucccagagaaugagagugaccacgaacaggaggaagagaagggccccgugagcccuagaaaccugcaggaaucugaggaggaagaggccccacaggaauccugggaugagggugacuggacauuaucaauaccgcccgauaugagcgcuaguuaccaaucugacagguccaccuuucacagcgucgaggagcaacagguggggcuggcccucgauaucggacggcauuggugugaccaggugaaaaaggaggaucaggaagcaacuucgccucgucuuucucgcgagcuguuggacgaaaaagagccagaaguccuacaggacucccuggauagauucuauucaacacccuuugaguaccucgagcugccugaccuuugccagccauacaggagugauuucuauagccugcaggaacaacacuugggccucgcucuggacuuagaucggaugaagaaagaccaggaggaagaggaggaucaggggcccccguguccucgacugucccgcgaacuacccgagguuguggaaccagaggaccuccaagauucucuggacagaugguacagcaccccuuuuucauaucccgaacuuccagauaguugccagcccuacggcuccuguuucuauagcuuggaggaggaacauguaggauuuucucuggacguggaugagauugaaaaguaccaggagggugaagaggaccagaagccuccaugcccgaggcucaaugagguccugauggaagccgaggaacccgaggugcuucaagacucacuggaucggugcuauaguacgacuagcaccuacuuccaguugcacgcguccuuucagcaguaccgcucugccuucuauucguuugaggagcaagacguuagccucgcacuggauguggacaacagauucuucacauuaacugucaucaggcaccaucuggcuuuucagaugggcgugauuuucccucacuga

SEQ ID NO: 59518 - RNA, 2814 nt, Artificial Sequence
  derived and/or modified sequence opt3 from NBR1__Homo_sapiens__NP_001278500
auggagccccaggugacccugaacgucacauucaagaaugaaauccagagcuuucucguuuccgacccugagaacacuacgugggccgauauugaagcuauggugaaaguaucuuucgaccuuaauaccauacagaucaaguaccuggaugaggaaaacgaggaggugucaauuaauagucagggcgaauaugaggaagcauugaaaauggccgucaagcaggggaaccaauuacagaugcaagugcacgagggacaucacguuguggacgaggcgccaccgcccgucgugggugcuaaaagacuggccgcaagggccggcaagaagccucuagcucauuacagcucccucguacggguucuggggucugauaugaaaacaccagaagaccccgcagugcagucguuuccucuugucccaugcgauacugaccaaccccaggauaagccuccagacugguucaccucauaucuggagacauuucgcgaacagguggugaaugagaccgucgaaaaauuggagcagaagcuccacgagaaacugguucugcaaaacccgagccucggaaguugucccuccgaagugucuaugccuacuagcgaggaaacauuauuccugccagagaaucaguuuuccuggcauaucgccugcaacaauugucagcgacguauuguaggcgugagauaccaaugcucacuuugucccaguuauaacaucugcgaagauugugaggcugguccuuacgggcacgacaccaaucacgucuugcugaagcuaaggcggccagugguuggaagcucugagcccuucugccauuccaaguauucaacgccgcgccucccugccgcgcuggaacaggugagacuucagaaacaggucgauaagaacuuucugaaagcagagaagcaaagguugcgggccgagaaaaagcagcgcaaagcugaagugaaggaacucaagaaacagcugaaguuacaccgaaaaauacaucuguggaauagcauccacggccuccagagucccaagucuccacuuggcagaccugagucccuguugcaaagcaacacucuaaugcugccccuccagccauguaccucgguaaugcccaugcugucugccgcauucguugacgagaaccuuccugacgggacacaucugcagccaggaacuaaauuuauuaagcacuggaggaugaagaauaccgguaacgugaaaugguccgcugauacaaaguugaaauucauguggggcaaucucacccuggccucaacggaaaagaaagacgucuuagugccgugccugaaggcggggcacgucggagugguuaguguggaguuuaucgcccccgcacuagaaggcacuuacacaagccauuggcggcucucccacaagggucagcaauucgggccucguguaugguguucuauuaucgucgauccauuccccagcgaggagucaccugacaacauagaaaaaggaaugauuaguuccagcaagaccgaugaccugacuugccagcaggaggaaacauuucuuuuggcuaaagaggaacgccagcugggcgaggugaccgagcaaacggaaggcaccgccgcuugcaucccacagaaggccaaaaauguugcaucugagagagaacucuacauucccucaguggaucugcuuacagcccaggaccuguugaguuucgagcuccuggauaucaacaucguccaagaauuagagagggugccgcauaauacuccuguagacgugaccccauguaugagcccccugccucacgauuccccacuaauugagaagccagggcucggacagauagaagaggaaaacgagggugcuggcuuuaaggcgcugccugacucuaugguuucggucaaacggaaggcagaaaauaucgccagcguggaggaggcugaagaggaccuuuccgggacacaguucgugugcgaaacugucauucgaucauugacccuggaugccgcacccgaccacaacccaccgugucgccagaaaagucuccaaaugacauuugcccugccugagggacccuuaggcaaugagaaggaagagaucauacauauugcugaagaggaagccguuauggaggaggaagaggaugaagaggacgaagaggaggaagaugagcugaaagacgaagugcagucucagagcuccgcaucaagcgaggauuauaucaucauucuuccagaaugcuucgacaccucuagacccuugggugauuccauguacaguagcgcgcucucucagccugggcuggagaggggcgcugagggaaagccaggcguggaagccgggcaagagcccgcagaagccggagagcggcuaccugguggcgagaaccagccgcaggaacacuccaucucagacauucugacuacgagucagacacucgagaccguaccacugauacccgaagucguggagcuuccucccagcuugccccgcucguccccuuguguucaucaccacgggucuccgggaguggaucugcccgucacuaucccagaagugagcucaguuccugaccaaauuagaggcgagcccagggguaguuccggguuaguaaauucucgucagaaaagcuaugaucauucccggcaccaucacggcucaagcaucgcuggaggccucgugaagggggcccugagugucgcagcuucugccuacaaggcgcuuuuugccggaccaccugugaccgcucagggucuguggggcuugcucuccuuccugcaucuagccaaaaagugcuuuuuccugaaagcacccagcgaggcuuuuucgugguucuga

SEQ ID NO: 59519 - RNA, 582 nt, Artificial Sequence
  derived and/or modified sequence opt3 from NCALD__Homo_sapiens__XP_011515637
augggcaagcagaacagcaaacugagacccgaggugaugcaagaccuccuugaauccaccgauuucacagagcacgaaauccaggagugguacaagggguuucugagggacugcccuucuggacauuugucaauggaagaguucaaaaagauuuaugguaauuucuucccauacggcgaugccaguaaauuugcugagcacgucuuccggacuuuugacgcaaacggggauggaacgauagacuuccgcgaauuuaucauugccuuaagcguuaccucccgaggcaagcuggagcagaagcuaaaaugggcguucucuauguaugaucucgacgguaauggguacaucucgaaggcugaaaugcuggagauugugcaggccaucuauaaaaugguaucaagcgugaugaagaugccggaggaugaaaguacacccgagaaacguacugaaaagauauuuagacaaauggacaccaacagggauggaaaacuuucccuggaggaauuuauccggggcgcaaagucugacccuagcauuguccgcuugcuccagugugauccauccucagccggccaguuuuga

SEQ ID NO: 59520 - RNA, 2547 nt, Artificial Sequence
  derived and/or modified sequence opt3 from NCAM1__Homo_sapiens__NP_000606
augcugcagaccaaggaccucaucuggacacuuuucuuucugggcacugccgugagcuugcaagucgauauuguucccucccagggggagauaucugugggagaaucaaaauucuuuuuaugccagguagcuggugacgcaaaggauaaagacaucaguugguucagcccuaacggcgagaagcugacgccaaaucagcaaagaauuuccguggucuggaacgaugacucuucgucaacccuaacaaucuacaaugccaacauugaugacgcggggaucuauaaaugugugguuacuggagaagauggcagcgagagugaagcuaccgugaaugucaagauauuucagaagcucauguucaaaaacgccccgacaccccaggaguuuagggagggugaagacgcagugaucguaugcgauguuguguccucucugccuccaaccauuaucuggaagcacaaagggcgggacgucauucuuaagaaagaugugcgcuucaucgugcugagcaauaacuacuugcagauacgaggaauuaagaagacugacgagggcacauaucguugugaaggcagaauccucgccaggggagagauuaauuuuaaagacauccaagucaucguuaacgugcccccuaccauucaggcucggcagaauauaguaaacgcaacggccaaucuggggcaguccgugacucuggucugcgaugcugaggguuucccagaacccaccaugucauggacaaaggacggcgagcaaaucgaacaggaggaagaugacgagaaauacauuuuuagugaugacagcucucagcucacuaucaagaaaguggauaagaacgacgaggccgaauauauauguauugcggagaauaaagcaggggaacaagaugccaccauccauuuaaagguuuucgcuaagccuaaaaucacauacguggagaaccagaccgccauggaacuggaggagcaggucacgcuuacuugcgaagcauccggagacccaauuccgucaaucacauggcgcaccagcacuagaaacauuaguucugaggaaaagacauuggauggccacauggugguaaggucccaugcucggguuagcucgcugacccuaaaaucuauacaguauacggacgccggugaguacaucuguaccgcguccaauacaauugggcaagacucacagaguauguaccucgaagugcaguaugcccccaagcugcagggaccugucgcaguguacacuugggagggcaaccaagucaauauuaccugcgagguguuugcuuauccaagcgccacaaucuccugguuccgcgauggccagcuucugcccucuagcaacuacucaaauaucaaaauauauaacacuccuagugcuuccuacuuggaaguuaccccagacagcgagaaugauuucgggaacuauaauuguacagccgugaaccgaaucggacaggaaucucucgaguuuauucugguacaggcagacacccccucaaguccgagcaucgaucaagucgagccuuacuccucuacugcccaggugcaguucgacgaacccgaggcuacggguggcguuccaauuuuaaaguacaaggcggaauggagagcagugggggaggaagucuggcacucgaaaugguaugaugccaaggaggcuagcauggagggaaucgugacaauaguaggccugaaaccugaaaccacuuacgccgugaggcucgcagcccuuaaugguaaggggcugggcgagaucuccgcugccucagaauuuaaaacccagcccguucaaggagagccaagugcacccaaguuggaaggccagaugggggaggacggaaacucuauuaaggucaaucuaaucaaacaggaugacgguggcagcccuauucggcauuaucuggugcguuaccgcgcgcucuccucagaguggaagccagaaaucagacugccgagcgggucugaucacgugaugcuuaaaucccuggacuggaacgcugaguaugaagucuacguuguggccgagaaucaacagggaaagaguaaagcagcccacuucguguuuaggacaagcgcucagcccaccgccauaccugcaaacggcucuccaacuuccgguuugucaacaggggcuauuguaggcauccucauugucaucuucgugcuguuacugguuguggucgauauaacgugcuauuuucuaaacaaguguggacucuucaugugcaucgccgugaaucugugcggcaaggcggggcccggagccaaagguaaggacauggaagagggcaaagcugcauuuaguaaggacgagagcaaagaaccuauuguugaggugcggaccgaagaggagcgaacuccaaaccaugaugggggaaagcacacagaacccaaugagaccacaccgcuuacugaaccugagaaaggcccaguagaagccaagcccgagugucaggagaccgaaacgaagccugcucccgccgaggucaaaaccgugccaaacgacgcaacacaaacuaaggaaaaugagucgaaagcguga

SEQ ID NO: 59521 - RNA, 2514 nt, Artificial Sequence
  derived and/or modified sequence opt3 from NCAM2__Homo_sapiens__NP_004531
augagccugcuccuuuccuucuaccuguugggcuuacuggugucuucagggcaggcccuacuccaagucaccaucagucugagcaagguugagcuuuccgugggagaaucuaaauuuuucacaugcacugcuauuggugagcccgaaucgauagacugguauaacccucagggcgagaagaucauuucaacgcagagaguagugguccagaaagaaggggugaggagccggcugaccaucuacaaugcaaacauugaggaugccggaaucuaucgcugucaagcgacagacgcuaagggccagacucaggaggccaccguuguguuggaaauauaccagaaacucacauuucgagaggucgugaguccacaagaguucaagcagggugaagaugcagagguaguuugccguguguccucuagcccggcccccgcugucuccuggcuguaucacaaugaagaggugaccacuaucucagacaacagauuugcaaugcuggccaauaacaaucuccagauuuuaaacaucaauaagagugaugaagggauuuacaggugugagggacggguggaagcucgcggcgagaucgacuucagagauauaauugucaucguuaacgugccuccagccauuagcaugccccagaaaucuuuuaaugcgacagcagagaggggcgaagagaugaccuucuccugccgggccucagggagcccugaaccagcuaucaguugguuucgcaacggaaagcugaucgaggaaaaugagaaauauauucuuaaggguucuaacacggaguugacuguacgaaauauaaucaacuccgacggcgggcccuacguguguagagccaccaacaaagcaggagaagaugagaagcaggcuuuccugcaagucuuugugcagccucauauuauccaacuaaagaaugaaacaacuuacgagaacggccagguuacccucgugugcgacgccgaaggugagccaauaccggagauuacauggaaaagggcggucgauggguucaccuuuacggaaggagacaagagccuggauggccggaucgaggugaaaggccagcacgggucgucuucccuucauaucaaggacguaaaacugucagacaguggacguuaugauugugaagccgcaagccgcauugguggccaccagaaguccauguacuuggacaucgaguaugcucccaaauucauuucuaaucaaacuauauacuauagcugggaggggaacccuaucaauauuucaugcgauguuaagaguaacccacccgccuccauccauuggagaagggacaagcucgugcugccugcuaaaaauacaaccaacuuaaagacuuacagcacaggacggaaaaugauccuggaaauugccccaaccucugauaaugacuucggccgauauaacuguacggcaaccaaucacauagguacacgcuuucaggaguacauccucgcccuugcugauguccccucaaguccguacggggugaagauuaucgaacugagccagacuaccgcgaaagucuccuucaacaagccugacucucacggcggagugcccauucaucacuaucagguugaugugaaggagguagcaucggaaaucuggaaaauagucagaagccauggcgugcaaacaaugguuguguugaauaaccuagagccaaauacuaccuacgagaucagggucgccgcugugaacgggaagggacagggugacuauuccaaaauugaaaucuuucagacacugccuguacgggagcccucaccacccaguauucacggccagccuucuagcgggaaguccuucaaacucucaaucaccaagcaagaugacggaggcgccccaauacuggaauacauugugaaguaucgcagcaaagacaaggaggaucaguggcuugagaaaaagguucaggguaacaaagaccacaucauucuggaacauuugcaguggacuaugggguacgagguccaaaucacggcagccaauagacucggcuauucugaaccgacaguguacgaguuuuccaugcccccuaagccaaacauaaucaaggauacccuguucaauggauuaggccugggggcugugauuggacuaggugucgccgcacuccugcuuaucuugguugugacugacgugaguugcuuuuucauuaggcaguguggccugcucaugugcaucacccgucggaugugcgggaaaaagagcggaucuuccggcaaaucaaaggaacuggaggaagguaaagcggcuuaccuuaaggaugggaguaaagagcccauaguagagaugcgaacagaagacgagagagucaccaaccacgaagauggcagcccugugaaugagccaaacgagacuacaccccugacggaaccggagaaguugccucucaaggaagaggacggaaaagaagcccugaauccagagaccauugagaucaagguuucgaacgauaucauucaguccaaagaagacgauucuaaggcauga

SEQ ID NO: 59522 - RNA, 3966 nt, Artificial Sequence
  derived and/or modified sequence opt3 from NCAN__Homo_sapiens__NP_004377
augggcgcccccuucgugugggcucuggggcuccuuaugcugcagauguuguuauuugucgcaggagagcaagguacccaggacaucacagaugccagcgaaagaggccugcacaugcagaagcuaggguccggaucuguucaggcggcucucgccgagcugguggcacuuccuugccuguucacuuugcaaccaaggccgucagccgcucgggacgcaccccgcauuaaauggacgaagguacgaaccgccaguggccagcgucaggaucucccuauacugguggcuaaagacaacgucgugagaguugccaagagcuggcaggguagggugucccugccaucuuacccccggcgcagagcgaaugcaacacucuuacuggggccucuuagggccucggauucaggauuguaucggugucaagucgugcgcggcaucgaagacgagcaggaucugguaccacuagaaguuacuggcguggucuuucauuaccgaagcgcuagagacagguaugcccucaccuucgcagaggcucaggaggccugccggcugaguuccgcgauuaucgccgcaccccgucaccuucaggcugccuuugaagauggguucgacaacugugaugcuggauggcugucugaccgcacagugagauacccuauuacccaaagcaggccagguugcuauggcgaucgguccucauugccgggggugcgaaguuacggacgcagaaauccccaggagcucuaugacgucuacuguuuugccagggaacugggcggugagguuuucuacguggggccugcacggcgcuuaacucuggccggagcuagagcgcagugcaggcgucaaggcgcagcccucgcuagcguaggccagcuucaucuggccuggcacgagggguuggaccagugugauccaggauggcuagcagacgguucugugcgguaucccauccagacaccucgaagaaggugcggcgggccagcccccggaguccgcaccguguaccgguuugcuaacagaacgggcuucccguccccugccgaaagguuugaugcauauuguuuccgcgcgcaucaccccacuucacaacacggugaccuggagaccccaagcaguggggaugaaggcgagauacucucugcugaaggaccucccguucgagagcuggagccaacacuugaagaggaagagguggucacucccgacuuucaggaaccucugguguccagcggcgaggaggaaaccuugauccucgaggaaaaacaggagucgcagcaaacacugucuccaaccccgggggaucccauguuagccuccuggccuacgggagaaguauggcugucaacuguugcaccaagucccagcgacaugggugccggcacagcugccuccucucauaccgagguggcaccuacugauccaaugccccggcguagagggagguucaagggacuaaauggccgcuacuuccagcagcaggagccggaaccuggucuccaagggggcauggaggcuagcgcccagccacccacaucagaagcggccgucaaccagauggagccuccccuggcuauggcagugaccgagaugcuuggaaguggccagucccggagcccaugggccgacuugacgaaugaagucgauaugccuggggcuggaucugccgguggcaagucaagucccgagccauggcuguggccgccuaccauggugcccccaagcauuuccgggcacucuagagcacccguucucgaacuggagaaagcggaaggaccuucggccaggccagcuacacccgaccuguuuuggagcccucuugaggccacuguguccgcaccgucaccagcucccugggaggccuucccuguagcaaccaguccagacuugcccaugauggccaugcuccgaggcccuaaggaauggaugcugccgcaucccacaccaaucucuacugaggcuaaccgcgucgaagcgcacggugaggccaccgcaacagcuccucccagcccagccgccgaaaccaaaguguauuccuuaccucugucacuaacucccacggggcaaggcggagaggcuaugccaacaaccccggagagcccucgggcagauuuuagagaaacuggcgagaccucucccgcccagguuaauaaggcggaacacuccaguagcucuccauggcccuccgugaacaggaaugucgcugugggguucguaccuacagagaccgccacugaaccaacaggacuccguggcauucccgguucagagagugggguguuugacacggcagagagcccuaccucgggacugcaggccacuguugaugaaguccaagacccguggccauccguguacucuaaaggccuugaugcuagcucacccagugcaccuuuggguucccccggcguguuccuggucccaaagguuacaccuaaccucgagcccuggguggccaccgacgaagggccaacagugaauccuauggauucuacuguaaccccggcgcccagcgacgcuuccggaaucugggagccaggcucacaggucuuugaggaagccgagagcacgacccugaguccucagguggcauuagauacaucuauaguuacuccccugaccacacuugaacagggggacaaggugggagucccagccauguccacuuugggcagcucgucaucucaaccucaucccgagccggaagaucagguggagacccaggguacgaguggggcuuccguuccaccucaccagagcucuccccucggaaaaccagccgugcccccuggcacaccgaccgcagcuagcguaggugaguccgccucagucaguagcggcgaacccacugugccaugggacccuucuuccacacugcuacccgugacccuggggauugaggauuucgaacucgagguccuggcgggaucaccuggcguugaaaguuuuugggaggagguggccagcggggaggaaccagcacuucccggaacuccuaugaacgcuggcgccgaagagguacauuccgacccaugcgaaaauaaccccuguuugcacggugggaccugcaacgcuaauggaacaauguauggcugcucuugugaccaagguuucgcaggcgagaacugcgagaucgauauugacgauugucugugcucgccgugugaaaaugggggaacgugcaucgacgaggugaacggcuuugucuguuuaugccucccuagcuacgggggaucauucugugaaaaggauaccgagggcugcgaccgcgguuggcauaaauuucaggggcacuguuaccgguauuucgcccacagaagggccugggaggaugcugaaaaggacugccgacggcgcuccggacaucugacaagugugcacucuccagaggaacauagcuucaucaauuccuuuggccacgagaacacuuggauuggccuuaaugauagaauaguugaaagggacuuccaguggaccgauaacacagggcugcaguuugagaauuggcgggagaaccaacccgacaauuucuuugcgggaggugaagauugcguggucaugguggcacacgagucaggccgauggaacgacguuccuuguaauuacaacuugccauaugugugcaaaaaggggacuguccucuguggacccccgccugccguagaaaaugcuucucugaucggcgccagaaaagcaaaguacaacgugcaugccaccguucgcuaucagugcaacgaggguuucgcucagcaccauguggcgacgauuaggugucguagcaaugggaagugggaccggccccaaaucgucugcacaaaaccaagaaggagucaccgcaugcgaagacaucaccaccaucaccagcaucaccaucagcaccaccaucacaagucccggaaagaaaggcgcaagcauaaaaagcacccuaccgaggauugggagaaggacgaaggaaacuuuuguuga

SEQ ID NO: 59523 - RNA, 4206 nt, Artificial Sequence
  derived and/or modified sequence opt3 from NCAPD2__Homo_sapiens__NP_055680
auggcuccccagauguacgaguuccaucugccucucagcccagaagaacuucugaaguccggcggggugaaccaauaugucguucaggaaguguugucuaucaaacacuuaccgccccagcugagagccuuucaggcagccuucagggcgcaaggaccucuagcuaugcuccagcacuuugacaccauuuacucaauacugcaucacuuccggaguaucgauccaggucuuaaggaggacacacugcaguuuuugauuaaaguagugagccgccauucccaggaacuccccgccauccuggaugacacuacgcugucuggcucggaucgaaaugcacaccucaacgccuuaaagaugaauugcuaugcucugauucgucuuuuggagucauucgagaccauggcaagccaaacaaaccuggucgaccuagaucucgggggaaaaggcaagaaggccagaacuaaagcugcccacgguuuugacugggaagaggaaaggcagccuauccugcagcuucugacccaguugcuccaacuggauauacggcauuuauggaaucacaguaucauugaggaggaguucgugucccugguuacaggguguugcuaccgccuccuugagaacccaaccaucaaucaucagaagaacagacccacuagggaagcgauuacacaccuguugggaguggcacuaacccgguauaaucacaugcugucugccacggucaaaaucauacagaugcuccaacauuuugagcaccuggcuccugugcuuguagccgcaguuagccugugggcuacugacuacggcaugaaguccauugugggcgaaaucguccgcgagauugggcagaaauguccacaggaguugucacgagauccgaguggaaccaaggguuucgccgcguuucucacagaacuggccgagagagugcccgcaaucuuaaugagcucuaugugcauccugcuagaccaucucgauggcgaaaacuauaugaugaggaaugcugugcuggccgcuauggccgagaugguccuucagguuuuguccggggaccaacuggaagcagccgcucgggacacucgugaucaguuccucgacacccugcaggcgcacggacaugaugugaacucauuuguacgcagcagagugcuucagcuguucacaaggauuguccaacagaaggcauugccucucacccgguuccaggccgugguugcucuggccgugggccgauuagcagacaaaaguguccugguguguaagaaugccauacagcuacucgcuucuuuucuggccaacaauccauucuccugcaaacuuagcgaugcagacuuggcggguccccugcaaaaggagacgcagaaacuccaggagaugcgcgcucagagaaggacugccgcagccucggcuguacuggauccugaagaggaaugggaggccauguuaccagaacugaagucuacacuucaacaguugcuccagcugccccaaggggaggaggaaaucccggagcagauugcaaacaccgaaacuacagaggacguuaaaggacggaucuaccagcuacuggcuaaggccuccuacaagaaagcgauaauucucacccgcgaggccacgggccacuuucaggaaucagagccuuucagucacaucgaucccgaagagagcgaagagaccagacugcuuaacaucuugggccugauuuuuaaggggccagcugcauccacacaagagaaaaauccuagggaaucuacuggaaacauggugaccggucagacagucuguaagaauaaacccaacaugagcgacccagaggaaucacguggcaaugaugaguuagugaagcaggaaaugcucguccaguaucugcaagacgccuacaguuucucccggaagaucacugaggcuauugggauaaucagcaaaaugauguaugagaacaccacaaccgugguucaggaagugauugaguuuuucguaauggucuuucaguucggagugccccaggcccuuuuuggcguucgaagaaugcugccuuugaucuggucuaaggaaccaggugugagggaggcaguccucaaugcguaccgccaacuguaucuaaacccgaaaggggacucagcccgggcuaaggcccaggcacugauccagaaucucagucugcuuuugguggaugcuagcguaggcacuauucaaugccuggaagagauauuaugugaguucgugcagaaagacgaacucaagcccgccguuacgcagcugcuuugggagagagcaacagaaaaggucgccugcuguccucuggagaggugcuccucugugaugcuacucggaaugauggcucgcggcaaaccagagaucguggggucgaaccuggauaccuuggucagcauuggacuggacgaaaaguuuccccaggauuaccgauuagcgcaacagguuugccaugccaucgcaaauauuuccgaccggcguaaaccuucacucgguaagagacacccacccuucaggcugccgcaggagcaucgccuuuucgaacggcugagagagacugugaccaaaggcuuugugcacccugauccauuguggauccccuucaaggaaguagcugucacacucauauaucagcuggccgaggggccugaggugaucugugcccaaauucuacagggaugcgcuaagcaggcacuggaaaaacuugaggaaaagaggaccagucaggaggaccccaaagaaucuccagccaugcucccuacuuuucuguugaugaaccuguuaagccucgcgggcgauguugcucugcaacagcuugugcaccuggagcaggccgucuccggugaguugugucgacgccgggugcucagagaagaacaggaacauaagacaaaagaccccaaggagaaaaauacgucaagcgaaaccacuauggaggaggaacuggggcuaguuggcgcaacagccgaugacaccgaggcugaacugaucaggggaauuugcgagauggagcuucucgauggcaagcaaacacuggcagccuucgugccauuguuacugaagguauguaacaauccggggcucuacucuaacccugaccuguccgcggcugccagucuugcacugggaaaauuuugcaugaucagcgccacuuucugugacucucaguugcgucuacuguuuaccaugcucgaaaagucaccccugccaauaguccgcuccaaccuuaugguggcuacgggugauuuagccauucgguuccccaaucugguggacccuuggaccccacaccucuacgcaagauugagggaucccgcucagcaaguccgaaaaacagccggccugguuaugacucaucucauccugaaggacauggugaaaguaaagggacaggugagugagauggcgguccuucugauugauccugaaccgcagaucgccgcauuggcuaagaacuuuuucaaugagcuaagccacaaagggaacgccauauauaaucugcucccagacaucauuucgcgguuauccgaucccgaacugggcguggaggaggaaccuuuucauaccaucaugaagcagcuucugucuuacauuacaaaagacaagcaaacugagagccucguugaaaaauugugccagcgcuucagaaccucaaggacggagcggcagcagcgagaucuggcuuauugugugagucaacucccacugacagaaagaggucuucgcaagaugcuagacaacuuugauugcuucggggacaagcuguccgaugagucuaucuucagcgcauuuuuguccgucgugggcaaauuaaggcguggagccaagcccgagggcaaagccauaauugacgaguucgagcagaagcugcgggcuugucacaccagagggcucgacggaaucaaagaacuggagaucggccaggcggguucacagagggcaccuagcgccaagaagccgaguacugggucucgcuaccaaccccuugcuuccacagccagcgauaaugacuuuguuaccccagaaccucgaagaacuacccggaggcaccccaacacacagcagcgcgcaucgaaaaagaaaccaaagguggucuucucaucugaugagaguuccgaggaagaccugagcgccgagaugacggaagaugagaccccuaaaaagacuacacccauucuccgugcuucugcgagacggcauaggagcuga

SEQ ID NO: 59524 - RNA, 4497 nt, Artificial Sequence
  derived and/or modified sequence opt3 from NCAPD3__Homo_sapiens__NP_056076
augguggcccugagaggccucgggagcggacuucagcccuggugcccucuggacuugagguuagagugggucgauaccguuugggaacuggacuucacagagacugaaccacuagauccguccaucgaggcugaaauuauagagacgggucucgcagccuuuaccaagcuguacgagucucuucugcccuucgcgacaggcgaacacgggucaauggagaguaucuggacauuuuucauugaaaacaaugugagccauuccaccuugguagcucucuuuuaucacuucgugcaaaucguccauaaaaagaacgugucuguucaguaccgggaguauggacugcacgccgcaggccuguacuuucucuuacuggaggugccugguucggucgccaaucagguguuccauccaguaauguuugacaaauguauucagacacuuaagaaaucauggccccaagaaagcaacuugaaucgcaagcgaaagaaagagcagccuaagaguucccaggcuaacccagggcgucacagaaaaaggggaaagcccccucggcgcgaagauaucgagauggacgaaauaaucgaggagcaggaagaugagaauauuugcuucucugcaagagaccugagccaaaucaggaacgccauuuuucaccuacucaaaaauuuccugcggcuucugccaaaguuuuccuugaaggaaaaaccgcaguguguucagaacugcaucgagguguucgucucacucaccaauuucgaacccgugcugcaugagugucacgugacucaggcucgcgccuuaaaccaagcgaaguauauaccugagcuggcauacuauggccucuaccuucugugcaguccaauucauggcgaaggggauaaagucaucagcuguguuuuucaccagauguugucugugauucuaaugcuggagguaggagaagguucccaccgagcuccccucgccgugacaucacaggucaucaauugcagaaaccaagccgugcaguucaucagcgcacugguugacgagcuuaaggaaaguauuuuuccuguggucaggauacuguugcagcauaucugugcuaaagugguagauaagucugaguaccggaccuucgccgcgcagucccucguucaacuguuaagcaaacugccaugcggcgaguaugccauguuuauugcauggcuauacaaguauucgcguucuuccaagaucccccaccgcguguucacgcucgacgucgugcuggcucuuuuggaacugccggagagagaagucgauaauacucucucacuggagcaucagaaauuucuuaagcacaaauuccuggugcaggagauaauguuugacagguguuuggacaaggccccuaccguucggaguaaagcucucagcuccuucgcccauugccuggaauuaacagugacuucugcaagcgagucaauucuggaacuacucaucaacagucccaccuuuuccguaaucgagagccacccagggacacugcuucgaaacucuucagccuucaguuaccagcgccaaaccagcaauagauccgaaccuucuggagagauuaacaucgauucgagcggcgagacggucgguuccggggaaaggugcgugauggcuauguugcggcgcagaauuagggacgagaagacuaauguucguaagucagcgcuucaggugcucgucaguauacugaaacacugugaugugucuggaaugaaggaagacuuauggauccugcaggaucagugccgggaccccgcaguaagcgugcgaaaacaagcccuucaguccuugacagagcuccugauggcucagccaagauguguucagauucaaaaggccuggcuaaggggcgucgugcccguggucauggauugcgaaucaaccguucaggagaaagcacuggaguuucucgaccagcugcuuuugcaaaacauccgccaucacagccauuuccacucuggcgaugacucccaggugcuggccugggcuuuacucacucugcuuacaaccgaaagucaggagcugagccgguauuugaauaaggccuuccacaucuggucuaagaaagaaaaguuuuccccuacguucauuaacaaugugauaucacauaccgggacagagcacagugcaccagcguggaugcuccugagcaaaaucgcuggaucguccccgagacuagauuacucuaggauuauccagagcugggaaaagauuucaagucaacagaaccccaauuccaacacucugggucauauccucuguguaauaggccacaucgccaaacaucugccuaagucuacccgcgacaaggucacagacgcagugaaaugcaagcugaauggguuucaguggagcuuggagguuauuuccucagccguggaugcucugcagcgauuaugucgggccagcgcagagacuccagcugaagaacaagaacuccugacccaggucugcggagacgugcuuaguacaugugagcaccgucugucuaacaucguucuaaaagagaauggcaccgguaacauggaugaagaccuccuggugaaguauauuuucacuuugggggauaucgcccagcugugccccgcgagaguagagaaaaggauauuuuuacucauucaguccguccuggccagcucggcugacgcagaucacucaccuucuagucaaggcuccagcgaagccccagcuucucagcccccgccucaggugcgcggaagcgugaugccauccgucauccgggcccaugcaauuaucacgcuuggcaagcuguguuugcaacacgaggaccucgcgaaaaagucaauacccgcccugguuagagaacuagaggugugcgaggauguagcugugaggaauaacgucaucauugugaugugcgaccuguguauccgauacacaauuaugguugauaaguacaucccuaacauaaguaugugccuuaaagacagcgaucccuucauucgcaagcagacccucauccuguugacuaaucuguuacaggaagaguuugugaaauggaaggggucucucuucuuucgguucgucuccacccugaucgacucacauccagacauugccaguuuuggagaguucugucuugcacaccuguugcucaaaagaaacccugugauguuuuuccagcauuucaucgagugcauuuuucacuucaauaacuaugaaaagcacgagaaguacaauaaauuuccccaaagcgagagggaaaagcgucuguucucccuaaaagguaagucuaacaaagagcgccggaugaagauauauaaguuucugcuugaacauuucacagaugagcagagauuuaauaucaccucgaaaauuugucucagcauccuggcuugcuucgccgacggcauuuugccauuagaucuggacgcaucagaacuccuguccgauacuuuugagguucuuaguucuaaggagaucaaacuguuggccaugaggagcaagccggacaaagaucuacugauggaagaggacgauauggcucucgcgaacguggucaugcaggaagcccagaagaagcugauaucccaaguacagaaacgaaauuucaucgagaacauuaucccuauuaucauaucacuuaagacaguguuagagaaaaauaagauucccgcacugcgggaacucaugcacuacuugcgcgagguuaugcaggacuauagagaugaacugaaagacuuuuucgcuguggauaagcagcucgccucugagcuggaauacgacaugaaaaaguaucaagagcagcuuguccaggagcaggaacuggccaagcaugcugacguggcagggacggccggaggcgcggagguagcuccaguggcccaagucgcauugugucuagaaaccguucccgugccugccggucaggagaacccagcuaugagccccgcagugagucagccuugcacuccgagggccuccgcggggcacgucgcugugagcucuccaacacccgaaaccggcccucugcaacggcucuuaccaaaagcccgacccaugucacuguccacaaucgcaauccuuaauaguguuaagaaagccguagagagcaagucgagacaccgcucuaggucccugggagugcucccuuucacuuugaacagcggcucaccggagaaaaccuguagucaggucucuuccuacagccuggaacaggagucaaauggggaaauugagcaugugacgaagcgugcuauaaguacccccgaaaagagcaucuccgauguuacauuuggagccggugugucuuacauuggcacuccacggaccccuagcuccgcaaaagagaagaucgaggggagaucacagggaaacgacauucucugccugucucuucccgauaaaccaccuccccaaccacagcaguggaacgucaggaguccggcucgcaauaaggacacuccugccuguucgcgaagaagccuacggaaaacuccccugaagaccgcgaacuga

SEQ ID NO: 59525 - RNA, 3432 nt, Artificial Sequence
  derived and/or modified sequence opt3 from NCAPG2__Homo_sapiens__NP_001268861
auggagaagagagaaaccuucgugcaggccgucagcaaagagcugguuggcgaauuucuccaauucgugcagcuugacaaggaggcuuccgaucccuuuucucugaacgaauuguuagacgagcugucaaggaaacagaaggaggaacuauggcagcggcucaaaaaucugcuuacagauguacuguuggagaguccuguggacggguggcaagucguggaagcacagggagaggauaacauggagacugaacacgguagcaagaugcgcaaguccaucgagauuauauacgccaucacgucuguuauucucgcgucggugucagucaucaaugaaagcgagaacuaugaagcucugcuggagugcgugauuauccucaauggcauauuauacgcccugccagagagugaacgaaaacuucaguccucuauccaggacuuguguguaaccuggugggagaaggggcugccggcaaaagaagauacaggaaagacugccuucguuaugcuacuccguagaagccuggagaccaaaacaggcgcugacgugugcaggcuuuggcggauucaucaagcacuguauuguuuugauuacgacuuggaagaguccggugagaucaaggauaugcuccuggaaugcuucauuaacaucaauuauauaaagaaagaggaagggcgcagauuuuuaucaugucuguucaacuggaauauuaacuuuaucaagaugauucacggaaccaucaaaaaucagcuccagggccuucagaagagucugauggucuacaucgccgagauuuauuucagggcuuggaaaaaggccagcggcaaaauauuggaagcgaucgagaacgacugcauucaagauuuuauguuccaugggauccaccuaccccggcgcucuccugugcauuccaaggugcgagagguccugucauacuuucaccaccagaagaaaguuagacagggaguggaagagaugcucuacaggcuguauaagccaauacuuuggcggggucugaaagcacguaauagcgaaguacgcaguaacgccgcuuuacucuucguggaggccuuccccauuagagacccuaaucugcaugcaaucgagauggacucugaaauccaaaagcaguuugaggaauuauacucccugcuagaggauccauaucccauggucaggagcacuggcauucucgggguguguaaaaucacaucgaaguacugggaaaugaugccuccaaccauucugauagaccuuuugaagaaaguuacgggagagcuggcuuucgauacuucuuccgccgacgugcggugcucagucuuuaagugucucccgaugauccuggauaacaaacuuagucacccccuguuggagcagcuccugccugcguuacgauauagccugcaugacaacuccgaaaaggugcgcguagccuucguugauaugcuacucaaaauuaaggcagugagagcugccaaguuuuggaaaaucugcccaauggagcacauccuggucaggcuugaaaccgacucucggcccgugagccgcagauuggucucacugauuuucaauaguuuucucccugugaaccagccagaggaaguuuggugugagaggugcgugacacugguacaaaugaaucacgcugccgcacgucgguucuaccaguaugcccaugagcacacugcuugcaccaacauagcgaaguuaauccaugucauucgacacugucugaaugcaugcauccagagagccgugagggaacccccggaggaugaagaggaagaggacggccgcgagaaagaaaacguuacagugcuugauaagaccuuguccgucaaugacguggcuuguauggccggucuccuggagauuaucguaauacuauggaaaagcaucgaccggucuauggaaaacaauaaggaggcaaagcuguacacgauuaacaaauuugccucagugcucccugaguaccugaagguuuucaaagaugacagaugcaagaucccccuuuuuauguugaugaguuucaugccagcuagcgccgucccucccuuuuccuguggggugauuucuacucugaggucgcgcgaagagggagcaguggauaaaagcuauugcacauuacucgacugucugugcuccuggggccaggucggccauauccuugaacugguugauaauugguugccaaccgagcacgcgcaagcuaagucaaacacugccaguaaagggcgagugcagauacacgacacacggcccgugaagccugaacucgcacugguauacauugaguaucuacugacccauccaaagaaucgugagugucuccugucugccccgagaaagaaacuuaaccacuugcugaaggcuuuagaaacgagcaaagccgaucucgagucccugcuucagacccccggagguaaaccuaggggcuucucagaagcagcugccccacgcgcguucgggcugcauugccggcuaagcauccaccuccagcacaaguuuuguucugagggaaaggucuaccuguccauguuggaagacacaggcuucuggcuggagaguaaaauuuugagcuuuauccaagaucaggaggaagacuaucucaagcugcauagagugauauaccagcagaucauucaaacuuaucuuaccguuugcaaagauguggucauggugggucugggggaccaccaguuccagaugcaauugcuccagaggucucugggcaucaugcagacaguuaagggauuuuucuacgugucccuacugcuugauauucucaaagagaucacuggcucaagucugauacagaagaccgacagcgacgaagagguagccauguugcuggauacaguccaaaagguguuucagaaaauguuagaaugcauugcucgaucguuccgcaagcagcccgaggaggggcuccggcugcuuuacuccgugcagagaccucugcaugaauuuaucaccgcaguccaaucuaggcacacugacacgccaguucaucguggaguguugagcacacucaucgccggucccguaguggagauuucacaccagcugcgcaaagucagugauguggaggaacuaaccccgccugagcaccuguccgaccuuccacccuucucucggugucucaucggcauuauaaucaagagcuccaauguugugagaucauuucuggaugaauugaaggcuugcgucgccagcaacgacauugaggggaucguguguuuaacugcagcgguucauauuauccuggugauaaacgccggaaaacacaagaguucuaaagucagggaaguagcugccaccgugcaucgaaagcucaaaacauucauggagaucacccuggaagaggauuccauugagcgguuucuuuaugaaagcucgucacgcacucugggcgaguugcuaaauucuuga

SEQ ID NO: 59526 - RNA, 3048 nt, Artificial Sequence
  derived and/or modified sequence opt3 from NCAPG__Homo_sapiens__NP_071741
augggcgccgagagaaggcugcucagcaucaaggaagcauuccggcuugcacagcaaccccaccagaaccaggccaaacugguggucgcguugucccgcaccuaccgaacaauggacgauaagacuguuuuucaugaggaguucauucacuauuuaaaauacgugaugguaguguauaagcgugaaccugcugucgaaagagugauagaguuugccgcaaaauucguuacgucuuuucaucagucagacauggaggaugacgaagaggaagaggaugggggacugcuaaauuaccucuucaccuuucugcuuaagagucacgaggccaacagcaaugcugugagguuccgggucugccuguugaucaacaagcuccuggguuccaugccagaaaaugcacaaauugacgaugacguguuugauaaaaucaacaaggccaugcugauucgccucaaagacaagaucccgaauguaagaauacaggcuguuuuagcccugucuaggcuucaggaucccaaagacgaugaguguccuguggucaacgcguaugcaacauugaucgaaaaugacucgaacccagaggugcggcgcgccgugcugucaugcauugcucccagcgccaagacucuaccuaagaucgucggccgaaccaaagacguuaaggaagcagugagaaaacucgcuuaccagguacuggccgagaaggugcauaugagggcgaugaguauugcccaacgggucaugcuucugcagcagggguugaaugaucguuccgacgcagugaaacaggcuaugcaaaagcaccuccugcagggaugguuacgcuucucugagggcaacauccuggaacuccuucacagacuggauguugagaauagcuccgaaguggccgucucaguguugaacgcucuauuuaguauaacaccacugagcgagcucguaggucuguguaaaaauaacgacgggaggaaacuuauucccguugaaacccugacuccugagaucgccuuguauuggugcgcacucugugaguaccugaagucuaaaggagaugaaggcgaggaguucuuagaacagauucugccagaaccgguggucuacgccgacuaucuacucuccuacauccaaucaauccccguggucaacgaggagcaucggggcgauuuuagcuauauugggaaucugaugacaaaggaguucauaggacagcagcuuaucuugauuaucaaaagucuggacaccucugaagaagguggccgaaagaaacuccuggcugugcuucaggagauacugauuuugccuacgaucccaaucucccucguuagcuuccugguggagcgcuuacugcacauuaucauugaugacaacaagagaacucaaauaguaaccgaaaucauuucggagaucagggcgcccaucgucacaguggggguuaauaacgauccugcagacgugcggaagaaagaacuaaagauggccgagauuaaagucaagcucauagaagcuaaagaggcccuggagaauugcaucacucuucaggacuuuaaccgcgcaucugaauugaaggaggaaauuaaggcccuggaggaugcuagaaucaaucuccugaaagaaaccgagcaguuagagauuaaggaagugcauaucgagaaaaacgacgccgaaacacugcagaagugucuuauauugugcuacgagcuccugaaacaaauguccaucucaaccggacuaagugcaacgaugaauggcauuaucgaaagccugauucucccagguaucauauccauucaccccguagugaggaaccuggcgguucuuuguuuggggugcuguggacugcagaaucaggauuucgcucguaagcacuuugucuuacuccuucaggugcugcaaaucgacgaugugacuauuaagaucucugcccugaaagcaauauucgaccaguugaugacauuuggcaucgagccguucaagaccaaaaagauuaaaacucuccauugcgagggcacagaaaucaacagcgaugacgagcaggaaucaaaggaggucgaggaaaccgccacggcuaaaaauguucugaagcuacugagugauuuucucgacuccgaggugagcgaacugcggaccggggccgcagagggacuugcuaaguugauguucucuggucuguuagugucaagucgaauccucagcagacugauucuucugugguauaacccuguaacagaagaggauguccagcuaaggcacugccucggcguguuuuuccccguuuuugccuacgcgucccgcacuaaucaagaguguuucgaagaggccuuucugccaaccuugcagacacuggcuaacgcuccugccucuucgcccuuagcugaaauagacauuacuaacguggccgagcuccuggucgaucuuacccggccaagcgggcugaauccccaggcaaaaacaucccaagacuaucaggcguugaccgugcaugacaaccucgccaugaagaucugcaaugaaauccugacuucaccuuguaguccagagauuagaguuuacacgaaagcucuaucuagccuggagcuuuccucacaccucgccaaggaucuguuggugcuguuaaacgaaauccucgagcagguaaaagacaggacaugccugcgcgcacuugaaaagauuaagauacagcuggagaaaggaaauaaggaguucggcgaucaagcugaagccgcacaggacgccaccuugacuaccacaaccuuccagaacgaggaugaaaagaauaaggaggucuacaugacuccgcuccgaggugugaaagcuacacaggcgagcaagucuacgcaacugaagaccaaccgggggcagcguaaagugacugucuccgccagaacaaauaggcgcugucagaccgcagaagcugacagugagagcgaucaugagguucccgaaccugagucugaaaugaagaugcggcuaccaagaagggccaaaacagccgcucuggagaaguccaaacuuaaccucgcacaguuucugaaugaagacuugucauga

SEQ ID NO: 59527 - RNA, 312 nt, Artificial Sequence
  derived and/or modified sequence opt3 from NCBP2__Homo_sapiens__NP_001036005
augagcggcgggcugcucaaggcccuuagauccgacucuuacguggagcugucacaguauagggaucaacacuuccggggagacaacgaggaacaggaaaaauuguuaaagaaaaguuacgcugagaaugcaaugcgcuauaucaacgguacccgacuggaugaccguauuauaagaacagauugggacgccggcuuuaaggaagggaggcaguacggacggggccgcagcggugggcaggucagagaugaguauaggcaagacuacgaugcgggacggggcggcuaugggaaacuagcucagaaucaguga

SEQ ID NO: 59528 - RNA, 1347 nt, Artificial Sequence
  derived and/or modified sequence opt3 from NCEH1__Homo_sapiens__NP_001139748
augagcuccugcagaggccagaagguggccgggggacugagggucguuucucccuucccucucugucaaccagcuggugagccgucacagggcaaaaugcggaguagcugcgugcuucugaccgcauugguagccuuagcggcuuacuauguguacaucccccugccuggguccgucucugacccauggaagcuaaugcuccuggaugccacauuucgcggagcacaacaggugucgaaccuuauucacuaucugggcuugucacaucaccuccuggcccugaauuucauaaucguuagcuuugguaaaaagagugcuugguccucugcacaggugaaagucacugacacggauuucgacgggguggaaguacgaguuuuugagggacccccuaagccagaggaaccccucaagcguagcguggucuacauucauggcggcgggugggccuuagcuuccgccucagcgaguuggagcccuucugaugaaaucagauauuacgacgagcuguguaccgcaauggccgaggaacuuaacgcugugauuguguccaucgaguauagguuggucccaaaaguuuacuucccggaacagauacacgaugugguacgggccacaaaguacuuucugaaacccgaggugcuacagaaguauauggucgacccuggacgcaucugcauuucaggugauagcgcaggcgggaaucucgcugccgcgcugggacagcaauucacucaggacgccagucuuaaaaacaagcugaaguugcaggcacucaucuacccagugcugcaggcuuuagauuuuaauacccccucuuaucaacagaacguuaauacaccuauucugccaagauacgugauggucaaauauuggguggacuacuucaagggcaacuaugauuuuguacaggccaugaucguuaauaaccauaccucccucgacguggaggaagcugccgcagucagggcccggcuuaauuggacuagccuguugcccgcuucguucaccaaaaacuacaagccggugguccaaacaacggguaaugcgcgcauagugcaggagcuaccucagcugcucgacgcacgaucugcuccccugauugccgaucaggccguucuucaacuguugccaaaaacuuacauccucaccugugaacacgacgugcugagagaugacgggauuauguaugcaaagagguuagaguccgccggaguagaagucacacuggaucacuuugaggacggcuuccauggcugcaugaucuucacuucauggccuaccaacuuuaguguggggauccggacacguaauagcuacauuaaauggcuagaucagaaccucuga

SEQ ID NO: 59529 - RNA, 1173 nt, Artificial Sequence
  derived and/or modified sequence opt3 from NCF1__Homo_sapiens__NP_000256
augggcgacaccuucaucagacacauugcccugcucggguuugagaagagguucgugcccagccagcauuacgucuauauguuucuuguuaaauggcaagaucuguccgaaaaggugguauaccggcgcuucacagagauauaugaauuucacaaaacuuugaaggagauguucccuaucgaagcuggagcaauuaacccagagaaucgaaucauuccgcauuuacccgccccuaaaugguuugacggucagcgugcggcugagaacagacagggcacgcugaccgaauacugcucuacacuaaugucacucccaacuaagaucaguagguguccccaucugcuugauuucuuuaaggugcggccugacgaucugaaauugccaaccgacaaucagacaaagaaacccgagaccuaucucaugccuaaggaugggaaaagcacugccacagacauaaccggaccaaucauucugcaaacguaccgcgcaaucgccaacuaugaaaagacuuccggcucugagauggcucugucgaccggugaugucguggagguuguggaaaagucagagagcggguggugguucugccagaugaaagcaaagagaggauggauuccggccaguuuucucgaacccuuagacuccccugaugagacagaagacccagagcccaauuacgcuggcgagccuuacgucgccaucaaagcguauacugcaguggaaggcgaugagguaucucugcuugaaggggaggccguugaagugauacacaaguugcuggacggauggugggucauuaggaaagacgaugugaccgguuacuucccaagcauguaucuacagaaguccggccaggacgugucacaagcucagcggcagaucaaacgcggggcacccccgcgaagaaguagcauuaggaacgcccacucuauccaccagcggucccguaagcgccucucacaagaugcuuacagaaggaauagcguccgguuucugcagcagcgacgcagacaagccaggccuggaccccagaguccaggcucuccucuugaggaggaacggcagacacagcgcuccaagccccaaccagcgguucccccuagaccaagcgccgaccugaucuugaacagguguucggagucuaccaaacguaagcucgcauccgcuguguga

SEQ ID NO: 59530 - RNA, 1338 nt, Artificial Sequence
  derived and/or modified sequence opt3 from NCF2__Homo_sapiens__NP_001177718
augagccugguggaggccaucucccucuggaacgaaggcguccuugcugcagacaagaaagauuggaagggggcccuggacgcguucucugcuguucaggauccccacucaagaauuugcuuuaauauaggauguauguacaccaucuugaaaaacaugacagaggccgaaaaggcauucacuaggaguauuaaucgggacaaacauuuagccguggcuuauuuucaacgcgguaugcuguacuaucagacggagaaguacgaucuagcaaucaaggaccucaaagaagcccugauucagcuucgaggcaaccagcugaucgauuauaagauauuggggcuccaauucaaacuguuugcuugcgagguaguggccagcgucguggaccaggauuccuucucuggauuugcgccucugcagccacaggcagccgagccgcccccucguccaaagacccccgaaaucuucagagcucucgagggcgaagcccacaggguuuuauuugguuucgugccugagacaaaagaggaacugcaagucaugccagggaauauuguguuuguacuuaagaagggaaacgacaauugggcaacuguuauguucaacggccagaaaggcuuggugcccuguaauuaccuggagccugucgaacuacggauccauccacagcagcaaccgcaggaggaaucgucaccccagagcgauauuccugcuccacccaguuccaaggccccugggcgcccacaacucucucccggacagaaacagaaggaggagccgaaagaagugaagcugagcgugccuaugcccuauacccuuaaaguccacuacaaguacacaguugugaugaagacccagccaggucugccuuauucccaaguaagagacauggugaguaaaaaguuggagcucaggcuggaacauacuaaauuaucauaccggccccgcgauagcaacgagcuggucccacucucugaagacuccaugaaggacgcguggggccaggugaaaaauuauugccuuacacuguggugugagaacaccguuggggaucagggauuucccgacgagccuaaggaaucagagaaggccgaugcaaauaaccagacgacugaaccacaauugaaaaagggcagccagguggaggcucuauucaguuacgaagccacccagccggaggaccuggaguuccaggaaggugauaucauacucguccugucuaaagugaaugaggaauggcuugagggggagugcaagggaaaaguaggcauuuuucccaagguuuucguggaagacugugcuacaacugaucuggaguccacccgaagagaagucuga

SEQ ID NO: 59531 - RNA, 1020 nt, Artificial Sequence
  derived and/or modified sequence opt3 from NCF4__Homo_sapiens__NP_000622
auggccguggcucagcaacugagagcagagagcgacuucgaacagcuccccgaugacgucgccaucuccgcgaacauugcugauauagaggaaaagaggggcuuuaccucucacuucguuuuugugaucgagguaaaaacaaaagggggaucaaaguaccuuauuuaucggcgcuaccgacaguuccaugcccugcagaguaaguuggaagaacguuuugguccugacagcaaauccucugcauuagccugcacucugccaacgcuaccggcuaagguguaugucggcgugaagcaagagaucgcagaaaugaggauucccgcccucaaugcuuacaugaaaucgcugcuuucacugccuguuuggguguugauggaugaggacgucaggaucuucuuuuaucagagcccauacgauagugaacaggugccccaggcccuccggcgccugagaccuaggacccggaagguaaaauccguuucuccacaagggaacagcguggaccgcauggcggcaccccgagccgaggcucuguucgauuuuacaggaaauuccaagcucgaguuaaacuucaaagccggcgacgucauauuucugcuuucaagaaucaauaaggauugguuggaagguacugugagaggggcaaccggaauuuucccucugaguuuugugaagauccuaaaagacuucccagaggaagaugacccgacaaacuggcuccgguguuauuacuacgaggacaccauuagcacuaucaaggauauagcugucgaagaggaccugucuuccacaccccuucugaaagauuugcucgagcugacccgucgcgaguuccagagagaggacauugccuuaaauuauagggaugcggaaggcgaccugguucggcuccuuucagaugaggacguggcccugaugguacgacaggcacgcggcuugccuagccagaagagacuauuuccauggaaacugcacaucacgcaaaaggauaacuacaggguguauaauacuaugcccuga

SEQ ID NO: 59532 - RNA, 942 nt, Artificial Sequence
  derived and/or modified sequence opt3 from NCK1__Homo_sapiens__NP_001177725
auggacuggcugaacguguucaaggacuuuuucagcaucggcaaagucaagagaaaacccuccguuccugauucugccucaccagcugaugacaguuuuguggauccgggggagaggcucuacgaccuuaauaugcccgcauauguaaaguucaacuacauggccgaacgggaggaugaacugagcuugauuaaaggaaccaaggugauagucauggagaagugcuccgacgguugguggcgcggcucuuauaauggacagguggggugguuuccuucgaacuacguuacagaagagggcgauucaccauuaggugaccacguggggagccugagugagaaacuagcggcugucgugaauaaccucaauacuggacaaguacugcauguugugcaggcccuuuaucccuucuccucuagcaacgaugaagaguuaaauuuugaaaagggcgacgucauggaugugaucgagaaaccugagaacgacccagaaugguggaagugucgaaaaauuaauggcauggugggguugguccccaagaacuacguuacggugaugcagaauaacccucucaccuccggacuggagccaucaccgccccagugcgacuauauccguccuagucugacagguaaguucgcaggcaauccaugguacuacgggaaaguaacuagacaccaagccgaaauggcucucaacgagaggggacaugaaggcgauuuucugauucgggacagcgagucuucccccaacgauuucucagugagccugaaggcacaggguaaaaauaagcacuuuaaaguccagcuuaaggagaccguguauuguaucgggcagcgcaaauucaguacaauggaagaguugguugaacauuacaagaaggccccuauauuuaccucugagcaaggagaaaaacuguaucuagugaagcaccucuccuga

SEQ ID NO: 59533 - RNA, 252 nt, Artificial Sequence
  derived and/or modified sequence opt3 from NCK2__Homo_sapiens__NP_001004722
augaccgaggaagugauagucauugccaagugggacuacacagcucagcaagaucaggagcuggacaucaaaaagaacgaaagacucuggcuucuggaugacagcaaaacuugguggaggguucggaaugcagccaaccgcacgggcuaugugcccuccaauuacguagagcgaaagaacucuuugaaaaaggggucauuagugaagaaucugaaagauacccuagcgcagcgucuccugagagucccuuga

SEQ ID NO: 59534 - RNA, 3387 nt, Artificial Sequence
  derived and/or modified sequence opt3 from NCKAP1__Homo_sapiens__NP_038464
augagcagauccgugcugcagcccucucaacagaagcucgccgagaaacuuaccauccugaacgacaggggcgucgggauguugacacgguuauacaauauuaagaaggcuugcggagauccuaaggcaaaaccaucauaucugauagacaagaaccuagaaagugccguuaaguucaucgugcgcaaauuuccggcgguagagacucgaaauaacaaucagcagcucgcucaacugcagaaggaaaaaucugagauucuuaagaaccuggccuuguacuauuucacguuuguggaugucauggaguucaaagaccacgugugugaacuccugaauaccaucgauguuugccagguguuuuucgacauuacagucaacuuugaucugacuaagaauuaccucgacuuaaucauaaccuauacaacccugaugauccuuuugucccguauugaggaaagaaaggcaaucauuggucuguacaacuaugcccaugagaugacucacggcgcuucugauagggaauacccccggcuagggcagaugaucguggacuacgagaauccucucaaaaagaugauggaggaguucguaccacauucgaaaucacugagcgaugcacuuauaagucugcaaaugguuuauccccgcagaaacuuguccgccgaccaguggaggaaugcucagcuccugucuuuaauuagcgccccuuccacaaugcugaacccagcgcagucagauaccaugcccugugaauaccucagucuugacgcaauggaaaaguggaucauuuuuggauucauccugugccacggcaucuugaauacggacgccacugcucuaaaccuguggaaacucgcccugcaaagcagcuccugucuuucacuguuucgggaugagguguuccauauucacaaggcagcugaagacuuguuugucaacauacgcgguuauaauaaacgaaucaacgauauuagagagugcaaggaggccgcggugagccacgccgggaguaugcauagggaacggcguaaguuccuccgcucugcacugaaagaguuagcuaccgugcuguccgaccagccuggacuacucggcccaaaggcccuguucgucuuuauggcucuuagcuucgccagagaugaaaucauaugguugcugaggcacgcagacaauaugccgaaaaagucggccgaugacuuuauugauaaacauaucgcugagcucaucuucuacauggaggaacugcgggcgcacguucgaaaguauggccccgugaugcagcgcuacuauguacaauaccuuucuggguuugacgcagugguccugaacgaguuggugcagaaucucuccguuuguccugaagaugagucaauuaucaugaguagcuucgugaacacaaugacuucccugucugucaaacagguggaagacggagagguauuugacuucagagguaugagguuagauugguuucggcugcaggccuacaccagcguuucaaaagcuagucuaggccucgccgaccaccgcgaacuggggaagaugaugaauacaauuauauuccauaccaaaaugguggauucccuugucgagauguugguggagacgagcgaccugucuaucuuuugcuucuauucaagagcauuugaaaagauguuccaacagugucucgagcugccaagucagagcagguacuccauugccuuccccuuacugugcacucacuuuaugucuuguacacaugaacuuugcccugaggagcgucaccauaucggagaucggucguugagccucugcaacauguuccuggacgaaauggcuaaacaggcccgaaaucuaaucaccgauauuuguacugagcaaugcacacuguccgaccagcuccugccaaagcacugugcaaagaccauaucacaggcggucaacaaaaagaguaaaaagcagacgggcaaaaagggugaacccgagagagaaaagccggggguggagucuaugaggaaaaaucgccuuguugugaccaacuuggauaagcugcacacagcuuuaagcgagcucugcuuuuccaucaauuauguaccuaacauggucgugugggaacauacuuucacaccccgggaguaccugaccucacaccuugaaauuagauuuacuaaaagcaucguuggaaugaccauguauaaucaagccacacaggagauugcaaagccaucugaacuguugaccuccgugagggccuacaugacuguccuccagaguaucgagaacuaugugcagauagacaucacgcgcguauucaacaaugugcugcuacaacagacacagcaucuggauagccacggcgagccuaccauuacuucucucuacaccaacugguaccuggaaacacuuuugcgacaaguuuccaauggccacaucgcuuauuuucccgccaugaaagcauucgucaaccugccaaccgagaaugaauuaacuuuuaacgcugaggaauacucagacauuagugagaugcggagccucucggagcugcuugggcccuauggaaugaaguuccuguccgaaucucuaauguggcauaucagcucacagguggccgagcucaaaaagcugguggucgaaaauguugauguguugacacagaugcguacgaguuuugacaagccugaccagauggcggcccuguucaaaagauuauccucuguggauagcguacucaagaggaugaccauaauuggugucauccuguccuuucgcucacuugcucaagaggcacugcgggacguguugagcuaccacauuccauuccucguuaguucuaucgaggauuucaaagaccauauaccgagagaaacugauaugaagguggccaugaacgucuaugagcuguccagcgcugccggccuacccugugaaaucgacccugcacuggugguugcgcuuucgucacagaaaucugagaauauuaguccagaagaggaguacaagaucgccugccuccugaugguguuuguagcugucuccuugcccacacuggccagcaacgugaugucucaguauagcccugcaauugaagggcacuguaauaacauccauugcuuagcuaaggccauaaaucagauugcagccgcucucuucaccauccacaaaggauccaucgaggauaggcugaaggaauuucuugcgcuggccucaaguagcuugcucaaaauuggccaagagacagacaagacuaccacgcgaaaccgcgaaucuguguaccugcuacuggauaugaucguccaggaguccccauuccuuaccauggaccuccuggagucauguuuucccuacguuuuguuacggaaugcauaucacgcuguguacaaacagaguguaacaagcuccgccuga

SEQ ID NO: 59535 - RNA, 3234 nt, Artificial Sequence
  derived and/or modified sequence opt3 from NCKAP1L__Homo_sapiens__NP_001171905
auggagcccagccugaaguacaucaacaaaaaguucccuaauauugacgugagaaacuccacccagcaccucggcccaguccauagggaaaaagccgagauaauccgguuucuuacaaauuauuaccaaucuuucguugaugugauggaauuucgcgaccacguauaugagcuguugaacacuauugaugcuugccagugucauuucgacaucaauuuaaacuuugauuucacgcgaucauaccuggaccuaauugugaccuauacaagugucauccuccugcuuagccguauagaagauagaaggauccugauugggauguacaauugcgcacacgagauguugcauggacacggugacccguccuuugcccggcucggccagauggugcuggaguaugaucacccccugaagaaacucacugaagaguucgggccucauaccaaggcgguuucuggagcuuuacugucgcuucacuuuuuguucgugcgcagaaaccagggcgccgaacaauggaggucagcacagcugcuaagccucaucaguaauccacccgccaugauuaacccugcuaauuccgacacaauggcaugugaguaccugucugucgaggugauggaacgguggaucauaauugguuuucuucugugccauggguguuugaacagcaauucccagugccagaagcucuggaaacuguguuuacaaggaucacuguacaucacccucauucgcgaggauguacuucagguucacaaggugacugaagaccuguucaguagcuugaaaggcuauggcaagcgagucgccgauaucaaagagucuaaggaacacgugaucgcuaacuccgggcaguuucauugccagagaaggcaauuccuacggauggccgugaaggagcuggagacaguccucgcggacgaaccaggacugcuuggucccaaagcacuguucgccuuuauggcuuugucauucauucgugacgagguuaccuggcucgugcgccacacggaaaauguaacuaagaccaaaacaccugaggauuacgccgacagcaguauagcagaacuguuauuucugcuagagggcaucagaucucucgugaggcggcauauuaaggucauccagcaguaucacuuacaauaccuugcucgauucgaugccuuggugcuguccgacauaauucagaaccucagcguuuguccagaggaagagucgaucaucaugucuuccuuugugucaauucugaguagccuuaaccugaaacaggucgauaauggggaaaaguucgaguuuuccggauugcgccucgacugguucagacugcaggcguauacuucuguggccaaagcaccguuacaucugcacgaaaaccccgaucuagcuaagguaaugaaucucaucguuuuucacagcaggaugcuggacucaguggagaaacuuuuggucgagaccagugaucuguccacauucugcuuucaucuccggauuuucgaaaagauguuugccaugacccuggaggaaagcgcuauguuacgcuacgccauagcauucccucugaucugugcccacuucgugcauugcacgcacgagaugugcccagaggaauauccccaccuuaagaaccauggcuugcaccauuguaauucuuuucucgaggaacuggcuaaacaaacuucaaacugcguccuagagauuugugcggaacagagaaaucugagugagcagcuccugccuaagcacugcgcaacaaccaucagcaaagccaagaacaagaaaacuaggaagcagcgucaaacaccacggaaaggugagcccgaacgagacaagccgggggcugagucccauagaaagaauaggucuaucgugaccaacauggauaaacuucacuugaaucugacggaauuagcccucaccaugaaccacguuuacucguucagcguguuugagcauacaauuuucccuuccgaauaccugucaagucaccuugaggcacgccugaaucgggccauaguaugguuggcuggauauaacgccacuacccaggagaucgucagacccucugaacuccuggcaggcgugaaggcguacauuggcuuuauccagagccuagcucaguuccugggggccgacgcauccaggguuauucgcaaugcccuccugcaacagacacagccacuugacucauguggagagcagacuaucaccacauuguauaccaacugguaccuggaaagccugcuccgacaggcuucuuccgguacuauaauccugaguccugccaugcaagcauuugugagccuuccccgggagggcgaacagaacuucucugcugaggaguuuuccgauauuucagaaaugcgugcccuggcggagcuacucgggccauauggaaugaaauuccugagugaaaauuugauguggcaugucacgagccaaaucguggagcugaagaaauuaguaguggagaacauggacauucucguucagaucagaucgaauuuuuccaagcccgaucugauggccucucuucugccucaguugacaggcgcugaaaacguccucaaaaggaugaccauaauuggugugauccugagcuuccgcgcaauggcccaggaggggcuacgggaaguguuuucaagucacugcccauuccugaugggcccgauugagugucuuaaggaguucgucacucccgacaccgauaucaagguuacacucuccauauuugaacuggcuucugccgcaggagugggcugcgacaucgauccugcguugguggccgcuauugccaaucugaaagcagacaccagcuccccagaggaagaguacaagguagcuuguuuacuccugaucuuccuugccgucucacugcccuugcucgcaacugauccuagcaguuuuuauucuauugaaaaagacggguacaacaauaacauccauugccugacaaaggccauaauucaaguguccgcugcgcuauucacgcuguacaauaaaaacaucgagacccaccuuaaggaauuucucguuguggccagcgucucgcuguugcaguuaggacaggagacugauaaacugaagacaagaaauagggagucaaucucucuccugaugcgacuugugguugaagagaguuccuuccugaccuuggacaugcuagaaagcuguuuuccauaugugcugcuccgcaacgcauaccgggagguaucuagagcuuuccaccugaauuga

SEQ ID NO: 59536 - RNA, 5730 nt, Artificial Sequence
  derived and/or modified sequence opt3 from NCKAP5__Homo_sapiens__NP_997246
auggagggaaagaggcagcuggagaagagggacuucgggaagcggcucagccuugauuccucucugguggaguacauggacucaaacaaauauaucgaacacuuguuaacccaacuggaggaacagcaucgcagccuauggcgagagaagcucgccgucgcucgucugcagcgagagguugcacagaggacaagcgaaggagccaugcacgagaaacuuauucaugaacuggaggaggaacggcacuugcgccuccaauccgagaagagacugcaggaagugacucuggagucugaaaggaaucggauacagaugcgcucgcuccagcaacaguuuucacgaauggaggagacgguaagaaacuuacugcagagccaggguagucccgaacaaaagaaagaggaaaccgugaauaucauggucuaccaggagaaacuuuccgaagaggagaggaaacauaaggaagcguuggaggaucugcacauggugguugacgaagauucucggagcgaguccucaaguacagacgaaggcaaagagaagacuaagcuacuccuggagcgucuuaaagcucuggaagccgagaacagcgcauuggcccucgaaaaugagaaccagcgcgagcaauaugaaagaugccuggaugagguggcuaaucaggucgugcaggcauuacugacccagaaggaccucagggaagaguguguaaaacuuaagacacggguuuucgaucuggaacaacagaaccgaaccuugucuauucuauuucagcagcgcgugagaccuacuuccgaccugcuccugcaaaaacuucacucaaggcuguuggaucucagcaguggggaccuguuaucugaggucgagcggaaucgcucccugacacagagcagaaccgaugccgaagugcaugagcaccagcuaaacacgaagucggcucucaaaugcccaggacugggcgccgugaucccgggucaucuuugucccagaaauucuuacuccucaaguagcgaauugucccugucuagcacuugcucagaguauaguuccgggagcucuuacaccuggcacgacggaaagaaccuccguaagcggcagucaagucaaaauugggacaaacgacugagcauugauuccucucuuccuucgggcuucgcgagcccaacaaacgaacugcccccuacuagaaucaaggagucccacauauuggagggccucaggaaacugcagaagcgcaaagucuuacuggaaccacccucaguuaucaccaaguggggguauaaggacuguaugaauaguaacgagggaauuuacucuccugguaucaaaagcuccucacuaaaggaauacccaccgugcaaaacagcagaucucggcagccccuguaaggagccucauaaaaccuuuguguaugaccuggauucucacguagacgccgaugacgauccauccacgcuugcuuugcugcaggccgugcccaaccagaguugccggccucaugggagcaagcucacucacucugucuccgacucacuguucggaugggaaacaaauagaaagcacuuuuuagagggcaccaguagcguguacccaaaagagaggcccgaaaagcugacuucgugugcauccucuugcccgcuugagaugaaauuguguccuagcguucaaacaccccaggugcagcgcgaacgagguccacaagggcagggacacggccggauggcucucaaccugcagcuaucagauaccgacgacaaugagacguucgaugagcugcacauugaaaguuccgacgagaagucuccuagcgaugucucccucgccgcggacaccgauaaaucaguggaaaaccuggacguacuuguuggcuuugggaaguccuugugcggaagucccgaggaagaggagaaacaggugccaauccccucugaaacacguccuaaaacuuucuccuuuauaaagcaacagagagucgugaaaaggaccagcucggaggaaugcgucacagugauuuucgaugccgaggacggugaaccaaucgaguuuucaucucaucagacuggcguugugaccguaacacgcaaugagauuaguaucaacuccaccccggcagggcccaaggcugaacacacugagcuguuaccucagggaaucgccugucuccaaccacgggcugccgcaagagauuauacguucuucaaaaggagcgaagaggacacagaaaagaauauucccaaagauaacgucgacaaugugccucgaguuucuaccgagagcuuuuccucacgcacugugacccagaacccacagcagcaaaagcuggucaagcccacacauaauauaaguugccagagcaacucucgguccucagccccgaugggcaucuaccagaaacaaaaucuuaccaagauuccuccaagagguaaaaguagcccccagaaguccaaacugauggagccugaagcuacuacauugcuccccucuucggggcuggugacgcuagaaaagagcccagcgcuggcaccuggcaagcucucaagguucaugaaaaccgaauccaguggaccccuguuugagcuucguucugauccacacaucccgaagcacagcgcccaguugccucauuccucacgcaugcccucucggagagacuggguacaguguccaaaaagccaaacucccggcaguaggucccgaccugcuauagagagcucugacucaggggaaccacccacacgggaugagcacugcggauccgguccugaagccggcgugaagaguccgagcccacccccuccacccgggcgcucgguuucucuguuagcaagaccuuccuaugacuacagcccggcccccucaaguaccaaaucugagacaagggucccauccgaaacugcucggaccccuuucaagagcccccuccugaagggaauuucagccccagugaucaguagcaacccugcaacgaccgaggugcagcgaaagaagcccuccgucgcguuuaaaaagccaaucuucacacauccgaugccuucucccgaggcuguuauucagacuagauguccagcccacgcacccagcuccucauuuaccgugauggcccuuggcccuccaaaagugucucccaagcgcgguguaccuaagacaaguccgaggcagacucuggggaccccacaacgugauaucggccuacagacgccccggauuucgccuagcacacaugaaccccucgagaugaccuccucuaaaucagucagcccaggaagaaagggccagcugaaugacuccgcuaguacuccucccaaaccaucuuucuugggggugaacgaaagcccuucaucccagguuaguaguucuuccucaagcucgucuccggccaagagucacaacagcccccauggaugccaaagcgcacaugagaaaggucugaagacaagguuaccagugggccucaaaguccugaugaagucaccucagcuucugcgcaaguccucuaccgugcccgggaaacacgaaaaggauagcuugaaugaggcuaguaaauccagcguugccgugaacaagucuaaaccagaggacucaaagaauccugcgaguauggaaauaacugccggagagcgaaacguaacccuccccgauucccaggcucagggcagccuggcagacggucuaccgcuggaaacagcccuucaagagccacucgaaucuucgaucccugggucagauggcagagacggagucgauaaucggagcaugaggcgcucccugaguucuagcaagccccauuugaaaccagcucugggcaugaacggggccaaggcacguucccacucauuuaguacgcauucuggagacaaacccagcaccccuccgauugagggcuccgguaaggugagaacucagaucaucacaaauaccgcggagcgggggaacucauuaacaaggcagaauagcucuacugaauccagucccaacaaagccccaagcgcuccuaugcucgagucgcugcccuccgugggacgcccuucuggccacccaucaagcgguaagggcagucuuggguccucuggcagcuucucaucccaacacggcagucccagcaagcugccuuugcggauuccacccaaaucugaagggcuccugauaccgccuggaaaggaggaucagcaggccuuuacccagggcgaguguccaucagcaaaugucgcuguucuaggugaacccggguccgacagaagaagcugcccuccaacgcccacagacuguccggaggcccugcaaucuccuggaaggacccagcaucccaguacuuucgaaaccucguccacaagcaaacuugagacuucaggccgccacccagaugcaucugccaccgcuacagacgcggugagcuccgaagccccucucagucccacgaucgaggagaagguaaugcugugcauucaggaaaacguggagaaaggucagguccaaaccaagccaacuucaguggaagcaaagcagaaacccggcccuucuuuugcuagcugguucggguucagaaaguccagguugccagccuuaaguagccggaaaauggauaucuccaagacaaaaguugagaagaaggacgccaaagugcugggauuuggcaaucgucagcucaagucugaacgcaaaaaggagaaaaagaaaccggagcugcagugugaaaccgagaacgaacuuauuaaggauacuaagucagcugacaaucccgaugggggacugcaaagcaaaaacaaccgaagaacaccucaggacaucuauaaucaguugaagauagagccaaggaaccggcauucgcccgucgcaugcuccaccaaagauacguucaugacugaacuacugaaucgcguggacaagaaagccgcgccucaaaccgagaguggcucuagcaacgcuucaugcagaaauguucucaaggguuccucucaggggaguugucugaucggaagcuccauuucaacacagggcaaccacaagaaaaauaugaagaucaaagccgauauggaggugccaaaggacagccuugucaaagaagcaaacgagaauuuacaggaagacgaggaugacgccguagcugauucuguguuucaaagucacauuaucgaguccaacugccagaugaggacccuggacagcgguauaggcacuuucccccucccugauucagggaaucggucuacaggacgauacuugugucagccggacuccccagaagaugcagagccccugcucccucugcagucggcccuuagcgcgguuaguucuaugagagcucaaacccuggaacgcgaggugcccuccagcacagacggccagaggccagccgauucagcaauuguccauaguacuuccgacccuaucaugaccgcccgggggaugcgucccuugcagagcagacuaccaaagccggcuucuucaggaaaggugagcucccagaaacaaaacgaagccgagccuaggccccagacgugcucuaguuuuggcuacgcagaggauccaauggcuucgcagccccugccugacugggguagcgaaguagccgcgacagggacccaggauaaggccccacgcauguguacuuauuccgcaucaggaggcucuaauagcgacagugaccucgauuacggcgacaacggguucggagcuggucggggccaauuagugaaagcccugaaguccgcugcacccgagauugaaaccacauga

SEQ ID NO: 59537 - RNA, 2169 nt, Artificial Sequence
  derived and/or modified sequence opt3 from NCKIPSD__Homo_sapiens__NP_057537
auguacagagcccuguaugcuuucaggagcgcagagcccaacgcccucgcguuugcugccggcgaaaccuuccuugugcuggagcgguccucugcacacuggugguuggccgcucgcgcacgaucaggggaaacaggauacgucccuccagccuauuuacguagacugcagggucuagagcaagacguucuccaggcuaucgauagggccauugaagcggugcauaauacugcaaugcgggacggcgggaaguacagucuggagcagcgcggaguacuucagaaacugauacaccauagaaaggagacguugagcaggcggggcccguccgccucuucgguggcugucaugaccucaagcacaagugaucaccaucucgacgccgcagcugcccgccaacccaacggugugugccgagcgggguuugaaagacagcacucccugccuucuagcgagcaccugggagccgauggcggccucuaucagaucccauuacccuccucacagauuccuccacaacccaggcgggcagcuccuacuaccccaccgcccccuguuaaacgucgcgacagagaagcccugauggcuagugggagcggaggucauaauacaaugccaucuggcgggaacuccgugucaagcggaaguucugucuccagcaccucgcuugauacuuuguacacaucuuccucacccagugagccuggcagcuccuguucuccaacgcccccgccugugcccaggcgggguacccacacuaccguaagccagguucagccaccucccucaaaggccagugcaccagagcccccugccgaagaggaaguggcuacagggacuaccuccgcgagcgacgaucuggaggcacuaggaacacucucucugggcaccacggaagagaaagccgcugccgaggcagccgucccacgaacuaucggcgcugaacuuauggagcuggugcgcagaaauacaggguugucacaugaacucugcaggguggccauuggaaucauagucggucacauccaggcaaguguuccggcgagcucccccgugauggagcaaguacuguuaucucugguggaaggcaaggaccucucgauggcucugccuagcgggcaggucugucacgaucagcaacggcuggaggugauuuucgccgacuuggcacgcagaaaggaugacgcccagcagagguccugggcucuauaugaggacgaaggaguuauccguugcuaccuggaggaacuccugcauauucuuaccgaugccgacccagagguguguaaaaagaugugcaaacggaacgaauuugagucaguccuggcauugguggcuuacuaucagauggagcaccgagccagucucagacuguuacugcuaaaguguuucggcgcgaugugcucucucgaugccgcuaucauaagcacucugguauccucaguucuucccguggaauuggcaagggacaugcaaacagauacccaggaccaucagaaacuguguuacagcgcccucauucuggcuauggucuuuucuaugggugaggccgugccuuaugcacacuacgaacaucuugggacgccauucgcgcaguuucuguugaauaucgucgaggauggccucccccuggacaccacagagcaauuaccggaucugugcgugaaccuacuccuggcccuuaauuugcaccuuccugcugccgaccagaacguuauuauggcagcucucuccaagcacgccaaugugaagaucuucagugaaaaacuguuacugcuuuugaaccgcggagaugacccaguacggaucuuuaagcaugagccccagccuccccacagcguccucaaauuccugcaggacguguuuggcucuccagcaacugccgcuauuuucuaucauaccgauaugauggcgcuaauagacaucacaguuagacacauugccgaucuguccccuggggacaagcucaggauggaauaccugucacuuaugcacgcaaucgugcgcacuacccccuauuugcaacaucgacaccggcugccagauuuacaggcuauacuccguaggauucugaaugaggaagagacaaguccgcagugucagauggacagaaugaucguccgcgagaugugcaaagaguuccuugugcugggagaagccccuagcuga

SEQ ID NO: 59538 - RNA, 2133 nt, Artificial Sequence
  derived and/or modified sequence opt3 from NCL__Homo_sapiens__NP_005372
auggugaagcuggccaaagcuggcaagaaccagggggaccccaaaaagauggcaccuccaccgaaagaggucgaagaggauagcgaagacgaggaaauguccgaggaugaggaagacgauucuucaggagaggaaguugugaucccccaaaagaaggguaaaaaggccgcggcuaccagugccaaaaagguaguggucagcccuacaaagaagguggcaguugccacuccagcuaagaaagcagccgugacgcccggcaagaaagcugccgcgaccccugcaaagaaaacagucacuccagccaaggcugugaccacacccgggaaaaagggagccaccccuggcaaggcacucguagcuacuccagguaaaaagggggccgcgauuccggccaaaggagcaaagaauggcaaaaacgcuaagaaggaggacuccgaugaggaagaggacgaugacucugaagaggaugaagaggacgaugaggacgaagacgaggaugaagacgagauagaacccgccgcuaugaaagccgcagccgcugcgccugcaucggaggaugaggacgaugaagacgaugaggacgaugaagacgaugacgacgaugaggaagacgauucagaggaggaagccauggagacaaccccagcuaagggcaaaaaggccgcaaaaguugugcccgucaaggccaagaauguggcugaagacgaggaugaggaagaggacgaugaagacgaggaugacgaugacgaugaagacgacgaggaugacgaugacgaggaugacgaagaggaagaggaagaggaggaagaggaaccugugaaagaggccccagggaagcggaaaaaggaaauggcaaaacagaaggcggcucccgaggccaagaaacagaaggucgagggaacggaaccgacuaccgcauucaaccuuuuuguugguaaucugaacuucaauaaaagcgccccugaguugaagacaggcaucagugauguguuugcuaaaaacgacuuagccguaguggaugucaggauugggaugacucggaaguucggauacguggacuuugaauccgcagaggaucuggagaaagcucuagaacucaccggccugaagguuuucgguaaugagaucaaacuugaaaaacccaaggggaaagacucuaagaaagagcgcgaugcccgaacacuguuggcgaagaaccucccauauaaggugacccaggacgaacugaaagaggucuuugaggacgccgcugaaauucgucuggugagcaaggauggaaaauccaagggcaucgcauacauagaguucaaaacggaagccgacgcugagaagacuuuugaagagaagcaaggcacagagaucgaugggagaucaauuagucucuauuacaccggagaaaaaggucagaaucaggacuauaggggcgggaagaacagcacuuggucuggagaguccaaaacauuaguacugucaaaucuuagcuacagugccaccgaagagacguugcaggaaguuuucgagaaggcaaccuuuaucaaagugccucaaaaccagaauggcaagucuaaggguuaugcguucauugaguuugccuccuucgaagaugcuaaagaggcccugaacagcugcaacaagcgggaaaucgaggggcgcgcaauaagacuagagcuccagggccccaggggaucgccaaaugcucggucucagcccuccaaaacacuguucgucaagggccuuucagaagacacuaccgaggaaacacugaaagagaguuuugaugggagcgugcgcgcccgaauugucacugacagagaaaccggauccucuaaggguuucggcuuuguggauuucaacagcgaggaggacgcaaaagccgcuaaggaagcgauggaggauggggaaaucgacggaaauaagguuacauuggacugggccaaaccuaagggcgaggguggguuuggcggaaggggcgggggacgggguggcuucgggggacguggcggugggcgcggcggaagaggcggguuuggaggcagggguagagggggauucggcggucgaggcggguuucgcggaggcagagggggaggcggugaucacaaaccacaagggaagaaaaccaaguucgaauga

SEQ ID NO: 59539 - RNA, 4326 nt, Artificial Sequence
  derived and/or modified sequence opt3 from NCOA1__Homo_sapiens__XP_005264682
augagcggccugggggacuccucuucagaucccgccaacccugacagucacaagagaaaaggaagcccaugcgauacccucgcuuccucuacagagaagaggcggcgcgaacaggagaauaaauaccuugaggaacuggcagaauuguuaucggccaacaucucagacauugauagccugagugugaagccggacaaauguaagauacuaaagaaaacugucgaucaaauccagcucaugaagcgaauggagcaggagaaauccacgaccgacgaugacguucagaagucugauauuagcuccucaagucaaggugugaucgaaaaagagagccugggcccccuucuguuggaagcgcucgacggguucuuuuucguagugaauugcgagggacguauugucuuugugucugagaacguuacauccuaucugggcuacaaucaggaggaacugaugaacacuucaguguauagcauccuccaugucggugaucacgcugaguucgugaagaauuuacugccuaagagucuuguaaacgggguuccauggccccaggaagccaccagaaggaacucucauacauuuaauugucggauguugauacacccuccagacgaacccggaaccgagaaucaggaggcaugccaacgcuacgaagugaugcaguguuucacugucucccagccuaaaagcauccaggaggacggcgaagauuuucaaucgugccugauuuguaucgccagaaggcuaccacggccgcccgcuauuacaggcguggagucuuucaugaccaagcaggacacgacugggaaaaucauauccauugauaccucaagucuccgcgcagccggacgaacagguugggaagaccuggugagaaagugcaucuaugccuuuuuccagccucaaggcagggagccaagcuacgcucggcagcuuuuucaggaggucaugacucgugggaccgcguccucucccagcuaucgcuucauucugaacgauggaacaauguugucagcacauaccaaauguaagcucugcuacccucagaguccagacaugcaacccuuuaucaugggcauccacauuauagauagagaacacuccggucugagcccgcaggacgauaccaauucugggaugucaaucccuaggguuaaccccagugugaauccaagcauuuccccugcccauggaguagcucggucuucgacuuuacccccaagcaacuccaacauggugucaacacgaaucaaucgccagcagaguucugaccugcacagcuccucacauagcaacucuuccaauagucaaggcagcuucggcuguucucccgggucccagauagucgccaacguggcacucaaucagggacaggcuucaagucaaagcucgaacccuucccuuaaucugaacaauucuccaauggaggguaccggcauuagcuuggcccaguucaugucaccgagaaggcagguuacaagugggcuagcgacucggccccgcaugccuaacaauuccuuuccacccaacaucucuacccugagcuccccugugggaaugacgucaagcgccugcaauaacaauaacagaaguuacucuaacaucccagucaccucccuccagggcaugaaugaaggucccaacaauagcgugggguucucggcaucaucuccgguacugaggcaaaugaguucccagaacagcccuucucgucuuaauauucagccagcuaaagccgagagcaaggauaacaaggaaaucgcuuccauucugaaugagaugauacaaucagacaacaguagcucugacggcaaacccuuggauuccggacuccugcacaauaacgaccgguuaucagauggcgacaguaaguauagccagacaucccacaaacugguucagcuacucacuaccacagccgagcagcaacugcgacaugcagauaucgacacuucuugcaaggaugugcuuucguguaccgggacaagcaauucagccuccgcuaacaguucuggagguagcugcccuuccucacacucuagcuugaccgaaagacauaaaauucugcacaggcuccugcaggagggcagucccuccgacaucacuacgcuuagcgucgaaccagauaagaaggacucugcgucaacauccgugagugucaccggacaggugcaggggaauagcucgaucaaacuggaguuggaugcaucuaagaaaaaggaguccaaagaccaucaacuccugcgcuacuuacuggauaaggacgaaaaggaccuacggagcacuccuaaccucucacuggaugacguuaaagugaagguagagaaaaaggaacagauggaucccuguaauaccaacccaacaccgaugaccaaaccuacucccgaggaaauuaaacuugaggcccagagucaguuuacagcugacuuggaucaauucgaccagcugcucccaacgcuggagaaggccgcacaguuacccggccugugcgaaaccgauagaauggacggugccgucacuucugugacaauaaaauccgagauccuuccugcuagcuugcaaucagccaccgcaaggccaacaagucgccucaaccgacugcccgaacuagagcuggaagcgauugauaaucaguuugggcagccuggcacuggagaccagaucccguggaccaacaauacgguuaccgcuauuaaccaaagcaaguccgaggaucaguguaucucuagccagcucgacgagcugcuuugcccacccacaacuguggaaggccggaaugaugagaaagccuugcuggaacaguuagucuccuuccucucagggaaggacgagaccgaacuggcagagcuugaccgugcccugggaauagauaaauuggugcaagguggcgggcucgacguacugucugagagauuuccuccacagcaggcuacacccccucuaaucauggaagagaggccgaaccuguauagucagcccuacucgagcccauccccuacugccaaucuccccucuccauuccaaggaauggugcgccagaagccuucacugggcaccaugcccguucaggucacgccaccgcggggugcauuuagcccugggaugggcaugcagcccagacaaacacuuaacaggccacccgcugccccuaaucaguugcgacugcaguuacaacagcgccuccagggacagcaacagcugauucaccagaaccggcaggcgauccuuaaucaauucgccgcuaccgcaccagugggcauuaacaugagauccgggaugcagcagcagaucacuccccaaccuccgcugaaugcccagaugcuagcucagaggcaacgugaacucuauagucagcagcaccgccagcggcaacugauacagcagcagagagccauguugaugaggcaacagucuuuuggaaacaaucugccacccagcucaggcuuaccugugcagauggguaacccccgacucccacagggggcaccucaacaguuccccuacccaccuaacuauggaacaaauccgggcacgcccccagcguccaccaguccuuuuagccagcuggccgcuaaccccgaggccucucuugcaaaucggaacuccauggucucacgcgguaugacuggcaauauugggggacaguucggcacagggaucaacccacaaaugcagcagaauguuuuccaauacccuggagcuggcauggugccccagggugaggccaacuuugcaccgagccugucgccagggucuaguauggugccuaugcccauuccacccccucaguccagcuugcuccagcaaacgccgcccgccucaggauaccaguccccagauaugaaggcuuggcagcagggcgcgaucgguaauaacaauguauucucucaagccguccagaaccagccuacccccgcacagccuggcguguauaauaacaugagcauaacuguuaguauggcugggggaaauacaaacgugcaaaauaugaacccaaugauggcccagaugcagauguccagccugcaaaugcccggcaugaacaccgucuguccugaacagaucaaugacccagcccuaagacauacagggcuguacugcaaccagcuuucuucaacugaucuccugaagaccgaggcugacggaacgcagcaagugcagcagguucagguguuugcagauguacaauguacagucaauuuggugggcggugaccccuaucugaaccagccggggccuuuaggaacccagaagccaaccaguggcccccagacuccucaagcccagcagaaaucccuccugcaacagcuucugacagaauga

SEQ ID NO: 59540 - RNA, 4395 nt, Artificial Sequence
  derived and/or modified sequence opt3 from NCOA2__Homo_sapiens__XP_005251188
augagcggcaugggggagaacaccuccgaccccucuagagccgaaacaaggaagcggaaagagugcccugaucagcugggaccaucaccgaagcgcaauacugaaaaacgaaaccgugagcaagaaaauaaguacaucgaggagcucgcugaacuuauuuucgcaaacuuuaaugacauagauaacuucaauuuuaaacccgacaagugugccauccugaaggagacggugaaacagauuagacagaucaaggaacaggagaaagcggcugccgcaaacauugaugagguccaaaagagugacguuagcuccaccggucagggcgugaucgauaaagacgccuuggggccuaugauguuagaagcucuggauggauucuuuuucguagugaaucuagagggcaacgucguguuuguuucugaaaaugugacacaguaucucagguacaaccaggaggaacugaugaauaagucggucuauucaauacuucacgugggugaccauacugaguucguaaagaaccuguugccaaaaagcaucguuaaugggggaaguugguccggcgagcccccucggcgcaacucucacaccuuuaacugcagaaugcucgugaagccacugcccgauagcgaagaggaaggccaugacaaucaagaggcacaccagaaauacgaaacaaugcaguguuucgccgucucccagccuaagucaauuaaagaggagggggaagaucugcaaaguugccucaucuguguggcuaggcgggugccaaugaaggagcgcccggucuuacccagcucugaauccuuuaccacucgacaggaccugcagggaaaaauuacaucacuugacaccagcacgaugagagccgcgaugaagccugguugggaggauuugguuaggcggugcauccaaaaguuccaugcacagcacgaaggcgagagugugucuuaugccaaacgucaccaucacgagguacugcgccaggggcuagcuuuuucccagauauacagauucagccucucggacggaacucugguggccgcacaaaccaagucuaaacuuauuaggucccagacaacuaacgaaccacagcuggucaucucauugcauaugcuccaccgggagcagaauguguguguuaugaaccccgaucugaccggccaaacaauggguaagccuuuaaauccaauuaguagcaacucccccgcucaccaggcccugugcucugggaauccgggacaggacaugacccucagcucaaacaucaauuucccuaucaacggccccaaagaacagaugggcaugccaauggggcgauuuggagguaguggcgggaugaaucauguguccggaaugcaagcgacgacuccucagggcagcaacuaugcccuuaagaugaacucucccucacagaguagcccagguaugaaucccgggcagccuacauccaugcugucuccacgccacagaaugucgccgggcgucgcaggaagccccaggauuccuccaucccaauucucacccgcuggcaguuugcauucuccuguggggguauguagcuccaccggaaauucacacagcuacacuaacucuucccuaaacgcccugcaggcucucagugagggucauggcguuagccuggggucuucccuugccucaccagaucugaagaugggaaauuugcagaacagucccgugaauaugaacccgccuccacucagcaaaaugggcucgcuggacuccaaggauugcuuugguuuauacggggagcccucugaaggcacaaccggacaagcagagagcucaugucacccuggcgaacagaaagagacgaaugaccccaaccugcccccugccgucaguuccgaacgggcugaugggcagucucgccuacacgacagcaagggacagaccaaacuccugcaacuuuugacaacuaaguccgaucagauggagcccucaccacuggcgagcagucucucugacaccaauaaggacuccacagguagccugccgggcucggggucaacucauggaaccucucuuaaagagaagcacaaaauacugcauagauugcuccaggauaguuccagcccuguggaccuggcaaaguuaacagccgaagcuaccggcaaagaucugucucaggagagcuccucaacugcccccgguagugaagucacgaucaagcaagagccagugagccccaagaaaaaggaaaacgcacuacucagguaucugcuugacaaagaugacacaaaggauauuggguugccugagaucaccccaaaacuggagcgucucgacucuaagacugaucccgccuccaauaccaaacugauagcuaugaagacagaaaaggaggaaaugucauucgagccuggcgaccagccgggaagugaauuagauaaccuggaggagauucuugacgauuugcagaauagccagcucccacaacuguuucccgacacccggccuggcgccccagcaggguccguugacaaacaggcgaucaucaacgaucuaaugcagcugacugcugaaaauucucccgugacaccuguaggagcccaaaagacggcacuccgaauuucgcagagcaccuucaacaauccgagacccggccagcuggguaggcuuuugccaaaccagaaccugccuuuagacaucacucuccaaucacccacaggggccggaccauuuccucccauucgcaauuccaguccauacucugucauaccgcagccuggcaugauggguaaccagggcaugaucgggaaucagggaaaccugggcaauagcuccaccgggaugauuggaaacucagcuucucggcccacaaugccaagcggcgagugggccccacaaaguuccgcagugagaguuacuugcgcugccaccacgagcgcgaugaauaggccugugcagggugggaugauccgcaacccagccgcuucuauccccaugcgaccuucaucccagccgggacagcggcaaacccuucagagucaggucaugaauauuggcccaagcgaacuggagaugaacauggguggcccccaguauucgcaacagcaggcaccucccaaucaaacagccccauggccugagucuauauugcccaucgaucaggcuuccuucgccagccagaaccgucagccauuugggucaaguccugacgaucuccugugcccgcaccccgcagcggaaucuccauccgacgagggagcccuacuggaucaacucuaccuggcucuuagaaauuucgacggcuuggaagagauugauagggcccuggggaucccugaauuagugagccagucacaggcaguagaccccgagcaguuuaguagccaagauuccaacauuaugcucgagcagaaagcuccaguguucccucagcaguaugccucucaagcacagauggcccagggaagcuacucccccaugcaagacccgaauuuucacacuaugggccagcgcccaucauaugcuacccugcggaugcagccuagacccggucuuaggccaacagggcugguucagaaccaacccaaccagcuacgacuccagcugcagcaucgcuugcaagcgcagcagaaucggcagccucugaugaaccaaaucucuaaugucaguaacgugaauuuaacucucagaccgggagugcccacccaggccccaauaaacgcacagaugcuggcucagaggcaacgugaaauccuuaaucagcaucugcgccagcggcaaaugcaccagcagcagcaaguccagcagagaacguugaugaugaggggccagggucucaacaugacaccuucgaugguugcccccagcggcaugccugccaccauguccaauccacggauuccccaagcuaacgcacagcaguucccuuucccacccaauuacgggaucucucagcaaccggauccuggauuuacuggcgccacaaccccacagucaccccugaugagcccucgaauggcgcacacucaguccccaaugaugcaacagagucaggcuaaccccgccuaccaggcaccgucugacauuaaugggugggcccaaggaaacaugggcgguaauagcauguucucacagcaguccccuccccauuuugggcagcaagcuaacaccaguauguauagcaauaacaugaacaucaaugugucuauggcaacaaacacgggaggcauguccucaaugaaucagaugaccggccagauaagcaugacuucggugacaucuguaccaaccagugggcuauccagcaugggaccugagcaggucaacgaccccgcccugcgcgguggcaaucuuuucccaaaccaacuccccgggauggauaugauuaagcaggaaggagacacaacuagaaaauacuguuga

SEQ ID NO: 59541 - RNA, 4248 nt, Artificial Sequence
  derived and/or modified sequence opt3 from NCOA3__Homo_sapiens__NP_001167559
augagcggccugggggagaaccucgacccccuugccuccgauucuagaaagaggaaacugccuugcgacaccccaggacaggguuugacauguucaggcgaaaagcggcgccgagagcaagaaaguaaauacaucgaggaauuagcugagcugauuagcgcaaaucuauccgauauagacaacuucaaugugaagccggauaaaugcgccauccucaaggagacuguccgucagauuagacagaucaaggaacaggggaaaacgauuucuaacgacgaugacguucaaaaggcggaugugucgucaaccggacagggcguaaucgacaaagauagccuggguccccuucuguugcaggcucucgacggguuucuguucguggucaauagggauggaaacauaguguuuguuagugagaaugugacacaguaucugcaauacaagcaggaagaccucgucaacacuuccguguauaauaucuuacacgaggaggaccggaaagauuuccugaagaaccuuccuaagucuaccguaaauggcguuagcuggacaaacgaaacccagcgccagaaaucccauacuuuuaauuguagaauguugaugaagacaccacacgacauucuggaggauaucaacgccucacccgaaaugaggcaacgguacgagaccaugcagugcuucgcacuaagucagccucgcgccaugauggaagagggcgaggaccuccaaagcuguaugauuugcguggcucgaagaaucacgacuggggaaaggaccuuuccaucuaaucccgaguccuucauaacacggcaugaucugucaggaaaagucgugaacauugacacuaacagccuucguaguucuaugcgcccugguuuugaagauaucauuagaagguguauccagcgguucuuuucccugaaugacggccagagcuggucgcagaagcgacacuaucaagaggugaccucugaugggaucuucuccccaacagcauacuugaacggacaugccgaaaccccggucuaucgcuuuucacucgcugacggcacgauuguuacugcccagacaaaaaguaagcuguucagaaaucccgugaccaacgauaggcacgguuucguaagcacucacuuuuuacagcgggagcagaauggguaccgcccuaacccaaaucccgugggacaaggcauaagaccuccaauggcgggcugcaacuccucugucgggggaaugagcaugucacccaaucagggucugcagaugccgaguuccagggcauacggccucgccgacccuagcacaaccgggcagaugucuggagcucguuauggcgguucaaguaacaucgccagccuuacgcccgggccaggcaugcaauccccuucuucguaccagaauaacaauuauggacugaacaugagcuccccuccacauggcucacccggguuggcaccuaaucagcagaacauuaugaucaguccacggaaccgaggaucuccgaaaauagcuagccaccaauucucccccguggccgguguucauucaccuauggcgagcucuggcaauaccgggaaccacuccuuuaguucgucuucccuaucagcccugcaggcaauuagugagggagugggcacaagccuccugucgacucuuuccucuccaggucccaagcuggacaauagcccuaacaugaauaucacccagccaucaaaggucaguaaccaagauuccaaaucucccuugggguucuacugugaccagaauccgguggaaagcuccaugugccagucaaacagcagagaucaccucagugacaaggagucuaaagaauccagcguagagggcgcugaaaaucagaggggaccucuggagucgaagggccauaaaaaguuacugcaacuacucacauguucaucugaugaccgcgggcacaguucccugacuaacagcccacuugauucuagcugcaaggaguccucaguuagugugaccagccccucuggagucuccucaaguacaagcgguggcguguccucuaccucgaauaugcaugggagcuugcugcaggaaaaacaccggauccuccauaagcugcuucagaacggaaauucacccgccgaggucgcuaaaauuacugccgaagcaacgggcaaggacacauccaguaucaccucuugcggugaugggaacgugguuaaacaggagcaacugagccccaagaagaaagagaauaacgccuugcucagauaucuguuagacagggaugacccauccgaugcucugucaaaggaacuacagccucagguggagggcguagacaacaaaaugucucaguguacuagcaguaccauucccuccagcucucaagaaaaggacccaaaaauaaagacagagaccucagaagagggauccggcgaucucgacaaucuggaugcgauccuuggggacuugacgaguagcgauuuuuacaacaauucgauuucuuccaacggaagccaccugggcacaaagcagcaggucuuccaagguacuaauucacucgggcugaaaaguucucaguccgugcagagcauccgcccgccuuauaaccgagcaguuucauuagacagucccgugagcgucggauccucuccacccgugaagaauaucagcgccuuuccuaugcugccaaaacagcccaugcuuggcgguaacccucggaugauggauucccaagagaauuacggcucaucuaugggggacuggggauugccgaacaguaaggcuggccguauggaaccaaugaauagcaacagcauggggagacccggaggcgauuacaauaccucccucccuaggccagcccugggugggucuauucccacucuaccucugcgcucaaacagcauaccgggagcacggcccguacuccagcagcagcaacagaugcugcagaugagaccaggcgagaucccuauggguaugggcgccaaucccuaugggcaggcugccgcauccaaccaacuuggaaguuggccagacggcauguugucuauggaacaggugagccacgggacacagaacaggccucuguuacgaaauucacucgaugaccugguuggacccccauccaaccuugagggccagagugaugaacgcgcgcuguuggaccaacuccauacccugcuaagcaauacagacgcuacuggucuggaggagauugaucgggcccucgggaucccggaacuggucaaccagggacaggcacuugagccuaaacaagacgccuuccagggccaggaagcugccgugaugauggaucagaaggcagguuuguacggccaaaccuaucccgcucaggggccacccaugcagggaggcuuucaucugcaggggcaaucuccuuccuucaauucaaugaugaaccagaugaaucagcagggaaacuuuccauuacaaggcaugcaccccagagccaauauuaugaggccucguacgaacaccccgaaacagcuccgcaugcagcugcaacagcggcuucagggucagcaauuccugaaucagagcagacaggcgcuagagcucaagauggaaaacccaacagccgggggagcugcagugaugaggcccaugaugcagccucaacagggcuuucugaaugcccagauggucgcucagcgaucgcgggaguugcugucucaccacuuccgccaacagagaguugccaugaugaugcagcagcaacagcagcaacagcagcagcaacagcagcagcaacagcagcagcaacagcagcaacagcagcagcaacagcagcagcaaacucaggcauucagucccccaccuaacgugaccgcgucccccagcauggacggcuuacucgccgggccaacaaugccucaggcuccgccccagcaauuuccauaccagccuaauuauggaaugggucagcaacccgauccagccuucggcagggugucauccccucccaacgcaaugaugucuagccggauggggccgagucagaauccaaugaugcagcauccucaggcugccuccaucuaccaaagcucugagaugaagggauggcccucaggcaaccuggcacgaaacaguuccuuuagccagcagcaguucgcccaccaagguaauccagcuguauauucuaugguccauaugaacgggucgucaggacacaugggccagaugaauaugaaccccaugccuaugagcggcaugccgauggggcccgaccagaaauacugcuga

SEQ ID NO: 59542 - RNA, 1953 nt, Artificial Sequence
  derived and/or modified sequence opt3 from NCOA4__Homo_sapiens__NP_001138732
augggcgcccagcugaccacauucgcucucgcaggggccgugagaaggaugaacacuuuucaagaccagagcggauccucuucaaaucgggagccccuucugcgcugcagugaugcgcgacgugacuuggaauuagcuaucgguggcguccugagagccgagcagcagauuaaggauaaccuaagggaaguuaaagcacaaauacacagcuguaucucccggcaucucgagugccugcgcucuagagaaguguggcuuuacgagcagguagaccugauuuaucaguugaaggaggaaacgcuccagcaacaggcccagcagcuguacucgcugcucgggcaauucaauuguuuaacccaccagcuggagugcacacagaacaaagaucuugcuaaucaagugucagucuguuuggaaaggcugggaagccuaacucucaagccugaggacaguaccgugcugcuuuuugaggcagauacaaucacccugcggcagacuauuacaaccuucggcuccuugaaaacgauccagauaccagaacaucucauggcccacgcuucuagcgccaacaucgguccguuucuggagaagcgcgggugcauuuccaugcccgaacagaagucagcgaguggaaucguugcagugccuuucagcgagugguuacugggcucuaaaccagccuccggcuaucaagcucccuacauuccuucaacugacccacaggauuggcucacccagaagcagacacuugaaaauagccaaaccaguucucgagccuguaacuuuuucaauaacgucgggggaaaucugaaagguuuggagaacuggcuacugaaguccgagaaaagcucguaucagaagugcaauucucauuccacuacaucaaguuuuagcaucgaaauggagaaggugggcgaccaggaacuccccgaucaggacgagauggaucuguccgacuggcuuguaaccccucaagaaucucacaaacugagaaagccagagaacgggagcagggagacgucagaaaaauucaaguugcucuuucagaguuacaauguuaacgacuggcuggugaaaacugauuccuguacaaacugccagggaaaucagccgaagggcgucgagauagaaaacuuagguaaucugaaaugucuaaacgaccaccucgaggcaaagaagccccugagcaccccuucuauggugacugaagauuggcuugugcaaaaucaucaggacccaugcaaagucgaggagguuugccgggcuaacgaacccuguacaucauucgccgagugcgugugugaugaaaauugcgagaaggaggcguuguauaaauggcugcucaagaaagaagggaaggacaagaacggaaugccuguagagccaaaacccgaaccggagaagcacaaagauagucugaauauguggcuuuguccucguaaggaagugauugagcagaccaaagcccccaaggcaaugacgccaagccgcaucgcugacuccuuucaagucauuaagaacucuccucugucggagugguugaucagacccccauacaaagaaggcagccccaaggaggugccuggcaccgaagauagggccgggaaacagaaguucaaauccccaaugaauacaucauggugcaguuucaacacugcugacuggguucucccgggaaagaagauggguaaucugucucaguuaagcuccggcgaggauaaauggcugcuacggaagaaagcccaggaagugcuccugaacucaccccuucaagaggagcauaauuuuccuccagaccacuacggguugcccgcagucugugaccuguucgccugcaugcagcucaagguggauaaagaaaaguggcuguaucgaaccccuuuacaggcuuacuuuaaaaugaacuuccaggacguaacaguuggaaacuuucaaaucccauguggcuucuga

SEQ ID NO: 59543 - RNA, 1740 nt, Artificial Sequence
  derived and/or modified sequence opt3 from NCOA5__Homo_sapiens__NP_066018
augaacaccgcccccagcagaccuuccccaacaaggcgggacccguacggcuucggggauucucgcgacucacgacgugauagaagucccaucaggggaagcccucggcgcgagccaagagacgguaggaauggccgggaugcucgcgacucccgagauauuagagaccccagggaucugcgggaccaccgucauucucgcgaucucagagaccacagggauucgcggucagugcgagacguccgcgacguuagagaucuuagggacuuucgggaucugcgcgacagcagagauuucagggaccagcgugauccuauguaugaccgguaccgagauaugagagacaguagggauccaauguaucgccgggaaggguccuacgacagauauuugaggauggacgauuacugccgccgaaaggacgauucuuauuuugaccgguaccgugauagcuucgacggaagaggucccccuggcccagagucccaaucaagggcaaaagaacgcuuaaagcgggaggaaagaaggcgagaggagcuguaccgccaguauuuugaagagauacagcggagauucgaugccgaaaggccgguggacuguaguguaaucguggucaacaaacagacuaaggauuacgcggagagcguggggcguaaaguucgcgaccuaggaaugguggucgaucucauuuuucugaauacggaggugucucuuucccaagcucuggaagacguaucacggggcggcagccccuucgccaucguuauuacccagcagcaucagauccacagaaguugcacagugaacauaauguuugggacuccucaagagcauaggaauaugccacaggcagaugccauggucuugguggcucgaaacuaugaacgguacaagaaugagugucgcgaaaaggagagagaggaaaucgcaaggcaggccgcuaaaauggccgacgaggcgauucuccaggaacgggagcgaggaggucccgaagagggcgugagagggggacacccuccagcaauccaaucucugauuaaccugcucgccgacaaucgcuauuuaaccgcugaggaaacagauaagaucauaaacuaccugagggagcguaaagaacggcuuaugagauccagcaccgacucguugcccggcccgauuucuaggcagccucugggugccacuuccggggcaucacuaaagacacagcccaguagccaaccacuccaguccggacagguccugccuucugcuacccccacgccaagcgcgcccccuacuucacagcaagagcuucaggccaaaauccugaguuuguucaauuccggcaccguuacagccaacucuagcucagcaaguccaagcguggcugccggcaauacuccgaaccagaauuuuuccaccgcugccaacucucagccccaacagcgcucgcaggcaagcgggaaccagccuccauccauucucggacaagguggcucagcccagaauauggggccccgaccuggagcuccaagucagggccuguucggucagcccucuagcagauuagcgccggcauccaacaugacaucacaacggccuguaagcucuaccgggaucaauuuugauaacccauccgugcagaaggcccuggacacgcucauccagaguggccccgcucuuagccaccuggucucucaaacuacagcccagaugggacagccucaggcacccaugggcuccuaucaaaggcauuacuga

SEQ ID NO: 59544 - RNA, 3213 nt, Artificial Sequence
  derived and/or modified sequence opt3 from NCOA6__Homo_sapiens__NP_001229468
auggugcuggacgaucuccccaaccuugaggacaucuacaccagccugugcuccucuacaauggaagauucagagauggacuucgauaguggcuuggaagacgaugacacuaagagcgauuccauuuuagaggacucuacgauauuugucgccuucaaagggaauaucgaugacaaggauuuuaaauggaagcuggacgcuauucuaaagaacguuccuaaucuccugcacauggaaucgucaaaacuuaaggugcagaaaguagagccauggaacagcgugagagucaccuucaauaucccgagggaggcagccgaacggcugcgcauuuuggcgcaaaguaacaaucagcagcuccgagaccugggaauccuguccgugcagauagagggugaaggcgcuaucaaccucgccuuagcacaaaaucguucucaggauguuagaaugaacgggcccaugggagccggcaauagcgugaggauggaggcugguuuuccuauggcauccgggccaggaauuauccggaugaacaaucccgccacagucaugauuccuccaggcggcaacgugucaaguagcaugauggcucccgggccuaauccagagcugcagccgcgcacucccagaccugccucucaguccgacgcgauggauccacuuuugucaggacugcauauccaacagcagagccaccccagugguucucuagcaccuccacaucaccccaugcagccgguauccguuaacaggcaaaugaacccugccaauuucccccagcuccagcaacagcagcagcaacagcagcagcaacagcagcagcaacagcagcagcaacagcagcaacagcagcagcaacugcaggcucggccaccucagcagcaucaacagcagcagccccaaggcauacgcccacaguuuaccgcccccacacaggugccugucccaccgggguggaaccaacuucccagcggagcacugcagccuccacccgcucagggcucguuggguaccaugacugccaaucagggguggaagaaagcgccucucccaggacccaugcaacagcagcugcaggcccgaccgucuuuagcaacagugcaaaccccuucccacccacccccucccuauccauucggcucacagcaggcuagucaggcccacacgaacuuuccucaaaugagcaaucccggccaguucacugcuccacagaugaagucccugcaagggggaccgucuagagugccuaccccacuccaacagccacaucuuacaaacaaaagccccgccucaaguccuuccagcuuucagcaagguucuccagcaucaagucccacugucaaucagacccagcagcaaaugggcccuaggccgccacagaacaauccccugccucagggguuccagcaaccaguuagcucccccggacggaacccuauggugcagcagggcaauguaccgcccaacuuuauggugaugcagcaacagccaccuaaucaggguccccaaucuuugcacccagggcuaggcggaaugccuaagcgucugcccccaggcuucucggccgggcaggcuaacccgaauuucaugcagggacaggucccuagcacaaccgcgacgacucccgguaacuccggcgcaccacaacuccaggccaaccagaaugugcagcaugcugggggacaaggcgccggucccccucagaaccagaugcagguuucacacgggccacccaauaugaugcaaccuagucugaugggcauucacggaaacaugaauaaccagcaggcaggcacaucuggggugccgcaggucaaucuuagcaacaugcaaggacagccacagcaaggucccccuucccagcugaugggcaugcaucagcagaucgugcccucacaagggcagaugguacagcagcaaggaaccuugaauccacagaacccuaugauucucagccgcgcccagcugaugccccagggccaaaugaugguuaauccaccuucucagaacuuagguccgaguccccagagaaugacuccaccuaagcaaaugcugucccagcaggggccccagaugauggcuccacacaaucaaaugaugggcccucagggacaggugcuacuccagcaaaaccccaugaucgaacagaucaugacaaaucagaugcagggcaacaaacaacaguuuaacacccagaaucaaagcaacgucaugccggggccagcccagauuaugaggggaccuacgcccaauaugcagggcaacauggugcaguucaccggucaaaugucugggcagaugcugccacagcagggacccgucaauaacuccccuucacaagugaugggcauacagggucagguucuucggccgcccggcccaaguccucauauggcacagcaacacggggaccccgcgacaacugcuaauaacgaugugagcuugucgcagaugaugccugacguauccauccagcagaccaauauggucccaccccaugugcaagccaugcagggaaacucugcaagcggcaaucacuuuucagggcacggaaugaguuucaacgccccuuuuuccggcgcuccaaaugguaaccagaugucuugugggcaaaaucccggauucccgguuaacaaggaugugacacugacuagcccucuccuggucaaccuucugcaguccgacauuucagccggccauuuuggugugaauaacaaacagaauaacaccaaugcaaacaagcccaaaaagaaaaagcccccucgaaagaaaaagaauagccagcaagauuugaacacaccagacacccgccccgcuggccucgaggaagccgaucagccgccucugcccggggagcagggaaucaauuuagacaacaguggcccaaaacugccugaguucucuaauagacccccagcgcccucccagaaccuaguaagcaaggagacuucgacgacagcccuccaggcuucaguggcaaggccugagcuggaaguuaaugccgcuauagucucugggcagaguuccgagccaaaagaaauuguggaaaagagcaagaucccgggacggcgcaacucuagaaccgaggaacccacuguggccagcgaguccgucgaaaauggccacaggaaacguucaagucggccugcaagcgcgucuuccucaaccaaggacaucacaagugccguucagagcaaacgaagaaaguccaaauga

SEQ ID NO: 59545 - RNA, 2796 nt, Artificial Sequence
  derived and/or modified sequence opt3 from NCOA7__Homo_sapiens__NP_001116314
auggacaccaaggaggaaaagaaggagagaaaacagagcuacuucgccaggcugaagaaaaagaagcaagcuaaacagaacgcagaaacagccuccgcgguggcuacucggacgcacaccggcaaggaggauaauaacacagucguucucgaacccgacaaaugcaauaucgccguggaggaggaauauaugacugaugagaagaaaaagcgcaagucuaaccagcuuaaagaaauucgacguaccgagcugaagagauacuauucaauagacgauaaucagaacaaaacacaugacaagaaagagaagaaaaugguagugcaaaagccucacgggaccauggaauacacugcaggaaaucaggauacauugaacaguaucgccuuaaaguuuaauauuaccccaaacaaacuggucgagcuaaauaaacucuucacgcauacuaucgugccgggucagguucuguuugugcccgacgcuaacagcccuuccucuacccuuaggcugucgucaagcaguccaggcgcaacagucucccccucuagcuccgaugccgaauaugacaaauugccugaugcugaccucgcccggaaggcgcugaaaccaauugagcgcgugcugucaaguacuagcgaagaggaugagcccgggguaguuaaguuccucaagaugaauuguagauacuuuaccgacggaaaaggcguggucgguggggugaugaucgugacaccuaacaauauaauguucgacccacacaagucugauccguuagucaucgaaaacggaugcgaggaauauggccugauuugucccauggaggaaguuguguccaucgcacuuuacaacgacauuucacauaugaaaaucaaggaugccuugccuagcccaggcgagugggaggaccuggcuagugaaaaagauauaaaucccuuuucuaaguucaaguccauuaacaaagagaagaggcagcaaaauggggaaaagaucaugaccagcgacucgcggccuauuguaccacuagagaagucuacgggacacacucccacaaaaccguccgguucaagugugagcgaaaagcucaagaaacuggauuccucucgcgagaccagccacggcucaccuacugucacaaaacuuaguaaagagcccuccgacaccagcucugccuuugaaucaacggcaaaggagaacuuccugggggaagaugacgauuuuguggacuuggaggagcucaguagccagaccggaggcgguaugcauaaaaaggacacacugaaagaaugcuuaucccuggauccagaggaacgaaagaaggcugagucucagaucaauaacucggccguugaaaugcaagugcagagcgcgcucgccuuccuugggacugagaaugacgucgagcugaaaggagcauuggaucuagaaaccugugagaagcaggacaucaugccugaaguggauaaacaguccggcucacccgagaguagaguagaaaacacacugaauauucacgaggaccucgauaagguuaaacugauagaguacuaucuuacuaagaacaaggaaggcccacaagugucugagaaucugcagaaaaccgaauugagcgacgggaaguccaucgagcccggagguauugauaucacacucucaagcucucugucccaggcuggcgacccuauaaccgaagggaacaaagagccagauaagacuugggucaaaaagggagagccguuacccgugaagcugaauaguagcacggaagccaacgucauuaaagaggcucuagacucuucccucgaaucaacacuggauaauaguugccagggcgcccaaauggacaacaagagcgaggugcagcuuugguugcugaaaaggauccagguuccuaucgaggacauucucccaucgaaggaagagaaauccaagacucccccuauguuucuguguaucaagguggguaaaccaaugcggaagucuuucgcaacucauaccgccgcuaugguacagcaauacgggaaacgucgcaagcagcccgaauauugguucgcggucccgagagagaggguggaucaccuuuacacauuuuucguucaguggagcccugacguguauggcaaagaugcaaaggaacagggauuugucgugguagagaaagaggaacugaacaugauugacaauuucuuuucagagccaaccacuaagaguugggaaauaaucacaguggaggaagccaagcggcgaaaauccacgugcucuuacuaugaggaugaggacgaagagguuuugcccguccuccgcccucacagcgcucuguuagaaaacaugcauauugagcaacuggccagaaggcuacccgcacgggugcagggcuacccauggcgccucgccuacuccacccuggaacacgggacuucacuuaagacauuguauagaaaaagcgcuagucuggauucuccugugcuccuggucaucaaggacauggauaaucagaucuucggagccuacgcaacccaucccuuuaaauucuccgaccacuauuacgguacaggcgagaccuuuuuauauaccuucagcccacauuuuaagguuuucaaguggucgggggagaacucauacuuuauuaauggagauauaucuagucuggaacuuggcggugggggcggaagguucggcuuguggcucgacgcggaucuguaucacgggcguuccaacagcuguucuacguucaauaacgacauccuaagcaaaaaggaggacuuuauugugcaggaucuggaagugugggcuuucgacuga

SEQ ID NO: 59546 - RNA, 2745 nt, Artificial Sequence
  derived and/or modified sequence opt3 from NCOR1__Homo_sapiens__NP_001177367
augagcuccucuggcuaucccccuaaccagggggccuucucaaccgagcaaaguagauacccaccgcacagcgugcaguacacauuucccaauacuaggcaucagcaggacccugcuuucggagguaagcacgaagcaccauccucucccaucucgggccaaccuugcggggaugaccagaacgccucaccaagcaaacugaguaaggaggaacucauucaguccauggaucgggucgaccgcgagauagcgaaaguugaacagcaaauccuuaagcugaaaaagaagcagcagcaguuggaggaggaagcugccaaacccccugagccagaaaagccggugucucccccuccaguagagcaaaaacaucgaagcauugugcagaucauuuaugaugagaaucguaagaaagcagaagaggcccacaagaucuuugaaggauuaggccccaaggucgagcugccucuauacaaccagccauccgacacgaaaguguaucaugaaaauauaaagaccaaccaaguuaugaggaaaaagcucauccuguucuuuaaaagacggaaucacgcucgcaagcagagagagcagaaaauuugucagagguacgaucaacuuauggaggcaugggaaaagaagguggaccggaucgagaacaauccccgccgaaaagccaaggaaucaaaaacaagagaguauuacgaaaagcaguucccggagauuaggaaacagcgggagcagcaagaacguuuucagcgcgucggucagagaggggcuggacugagugccacuaucgcgaggagcgagcacgaaauaucugagauuaucgauggcuuguccgaacaggagaacaaugagaagcaaaugcggcagcucucagugauuccucccaugauguucgacgcagaacagcgacgcguaaaguuuaucaacaugaauggccugauggaggauccaaugaaaguuuacaaggacagacaguucaugaacguguggaccgaucaugaaaaagagaucuuuaaggacaaauucauucaacacccuaagaauuuugggcugauagccagcuaucucgagaggaagaguguccccgacugcguguuauacuauuaccugaccaaaaagaacgaaaacuauaaagcucuugugcggcgcaauuacggaaagagaaggggucguaaccagcagaucgcccggccaucucaagaggaaaaagucgaggaaaaggaggaggauaaggcagagaaaacagagaagaaagaagaggaaaagaaagacgaggaggaaaaggaugagaaagaagacuccaaggagaauacuaaggaaaaagauaagauugacggcacagcugaggagaccgaagaacgagaacaggccacgcccagagggaggaaaacugcgaacagccagggacgccggaagggcagaaucaccaggucgaugacaaaugaggccgcagcugccucugcugccgcagccgcugcgacugaggaaccuccaccgcccuugccuccacccccugagccaauauccaccgaacccguugagacaucacgcuggaccgaagaggagauggaaguggccaaaaagggucugguagagcaugggcgaaacugggcagcuauugccaagauggugggaacgaaaagugaagcacaguguaagaauuucuauuucaacuacaaacggcgucacaaucuagauaaccuccugcaacagcacaagcagaaaacuagcagaaagccgagggaggaacgcgacgucucccagugcgagucuguggccagcacaguuucagcucaagaggaugaagacaucgaggccaguaaugaagaggaaaacccugaggauuccgagggcgcagaaaauagcucugacaccgagucagcgccaagucccagcccuguggaagcugucaagcccuccgaggacucuccagagaacgccacuucgcggggcaauacagaaccugcaguggagcuugaacccaccacggagaccgccccaagcacauccccgucacuggcuguaccuaguacuaaacccgccgaagaugagucuguugagacccaggugaacgacagcaucuccgcagaaacagcugagcagauggaugucgaccagcaagaacauucagccgaggaagggagcgugugugauccacccccugcgacuaaggccgacucugucgauguggagguuagagugccagagaaccacgcuuccaaaguagaaggagacaauaccaaggagagggauuuggaccgagcaagugaaaaagucgagccccgcgaugaagaccucgugguugcccagcagauuaacgcucaacggccugagccgcagagcgauaaugacucuuccgccacaugcucagcagacgaggauguggacggugaaccagagagacagaggauguuucccauggauaguaagccuagccuguuaaacccaaccggcucgauccuggucuccucuccccucaagccuaauccgcuugaccugccccaguugcaacaucgugcggccgugauuccaccuaugguaagcuguacucccugcaacauaccaaucgggacgccugugucaggauacgcucuauaucagcgccacauuaaagccaugcaugaaagugcacugcucgaggagcagcggcagagacaagaacagaucgaucuggaguguagguccucuacaagccccugcggcaccuccaagucaccaaaucgagaaugggagggucgguga

SEQ ID NO: 59547 - RNA, 7377 nt, Artificial Sequence
  derived and/or modified sequence opt3 from NCOR2__Homo_sapiens__NP_001070729
augagcggauccacccagcccguggcccaaacauggagagcuacugagccuagauacccaccgcacucucugucauaucccguccagaucgcacggacgcacaccgacguugggcuccuugaauaccagcaccauagucgcgauuaugccagccaccuguccccuggaucuauuauccagccacaacgacguagacccucguuguuaucagaguuccagccugguaacgaaaggagccaggagcugcaucugcggccagaaagucacuccuaccuccccgagcugggcaagucugagauggaauuuaucgagagcaaacgcccuagacuugaacuguugccagacccgcuccugaggcccuccccucugcucgcgaccgggcagccagcuggaucagaggauuuaacuaaggaccggagucugaccggcaaacuugagcccgugagcccuccaucucccccgcacacagauccugaauuggagcugguacccccacgccuauccaaggaggaacucauucaaaacauggaccgaguggauagagaaaucaccauggucgagcagcagauuucaaaacugaagaagaaacagcaacagcuugaggaagaggccgccaagccucccgaaccagagaaacccgugagcccuccaccgaucgaaaguaagcauaggucucugguucagauaaucuaugacgagaaccggaaaaaggccgaggcugcccaccguauuuuggaaggucucgggccccaaguggagcugccuuuauacaaucagccauccgauacucgccaguaucaugaaaacaucaagauuaaucaggccaugaggaagaagcugauccucuacuucaaaaggcggaaccacgcucgaaagcaaugggagcagaaauuuugccagcgcuacgaccagcuuauggaagccugggagaagaaagucgagagaauagaaaauaaccccaggcggcgcgcgaaggagagcaaggugagagaauauuacgagaaacaauucccugagauuaggaagcagcgugaacugcaggagcggaugcagcgaguaggacaaagaggcucgggcuugucuauguccgccgccaggucagaacacgagguuagugaaaucauugaugggcuaagcgagcaggagaaucuggaaaaacagaugcgccagcucgcugugaucccacccaugcuguaugacgccgaucaacagcggaucaaguuuauuaacaugaauggacuuauggcagacccgaugaaagucuacaaggacagacaggugaugaacaugugguccgagcaagaaaaggagacauucagggaaaaauuuaugcagcauccuaagaauuucggucugauagcuagcuuuuuggagcgcaaaaccguggccgaguguguccucuauuacuaucugacgaagaaaaacgaaaauuacaagagcuuaguucgacggucauaccguagaaggggcaagagucagcagcaacagcagcagcaacagcagcagcaacagcagcaacagcagcagccaaugccccgcuccagccaagaggaaaaagaugagaaggaaaaagagaaggaggcggaaaaagaggaagagaagccugagguggaaaacgacaaggaggaucugcuaaaagaaaagacugacgauaccucuggggaggacaacgaugaaaaagaggccguagcaucaaagggacggaaaacagcuaauagucagggcagaaggaagggucgaaucacucgcagcauggccaacgaggcuaauuccgaagaggccauuacaccacagcagucugcagaacucgccucgauggagcugaacgaaagcucccgguggacagaggaggaaauggagaccgcuaaaaaggggcuuuuggaacacggaagaaauuggucagcgaucgcaaggauggugggcaguaagacggucucucaaugcaaaaacuucuauuuuaauuacaagaaacgucagaaccuggacgagauacuccagcagcauaagcugaaaauggaaaaggagcgcaaugcccggagaaagaaaaagaaagcuccagccgcagccagcgaggaagcugccuucccucccgugguugaggaugaagagauggaggcauccggcgugucagggaacgaagaggaaauggucgaggaagcggaggcuacugugaauaacagcucugacacagaguccauuccaaguccgcacaccgaagccgcaaaggauacuggacaaaaugguccuaaacccccagccacacuuggcgcugacgggcccccuccaggacccccuaccccgccacccgaggacaucccugccccaacggaacccaccccugcaagcgaggcuacaggcgccccgacucccccucccgcgcccccaucuccuuccgcaccaccaccgguaguuccuaaggaagagaaggaggaagagaccgcugcagcacccccaguggaagagggugaagaacagaaacccccugcugccgaggaacuggcagucgauacagggaaggcggaggaaccagugaaaucagaguguacugaggaagccgaggaaggccccgcuaagggaaaagacgccgaggcagcugaagccaccgcagagggcgccuugaaggcugagaagaaagaagggggaagugguagggcgacaaccgccaagagcucgggcgcaccucaggauuccgacucuagcgcuacuugcucagccgaugaggucgacgaagccgaagggggagauaaaaaccgacuccugaguccgcggccauccuuacugacgcccacaggcgacccucgcgcuaaugcaucuccccagaagccacuagaucucaaacaacugaagcagagagccgcggcuaucccucccauucaggugaccaaaguucaugaaccaccuagggaggacgccgcaccgacuaagcccgccccucccgcucccccaccuccccaaaaccuucagccggagagcgaugcaccacagcagccugguuccucaccccgggggaagucucgaaguccagcacccccugcggacaaagaagcugagaagccgguguuuuuccccgccuucgcagccgaagcucaaaaauugccaggcgauccucccuguuggaccucuggacugccuuuuccaguacccccuagagaggucaucaaggccuccccacacgcacccgacccgagcgcuuucucguaugccccuccaggccacccccucccucugggguuacaugacacagcgcgcccagugcugcccaggccgccuaccauuucaaaucccccaccucuuauaucuagugccaaacaccccuccguuuuggaacgucagaucggagcaauuagccaggguaugucugugcagcuccaugucccauacagcgagcacgcuaaggcccccgugggcccuguaacuauggggcugccacuaccgauggaucccaagaaacuggcuccuuuuuccggagugaagcaagagcagcucucaccacggggccaggcaggucccccugaaagucuggggguuccaacagcccaggaggccagcguccuuagaggcacggcuuugggaucugugcccggcggguccaucaccaaaggaaucccuucaacuagggugccgagugacagcgcgauuacauaucgcggcuccauaacccacgguacaccagcagauguccuguacaaggggacuaucacccgaauuaucggagaagacucucccucgagauuagaucggggcagggaggacagccucccuaaaggucauguuauuuaugagggcaagaaggggcacgugcugucauacgaaggaggcauguccgugacgcaaugcaguaaagaggaugggcgcucuagcuccggacccccacaugaaaccgccgcuccuaagcguacauacgacaugauggagggcagaguaggucgggccaucucaucugcaagcauagaagggcuuaugggaagggccauacccccagagcgccacaguccgcaucaccugaaagagcagcaccauauucgaggcuccaucacucaggguauuccuagaagcuaugucgaagcucaagaggauuacuugcggagggaagcgaagcuccugaaacgcgagggcacacccccacccccuccacccucuagagaccuaacagaagccuauaagacucaggcacuggggccucucaagcugaaaccggcucacgagggacuuguggccaccguuaaggaggcaggcaggucaauccaugaaauaccacgggaggaauugcgucacacgcccgagcugccuuuagccccacgcccccucaaagaaggguccauuacacagggaaccccucugaaguacgauacuggcgcuaguacaaccgguagcaaaaagcaugacgugcgaucgcuuaucgggucucccggaagaacuuucccaccgguccacccucuggaugugauggccgacgcgagggcacuagagcgggccuguuaugaggaaucccucaagagccgccccggcaccgcuucaaguucugguggcuccauugccagaggggcuccaguuaucgugccugagcugggaaaacccaggcagagcccauugacauacgaagaccacggcgcaccuuuugccgggcaucugccccggggaucaccgguaacgacccgagagccaacuccuagauuacaagagggcagucucagcuccucuaaggcuagccaggaucgcaaacugacauccacccccagggaaauagccaagucaccacacucuacaguccccgagcaucacccucacccgaucaguccauaugaacaucuucugcggggugugucggggguggacuuguaccguagccacauuccccucgcauucgauccuacuuccauccccagaggcauuccacuggacgcggccgcugccuacuaucuaccuaggcaucuggcacccaauccaaccuacccucaccuuuauccgcccuaccucauccgcggcuauccagauacggcugcccuggagaaccggcagacaauaauuaaugacuacaucaccucucagcaaaugcaucacaacgcagccacugcuauggcgcagcgagccgauauguugagaggccugucaccuagggaaagcuccuuagcacucaauuaugcugccgggccccgcggaaucauugaccugagucaggucccacaccuuccuguucuggugcccccgaccccagguaccccugccacugcaauggaucgguuggcuuaccuccccaccgccccacagcccuuuucuagcagacauucauccaguccucugagccccggcgggccaacacaccuaacgaaaccuaccacuacaucuuccucagagcgugagagggaccgggaucgcgaacgagacagagacagggagcgggaaaagagcauccugaccucgacuacaaccguagagcaugcgccgauuuggcgccccggaacggaacaaucuaguggcuccagcggugggggaggcggcucauccucuagaccagcuagccacagucacgcccaucagcacuccccuauaagccccaggacucaggaugcacuucagcaacgaccaucugugcuccauaacaccgggaugaaaggaaucauuacagccgucgagccuucaacccccacugugcugcggaguacauccaccagcucuccgguucguccugcugcaacauucccacccgccacucacugcccuuuggguggcaccuuagacgggguguacccaacgcugauggagcccguccuccugccuaaggaagcgccaagaguggcucgccccgagaggccgcgggccgauacaggacaugcauuucuugccaagccucccgcuagaucgggccuggaaccagccucaagccccuccaaagguagugagccucgcccauugguucccccugugucugggcacgcaaccaucgcuaggacuccagccaagaaucuagcgccgcaccaugccagccccgacccuccagcacccccugcuuccgccucagauccacaccgagagaaaacccagaguaagcccuucucuauucaggagcuggagcuccggagccugggauaucauggcuccucauacagcccggaaggcgucgagccuguaucuccaguguccagucccagccuuacacacgacaaaggguuaccuaagcaccuggaggaacucgauaagucgcauuuggagggagaacugagacccaaacaaccagguccgguuaagcucggcggggaggcagcucaucugccucaucuuaggccccugccagaaucccagcccucuucaagcccuuugcuacagacugccccaggagugaaaggccaccagcgcgucgugacccuggcccaacauaucagugagguaauaacgcaggacuauacacgucaccacccccagcagcucuccgcgccuuuaccagcuccgcuguacucuuuucccggugcaagcuguccugugcuugaucugcggagaccacccucagaccucuauuugccuccacccgaucauggggccccugcuaggggauccccgcacagugaaggcggcaagcgcagccccgagccaaacaaaaccucuguccuagggggaggugaggacggcaucgaaccuguuucacccccagaggggaugacugaaccuggacauucccgaagcgccguguacccccuccuguaucgggauggcgagcaaacagaaccaucuagaauggguaguaagucgccggggaauaccucccagccucccgcauucuuuagcaaacuuacugagucaaacucugccauggugaaaagcaagaaacaggagauuaauaagaaacuaaacacacacaauaggaacgaaccagaguacaauaucucccagcccggaaccgaaauuuucaacaugccugcuaucacgggcacuggccugaugaccuaccgcagucaagcgguccaggagcaugccucaacaaacaugggguuggaagcaauaauuagaaaggcuuuaaugggagguggcgggaaggccaaagugucuggacggccaagcuccaggaaggcaaaaagucccgccccuggccuggcuagcggugaccguccgcccuccguuucuucaguacacagcgagggggacugcaaucgacgcaccccacucacaaacagagugugggaggaucggccuucguccgccggcaguacucccuucccauauaauccucugaucaugaggcuucaggcgggagucauggcaucucccccaccgccuggccugcccgccgggagcggaccacucgcugguccucaccaugccugggacgaggagcccaagccauugcuguguucacaauacgaaacccuauccgauucugaguga

SEQ ID NO: 59548 - RNA, 912 nt, Artificial Sequence
  derived and/or modified sequence opt3 from NCR1__Homo_sapiens__NP_001138929
augagcuccacccugcccgcccuccuuugcgugggccuguguuugucucagagaaucucagcucaacagcagacauuaccuaagccauucauuugggcagagccgcacuuuaugguccccaaagaaaagcagguuacuauaugcugucaagggaacuacggagccguggaguaucagcugcauuucgaagguagucuauuugcgguagacaggccuaaaccacccgagcggaucaauaaggugcaguucuacauuccugauaugaacagccgcauggcuggccaguauuccugcaucuaccgagucggggaacucuggucugagccaucgaaucugcuugaccuggugguuacggagauguaugauacccccacauugucagugcacccuggaccagaagucauuagcggcgagaaagugacuuuuuacugucgucucgacaccgccacaaguauguuccugcugcucaaggaagguagauccucucauguacaaaggggguauggaaagguucaggcagaguuuccguuaggccccgugaccacugcccaccggggcacauaccgcugcuucgggagcuacaacaaucaugcuugguccuuuccuucagagccagucaaacugcuugugaccggagauaucgaaaacacgaguuuggcacccgaggacccuacuuucccagauaccugggguacauaucugcuaacuaccgaaacaggccuccagaaggaccacgcccugugggaucacaccgcucagaaucuucugagaaugggguuggccuuucucgugcuggucgcguuaguuugguuccugguggaggacuggcucagcaggaaacggacgcgcgaacgagcaucuagagccuccacuugggagggaaggcggcgucuuaacacacaaacccuguga

SEQ ID NO: 59549 - RNA, 813 nt, Artificial Sequence
  derived and/or modified sequence opt3 from NCR2__Homo_sapiens__NP_001186438
auggccuggagagcucugcacccccuccuucuguuguuacugcuauucccuggcagccaggcacaauccaaggcccaggugcuccagucugucgcggggcagacccugacaguuaggugccaauacccaccgacuggaucacuuuaugagaaaaaggguugguguaaagaagcuagugcccuggugugcauccgguugguaacgagcuccaagccccgcaccauggcauggacaucucgauuuacuauuugggacgauccugacgccggcuucuuuaccgugacaaugaccgaucuccgugaggaagacucggggcauuacugguguagaauauauaggccaucagauaacagcgucaguaaauccgugcgguucuaccugguugugucucccgcuagcgcauccacucagacaucauggaccccucgcgaccuggucaguagccagacgcagacucaaucuugcgugccacccaccgccggagcuagacaggccccugaguccccaucaacaaucccgguacccagccacccuaguucuccacuccccguuccuuuaccauccaggccccagaauagcacucugcggccgggcccugcggcacccauugcccuugugccagucuuuugugguuugcugguggcuaagucgcuagugcucucugcccugcuugucugguggguucugcgcaaccgacauaugcagcaccaagggagauccuugcuccauccugcacagcccaggccacaggcucaccggcacuucccccugucacaucgugccccuggaggcaccuauggcgggaagccauga

SEQ ID NO: 59550 - RNA, 534 nt, Artificial Sequence
  derived and/or modified sequence opt3 from NCR3__Homo_sapiens__NP_001138938
auggccuggaugcugcuccuuauccugauuauggugcaccccggcagcugcgcuuugugggucucccagccuccagagauaagaaccuuagaagggucuucagcauuccugccguguaguuuuaacgccagccaaggaaggcuagcgaucgguuccguuacaugguuccgggacgaggugguacccggcaaggaagugcgcaaugggacuccugaguuucgaggacgucucgcuccacuggccucuucgagauuccuucaugaucaccaggcagaacugcauauuagggacguccggggccacgaugccucaaucuacgugugccgcguugagguguugggucucggggucggaacgggcaacggcaccagacuggugguagagaaagaacauccccagcugggggcuggaacaguucucuuacugagggcagguuuuuaugccgugagcuuccuuagugucgcugugggcuccacuguguacuaucaggggaaguacgccaaaucuaccuugagcggauuuccucaacuguga

SEQ ID NO: 59551 - RNA, 1365 nt, Artificial Sequence
  derived and/or modified sequence opt3 from NCR3LG1__Homo_sapiens__NP_001189368
augaccuggagagccgcugcaagcacaugcgccgcgcugcucauccuucugugggcuuugacuacggagggcgacuuaaagguggaaaugauggccgggggaacccagauuacaccccugaacgauaaugucacuauauucuguaacaucuuuuacucccaaccucuaaauauuaccucuauggguaucacaugguucuggaaaucacucaccuuugacaaggagguuaaaguguucgaauuuuucggcgaucaccaggaggcauuuaggccaggggccauuguaaguccguggcggcuuaagagcggagacgcuucccuucgccugcccggcauccaguuggaagaggccggugaguaucgaugcgaaguggucgugacuccucucaaagcacaggggacaguucaacuggagguggucgcuucuccagccucgcgucugcucuuagaucaggugggaaugaaggaaaacgaggacaaguacaugugugagucaagcggcuucuaucccgaagcgauaaauaucaccugggagaaacagacgcagaaguuuccucauccaauugaaaucagugaggauguaauuacuggccccaccaucaaaaacauggacgggacauucaauguuacuuccugccugaagcugaacucuagccaagaagauccuggaaccguguaccagugugucgugagacacgcauccuugcauacaccacugaggucaaauuuuacccuaacggccgcucggcacagucucagcgagacugagaaaacagacaacuucucuauacauugguggccgauuuccuuuaucggugugggccugguccuucugauuguuuugauccccuggaagaagaucugcaauaaaucaagcagugccuauaccccucucaaguguauucugaaacacuggaacucuuucgauacucagacauuaaagaaagaacaccugauauucuuuugcacccgcgcauggccauccuaccagcuccaagacggggaggcuuggcccccugaaggaagcgugaauaucaacacgauucagcagcuugauguauucuguagacaagagggcaaguggucggaagugccauauguccaggccuuuuucgcgcugagggacaaucccgacuugugccaguguugccggaucgauccggcccuacugaccgugacaucugguaaauccauagacgauaacucaacuaagagugagaagcagaccccucgcgagcauagcgacgcaguucccgaugcuccaauucucccugugucccccaucugggaaccacccccugccacaacuucuaccacaccaguccugagcucacaaccgcccacccuucuguugccucuccaguga

SEQ ID NO: 59552 - RNA, 519 nt, Artificial Sequence
  derived and/or modified sequence opt3 from NCS1__Homo_sapiens__NP_001122298
auggccaccaucacagagaaggaagugcagcaaugguacaaaggcuucauuaaggacugccccagcgggcagcuggaugcugcaggauuucagaaaauauauaagcaguucuuuccuuucggugacccaacuaaauuugccacguucgucuuuaacguuuucgaugagaauaaggacggcagaaucgaauuuuccgaguucauucaagcgcucucugugaccucaagggggacacuugaugaaaagcugcggugggcuuuuaaauuguacgacuuagauaacgacggauauaucacucgcaaugagaugcuggauauuguagacgccaucuaccagauggugggcaacaccgucgagcuaccggaagaggaaaauacacccgagaagcgaguggaucguauauucgcaaugauggacaaaaacgccgaugguaagcucacccugcaggaguuucaggaagggaguaaagcugacccuagcaucguucaagcacuuucccuguaugacggauugguguga

SEQ ID NO: 59553 - RNA, 2070 nt, Artificial Sequence
  derived and/or modified sequence opt3 from NCSTN__Homo_sapiens__NP_001277113
auggacuucaaccugauccucgagagccuuugcagaggcaauuccguggaaaggaagauuuacauaccccugaacaaaaccgccccuuguguccgguuguuaaaugcuacacaccagaucgggugccaaucuucaauuaguggagauacugguguuauccaugugguagagaaggaagaggaccugcagugggugcuaacggauggcccaaacccgcccuauaugguccuccuggaaagcaaacacuuuacccgcgaccuuauggagaagcugaaagggcgaacaucccguauugcaggauuggccgugucucucacuaagccuucgccagcgucaggcuucagccccaguguucaguguccuaaugaugguuuugggguguacuccaacucuuauggaccagaguucgcucauugcagagaaauccaguggaauagccugggcaacggccuggccuacgaggacuuuuccuuccccauauuucucuuagaagaugagaaugagaccaaggucaucaaacaauguuaucaggaccacaaccugucacagaaugggagugcaccuacauucccacuuugcgccaugcaguuguuuagccauaugcacgcugugauuucuaccgcaacuuguaugaggcgguccucaauccaaagcacauucaguauuaacccggaaaucguaugcgauccccugucugacuacaauguuugguccaugcuaaagccuauaaacaccacgggaacucucaaaccagaugaccgcguggucguggccgcuaccagacuggauagcaggucguuuuucuggaauguggcccccggugcggagucugcagucgccuccuuuguuacacagcuugcugccgcagaagcucugcagaaggccccugacgugacuaccuugccacggaacguaauguucguguucuuucagggcgagacauucgacuauauugggucaagucgcauggucuacgauauggaaaaaggaaaguuucccgugcaacucgagaacguugacagcuucguggagcugggccaggucgcguuacgaaccucccuggaacucuggaugcacacggauccggugucucagaagaaugagagcguaagaaaccaaguugaagaccuucuggccacuuuggagaaaucaggugcaggggugccugcugucauccuaaggcggcccaaucagagucagccacugccucccuccagccuccagcguuuucugcgcgccagaaacauuucuggagugguccuugcugaucauucaggcgccuuccacaauaaguacuaucaaaguaucuacgacacagcagaaaacaucaaugugagcuauccagaguggcugucccccgaggaagauuugaacuuuguuaccgacacugccaaagcucucgcggauguggcaacaguacugggcagggccuuauacgagcuggcugggggaaccaauuucucugacacgguccaggccgauccucagaccgugacacggcuacucuaugguuuucugauuaaggcaaacaauucgugguuccagagcauacuucgacaagacuugcgcuccuaccugggcgacgggccacuccagcauuauaucgccguuucaaguccgacuaacaccacauacgugguccaguacgcucuggccaaucuuacuggaaccgugguaaaccugacaagagaacagugucaagaucccucuaaagugccuagcgagaauaaggacuuguaugaauacuccuggguucagggcccacuccacucaaacgagaccgauaggcugccccggugcguccgcagcacugcaagauuagcgagggcucugucuccugccuuugagcuaucccaguggaguagcacggaauauucuacauggaccgagucccguuggaaagacauucgggcacgaaucuuccucauagccucaaaggaacuggagcuuauuacuuugaccguggguuuugggauccugaucuucagucucauugugacauacuguaucaacgcuaaggccgauguccuguucauugcaccaagagagcccggcgcuguuagcuauuga

SEQ ID NO: 59554 - RNA, 1929 nt, Artificial Sequence
  derived and/or modified sequence opt3 from NDC80__Homo_sapiens__NP_006092
augaagagaagcuccgugucuucaggcggggccggaaggcugaguaugcaggagcuccggagccaagacgucaacaaacagggucuuuacacaccccagaccaaggaaaaaccuacuuucggcaagcuguccaucaauaaaccaacgucugagcgcaagguuucguuguuugggaagcgaaccucaggacacggcagccguaacagucaguuagguauuuucuccucuagcgagaaaauaaaggauccgagaccccugaaugacaaggcuuuuauccaacagugcauuaggcagcuaugugaguuccucacagaaaacggguaugcacauaauguguccaugaaaucacugcaggccccuaguguaaaagauuuucuuaagaucuucacuuuucuguacggauucuugugcccaagcuaugagcuccccgacaccaaguuugaggaagaggugccucggauuuucaaagaucugggcuacccauuugcgcugucuaaguccucaauguauacagucggcgcuccccacaccuggccucauaucguggccgcacucguuugguuaauagacuguaucaaaauucacacugccaugaaggaaagcaguccacuguucgaugacgggcaaccguggggagaggagacagaagaugguaucaugcauaacaaauuguuucuugacuacaccauuaagugcuaugagucuuucauguccggcgcugauagcuucgacgaaaugaaugcagagcugcagucgaaacuaaaggaucucuuuaacguggacgccuucaagcuggaaucucuugaggcuaaaaaucgcgcccugaacgagcagaucgcgagauuggaacaggagagggaaaaggagcccaaucggcucgaaucccugcgcaaauuaaaggcaucacugcaaggggacguccagaaauaccaggccuacaugaguaaccucgagagccacuccgcuauacuugaucaaaagcugaauggauugaacgaggaaauugcccgaguggagcuagaaugugagacgaucaagcaggaaaauacuagacugcagaacauuaucgacaaccagaaauauucuguagcagauaucgagaggauuaaucacgagcggaacgaacuccaacagaccauaaauaagcugacaaaagaccuugaggcugaacagcagaagcuguggaacgaggaguugaaauacgcccguggcaaggaagcgaucgagacucaacucgccgaauaucauaagcuggcacgcaaauuaaagcugauuccuaaaggugcugagaauagcaagggguacgauuuugaaaucaaauucaacccagaggccggagcuaauugccuaguuaaguauagagcccagguguacgucccccucaaggagcugcuuaacgaaaccgaggaagagauaaauaaagcauugaacaagaaaaugggccuggaagacacacucgagcagcugaaugccaugauuaccgagucaaagaggagugugcggacgcuuaaagaagaggugcagaagcuggaugacuuguaucaacagaaaaucaaggaagcugaggaagaggaugagaagugugcguccgaacucgagagccuggaaaaacacaagcauuuacuggagucuacugucaaccagggccuaucagaggcaaugaaugaacucgacgccguucagcgagaguaccaacuggugguacagacaaccacugaagaacgcagaaaaguggggaacaaucuucagagguugcuggaaauggucgcuacacacgugggaaguguugagaagcaccucgaggaacaaaucgccaaaguggaucgggaguacgaagagugcaugagcgaagaccuguccgagaacauuaaggagauccgcgacaaguaugagaaaaaggcaaccuuaauuaaaucuucggaagaauga

SEQ ID NO: 59555 - RNA, 1008 nt, Artificial Sequence
  derived and/or modified sequence opt3 from NDE1__Homo_sapiens__NP_060138
auggaggacagcggcaagaccuucuccucugaagaggaagaggccaacuacuggaaagaucuggcuaugacauauaagcagagagcagaaaauacucaagaggagcucagggaauuucaggaggggucacgggaauacgaggccgagcuugaaacgcagcugcagcaaaucgagacccgcaaccgagacuuguuaagugaaaauaaccgucugagaauggagcuagaaacaauuaaagagaaguucgaggugcagcacagcgaaggauauaggcagauauccgcgcucgaggaugaccuggcucagacuaaagccaucaaggaucaacuucagaaguacauucgggaacuggagcaggcaaaugacgauuuggaacgcgccaaaagagcuaccaucaugucucucgaggacuuugagcagaggcugaaccaagcaauugaacggaaugccuuccuggagucggaacucgaugagaaggaaaacuuacuggagucaguccagcgccuuaaagacgaggcucgagauuugagacaggaacuggccguucaacagaagcaggagaaacccaggacaccuaugccaagcaguguggaagcggagcggaccgacacugcaguacaggccacagguuccgugccgucuacccccaucgcucaucguggcccuagcuccucacuaaauacgccagggaguuuucgcagaggacucgaugacagcacuggcgguacaccccugaccccugccgcaaggauaucugcucuuaacaucgucggggaccuguugcggaaggugggagcccucgaguccaagcuggcgucaugccgaaauuuaguuuaugaucaaagcccaaaccgcacuggcggccccgccagugggagaucuuccaaaaauagggacggaggugaacggcgcccuagcucgaccucugugccacugggcgauaaggggcucgacacauccuguagauggcuuucaaaaaguaccacgaggagcuccucuagcugcuga

SEQ ID NO: 59556 - RNA, 987 nt, Artificial Sequence
  derived and/or modified sequence opt3 from NDEL1__Homo_sapiens__NP_001020750
auggacggcgaggauauccccgacuucagcucccugaaggaagagaccgccuacuggaaagaacucucucuuaaguauaaacagucauuucaagaggcuagagaugaacugguggaguuccaggaggggaguagggaauuggaggcagaauuagaggcccagcugguccaggcggagcaacggaaccgcgaccuacaggcugauaaucagcgacucaaguacgaaguugaggcccugaaagaaaaacuugagcaccaguaugcacaaagcuacaaacagguguccguacuggaagacgauuugucucagacacgugccauuaaggagcagcuccauaaguaugugagagagcuggaacaagcuaacgacgaucuggagagggcaaagcgggccacuauagucucgcucgaagacuuugagcagcgcuuaaaucaggcuaucgaaagaaacgccuuccuggagucagagcuugaugaaaaggagagcuugcuggugaguguucaaaggcuaaaagacgaagcgcgggaucuccgccaggagcuggcagugcgagaaagacagcaggaggucacgaggaaguccgccccuucuagcccaacccuugacugcgagaagauggacuccgcugugcaagccucacugaguuugccggcaacacccguaggaaaagguacugaaaauaccuuuccuagcccaaaggcuauucccaacggcuucgggacaucuccucucaccccauccgcccggaucucagcgcugaauauuguuggagauuuacugcguaaagugggcgcccucgagagcaaacuugcagcuugucgcaacuuugccaaggaccaggcuaguagaaagucuuacaucuccgguaaugucaacugcggggugcugaauggaaacggcacuaaauucagcaggucgggccacacaucuuucuuugauaaggggcaggaaaaggugauauuucccaccuuguucaugggacaguga

SEQ ID NO: 59557 - RNA, 666 nt, Artificial Sequence
  derived and/or modified sequence opt3 from NDFIP1__Homo_sapiens__NP_085048
auggcccuggcucucgcagcccuugcggcuguggagcccgccugcggcagcagauaccagcaacugcagaacgaagaggaauccggggagccugaacaggcagccggagacgcuccaccgcccuauucuucaaucagugcagagagcgccgcuuacuucgauuauaaggacgaguccgguuuuccuaaaccacccucuuacaaugucgccaccacauugccuucguaugaugaagcggagaggacuaaggcagaagccacgauuccauuaguucccggccgggacgaggauuucguggggcgcgacgauuuugacgaugcugaccagcugcgaauaggaaacgauggcaucuucaugcuaaccuuuuucauggccuuucucuucaauuggauuggguuuuuccugucauuuugucuuacaacuagcgcagcuggucguuacggagccaucaguggcuucggccuguccuugauuaaauggauccucauaguaagauuuucuaccuauuucccuggguacuucgacggacaauacuggcugugguggguguuucugguccucgguuucuuacuguuucuuaggggcuucaucaacuaugcgaaggugcggaaaaugccagagacauuuagcaauuugccgcgcaccagaguucuguucauuuacuga

SEQ ID NO: 59558 - RNA, 1011 nt, Artificial Sequence
  derived and/or modified sequence opt3 from NDFIP2__Homo_sapiens__NP_061953
auggccagaaggcggagccagcgcgugugcgcuuccggccccucuaugcugaacucagcacgaggggccccugagcuccuucguggaaccgcgacaaaugcugaagucagugccgcagccgcuggugcaacuggcagcgaggaacugccaccgggggacagaggauguaggaacggcggugggcggggacccgccgcuacgaccuccucuacaggcguugccgugggcgcggagcacggggaagauucguugucacgcaagccugacccagagcccggaagaauggaucaucaccaaccugguacuggcagguaccagguauuacugaaugaggaagacaacagcgagaguuccgcaauugaacagccacccaccucuaauccugccccacagauugugcaagcugccagcuccgcaccggcucuagagacagauucaagucccccuccauauagcucuauaaccgucgaggugcccacuacauccgacaccgaaguuuacggggaguucuauccugugccacccccguacucagucgccacgagccucccuacuuaugaugaagcggagaaagccaaggcagcugccauggcugccgcagccgcugaaaccagucagcggauccaggaggaggaaugucccccacgcgacgauuuuucugacgcggaucagcugcgagugggaaacgacggcauuuucaugcuugcauuuuucauggccuuuaucuucaauuggcuggguuuuugcuuguccuucugcauuacaaacacuaucgcugggagauacggagccauauguggcuuuggccucagccugaucaaauggauucugaucguaagguucucggauuauuuuaccggguacuucaauggacaauacuggcucugguggaucuuuuuaguucugggucuuuugcuguucuuccggggcuuugugaacuaucuaaagguccguaauaugucugaguccauggcagccgcucaucgcacaagauacuucuuucuccuguga

SEQ ID NO: 59559 - RNA, 1707 nt, Artificial Sequence
  derived and/or modified sequence opt3 from NDNF__Homo_sapiens__NP_078850
auggugcugcuccacuggugccuucugugguuguuauucccccugagcuccagaacccagaagcuaccuacaagggacgaggaacucuuucaaaugcagauccgggauaaagccuucuuucaugacucuucagucauuccagauggcgcugagauaaguagcuaccuguuccgcgacacuccgaagcgauacuuuuucguuguggaagaggauaacacgccccuuuccguaaccgugacaccuugugacgcaccacuggaauggaaauugucucuccaggagcugcccgaggaucguucgggggaaggaucaggugaccuggagccucucgaacagcaaaagcagcagaucauuaaugaggagggcacugaauuauuuagcuauaaagggaacgaugucgaguauuucaucaguuccucuagcccauccggacuguaccagcuugacuugcugucaaccgaaaaggauacacacuuuaagguguaugccaccacuacacccgagagugaccaaccuuacccagaacuaccguaugaucccagaguugacgugaccagccucggcaggacgacugucacccuggcguggaaaccuucuccaacagcuucccuucugaagcagcccauucaguacugcgugguaaucaauaaagagcauaacuucaagucauugugugccguugaggcaaaacucagcgccgacgaugcuuuuaugauggcaccuaagccaggucuggacuucagucccuuugauuucgcccacuucggguuuccgucugacaauuccggaaaggaacggagcuuccaggcuaaaccuucgcccaaguuaggccgccauguguacucuagaccaaaagucgauauacaaaagaucugcauuggcaacaaaaauaucuuuacuguguccgaccugaagccugauacccaguauuacuucgacguguuugucguuaacauuaauucaaacaugaguacagccuauguggggaccuucgcgaggacgaaagaggaagcaaagcagaagacuguagagcucaaagauggaaagaucacagacguguuugucaaacggaagggugccaaauuccuucgcuuugcucccgugagcucccaccaaaagguuaccuucuuuauacacucuugucuggaugccgugcagauucagguccgaagagacggcaaguugcuacugagccagaauguggaagggauccaacaguuccagcucaggggaaaaccaaaggcaaaauaccugguacggcuuaagggcaacaaaaagggugcuucaaugcugaagauuuuggccacuacacgucccaccaaacagaguuuuccuucccucccagaggacacgcgcaucaaggcguucgauaaacugagaaccugcagcucugccacaguugcaugguuagggacucaagagaggaauaaguucuguaucuauaaaaaggaaguggacgauaacuacaaugaggaccagaagaaacgggaacagaaccagugccugggaccggauauucgaaagaaaucagagaagguccuauguaaauauuuucauagucaaaaccuccagaaggcugugaccacagaaacuauaaaaggccugcagcccggcaagagcuaccuuuuggacgucuacgugaucgggcacggaggucauuccguuaaguaucagucuaaagugguaaagacccgcaaauucugcuga

SEQ ID NO: 59560 - RNA, 966 nt, Artificial Sequence
  derived and/or modified sequence opt3 from NDN__Homo_sapiens__NP_002478
augagcgagcaguccaaggaccugucugaucccaacuucgccgcugaagcaccuaauucagaggugcacaguagcccaggcgucuccgaagggguuccgcccucugccacccucgcggagccucaaucgccaccccuuggaccuacagcugccccacaggcagcucccccuccacaggccccgaacgacgaaggugaucccaaagcacugcagcaagccgcugaggagggcagagcccaucaggcgccuucagcagcccagccagggcccgcuccuccagcccccgcacaguuggugcaaaaggcucacgaauuaaugugguacguacuggugaaagaccagaagaaaaugaucauuugguuuccggauauggucaaggacgugauaggaagcuauaagaaauggugcaggaguauccuacggcgcacuucccucauucuggcccgaguuuucggccuucaucugcguuugacgucucuccacaccauggaguuugcgcuggugaaggcccuggaaccugaggagcucgauagagucgcauuaagcaauaggaugcccaugacaggucugcuuuugaugauccugucccuaauuuacgugaaagggcggggagcucgcgaaucagccguauggaacguucucagaauccugggccuuaggccauggaagaaacauaguacuuucggcgacgugcggaagcugauaaccgaggaauuuguccagaugaauuauuugaaguaccagcgcgugccuuauguggagcccccagaauacgaguucuuuugggggagccgagcuucuagagagaucacaaaaaugcaaauuauggaguuccucgccagggucuuuaagaaagauccccaggcauggccuucccgguaucgugaagcccuggaagaggcucgcgcguuaagagaagcaaacccaaccgcccacuacccgaggucaagcguuagugaggacuga

SEQ ID NO: 59561 - RNA, 402 nt, Artificial Sequence
  derived and/or modified sequence opt3 from NDP__Homo_sapiens__NP_000257
augagaaagcacgugcuggccgcuagcuucuccaugcucucucuucuggucaucaugggcgacaccgauucaaaaacagacaguagcuuuauuauggauuccgaccccaggcggugcaugcgccaucacuacguugauucuauaucgcauccuuuguauaaguguucaagcaaaaugguguuacuggcacgaugcgaggggcacuguagucaggccucccguucugaaccgcuagugagcuucuccacuguacucaagcaaccauuuagaucaaguugccauuguugcaggccccagacgagcaaacugaaggcgcuucggcugcgcuguucuggagguaugagauugaccgcuacauacagguauauccucuccugccacugugaggaaugcaacucauga

SEQ ID NO: 59562 - RNA, 1185 nt, Artificial Sequence
  derived and/or modified sequence opt3 from NDRG1__Homo_sapiens__NP_001128714
augagcagagagaugcaggacguggaucuggccgaagucaagccccucguugagaaaggcgaaaccaucacagggcuucugcaagaguucgacgugcaggaacaggauauugagacuuugcacggauccguacaugugacguuaugcgguaccccuaagggcaacaggccagucauacugacauaccacgacaucgggaugaaucauaaaacuuguuauaacccgcuauuuaauuacgaggauaugcaggaaauuacccaacacuucgcugugugccauguugacgcacccggacagcaggauggcgccgcgucuuuuccugcugguuauauguacccaucaauggaccagcucgccgagaugcugcccggggugcuucaacaguucggacugaagaguaucauuggcaugggcacaggggcaggagccuauaucuugacccgguuugcucucaacaauccugaaauggucgagggucuggugcugauaaacguaaauccaugugcagagggcuggauggauugggccgcuagcaaaaucuccggguggacucaggcccuccccgacaugguugugucucacuuauucggaaaggaagagaugcagucgaacgucgaaguggugcacacauaccgccaacauauugucaaugauaugaacccuggcaaucugcaccuuuuuaucaacgcguauaauucacgacgugacuuggagauugaaagaccaaugccggguacccauacgguuacucugcagugccccgcacuacucgugguaggggauagcaguccugccguggacgcugucguggaguguaacuccaagcuggacccaaccaaaacaacucuucugaagauggccgauugcggaggcuugccccagaucucucaaccugcaaaacucgcugaggccuucaaguacuuuguucagggcaugggguacaugccaagcgcguccaugaccaggcugaugcggucacgcacagccaguggaagcucugugaccuccuuagacgguacgagaucaaggagccacacaagugaaggcacucggucucgcucccacaccagcgaggggacucgaucgagaucucauacauccgaaggagcacaccuggauauaacccccaauucaggcgcugccgguaacagugcugggccgaaaagcauggaggucuccuguuga

SEQ ID NO: 59563 - RNA, 1104 nt, Artificial Sequence
  derived and/or modified sequence opt3 from NDRG2__Homo_sapiens__NP_001269140
auggagaacggcgggagcaugcaggccaccauggcugaacugcaagaggugcagaucacagaagagaagccccuccuuccuggacagacuccagaagcagccaaaacgcacuccgucgagaccccguacgguucuguuacauucacuguguauggcacccccaagccuaaaagaccagcgauucugacauaccaugacguaggguugaauuauaagucaugcuuucagcccuuauuccaauuugaggauaugcaggaaauaauccagaacuucgugaggguccacguggacgcuccuggaauggaggaaggcgccccaguuuuuccccuggguuaccaguauccuagucuagaucaacucgcagacaugauuccaugugugcugcaguaccuuaauuucagcaccaucauuggggucggagugggcgccggcgcuuauauccuggcacgguacgccuugaaccauccggauacuguagaggggcucguucugauaaauaucgaccccaacgcuaaaggauggauggauugggccgcgcacaagcugacaggucucaccuccucuauuccugagaugaucuuaggccaucuguuuucgcaggaagaguugucagggaauagcgaauugauucagaaguaccgcaacaucauaacgcacgcaccaaaucuggacaacauugagcuauauuggaauaguuacaacaaucgacgugaucucaacuucgaaagaggaggcgacaucacucugaggugccccgugaugcuugucgugggugaucaagccccucacgaggacgcuguggucgaguguaauuccaaacuggauccaacccagacaucuuuucuuaagauggccgacagcgggggacagccccaacucacucagccgggcaaacugaccgaagcauucaaguacuuuuuacagggcaugggguauauggcuuccucaugcaugacacggcugagucgcagcagaaccgccucucucacguccgcggccucaguugacggaaacaggagccggagucgcacucuuucucaguccagcgagucggguacacugucuuccggcccucccgggcauaccauggaagugucauguuga

SEQ ID NO: 59564 - RNA, 1092 nt, Artificial Sequence
  derived and/or modified sequence opt3 from NDRG3__Homo_sapiens__NP_071922
auggacgagcugcaggaugugcaacucaccgaaaucaagccccuucugaacgacaaagagcacgauauugaaacaacucauggcgucguucacgugacgauaagaggguugccuaagggaaauaggccaguaaucuuaaccuaccaugacauuggucugaaccacaaaagcugcuucaaugccuuuuucaacuuugaggauaugcaggaaaucacacagcauuucgcugugugucacgucgacgcaccgggccagcaagagggggcccccuccuuuccuacuggauaucaguacccaaccauggaugagcuagcggaaaugcugcccccugugcucacacaccuuucucugaagucaauuaucggcauagguguuggggcuggagccuauaucuugagucgguucgcacucaaucauccagagcugguggaaggccugguccucauuaacguggaccccugcgccaaaggcuggaucgauugggcugcaagcaaguuauccgggcugaccacuaauguaguugacauuauccuugcccaccauuuuggacaggaggaguugcaggcuaaccuggaucuaauacaaacauaccgcaugcacauugcccaggacaucaaucaggauaaccuccagcuguuccuuaauucuuauaacggucgacgugaccuggaaauugagagaccuaucuugggccaaaaugacaacaagucgaaaacccucaaguguucaacgcuguuaguggucggggauaauagcccagcgguggaagcaguggucgagugcaacaguaggcugaacccgaucaauacuacccuccuuaaaauggccgacuguggaggccugccccagguugugcagccugguaaguugacagaggcuuuuaaauacuuccuacaagggaugggauauauuccauccgccucuaugacucggcuggcacgcagcagaacccacuccacaucaaguagccucggcucuggcgaaucccccuuuucaaggagcguaaccaguaaccagucugaugggacgcaggaguccugcgaaagcccugacgugcuggaucggcaucagacuauggaggucucguguuga

SEQ ID NO: 59565 - RNA, 1176 nt, Artificial Sequence
  derived and/or modified sequence opt3 from NDRG4__Homo_sapiens__NP_001123959
augaaggugcugggccacagacucgagcuucugaccggguuguuacugcaugacgucacaauggccggacuacaggaacucagguuccccgaggaaaaaccucugcuucggggucaagaugcuacugagcuggaaagcuccgacgcauuuuugcucgccgcggauacggacuggaaggagcacgauaucgagaccccauacggccugcugcauguugugauucgcgggucuccgaaaggaaaccgacccgcuauacucacauaucacgacguaggcuuaaaucauaagcugugcuucaacaccuuuuucaauuuugaagauaugcaggagaucacuaaacacuucguggucugucacguggacgccccuggucagcagguuggggcaucacaauuuccacagggauaccaguuccccaguauggaacagcuugccgcuauguugccuagcgugguccaacauuuuggcuucaaguaugugauuggcaucgggguaggagccggugcauacguucuggcuaaguuugcccuaauuuucccagaucucguggagggccugguccuugugaacaucgaccccaaugggaaaggauggauagauugggcggcaacaaagcuguccggcuugaccucuacucucccugacacagugcugucgcacuuauuuucacaggaggaacuggucaacaauaccgagcucguucagagcuaucgucagcaaaucgguaacgugguaaaucaggccaaccuucagcuguucuggaauauguacaacaguagaagggauuuggacauuaaucggccagggacggugccgaacgcuaaaacucuacgcugccccgucaugcuggugguuggagacaaugccccugcagaagauggcguggucgaguguaacuccaagcucgacccaaccacaacuaccuuccugaaaauggcugauucuggcgggcuuccccaagugacacagccuggaaagcugaccgaagccuuuaaguauuucuugcaggguaugggcuacaugccaagcgcguccaugacgagacucgccaggucacggacugcaagucugacaagcgcuucuuccguagacgggucacgcccccaggccugcacccauagcgagaguucugagggauuaggccaaguuaaccacacuauggaaguguccuguuga

SEQ ID NO: 59566 - RNA, 2688 nt, Artificial Sequence
  derived and/or modified sequence opt3 from NDST1__Homo_sapiens__XP_005268491
augcccgcccuggcuugccucagaaggcuuugucggcacgugagcccucaggcaguccuguucuuguuauuuaucuucugccuguuuuccguuuucauuucugccuacuaucuauacggcuggaagcgcgggcucgagccaucagcggacgcuccggaacccgauuguggagacccuccacccguggccccuagucgacugcuuccacugaaacccguacaagcagccaccccuagccguacagauccauuggugcucgucuuuguggagucccuguauucucagcugggucaggaaguuguggcuauacucgagucgucaagauucaaguacaggacugaaaucgcaccgggcaaaggggacaugcccacguuaaccgauaagggacggggccgcuuugcccugauuaucuaugagaacauucuuaaauacgucaauuuggacgcuuggaacagagagcugcuagauaaguauugcguggccuacgguguagggaucauaggauucuuuaaggcgaaugaaaacagccuccugagugcacagcuuaaaggcuucccucuguuuuugcauuccaaucucggccugaaggacuguucuaucaacccaaaaagccccuuacuguacguuacaaggccuuccgagguggaaaaggggguccucccaggagaggauuggacuguguuccaaucaaaucacaguaccuaugagcccgugcuucuggccaaaacacggagcucugaauccauuccgcauuugggugcugacgccggccuacacgcagcucugcaugccaccgucguucaggaucucgggcugcacgacggaauccagcgcgugcuuuuuggcaacaaucugaacuucugguugcacaagcucguauucguggaugcggucgccuuucugacugguaagcgauuaucacugccucuagacagauacauucucguggacaucgaugacauauucguugggaaagagggaacaaggaugaagguggaagaugucaaagcacuguuugacacccagaaugagcuucgggcucauauucccaacuucacguuuaauuugggcuauagcggcaaguucuuucacacugggaccaacgccgaagaugcuggagacgaucugcuccugaguuacgugaaagaguucuggugguuuccacauauguggucucacaugcaaccucaccuuuuccauaaucaguccguacuggccgagcagauggcauugaacaagaaauuugccguugaacacgguauccccacagacaugggcuaugcuguggcgccacaucacagcggggucuaccccgugcauguccagcucuaugaggcauggaagcaaguguggucgauucguguuacuucuaccgaagaguacccucaccugaagccagcccgcuacagaaggggauucauccacaacggcaucaugguguuaccgcggcagacaugcggucuguuuacccauacgauuuucuauaaugaauaccccgggggcuccucagagcuagauaaaauaaucaacggaggcgagcuuuuccugacuguacuuuugaauccuauuaguaucuuuaugacacaccugagcaacuaugggaaugaccgacucggacuguacaccuucaagcauuuaguccgcuuucugcacuccuggacuaaccuuagauugcagacacucccacccgugcaacuggcucagaaauauuuccagauauuuucugaagagaaggauccucuauggcaggacccaugugaagacaaaaggcacaaggauauuuggagcaaggagaaaaccugcgaccgguuccccaagcugcucaucaucgguccgcagaaaacgggcaccacagcccuguaccucuuuuuggggaugcauccugaucugucaaguaauuauccauccagcgaaacuuucgaggagauucaauuuuucaacggacacaauuaccauaagggcaucgacugguacauggaauuuuuccccauuccuucuaacaccacaucagauuuuuauuucgagaaaagugcaaauuacuucgacagcgaaguugcuccccgcagagccgccgcauuacucccaaaggcgaaggugcugacuauacuuaucaacccugcugauagggccuauuccugguaccagcaccagcgugcacaugacgaucccgucgcccugaaauauaccuuucacgaggugauuacagcugguucugacgccucgagcaaguugcgggcacuccaaaaucgaugucugguaccagggugguacgcuacccacaucgagagauggcuauccgccuaucaugcgaaccagauccuggugcucgauggcaaacugcuuaggacugaaccggccaagguuauggacaugguccagaaauucuugggagugacgaauacaauugauuaccacaagacccuggcuuuugacccuaagaaaggcuucuggugccaguuacucgaagggggaaagacuaaaugucuggguaagucaaaaggccgcaaguaccccgagauggaccuugaugugagugggggacauaccacaugcucuaccugcauacggagcagagcauuucugaaagacuauuacagggaucacaacaucgagcuauccaagcuccuguauaagaugggccaaacuuugccaacauggcugcgcgaagacuuacagaacacgcgauga

SEQ ID NO: 59567 - RNA, 2448 nt, Artificial Sequence
  derived and/or modified sequence opt3 from NDST2__Homo_sapiens__XP_005270312
augcugcagcucuggaagguggucagacccgccaggcaacuugagcugcaccgguugaucuuacugcuaauugcuuucagccucggcuccaugggguuucuggcauacuauguuucuaccucaccuaaagccaaggaaccacuuccgcugcccuugggagacugcaguagcgguggcgcggcugggccuggaccagcccgacccccugugccaccccgcccuccacguccgcccgagacagcaagaacugaaccuguagugcucgucuucguggaguccgccuacucucagcugggccaggaaauaguugcuauccuggagucgucaagguuucgguauagcacggagcucgcaccaggucgcggggauaugcccaccuuaacagacaacacucauggaagauacgugcuggucauuuaugaaaaucuuuugaaauacgugaaccuggaugccuggaguagggagcuacucgaccgguauuguguagaauacggcguuggcaucauuggguucuuucgcgcucacgagcauucccugcuuucugcccagcugaagggauucccuuuguuucuccacagcaaucuggguuuacgagauuaccaagugaacccauccgcgccccugcuccaucuuaccagaccgucaaggcuggagccuggccccuugccaggggacgauuggacaaucuuccagaguaaucacagcaccuaugaaccuguccuacuggcaucucuccggcccgccgagccagcugugcccggaccugugcugcgucgcgccagacuuccaacugucguucaggaccugggcuugcacgaugguauacagagggugcucuuugggcauggacuguccuucugguuacacaaacugaucuuuguagacgcaguggcuuaccuaacaggcaagcggcucugccuggaucuugaccgauauauuuuggucgauaucgacgacauuuucgugggcaaggaagggacccgcaugaaaguugccgauguggaggcgcugcucacgacucaaaacaagcugagaacccuugucccgaauuuuacauucaaccugggauucucagguaaauuuuaccauacuggcaccgaagaggaggacgccggggaugacauguugcucaagcacaggaaagaauuuuggugguuuccccacauguggagccauaugcagccucaccuguuccauaaucggaguguguuagcagaucagaugcgccugaacaagcaguuugcucuagagcacggaaucccaacagaccucggcuaugccguagcuccccaucacucugguguuuacccuauacacacccaacuguaugaagccuggaaguccgugugggggauucaggucacgagcacugaggaauacccacaucuuagacccgcaagguaccgucggggcuucauccacaauggaauuaugguguugccgcgacagacauguggccuguuuacccauacuaucuucuauaacgaguacccugggggaucgagagagcucgauaggucuauccgcgguggcgaacuguuuuuaacaguccugcuuaauccaauuuccauauucaugacccacuugucaaacuaugggaaugaccggcucggacuguacacguuugagagucuagugagauuccugcaaugcuggaccaggcuccgccugcagacacuucccccuguucccuuggcccagaaauauuuugaacuguucccacaggagcgaagcccuuuauggcaaaaccccugugaugacaagcggcacaaagauaucugguccaaggagaaaacuugcgaccgucucccaaaguuccugauugugggcccgcagaaaaccgguacaacugcuauccacuuuuuccuuucucugcacccugcgguaaccagcucauuucccaguccauccacauucgaagagauacaguuuuucaacagccccaauuaccauaaggggauugacugguauauggauuucuucccugucccaucuaacgcaucaaccgacuuuuuguucgaaaagagugccacuuacuuugauagcgaggugguucccagaaggggcgcugcccuccugccucgcgcaaaaaucaucacggugcuaacaaauccggccgaccgggcuuacuccugguaucagcaccaaagagcccauggagauccagucgcacugaacuacaccuucuaucaggugauuucugcgucgagccagacuccccucgcucugaggucccuucagaaucgauguuugguaccuggcuacuauucaacccaucugcaacgcugguuaacauacuauccaagugggcagcuccugaucguggacggacaggaacuucggaccaaccccgccgcaucuauggagagcauucagaaguuucugggucuaaugaugauaagagauuucggcgccagggaccucaaaguuguccgucuggcuguguga

SEQ ID NO: 59568 - RNA, 2622 nt, Artificial Sequence
  derived and/or modified sequence opt3 from NDST3__Homo_sapiens__NP_004775
augagcuucaucaugaagcugcacagacauuuucagaggaccgugauucuccuugccacauucugcauggucuccauaaucauuucugcuuacuaucuguacucaggcuauaaacaagagaacgaauugagugagacugcaagcgaaguugacuguggggauuuacagcaucugcccuaccagcuaauggaggugaaggccaugaaacucuuugacgcgucccggacggauccuaccguacugguguucgucgaaucucaguauucgucacuuggacaagacaucauuaugauccuggagagcagucgcuuucaguaccacauagagaucgcuccagguaagggcgauuugccggugcucauugacaaaaugaaggggaaguauauccugauuaucuacgaaaauauacugaaauacauuaacauggauuccuggaaucgaucucucuuagacaaguauugcguugaguacggagugggcgucaucgguuuccacaaaacaagcgaaaaguccgugcagucauuucagcugaaaggguuccccuuuaguauuuauggaaaccuugccguaaaggauuguugcaucaauccucauagcccauugauccguguuacuaagucuuccaaacuggagaagggcucacuacccggcaccgacuggacaguguuccaaauuaaccacagcgcauaccagccugucauauuugccaaagugaagaccccagagaaucucagucccucuaucuccaaaggggcuuucuaugcaacuauuauccacgaucugggacuucaugacgguauacagagagugcuguuuggcaacaauuugaacuucuggcuccacaagcugauuuucaucgaugccaucagcuuuuuaucggggaaaaggcugacacucucucuugaccgguacauucuggucgacaucgaugacauuuucguuggaaaggaaggcacccgcaugaauacgaacgaugugaaggcuuugcuagacacucagaaucugcucagagcccaaauaaccaacuuuacauucaaucuggguuuuuccgggaaauucuaucauacuggaaccgaggaagaggaugaaggcgacgauugucuucugggcucaguagacgaguuuuggugguucccucacauguggagucacaugcagccacauuuguuucacaacgagagcucccucguggaacagaugauccugaacaagaaauucgcguuagagcaugggauuccgacagauaugggauacgcagucgcuccccaccauucugguguguacccuguucacgugcaacuguaugaagccuggaagaaagucuggaauaucaagaucaccagcacggaggaauacccacaccuaaagcccgccagguaucggcgcggcuuuauucauaaaaacauaauggugcucccucgacagacuugcgggcuguucacacacaccaucuuuuacaaggaguauccaggaggccccaaagagcuugacaagucaauucaggguggggaauuguucuucacuguaguucugaauccgaucaguauuuuuaugacacaucucuccaacuacggcaaugauagacugggacuuuauaccuucgugaaccuggcaaauuuugucaaaagcuggacgaacuugaggcuccagacccugccucccgugcaauuagcucacaaguacuucgagcuguuuccagaccagaaggacccucuauggcagaaucccugugaugacaaacggcaccgugauaucuggucuaaggagaaaacaugcgaccgccucccaaaguuccuggucauaggcccccagaaaacugggaccacagcccuuuacuuguuucuggugaugcauccuucaauccucaguaacagcccauccccgaagacuuucgaagaaguucaauuuuucaauagaaacaauuaucacaggggaauugauugguacauggacuuuuuccccgugccuucuaacguaaccacagauuuucuguucgagaagucggcgaauuauuuccauagcgaggaagccccaaaacgggcagcuuccuuaguccccaaggccaaaaucauuaccauccugauagacccuucagaucgagcuuacaguugguaucagcaccagcgcucucaugaggacccagccgcacuuaaguuuagcuucuacgaagugauuuccgccggucccagagcuccgucagaguugagggcgcuccagaaacggugucugguuccuggcugguaugcaagccacaucgagcgcuggcuaguguacuuuccacccuuccaacugcucauuaucgaugggcagcagcugagaacugacccugccacggucauggaugaagugcagaaguuucuuggaguauugccccacuacaacuauucugaggcucugacauucgacucccauaaaggcuuuuggugccaauuacucgaagaggguaagaccaagugucuggggaaaaguaagggcaggaaauacccaccuauggacagcgauucucguacuuuccuuuccucauauuaccgggaccacaacguggaacugaguaaguugcuccauaaacugggacagccccuaccaagcuggcugcgacaggagcuccaaaagguuagauga

SEQ ID NO: 59569 - RNA, 2619 nt, Artificial Sequence
  derived and/or modified sequence opt3 from NDST4__Homo_sapiens__NP_072091
augaaccugaucgugaagcucagaaggagcuuccggacccuuauuguccuguuggccacauuuugcuuaguuuccauagugaucucugcuuacuuccuguauucaggcuacaaacaggagaugacucuaauugaaacgaccgcagaggccgaauguacagacaucaagauucuccccuaucgcaguauggagcugaaaacuguaaagccuaucgauaccagcaaaacagacccaaccgugcuucuguuugucgaaucccaauacucucaguuggggcaggauauaaucgcgauucucgagucgucacgauuccaguaucacauggugaucgcuccgggaaagggugacauucccccucugacugauaauggcaaggggaaauacacacugguuaucuaugagaacauacucaaguacgugagcauggacaguuggaaucgugaauuacuggagaaauacugcgucgaauauuccgugucuauuaucggauuucauaaggccaacgagaauagccuuccauccacccaauugaaaggcuucccccugaaccuauuuaauaaccucgcacugaaggauuguuucguaaauccucagucaccacuucugcacauuacgaaggcccccaaaguugagaaggguccuuugccaggggaagacuggacuaucuuucaguacaaccauaguaccuaucagccggugcuccugacagaguuacaaacugagaaaagccugucuucccucucaagcaagacccuuuucgcuacagucauccaggaucugggauugcacgacggcauucagagagugcuauuuggcaauaaccugaauuucuggcuccauaaacugauauuuaucgaugcaauuaguuuccuuucugggaagaggcugaccuugucccucgaccgguacauccugguggauauagacgacauuuucgucggaaaagaggguacgcgcaugaacguuaaggaugugaaggccuuacuggaaacucagaaucuacucagaacacaaguagcuaacuuuaccuucaaccugggcuuuagcgggaaauucuaucacacuggaacagaggaggaagacgagggcgaugaccuuuugcugaggucgguggaugaauuuuggugguucccccacauguggucucauaugcagccucaccucuuucauaaugaguccucacuggucgaacagaugauccuuaacaaggaguucgcccuggagcacgguaucccaauuaauaugggguacgcgguggcaccccaccauaguggaguuuauccugugcacauccaauuguacgccgcuuggaaaaaggucuggggcauucaggugaccagcacggaagaguacccacaucucaaacccgcccgguaucgcaagggcuuuauacacaacuccaucaugguacugccgcgacagaccugcggguuauucacacauacuaucuuuuacaaggaauauccuggagguccccaggagcuggacaaaucuauuagaggcggggaacuauuccucaccauccugcuuaauccaauuagcauauuuaugacacacuugucaaacuacggaaaugauaggcugggccucuauacuuucguuaaccuggugaauuucguccaaaguuggaccaacuuaaagcugcagacacuuccucccgugcaguuggcacaccaguacuuugagcuuuucccagagcaaaaagacccccuguggcagaauccuugugaugacaagcggcauaaagauaucuggucccgugaaaagaccugcgaccaccuaccaaaguuucuggucauugguccgcagaaaacugggacgacagcucucuaucuguuccuuuugaugcaucccagcaucauuucuaaccugccuucaccaaagaccuuugaggaagugcaguucuuuaauggcaacaauuaccacaaaggaaucgacugguacauggauuucuuucccacuccuaguaacaccacaagcgacuucuuauuugagaaguccgccaacuauuuccacucugaggaagcgccacgcagagccgcaucgcucguucccaaagcuaagauaaucaccauucugaucgauccgagcgacagggccuacuccugguaucaacaucagcggucacacgaggauccugcugcccuucgauuuaauuucuacgaagugauuaguacuggccauugggcaccaucugaccugaagacauugcagcgcagaugucucguacccgggugguaugccguccacaucgagagguggcugacguacuucgcuaccagccagcuacugauaauugauggacaacagcuccgguccgacccugcgacugugauggaugaaguucagaaauuucugggugugacaccccgcuauaacuacucagaggcacuuaccuucgacccacaaaagggcuuuuggugccaguugcuggaagggggaaaaacaaaguguuuaggcaaaagcaaggguagaaaauacccucccauggauccagaaucuaggacuuuccucuccaauuauuaccgugaccauaacgucgagcugaguaagcuccugcaccggcuagggcagccgcucccuagcuggcugcgacaggaauugcaaaaggugagauga

SEQ ID NO: 59570 - RNA, 1068 nt, Artificial Sequence
  derived and/or modified sequence opt3 from NDUFA10__Homo_sapiens__NP_004535
auggcccugagacuccuuaagcuggcugcaaccagcgccuccgcgaggguggucgcugccggcgcacagcggguucgcgggauccacucuucagugcaaugcaaauugcgauacggaauguggcauuucuuacugggugacaaggccaguaaacgucuaacagagagaagcaggguaauuacuguggauggcaacauauguacggggaagggaaaacucgcuaaggaaaucgcagagaagcugggcuuuaaacacuuccccgaagccgguauucauuauccugacuccaccacaggggauggaaagccacuugcuacugacuacaauggcaacugcucucuggagaaauuuuaugaugacccgcggucgaaugauggcaacucauaccgcuugcagagcuggcucuauaguuccagacugcugcaguacucugacgcccucgaacacuuacugaccacagggcagggagucgugcuugagaggagcaucuucuccgauuuuguuuucuuggaggcgauguauaaucaagguuuuauucggaagcaguguguggaccauuacaacgaagucaaaucagugaccaucugcgauuaccugcccccucaccuaguaauauauaucgacguuccagugcccgagguccagcgccgaauccagaagaagggcgauccucacgaaaugaaaauuacaagugcauaccuccaagacauugagaaugccuauaagaaaacuuuccugccagagaugagcgaaaagugugaggugcuucaguacucugcuagagaagcccaggacuccaaaaagguggucgaggauaucgaauaucugaaauuugacaaggggcccugguugaagcaggauaacaggacccucuaccaucugcgguuacugguucaagacaaauucgaggugcucaauuauacgucaauaccuauuuuucuuccagagguaacuaucggagcacaccagaccgaucgugugcugcaucaguuccgcgaauugccgggcagaaaguacagccccgguuacaacacagaggucggggacaaauggauuuggcuaaaguga

SEQ ID NO: 59571 - RNA, 687 nt, Artificial Sequence
  derived and/or modified sequence opt3 from NDUFA11__Homo_sapiens__NP_001180304
auggcccccaagguguucagacaauacugggacaucccugauggcaccgacugccacaggaaggcuuauagcacaacuuccauugcaucugucgccgggcugacggcggcugccuaccggguuacccucaacccaccgggaacauuucuugaggguguggcaaagguaggccaauauacuuucaccgccgcugcagugggggccgucuuuggacugacaaccuguauaucagcucaugugcgcgaaaaacccgaugacccuuugaauuacuucuuaggcgguugcgccgggggacugacucuaggcgcgcgaaagacaggcagucacuguguugugcaggcagggcucaaacugcuugccagcuccucuccacauaccucggcuucacagagcgccggaaucauugguaugagucacugcguccagcguuuuugggugcccuccucuagcgcaugucuggagguauuguccggcgaaucaacggauguucaugcuugcaguagcacuagaggggccuguaacucuuccggaucaaggccucucccagagcugggcgcgcgggccagcgguagucugcgcaaagggggacacacccaccccgcaccuagaggcgcuggcgcccucacaccagugcaggcuuuaaucgaaucucugcuuaauacuuugggguccaacccgaggaccuga

SEQ ID NO: 59572 - RNA, 192 nt, Artificial Sequence
  derived and/or modified sequence opt3 from NDUFA12__Homo_sapiens__NP_001245267
auggagcuggugcagguccucaagagaggccuucaacagaucaccgggcacggaggucugaggggcuacuugcggguuuucuuucgcacaaacgacgccaaaguggggacuuuaguaggagaagauaaguauggcaauaaauacuaugaggacaacaagcaguucuuugguauugugggguucacggucuga

SEQ ID NO: 59573 - RNA, 435 nt, Artificial Sequence
  derived and/or modified sequence opt3 from NDUFA13__Homo_sapiens__NP_057049
auggccgcuagcaaggugaaacaggacaugcccccuccaggcggguacggaccgaucgauuauaagagaaaccugcccaggcggggucucuccggcuacucuaugcuugcaauugggauaggaacccugaucuauggccacuggucaauuaugaaauggaaucgcgagcgacguagauugcaaaucgaagacuucgaggccaggauugcguuacugccucuacuccaggcugaaacagaucggcgcacucugcagaugcuuagagagaaccuggaagaggaggccaucauaaugaaggacgucccagauuggaaaguuggugaaaguguguuucauacgaccagguggguacccccuuugaucggggagcucuacggacugcggacaacugaagaggcacugcacgccagccauggcuucaugugguauaccuga

SEQ ID NO: 59574 - RNA, 213 nt, Artificial Sequence
  derived and/or modified sequence opt3 from NDUFA1__Homo_sapiens__NP_004532
augugguucgagauccugcccggccucagcgugaugggggucugccuucugauuccuggauuggccaccgcuuacauacacagauuuacaaacgguggcaaggagaaaaggguugcacauuucggguaucacugguccuuaauggaacgggaccgccgaaucucuggaguggaucguuacuauguaucaaagggccuggaaaauauugacuga

SEQ ID NO: 59575 - RNA, 231 nt, Artificial Sequence
  derived and/or modified sequence opt3 from NDUFA2__Homo_sapiens__NP_001171941
auggccgcugcagccgcgagcagaggcgugggggcuaagcugggacucagggagauccggauucaccuuugccagcgcucccccgguucucaaggcguccgagacuucauagaaaaacguuacguugagcugaagaaagccaacccugauuugccaaucuuaauuagagaauguucagacgugcagccgaagcugugggcaagguaugccagucggguacagaauagcuga

SEQ ID NO: 59576 - RNA, 351 nt, Artificial Sequence
  derived and/or modified sequence opt3 from NDUFA5__Homo_sapiens__NP_001269349
augcccuacagagugggccagaccacagggcuggucggacucgccguuugcaacacuccucacgagaggcuucggauccuguauacgaagauuuuggacguguuagaagagauaccgaaaaaugcugcauaccgcaaguauaccgaacaaaucacaaacgagaaacuggccaugguaaaggcggaaccagaugugaaaaagcuagaggaccagcuccaggguggccagcuggaggaagucauucuucaagcugagcaugaacugaauuuggcccgaaagaugcgugaguggaaacucugggagccccugguggaggaaccuccagcagaucaguggaaguggcccaucuga

SEQ ID NO: 59577 - RNA, 465 nt, Artificial Sequence
  derived and/or modified sequence opt3 from NDUFA6__Homo_sapiens__NP_002481
augggcaaggacaucagacccaggagcgcccgggcugcaugcaaaggggugggacugugguccgguuguuucggcaagauggccgggucuggaguccgccaggcgaccucaacagcuaguacuuuuguuaaaccuauuuucagccgagauaugaacgaggccaagcguagagugagggaacucuaccgggcaugguaucgcgagguaccaaauacggugcaccaauuucagcuugacauaaccgucaaaaugggcagagauaaggugagggaaauguucaugaagaacgcccauguuacagacccgcggguggucgaucuguuggugaucaaagguaagauugaguuagaagagacuaucaaaguauggaagcagcgcacccacguuaugcgauuuuuccaugagacagaagcucccagaccuaaagacuuucuguccaaguucuacguggggcacgauccauga

SEQ ID NO: 59578 - RNA, 1134 nt, Artificial Sequence
  derived and/or modified sequence opt3 from NDUFA9__Homo_sapiens__NP_004993
auggccgcugcagcccagagcagaguggucaggguucuguccaugucucggucagcgaucaccgcuauugccacaagugugugccacgggcccccuugucgccaacuccaucacgcacuuaugccacauggcaagggaggucgaagcuccguaucuggcauaguggccacugucuucggggcuacgggauuucugggccguuacgugguuaaccacuuggguagaauggggucacaggugaucauuccguauaggugcgacaaauacgauaucaugcauuuacggcccaugggagaccugggccagcuacucuuccuggagugggaugcacgcgacaaggauucgauuagaagggucgugcagcacagcaauguaguuaucaaccuuauaggccgggacugggaaaccaaaaauuuugauuucgaggacguguuugucaagaucccucaagccauugcucagcugaguaaagaagccgggguggagaaguucauccacgugucccauuugaacgcgaauauuaagucuagcucccgcuaucuccgaaacaaagcagucggagaaaagguugugagagaugccuuuccagaggcuaucauaguaaaacccucagacauuuucgguagggaggaucgguuucugaauaguuucgccagcaugcaccguuuuggcccuaucccacuggggucucucggauggaagacagugaaacagcccgucuacgugguugacguguccaagggcauugucaacgcagugaaggauccugacgcuaaugguaaaucauucgccuuuguagggccaagccgcuauuuacuguuccaucuuguuaaguacaucuucgcgguggcccacagauuguuucugccguucccccuaccucucuuugcauauaggugggucgcucggguguucgaaaucaguccauuugagcccuggauuacucgagacaaagucgaacgcaugcacauaaccgauaugaagcugccucaucuuccaggacuggaggacuugggcauccaggccacaccccucgagcugaaagcuauugaaguguuaagaaggcaccggaccuaccgcuggcugucugccgagaucgaagauguuaagccggcaaaaacugugaacauauga

SEQ ID NO: 59579 - RNA, 471 nt, Artificial Sequence
  derived and/or modified sequence opt3 from NDUFAB1__Homo_sapiens__NP_004994
auggccagcagagugcuguccgcuuacgucucuaggcuccccgcagccuucgcgccucuuccacggguucgcaugcuggcuguggcccgaccguugucaaccgcauuaugcagugccggcacacagacucgucuggggacgcuacaacccgcucucguacuggcacaggugccuggaagagucacccagcuuuguaggcaguauagcgacaugccaccccugacauuggaggguauccaagaucgggugcucuacguucugaagcuguaugacaaaauugauccugaaaagcucuccgugaacucucacuuuaugaaagacuuaggccuggauucgcuugaccaggucgagauaaucauggccauggaagaugaguucggguuugaaauuccagacaucgaugcugagaaguugaugugcccccaggagauuguggacuacaucgccgauaaaaaggacguauaugaauga

SEQ ID NO: 59580 - RNA, 984 nt, Artificial Sequence
  derived and/or modified sequence opt3 from NDUFAF1__Homo_sapiens__NP_057097
auggcccuggugcacaagcuccuuagaggcaccuacuuccugaggaaauuuagcaagcccacauccgcuuuguauccuuucuuagggauccgguuugcagaguacucuucaagucugcagaaaccagucgccagcccgggaaaggcguccucucaacgcaaaacugaaggugaccuacagggcgaucaucagaaggagguugcucucgacauuacgucgucagaagagaagcccgaugugagcuucgacaaagccauacgagaugaagcaaucuaucacuuucgucugcuuaaggacgagauuguagaucauuggagagggccugagggacacccacugcaugaaguguugcucgagcaggccaaagucguguggcaauucaggggcaaggaagaccuggauaaauggaccguuacaagugacaagacuaucggugggcgguccgagguguuucugaagauggggaaaaacaaucagucugcucucuuauacggcacccugagcuccgaggcaccccaggauggcgaaucaacacgcaguggguauugcgccaugauuagcagaaucccuaggggagcuuucgagcggaagaugucuuacgacuggucccaguuuaacacccuuuauuugcgcguccgaggugauggcagaccauggauggugaauauaaaagaagacacugacuucuuucaaaggacaaaccagauguacucauacuucauguuuacccggggaggacccuauuggcaggagguaaagaucccuuucagcaaauucuuuuucaguaaucguggccgcauuagagauguucagcacgaacugccacuagacaagaucucuuccauugguuuuacgcucgccgauaaaguggacgggccguucuuucuggagaucgauuucauaggagucuuuacugaccccgcgcacaccgaggaguucgcauacgaaaacagcccugaacuuaauccaaggcuguuuaaguga

SEQ ID NO: 59581 - RNA, 510 nt, Artificial Sequence
  derived and/or modified sequence opt3 from NDUFAF2__Homo_sapiens__NP_777549
augggcuggagccaggaccuguucagagcccucuggaggucccuuucucgggaggugaaggaacacgucgggaccgaucaauuuggaaacaaauacuauuacaucccccaguauaagaauuggcgcggucagacaauucgagagaaacguauaguugaagcugcaaacaagaaagagguggacuacgaagccggcgauaucccuacugagugggaggcguggauuagaaggacgcggaagaccccaccgacaauggaagagauccugaagaaugaaaaacaucgcgaggagauuaagaucaaaucacaggacuucuaugaaaaggagaaauuguuaaguaaggaaacuagcgaggaacugcuacccccuccaguacaaacccagauaaaggggcacgcuuccgcccccuacuuuggaaaagaggagccuucuguggcaccaucgucaacaggcaagaccuuccagcccgguagcuggaugccuagagaugggaaaagucauaaccaguga

SEQ ID NO: 59582 - RNA, 555 nt, Artificial Sequence
  derived and/or modified sequence opt3 from NDUFAF3__Homo_sapiens__NP_951032
auggccaccgcucuggcacucagaagccuuuacagggcccggcccucccugcgcugcccuccaguggaguugccgugggcgccccgacguggccacagauuaucuccugcugacgaugaacuguaucagaggacacggaucucacuacuccaacgcgaggccgcacaggccauguacaucgacaguuauaacagcagaggguucaugauaaauggaaacaggguccuggguccaugugcacuucugccccauuccguugugcaguggaauguaggcucucaccaggauaucacugaagacucguuuucauuguucuggcuccuggagccucggauugaaaucguggucguggggacgggagaucgcaccgagcgacugcaaagccagguucuccaggcuaugagacagaggggcauugccguggagguccaagacacaccaaacgcuugcgccacuuuuaauuucuuaugucaugaaggucgggugaccggggcggcacugauucccccuccaggaggcacaagucuuaccuccuugggccaggccgcucaguga

SEQ ID NO: 59583 - RNA, 528 nt, Artificial Sequence
  derived and/or modified sequence opt3 from NDUFAF4__Homo_sapiens__NP_054884
augggcgcccuggugaucagagggauuaggaacuucaaucucgagaaccgggcugaacgcgagauaagcaagaugaaacccuccgucgcaccucgacacccaucuaccaauucacuucugcgugaacagaucaguuuguacccggagguuaagggagaaauugccagaaaagacgagaaguuacugagcuuucuaaaagauguguauguagacuccaaggaucccgugucuucgcuccaagucaaggcggcugagacaugccaggaaccuaaagaguucaggcugccaaaggaccaucacuuugauaugaucaacauuaaaucaauccccaaggguaaaauaagcaucguggaagcccuuacucuguugaauaaccauaaacucuucccugagacguggaccgcagagaagauuaugcaggaauaccagcuggagcaaaaggacguuaauagucugcucaaguauuuugugacauucgaagucgagaucuuuccacccgaagauaaaaaggccauucgguccaaauga

SEQ ID NO: 59584 - RNA, 954 nt, Artificial Sequence
  derived and/or modified sequence opt3 from NDUFAF5__Homo_sapiens__NP_001034464
augcugagacccgccggccucuggaggcuuugccggcgcccuugggcugcacgaguaccagccgagaaccuggggcguagagaagucaccagcggaguuuccccgagggguucuacaucaccccggacuuugaauaucuucgaccgcgauuuaaagagaaaacagaagaacugggcggcuaggcaaccugagccaacgaaauuugacuaccugaaggaagaggugggcagucggauugccgaucgcguauaugacauaccccgaaauuucccucuagcacucgaucugggguguggaagaggcuacaucgcccaguaucuuaacaaacugcaguuguuucacugcaggaagcuccuggagagcuucuccaagcugacccuccagaaaauguuaugucugcauugggugaaugaccuuccacgggcuuuggaacaaauucacuacauccugaagcccgauggugucuuuauuggggcaauguucggaggcgacacacuauaugagcuccguugcucucugcagcuugccgaaacugagcgcgaaggcggguuuucgccucauaucucaccauucaccgcugugaacgaucugggacacuugcucgguagagccggcuuuaauacacugaccguugacacugaugagauacaggugaacuacccggggauguucgaguuaauggaagaccugcagggaaugggcgagagcaauugugcguggaacaggaaagcacuccuucaucgggauacaaugcuggccgcugccgcagucuaucgagaaauguaccgcaaugaggacgguagugugcccgcuaccuaccaaaucuauuacaugauuggguggaaguaucacgaaucccaggccagaccugcggagaggggaucugccacggugagcuuuggcgaguugggcaaaaucaacaaucuaaugccacccgggaagaagucccaguga

SEQ ID NO: 59585 - RNA, 1002 nt, Artificial Sequence
  derived and/or modified sequence opt3 from NDUFAF6__Homo_sapiens__NP_689629
auggccgcuagcgcacacggcuccgugugggggccccugagacucggaaucccuggucuuugcuguaggcggccaccgcugggcuuguacgcccgcaugcgacguuuacccgggccugaggucucuggaagaucaguugcggcugccaguggcccaggugcaugggggaccgaccauuauugccuggaacuacucaggaagcgggauuacgagggauaucuguguagccuucuguugcccgccgaauccagaucuucgguguucgcucuccgcgcauuuaacguagagcuggcccaggugaaagacucagucagcgaaaagacaauuggccugaugaggaugcaauucuggaaaaagacuguggaggauauauacugcgacaauccuccacaccagcccguugcuaucgagcucuggaaagccgugaagcggcauaacuuaacgaagcgcuggcugaugaaaauugucgaugaacgagagaagaaucuugacgauaaagcguauagaaacaucaaggaauuggagaauuacgcagagaacacccagaguucccugcuauaucucacacuggaaauucuuggcaucaaagaccugcacgccgaucaugcugccucucacauagggaaggcacagggaaucgugacuuguuugagggcuaccccuuaccacgguagccggcguaagguauuucucccaauggacauuugcaugcugcauggcguuucccaagaggauuucuuacgcagaaaucaggacaaaaacgugagggaugucaucuacgacauugccucacaggcgcaucugcaccucaagcacgcccggaguuuucacaaaacagugccggugaaggcauuccccgcuuuucuucagaccgucagccuggaagacuucuugaaaaagauccaacgaguugauuuugacauauuccauccuucucuacagcagaaaaauacucugcucccacuguaucuuuacauucaguccuggcgcaagacauauuga

SEQ ID NO: 59586 - RNA, 519 nt, Artificial Sequence
  derived and/or modified sequence opt3 from NDUFB10__Homo_sapiens__NP_004539
augcccgacagcugggauaaggacguguacccugagccaccgagaaggacccccguccagccuaacccaaucguuuauaugaugaaagccuucgaucugauuguggaccggcccguaacacucgugcgcgaauuuauagagcgacaacacgcuaagaaucguuacuauuacuaucauagacaguacaggcgggucccugauaucacugaaugcaaagaggaagacauuauguguauguaugaggcagagaugcaguggaagcgcgauuacaaaguggaccaggaaaucauuaacaucaugcaagauagacuuaaggccugccagcagagggagggccagaauuaccaacagaacuguauaaaggaaguugagcaguucacccagguggcgaaggcuuaucaagaccgguaccaggaucugggggccuauuccucugcacgcaaaugcuuggccaaacagcgacaaagaauguuacaggagaggaaggcugcaaaagaagccgcugccgcgacgucauga

SEQ ID NO: 59587 - RNA, 462 nt, Artificial Sequence
  derived and/or modified sequence opt3 from NDUFB11__Homo_sapiens__NP_001129470
auggccgcuggccuguucgggcucagcgcaagaaggcuucuggccgcggcugccacccggggauugcccgcagcccgcgugcgaugggaguccucuuuuucacguacagucguugcuccuagugcaguggccgguaagagaccaccggaacccacuacgccuuggcaggaggacccagaacccgaggaugaaaacuuauacgagaaaaauccugacagccacggcuaugauaaggacccaguacuggauguguggaacaugaggcuagucuucuuuuucgggguguccaucauucucguucugggaucuaccuuuguggcuuaccuucccgacuaucggaugaaagaguggucgcgcagagaagccgagaggcuggucaaguaccgggaagcgaauggcuugccuauaauggagucaaacugcuucgauccaagcaaaauccaacucccggaggacgaauga

SEQ ID NO: 59588 - RNA, 318 nt, Artificial Sequence
  derived and/or modified sequence opt3 from NDUFB2__Homo_sapiens__NP_004537
augagcgcccugaccagacucgcuuccuucgcaagggugggcgggcggcuuuuucgcucuggaugcgcccgaacagcgggugacggcgggguccgucacgcuggaggcgguguucauaucgagcccagauacaggcaguucccucaacugacucggucacagguguuucagagugaguucuuuagcggguugaugugguucuggauuuuauggcgcuuuuggcacgauuccgaagaaguacugggacauuucccauauccggaccccucucaguggacggaugaggaacuaggcauaccuccagacgaugaggacuga

SEQ ID NO: 59589 - RNA, 297 nt, Artificial Sequence
  derived and/or modified sequence opt3 from NDUFB3__Homo_sapiens__NP_001244031
auggcccacgagcauggccacgaacaugggcaccauaagauggagcugcccgacuacagacaguggaaaaucgaaggaaccccucucgagacaauucaaaagaaacuugcugcaaagggucugagggauccauggggccggaacgaagccuggcgcuauaugggaggguucgcgaaaagcguguccuuuucugacgucuucuuuaagggcuucaagugggguuuugcugccuucguuguggcaguaggggccgaguacuauuuggagucauuaaauaaagauaagaaacaccacuga

SEQ ID NO: 59590 - RNA, 363 nt, Artificial Sequence
  derived and/or modified sequence opt3 from NDUFB4__Homo_sapiens__NP_001161803
augagcuuccccaaguacaaaccuuccucucugagaacccucccagagacacuugacccggccgaauauaacaucucacccgagacuaggcgggcucaggcagaacgccuggccauucgagcgcaauugaagcgugaguacuuacugcaguauaaugauccuaacagaaggggccuaauagaaaauccagcucuccugcggugggccuacgcacgcacgaucaacguguaucccaauuuuagaccuacccccaaaaacagucuuaugggggcccugugcggauucgguccauugauuuuuaucuacuauauuaucaagacagagagggucagcauacagacucggugucucguuuucgaguga

SEQ ID NO: 59591 - RNA, 414 nt, Artificial Sequence
  derived and/or modified sequence opt3 from NDUFB5__Homo_sapiens__NP_001186886
auggccgcuaugagccugcucagaaggguguccgucaccgcaguugccgcgcuuucuggccggccccuggggacacgcuugggauucgguggcuuuuuaacucgaggguucccuaaggcugccggacaggcagagcuggccgaaaucccagagggcuacgugccggaacacugggaguauuacaaacaucccauuucacguuggauagcuagaaacuuuuaugacaguccugaaaagaucuacgagaggacgauggcaguacuacaaauugaggccgaaaaagcugagcuccgggugaaggaacuggagguccgcaaacuuaugcacgugagaggugaugggccaugguauuacuaugagaccaucgacaaggaacugauugaucauagccccaaggccacaccugacaauuga

SEQ ID NO: 59592 - RNA, 387 nt, Artificial Sequence
  derived and/or modified sequence opt3 from NDUFB6__Homo_sapiens__NP_002484
augaccggcuacacacccgacgagaagcugagacuccagcaacuuagggaacugcggcgccgaugguugaaagaucaggaguuaagcccucgugaaccagugcugccgccccagaagauggggccuauggagaaauucuggaacaaguuucuagaaaauaaauccccauggagaaagaugguccacggaguuuauaagaaaucuaucuucguguuuacucauguacucgugcccgucuggauuauacacuacuauaugaaguaccaugugucagagaaaccuuaugguaucguugagaagaaaaguaggauuuucccaggcgacacgauccuggaaaccggggaggugauucccccuaugaaggaauuuccagaucagcaccauuga

SEQ ID NO: 59593 - RNA, 519 nt, Artificial Sequence
  derived and/or modified sequence opt3 from NDUFB8__Homo_sapiens__NP_001271296
auggccguggcuagagcaggcguccuggggguucaguggcuccaaagggccagccggaacgugaugccccuuggagcgcgcaccgcuucccacaugacaaaggacauguucccugguccauacccgcgaacucccgaggaacgugccgcagccgcuaaaaaguauaauaugagaguagaggauuacgaaccuuauccagacgauggcaugggguacggagacuaucccaaacugccugauaggucucagcaugagcgggacccaugguacucaugggaucagcccggcuugcgcuuaaacuggggugaaccuaugcacuggcaucuggacauguauaauagaaacaggguggauacgaguccaaccccggucagcuggcacgugaugugcaugcagcuauuuggguuccucgcauuuaugaucuucauguguuggguuggagacguguaccccgucuaccaaccugugugccggcaucacuuuuccuauaaucugggcuuccuuucugcccugggcuga

SEQ ID NO: 59594 - RNA, 540 nt, Artificial Sequence
  derived and/or modified sequence opt3 from NDUFB9__Homo_sapiens__NP_004996
auggccuuccuggcuagcggccccuaccucacccaccagcaaaaggugcuuagacuguauaaaagggcauugcggcauuuagaguccuggugcguccagcgcgacaaguaccgauauuuugccugucugaugcgugcgagauucgaggaacacaaaaacgaaaaggauauggcuaaagccacacagcuacucaaggaggcagaagaggaguuuugguacaggcagcauccucaaccauauaucuucccggacucucccgggggaacuucauacgaacgguaugauugcuacaagguuccugaguggugucuggacgauuggcacccaagugaaaaagccauguaccccgacuauuuugcuaagcgcgagcaguggaaaaagcugagaagggagagcugggaacgggaggugaaacagcuucaggaagagacgccuccagguggccccuugaccgaagcacucccuccagcccgcaaggagggggaucugccgccccuguggugguacauuguaacacgaccuagagagaggccaauguga

SEQ ID NO: 59595 - RNA, 267 nt, Artificial Sequence
  derived and/or modified sequence opt3 from NDUFC2__Homo_sapiens__NP_001190983
augaucgccagaaggaaccccgagccucugcgguuccucccagacgaagcucgcagccuuccgcccccuaagcugaccgauccacgauuguuauacauuggcuuucugggguauugcuccggacuaauagacaaucucauccguagaaggcccauugcaacagccggucugcaccggcagcuucuguacaucacugcguucuuuuucgcuggcuauuacuuggugaaacucgaggccuaugcaaaccuguacgucgauacgcuguga

SEQ ID NO: 59596 - RNA, 2076 nt, Artificial Sequence
  derived and/or modified sequence opt3 from NDUFS1__Homo_sapiens__NP_001186910
augcugagaauccccgugaggaaggcccucgucggccuuagcaaauccccuaaggggugcguucggaccacagcuacugcagccucuaaccugauugagguguucguagacggacagucagugauggucgaaccagguacgaccguguugcaaguuguggcggcuugugccaugccggucaugaaaggcuggaauauauuaacaaacagugagaaaagcaaaaaggcacgcgaaggggugauggaguuucugcuagccaaucacccccucgauugcccuaucugugaccagggaggcgaaugcgaucugcaggaccaguccaugauguucgguaacgaucgaucucguuuucuugaggggaagagagcuguagaggacaaaaauauuggaccacugguuaagacuaucaugaccagguguauucaaugcacacgguguauccgcuucgcaucggaaauagccggcguggaugacuugggcaccacugggagaggaaacgauaugcaggucgguacauacaucgagaaaauguuuaugucagaacucagcggcaauauuaucgacauuugccccgugggggcucugaccaguaagccuuaugccuucacggcgaggccaugggagacucggaaaaccgaguccaucgaugugauggacgcagucggaucuaacauaguugugagcacacgcacuggcgaaguaaugcgaauccugcccagaaugcaugaggauauuaaugaagaguggauuuccgacaagaccagguuugccuacgacggucucaagcggcagcguuuaacagaaccuauggugcgcaacgagaaagggcugcuuaccuauacgucaugggaggaugcuuugaguagagucgccggaaugcugcagagcuuccaaggcaaggacguggcagcuaucgccggcgggcuaguugaugcggaagcccucguggcacugaaagaccuucugaauagggucgauucugacacuuuguguacagaggaaguguuuccaaccgcuggagccgguacugaucuccgguccaacuaccuguuaaauacaaccaucgcuggcguagaggaagccgacguugugcugcucgucgggacgaacccgcgauucgaggcaccccuuuuuaaugcccgcauuagaaagucauggcugcacaacgauuugaaaguggcucuaauaggaagcccugucgaccugaccuauacauacgaucaucucggcgacaguccaaagauccugcaggacauugcgucugguucccaccccuucagccaggugcuuaaagaggcaaagaagccuaugguugugcuggggucgucugccuugcagaggaacgauggcgcugccauccucgcagccguauccucaauagcucaaaagauucggaugaccaguggagucacuggcgacuggaaggugaugaauauccugcaucgcaucgccagccagguugcagcguuagaucugggguauaaaccaggaguggaagcuauuagaaagaaucccccgaaaguccuauuucuccugggugccgacggcgggugcaucacaaggcaggaucuuccuaaggacuguuucauuauauaccaaggacaccacggcgaugugggugcacccaucgccgacguaauuuugccaggggcugccuacacugagaaguccgcaaccuaugugaacacagaaggccgugcucagcagaccaaaguugccgucacuccucccggacuggcgcgggaggauuggaagaucauccgagcccucucugaaauugcuggcaugacgcugccauacgacacacuugaucaggugagaaacaggcuggaggaggugagccccaauuugguccgcuaugacgauauagaaggggcaaacuacuuccaacaggccaaugagcucucaaaacugguuaaccagcaguuacuggcugacccucuagugccaccgcaacucaccaucaaggacuuuuauaugacugauaguauuucccgggccagccagaccauggcaaaaugcgugaaggcgguaacagaaggagcccaggcugucgaggagcccucuaucugcuga

SEQ ID NO: 59597 - RNA, 1374 nt, Artificial Sequence
  derived and/or modified sequence opt3 from NDUFS2__Homo_sapiens__NP_001159631
auggccgcucugagagcacucugcggcuucaggggaguggccgcgcagguccuucggcccggggcugguguucgccugccuauccaaccaagccgaggcgugcgucaguggcagccggacguagagugggcccagcaauuugggggagcagugauguaccccuccaaggaaaccgcccacuggaaaccuccacccuggaacgaugucgacccuccaaaggauacaauugugaaaaauauaacuuugaacuucggcccccagcauccugcugcacacgguguuuuaagacuggugauggagcuaucuggggaaauggucaggaagugugacccacauaucggacuccugcaccggggcacggagaaacuuauugaauauaagaccuaccugcaggccuugccguauuuugaucgccucgacuacgugucaaugaugugcaaugagcaggcuuauagucuggccguagagaagcugcucaacaucagacccccuccaagggcgcaauggauucggguuuuauucggcgaaaucacacgccugcuuaaucauauaauggcagugacuacccacgccuuggaucugggggcuaugacacccuuuuucuggcuauuugaggaacgagagaaaauguucgaguuuuacgaaagagucagcggagccaggaugcacgcagcuuauauccggccugguggcgugcaucaggaccucccacuggggcuuauggaugacauuuaccaguucuccaagaacuuuucucugcguuuggaugagcucgaagaacuguuaaccaauaaccgcaucuggagaaauaggacuauugacaucggaguggucacagccgaagaggcgcugaacuacggcuucucggguguuaugcuccgggggucaggaauacagugggaucuucgaaaaacccaacccuaugacguguacgaccagguagaguuugaugugccggucggcagccgcggcgacuguuaugauagauaccugugcaggguggaagagaugcggcagaguuugcgcauuaucgcccaaugucuaaauaagaugccucccggggaaauuaaaguugacgaugcaaagguguccccaccuaagagagcugagaugaaaacgucuauggaaagccugauccaccauuucaagcucuauacugagggauaccaggugcccccaggugccaccuauacagcuaucgaggcccccaaaggcgaguucggggucuaccugguauccgacggaucaaguaggccuuaccguugcaagauuaaagcaccaggcuuugcccaccuugcuggucuggauaagaugagcaaagggcacauguuggcggacguuguggcaauaaucggcacucggccgauugucuga

SEQ ID NO: 59598 - RNA, 795 nt, Artificial Sequence
  derived and/or modified sequence opt3 from NDUFS3__Homo_sapiens__NP_004542
auggccgcugcagccguggcgagacugugguggaggggcauccucggggcuagcgcccuuacccggggaacaggucgccccuccguccuguuguuaccuguucgacgugagucugcaggcgccgacacuagaccaacggugaggccgcggaacgauguagcucacaagcagcugucagcauucggggaauacguggccgagauucuacccaaauauguccaacaggugcagguuaguugcuuuaaugaacucgagguguguauacauccugacggagucaucccagugcugaccuuccuucgcgaucacacaaacgcucaguuuaagagccugguagacuugacugccguugaugugcccaccagacaaaauagguucgaaauugucuacaaccuccugucccugcgguuuaauucucgcauccgagugaaaacauauaccgacgagcucacuccuauugagucggcggugucagucuucaaggcagccaacugguacgaaagagagaucugggauauguuuggcguuuucuuugcuaaucauccagacuuaaggcggauacugacagauuaugguuucgaagggcaccccuuucguaaagacuucccucuuagcggauacguggaguugcgcuaugaugacgagguaaagagaguggucgccgaaccaguggagcuggcacaggaauuuaggaaguucgaucuaaacaguccgugggaggcuuuccccguuuaccggcagccuccagaaucccucaaacuggaggccggcgacaagaaacccgacgcgaaguga

SEQ ID NO: 59599 - RNA, 528 nt, Artificial Sequence
  derived and/or modified sequence opt3 from NDUFS4__Homo_sapiens__NP_002486
auggccgcugugagcauguccgucguucugagacagacccucuggaggcggcgcgcaguggccguagcggcucuuucugugucacgaguccccacacguagucugagaacuagcacguggagguuggcccaagaccagacccaggauacacaguuaaucacuguggacgagaagcuggauauuaccacacuaaccggcguuccugaagaacacauaaaaacucggaaggugcgcaucuucgucccagcaagaaacaauaugcaauccggggugaacaauaccaaaaaguggaaaauggaauuugacacaagggagcggugggaaaacccgcucaugggaugggccucuacggcugauccccugucgaauaugguacuuacuuucucaaccaaggaggacgcaguuagcuuugccgagaagaacgguuggaguuacgauauugaggagcgcaaagugccuaagccaaaauccaagucuuauggcgcuaauuucagcuggaacaaacgaacaagagucuccacuaaguga

SEQ ID NO: 59600 - RNA, 375 nt, Artificial Sequence
  derived and/or modified sequence opt3 from NDUFS6__Homo_sapiens__NP_004544
auggccgcugcaaugaccuucugcagacugcucaacagguguggcgaggccgcgcggagccuuccccugggggcucgcugcuuuggagugcgagucuccccuacaggugaaaagguuacucacacgggccagguguacgacgauaaagacuaucguagaaucagguucguagggcggcaaaaggaggugaaugaaaacuuugccauugauuugauagcagagcagccagucucugaaguggagacccgcguuaucgccugugacggaggcgguggggcuuuaggacauccgaaaguguacauuaaucuggauaaggagacaaaaacugggaccugcggcuauuguggccuacaguucagacagcaccaucacuga

SEQ ID NO: 59601 - RNA, 642 nt, Artificial Sequence
  derived and/or modified sequence opt3 from NDUFS7__Homo_sapiens__NP_077718
auggccgugcugagcgcucccggccucagaggguucaggauccuuggacugcgguccucugucgguccugcaguucaggcccgcggcgugcaccaaucaguagcgaccgacgggccaaguagcacacagccggcuuugcccaaggcccgagcaguggccccuaaaccauccucucguggagaguacgucguggcuaaguuagaugaccugguuaacugggcaagaaggucgucacuauggcccaugacuuuuggccucgccugcugugcuguggaaaugaugcauauggccgcgccucgguaugauauggaccgcuucggugucguguuuagagcaagcccaaggcagagugauguaaugauuguugccgggacgcugaccaauaaaauggcucccgcccuucggaagguguacgaccagaugccugagccacgcuaugucguguccaugggaucuugcgcaaacggcggcggguacuaucacuacagcuauuccgugguccgaggaugugauagaauaguuccgguggacaucuacauucccgguugcccuccaacagcugaagcccuguuguacggcauccuccaacugcagaggaaaauuaagcgggagcgucgccugcagaucugguauagaagguga

SEQ ID NO: 59602 - RNA, 633 nt, Artificial Sequence
  derived and/or modified sequence opt3 from NDUFS8__Homo_sapiens__NP_002487
augagaugccugaccacacccaugcuccuuagggcccuggcucaggcagcccgggcgggcccuccagggggacgcagcuugcacuccucugcuguggccgcaacuuacaaguaugucaacaugcaagacccggagauggauaugaaaucaguuacggaccgagccgcucguaccuuacuguggacagaacuauucagaggucucggcaugacucugaguuaccuuuuuagggagcccgcaaccaucaauuauccuuucgaaaaggggccacugagcccccgguuucgcggagagcaugccuugagaagguacccuuccggcgaggaacgguguauugcuugcaaacucugugaggccauaugcccagcgcaggcaaucacaauugaagccgagccccgcgcugaugguucucgaagaaccacuagguaugacaucgauaugacaaaguguauuuacugcggguucugucaggaagccugcccuguggacgcaaucguagagggaccaaacuuugaguucucgaccgaaacgcacgaggaacugcuguauaauaaagagaagcucuuaaacaauggcgauaagugggaagcugagauagccgcgaacauccaggccgacuaccuguaccgguga

SEQ ID NO: 59603 - RNA, 1368 nt, Artificial Sequence
  derived and/or modified sequence opt3 from NDUFV1__Homo_sapiens__NP_001159574
augcuggccaccagaaggcuccuuggcuggagccugcccgcucggacagcaccuaagaaaacuuccuucgggucuuugaaggacgaggaucgcaucuuuacgaacuuauacggacgacacgacuggcgucugaaagguucacuaaguagaggcgauugguauaagaccaaagaaauucuccugaaggggccagacuggauacuuggagagaucaagacaagcggccugaggggucgcgggggagccggcuucccgacuggcuugaaaugguccuuuaugaauaagcccucugaugggcggccuaaauaccucguggucaacgcggacgaaggagagccagguaccugcaaggauagagaaauucugaggcaugacccccacaaacugcucgagggcuguuuaguugggggacgggcuaugggcgcccgcgcagccuauaucuacauucgaggugaguucuauaaugaggcuucgaaccuucagguggcaaucagagaagccuacgaagcugggcugauaggaaagaaugccugcggcucaggcuaugauuuugacguauucguggucaggggagcgggggcauacaucuguggugaggagacagccuugauugaaagcaucgagggcaagcaagggaaaccucggcugaagccacccuuuccugcugaugugggaguuuucggcugcccaaccacuguggccaacgucgaaacaguggcaguaaguccgaccauuugucgucgcggugggacgugguuugcuggcuucggaagagagaggaacuccggcacuaaacuauuuaauaucucugggcauguuaaucaccccugcaccguggaagaggagaugagcgucccucucaaggaacugauagagaaacaugccggaggugugacaggcgggugggacaaccuucuggcggugauuccaggaggcuccucaacucccuugaucccuaagagugucugugaaaccguucucauggauuucgacgcccuggugcaggcacagacagguuuagggaccgcugccguaauugugauggaccggagcacggauaucgucaaagcuaucgcccgacugauugaguuuuacaagcacgaaucuugcggccaguguacuccaugccgcgagggaguggacuggaugaauaagguuauggcaagauucgugaggggcgaugcccggcccgcugagauagacucccucugggaaaucucaaaacaaauugaggggcacacaaucugugcgcuuggagauggugcagccuggccgguccagggccugauacgccauuucagaccugaauuggaggaaaggaugcagcguuuugcucagcaacaccaggcccggcaggcagccagcuga

SEQ ID NO: 59604 - RNA, 750 nt, Artificial Sequence
  derived and/or modified sequence opt3 from NDUFV2__Homo_sapiens__NP_066552
auguucuuuagcgccgcucugagagcaagggccgcgggccucaccgcucacugggggcggcaugugcgcaaccuucacaagacagucaugcagaauggagccgguggcgcacuguucguucaucgagacacucccgagaacaauccugauacgccauuugacuucaccccggaaaacuacaaacguaucgaggccauugugaagaauuaucccgaagggcacaaagcugcagccguauugccuguguuagaucuggcucaaagacagaacggauggcuaccaauauccgccaugaauaaggucgcggaggugcuccagguucccccuaugaggguguacgaagucgcaacauuuuauacuauguacaaccggaaaccagugggcaaguaucauauccagguaugcaccacaacccccuguaugcugcgcaauucugacucaauucuugaggccauccaaaagaaacuggguauuaagguuggggagacuacaccugauaaauuguucacccucaucgaaguggagugccugggagcuugugucaacgccccaauggugcagauaaaugacaacuacuaugaagaucugacggcaaaggacaucgaggagauuaucgaugaacucaaagcuggcaagauuccgaagcccggcccuagaagugggagguuuagcugcgagccagccggagguuuaacuucccugaccgaacccccuaaaggcccaggguucggagugcaggcgggccuuuga

SEQ ID NO: 59605 - RNA, 327 nt, Artificial Sequence
  derived and/or modified sequence opt3 from NDUFV3__Homo_sapiens__NP_001001503
auggccgcucccugccugcucagacagggcagggcaggggcccuuaagaccaugcugcaagaggcucagguguuccggggauuggcgagcacagucuccuuaucugccgaaucagguaaaagugagaagggccagccucagaacagcaaaaagcaauccccaccgaaaaagcccgcaccuguuccagccgaacccuuugacaauacuacguacaagaaccugcagcaccaugauuauucuaccuacacauuccuagaccucaaucuggagcuuucgaaauuucgcaugccucagccaucaagcgggcgagaaaguccccgucacuga

SEQ ID NO: 59606 - RNA, 25578 nt, Artificial Sequence
  derived and/or modified sequence opt3 from NEB__Homo_sapiens__NP_001157979
auggcagaugaugaggacuacgaagagguggucgaauauuacaccgaggaaguuguguaugaggagguacccggcgaaacaaucacuaagauuuacgagacgaccacaacucgaaccagcgauuaugaacaguccgagacaucuaaaccugcucuggcacaaccagcacucgcgcagccggcuucagcaaagcccguggagaggcggaaagucauacgcaagaaaguggacccuaguaaguucaugaccccauacaucgcacacagccagaagaugcaggaucuauuuucccccaacaaauauaaggaaaaauucgagaagacuaaagggcaaccuuacgccucuacaaccgacacgccagaacugcgacguauuaagaagguucaggaucaguugucggaggugaaauacagaauggacggagaugucgcuaagacuaucugccauguggacgaaaaagcaaaggauauugagcacgccaaaaagguaucacagcaaguuagcaaaguguuauauaagcagaauugggaggacaccaaggauaaauaccuguuacccccugacgcuccagaacucguccaggccgugaagaacacagcgauguuuaguaaaaagcuguauacugaggacugggaagcagauaaaucccuuuucuacccguauaaugacucucccgagcugaggcggguggcccaggcucaaaaggccuugagcgaugucgcauacaagaaaggucucgcugaacagcaggcccaauuuaccccucuggcggacccacccgauaucgaguucgccaagaaaguuacaaaccagguguccaagcagaaauauaaggaggacuacgaaaauaagauaaaaggcaaguggucagagaccccuuguuuugaaguagcaaacgcucgcaugaaugccgauaacaucaguacgagaaaauaccaggaggacuucgaaaauaugaaggaucaaauuuauuuuaugcagacugagacaccagaguacaaaaugaacaagaaggcugggguggccgcaagcaaagucaaguauaaagaagacuacgagaagaauaaaggaaaggccgauuauaacgugcugcccgcuucugaaaauccgcagcucaggcaguuaaaagcggcaggcgacgcccuguccgacaaacuuuacaaggagaacuaugagaaaaccaaggcuaaaucaaucaauuacugcgaaacuccuaaguucaaauuggauacaguucugcaaaacuuuagcagugacaagaaguacaaagauucuuaucuuaaggacauucucggucauuacgugggguccuucgaggaucccuaucacagccauuguaugaaagucaccgcccagaacucggacaagaauuacaaagcagaauaugaggaagaucggggaaagggcuuuuucccacagacgaucacccaggaguacgaggccauaaagaaacuggaccaaugcaaggaucacacauauaaagugcacccugacaagacuaaauucacccagguaacagauucucccguucuucugcaggcucaggugaacuccaagcaauugucagaccucaauuacaaggccaaacaugaaagugagaaguuuaaaugucacauuccacccgauacuccugcauucauccagcauaaggucaacgcguacaaucugagcgacaacuuauauaaacaggacugggaaaaguccaaagcuaagaaguuugauauuaaaguggacgccaucccacugcucgcagccaaggcuaauaccaaaaacacaucugaugucauguacaagaaagacuaugagaagaauaagggcaaaaugaucggggugcuuagcauuaacgaugacccgaagaugcugcacucauugaaaguugccaagaaucaaagugaucgccuauacaaagaaaacuaugagaagaccaaggcaaaauccaugaauuacugcgagacucccaaguaucagcuggacacgcagcucaaaaacuucagcgaagcucgauacaaggaucuguacgugaaagacguacuuggacacuaugucgguucuauggaggauccuuaccauacacacuguaugaagguggccgcgcaaaauucagacaagaguuauaaagccgaauacgaggaagauaagggcaaaugcuauuuuccacagaccauaacucaggaguacgaggcuaucaagaaacuggaccaguguaaggaccauaccuauaagguucaccccgauaaaacaaaguucaccgcagugacugacagcccugucuugcuccaggcccaacugaacacaaaacaguuauccgaucugaacuacaaggcuaaacaugaaggggagaaguuuaaaugccacauuccagccgacgcaccccaguucauccagcacagagugaaugcguacaaccuaucugauaauguauauaagcaagacugggaaaagucgaaagccaagaaauuugauauaaagguggacgcuauuccgcuccuggccgcaaaagcuaacacgaagaauaccagcgauguuauguacaagaaagacuaugagaaguccaaaggaaagaugaucggcgcccuuucaaucaacgaugacccuaaaauguugcauagucugaagacugcaaagaaucagucugacagggaguaccggaaagauuaugaaaagagcaaaacaauuuacaccgccccacucgacaugcugcaggucacacaagcuaagaaaucccaggcgaucgccucagauguggacuauaagcacauucuucauagcuacucuuaucccccugauuccauaaacguggaccuggcaaagaaggcuuacgccuugcagagugaugucgaguacaaggccgacuauaauagcuggaugaaagguuguggguggguucccuucggaucucucgaaauggagaaggcuaaacgugcauccgauauccugaacgaaaagaaauaccgccagcacccagacacuuuaaaguuuaccucaauugaggaugccccuaucacggugcaaaguaagaucaaucaggcgcagagaagcgacauugcuuauaaagccaagggcgaggaaauaauccacaaauacaaccugcccccagaucuaccgcaguucauucaagcaaaggugaaugccuauaacaucucggagaauauguacaaagcugaccucaaggaccuguccaagaaaggcuacgaucuuaggaccgacgcaauuccuauccgggccgcgaaggcugcccgacaggcagccucugauguacaguauaaaaaggacuacgaaaaagcuaaggggaagauggucggauuucagagcuugcaagaugaccccaaacuggugcauuauaugaacguugccaagauacagucagaucgcgaguacaaaaaggacuaugagaagacuaagaguaaguacaacacuccacacgauauguucaauguggucgcagcuaaaaaggcccaggacgugguuuccaacgugaauuauaaacauucucuccaccauuacaccuaccugcccgaugcgauggacuuagagcugagcaagaacaugaugcagauccaauccgauaauguauauaaagaggacuacaacaauuggaugaaggguauuggcuggaucccuauugggucacuugacgucgaaaaagugaagaaggccggagaugcauugaacgagaaaaaguauagacagcacccagacacacucaaauucacuagcaucguggauagucccgucaugguucaggcuaagcaaaauaccaaacaggugucugacauacuguacaaggccaagggcgaagauguaaaacacaaguauacgauguccccugaccuaccgcaguuucugcaggcuaaaugcaacgcauacaauauuagcgaugugugcuauaagagggacuggcaugaucucaucgccaaagguaacaauguccugggggacgccauuccaaucacagcugcgaaggcaucgcggaacauagccucagauuacaaguacaaagaggcuuaugaaaagucuaaaggcaagcacgugggauuccgcagucuucaagacgaccccaaauugguucauuacaugaauguggccaagcugcaguccgauagagaguauaagaaaaacuacgagaacaccaagacuagcuaucacacaccuggcgacauggucucuaucaccgcagccaaaauggcucaggauguggcgacuaauguuaacuacaagcagccauuacaucacuauaccuaccuccccgacgccaugagccuggaacacacaaggaaugugaaccaaauucaguccgauaaugucuacaaagacgaguauaacucauuucuuaaggggaucggauggauuccuaucgguagucuggaaguagagaaggugaaaaaggcaggcgaugcuuugaaugagcguaaauaccggcagcauccggacacgguuaaguucaccagcgugcccgauucuauggggaugguccucgcccagcacaacacuaaacaacuguccgaccuaaauuauaagguggaaggagagaaacugaagcauaaguacacaauagauccagaacucccucaguuuauucaggcaaaaguaaacgcccugaauaugucagacgcucacuauaaggccgauuggaaaaagaccaucgcgaaaggcuacgaccuucgacccgacgcaaucccaauuguggccgcuaagaguagcagaaacaucgccuccgauuguaaguauaaagaggcuuacgaaaaggcaaaagguaagcaagucggguucuugucucugcaggacgauccuaaauuaguucacuacaugaauguggccaagauucagucggacagggaguauaagaaaggcuacgaggcuagcaagacaaaauaucauacuccccucgauauggugucagucaccgccgcaaagaaaucccaggaaguggcgacgaacgccaauuaccgccaaaguuaucaccauuacacacugcuuccagacgcucugaacguugagcacucucggaaugccaugcagauacagagcgauaaccuauauaaguccgacuuuaccaacuggaugaagggaaucggcuggguaccgauugaaucacucgagguggaaaaagcaaagaaagcuggggagauccugucugagaagaaauacagacagcauccugaaaaguugaaauucacuuacgccauggauaccauggagcaagcacugaauaagagcaacaaguuaaauauggacaaaaggcucuauacagaaaaguggaacaaagauaagacuaccauucacgucaugcccgacacaccagacauccugcuuagucgcgugaaucagauaacgauguccgauaaacuguacaaggccggaugggaggaagagaagaaaaaggguuaugacuugcgacccgaugcuaucgcgauuaaagccgcacgggcuagccgugacaucgccucugauuacaaguauaaaaaggccuacgagcaggcaaagggcaaacacauuggguuuagaucacucgaagacgauccuaagcugguucauuucaugcaaguggcuaaaaugcaauccgacagggaguauaagaaaggauacgaaaagaguaagaccagcuuucacacuccagucgauaugcuaucggugguagccgcgaaaaagucucaggaggucgcuacaaacgccaauuaccgcaacgugauccauaccuauaauaugcugcccgacgcaauguccuucgagcuugccaaaaacaugaugcagauacagagcgauaaucaauacaaggcugacuaugcagauuuuaugaaaggcauugguuggcucccucuggggucauuggaagccgagaagaacaaaaaggcgauggaaaucaucagugagaagaaauaccggcagcacccggacacucugaaguauucuacauuaauggacuccaugaauaugguucucgcucagaacaaugccaaaauuaugaacgaacaccuguacaagcaagcaugggaggccgauaaaaccaaggugcauauaaugccagacaucccccagauuauccuugcuaaggccaacgcaauuaauaugagcgauaaacuguacaaguugucacucgaggaaaguaaaaagaaaggcuaugaccugagaccugaugcuauccccauaaaggccgcgaaggccagcagggacaucgcauccgauuacaaauauaaguacaacuaugagaaaggaaagggcaaaauggucggguuccgaucucuagaagacgauccaaagcuggugcacagcaugcagguugcuaagaugcaguccgaccgcgaguacaaaaagaauuaugaaaacacgaaaacuucauaccauaccccugccgauaugcuuucugugacagcagcuaaggacgcccaagccaauauuaccaacacuaauuacaaacaccucauccauaaguauauucuguugcccgaugcgaugaacaucgaguuaacacggaauaugaacagaauacagagugacaaugaguacaagcaggacuauaacgaaugguacaaaggacugggcuggucgccagcugguagccucgaggucgaaaaggccaagaaagccaccgaguaugcuuccgaucagaaauacaggcaacacccuucuaauuuccaguuuaagaaacugacagacucaauggauauggugcuugccaagcagaacgcacacacuaugaauaagcaucuguauaccauugacuggaacaaagauaagacgaaaauccacguaaugccggacacacccgauaucuugcaggccaagcaaaaccagacccuauacagccagaaacuguacaagcucgggugggaagaggcucugaagaaaggauaugaccuuccaguggaugcgauuuccguucaauuagccaaggcaagucgugacaucgcuucugauuacaaauauaagcagggcuaccgcaaacagcugggucaucacgucggcuuccggagccuccaggacgacccuaaguuggugcugucaaugaauguggccaagaugcaauccgagagagaauauaaaaaggauuuugagaaauggaagacuaaauucaguagccccgucgacaugcucgggguagugcuggcaaagaagugccaggaacuuguuucugauguggacuacaaaaacuaucugcaccaguggaccuguuugccagaucagaaugacgucgugcaagccaagaaaguuuacgagcuacaguccgagaaccuguacaagucagaucucgaaugguuaaggggaauaggcuggagcccucuggggucgcuugaggcugagaagaauaagcgagccucugagauuaucagugagaagaaguaucggcagcccccggaccgcaacaaguuuacauccauuccagaugcgauggacaucgugcuggcaaaaacuaaugccaagaacagaagcgauaggcucuaccgggaggcuugggacaaagauaagacccagauacauauuaugccugacacgcccgacaucgucuuggccaaagcaaaucugaucaacacaucagauaagcucuaucgaaugggauacgaggaacugaagagaaaaggcuaugaccuuccaguggaugcuauucccaucaaggccgcuaaagccucccgcgagauugcaucugaauacaaguauaaagaggguuucaggaagcaacuagggcaccauauaggagcgcguaauaucgaagacgauccuaagaugauguggagcaugcacguagccaaaauucagagugaccgggaguacaagaaagauuuugagaaguggaaaaccaaguucuccagcccgguggacaugcugggcguugucuuggcuaagaaaugccagacuuuagugucugauguggacuacaagaacuaucugcaucaauggacaugucuccccgaucagucagacgucauccacgccagacaggcauacgaucugcagagugacaaucuuuauaaauccgaccugcaauggcucaaggguaucggcuggaugaccagcgggucuuuggaagaugagaaaaacaagagggcuacucagauucugucggaccacguuuaccgccagcauccagaucaguuuaaauucucaagccuaauggacuccauaccuauggugcuggccaagaauaacgcaaucacaaugaaccaccgacucuauaccgaagccugggauaaggacaaaacgacuguacauauuaugcccgauaccccugaggugcuucuggcgaagcaaaauaaagucaacuacagugaaaaguuauauaaauugggacuggaggaggcuaagagaaagggcuacgacaugcggguggaugccaucccaauuaaagcagccaaggcuucuagggacaucgccagcgaauuuaaauacaaggagggguaucgcaaacagcucggacaccauauaggcgcacgugcuaucagagaugaccccaagaugaugugguccaugcacguugccaagauucagucagaccgggaauacaaaaaggauuucgagaaauggaagacaaaauucaguucuccuguggacaugcugggugucguacuugcgaagaagugccagacccuggugagcgauguugacuauaaaaauuaccuccaccaauggacauguuugccagaucaguccgacgugauccaugcuaggcaggccuaugaucugcagucagacaacauguacaagagcgauuuacaauggaugcgcgggauuggaugggucucuaucggcucccuagacguggagaaaugcaagcgagcaacugaaauacugagugauaaaauuuauagacagcccccggaccgguuuaaguucaccagcgucacggauucgcucgaacaggugcuugccaagaauaacgcuaucacaaugaauaaaaggcuguacacugaagcaugggacaaggacaaaacccaaauucacaucaugccugauacaccagagauaauguuggcccgcaugaacaagaucaauuacuccgaaucucuguauaaacucgcgaacgaggaggccaagaaaaaggguuacgaccugagaucagaugcuauucccaucguugcagccaaggcuagcagggacauuaucagugauuauaaauacaaggacggcuauuguaaacagcuugggcaucacauaggagcccggaauauugaagaugacccuaagaugaugugguccaugcacguggcaaaaauccagucugaucgugaguacaagaaggacuuugaaaaauggaagaccaaauucagcucaccaguagauaugcucggcgugguccuggcuaagaaaugccagacuuugguuuccgacguggauuauaagaacuaccugcaugaguggaccuguuuacccgaccaaagugacgucauccacgcccgccaggcguacgaucuacagagcgacaauauuuauaagucugaucugcaguggcuccgagggaucggaugggugccgauaggcucaauggacguagugaaaugcaagagagccacagaaauucuuuccgauaacaucuacaggcaaccucccgacaaacugaaguuuacgagcguuacugauucuuuggaacaggugcuggccaaaaauaacgcucucaacaugaauaagcggcuguauaccgaggccugggacaaggauaaaacacagauucauaucaugccagacaccccugaaauaaugcuugcacgccagaacaagaucaauuacagugagacuuuauauaaacuggccaacgaagaggcuaagaaaaaggguuacgaucucagaucggacgccauucccaucgucgcggcuaaagcauccagggacgugauuagcgauuauaaguacaaggacggguaccggaaacaauugggacaccauaucggcgcccgaaauauugaagaugacccaaagaugauguggucaaugcacgucgcuaaaauccagucugauagagaguauaagaaagacuucgagaaguggaagacaaaauuuagcucccccguggauaugcugggcguuguacuagccaagaaaugccagacccuggugagugacgucgauuacaagaacuaucuccacgaauggacgugucuuccugaccaaaaugaugugauacaugcacgccaggccuacgaccugcagucagauaacauuuauaaaucugacuugcaguggcugagggggaucggauggguuccaaucgguagcauggacguggucaagugcaagcgggcugcggagauucucuccgauaauauauaccgucaaccgcccgacaaacugaaguucacaagcgugacagauagcuuagaacagguacuugccaaaaacaaugcacugaacaugaauaagagacucuauaccgaggccugggacaaagauaagacccaggugcacaucaugccugacacuccagagauuaugcuagcuaggcagaacaagaucaauuacuccgaaucucuguaccgccaagcaauggaggaagccaaaaaggagggcuaugauuugcggucagacgcuauucccaucguugccgcgaaagcaagccgagauauagccucggacuacaaguauaaagaggcuuacagaaagcagcuggggcaucacaucggagccagggcaguccacgaugacccuaaaauuauguggucccuccauaucgcuaaggugcagagugaucgcgaguauaagaaagacuuugagaaguacaaaacacgguauucuagcccaguggacaugcuuggcauuguccuggccaagaaaugucagaccuugguuucagauguggacuacaagcacccccugcaugaauggaucugccucccugaucaaaacgacauaauucacgcgagaaaggccuacgauuuacaguccgacaaccuguauaaaucugaucuugaguggaugaaggguaucggguggguaccgaucgacagucuggaagugguccgugcuaaaagggcaggagagcuacucagcgauacaauuuaccggcagcgcccagaaacucugaaguucacguccauaaccgacacacccgaacagguguuggccaaaaauaacgcucugaauaugaacaagcgacucuauacugaggcaugggauaaugacaagaaaaccauccauguuaugccugacacacccgaaauuaugcuugccaagcugaacagaaucaauuacucagauaaauuauauaagcuggcuuuggaggaaagcaaaaaggagggcuacgaccucaggcuggaugccauuccaauccaagcagccaaggcgucucgggacauagcuagugauuauaaauacaaggaaggcuaccgcaaacagcuagggcaccacaucggagccagaaacauuaaggacgauccuaaaaugaugugguccauccauguggcaaagauucagagcgacagggaguauaagaaagaguuugaaaaguggaaaaccaaguucucaucucccgucgauaugcuuggugugguacuggccaaaaagugucaaauccucguuuccgacauugauuacaaacacccacugcaugaguggacuugcuugccggaccagaaugaugugauacaggcucgaaaggccuaugaccugcagucggacgcaaucuacaagagcgaucucgaauggcuucggggcauugggugggucccuaucggaaguguggagguggagaaagucaagcgugcuggcgaaauccugucugacagaaaauaucgccaacccgccgaucaguuaaaguuuacguguauuaccgacacaccagagauaguucuggcgaaaaacaaugcauugacuauguccaagcaccucuacaccgaagccugggaugcugacaagacaagcauccaugugaugcccgauaccccugacauucugcuagccaaaucaaacagugcuaauaucucccagaaacuuuauacuaaagguugggaugagagcaagaugaaagacuacgaucugagggcagacgccauuucuaucaagucagcgaaggccagccgggacauagcuuccgauuacaaauauaaggaagcauacgagaaacagaaggggcaccacaucggagcccaaucuauugaggacgauccaaaaaucaugugcgcuauucaugccggcaagauccagagugaaagagaguauaagaaagaguuccagaaguggaaaacaaaguucucgagccccguagacaugcucuccauacuguuggccaaaaagugucagacguuagugaccgauauugacuaccgcaacuaucugcacgaguggacuugcaugccugaucaaaaugacaucauucaggccaaaaaggcuuacgaucuccagucagacucugucuauaaggcggaucuugaauggcugaggggcaucggguggaugccggagggaagcguggagaugaaccgaguuaaaguggcccaagaccuagucaacgaacggcuguacagaacaaggccagaggcacucaguuuuaccuccauaguggauacccccgaaguaguuuuggcuaaggccaauucacugcagaucucugagaaacuuuaccaggaagcauggaacaaggacaaaagcaauauuacaaucccuuccgacacuccagagaugcugcaggcccauauuaacgcucuccaaaucaguaauaaguuauaucagaaggauuggaacgacgcgaaacagaaggguuacgauauacgcgccgacgcaauugagaucaaacacgcuaaggccagccgugaaaucgccucugaguauaaauacaaggaaggcuaucggaagcagcuggggcaccauaugggauucagaacguugcaagaugaccccaaaucagugugggcuauucacgcagccaagauccaguccgauagggaguacaaaaaggcuuaugagaaaagcaagggcauacauaauaccccucuggacaugaugaguauuguccaggcgaagaaaugucaggugcucguuucugauaucgacuaccgcaacuaccuucaccaauggacaugccugcccgaucagaaugacgugauucaggccaagaaagcauaugaucuacaauccgacaaccuguacaagucggaccucgaaugguugaaagguaucggguggcugccagagggaagcgucgaagugaugcgaguaaagaaugcccagaaccuucugaaugagcgguuauauagaauaaaaccggaagcucucaaguuuacuucaaucguggauaccccugaggucauucaggcaaagaucaacgccguucagauuuccgagccccuguacagggacgcuugggaaaaagagaaggccaaugugaacgucccagcagauacaccuuugaugcugcaaucuaaaaucaacgcgcuccagauuaguaauaagcgcuaucagcaggccugggaagacgugaaaaugaccggcuacgaucuuagagcugacgccaucggcauacaacaugcaaaggcuagccgggauaucgccucagacuaucuguacaagacugcguacgagaaacagaaggggcacuauauuggaugcagguccgccaaagaagaucccaagcuaguaugggcugcaaacgugcugaaaaugcagaaugaccgucucuacaagaaggccuauaacgaucacaaagcuaagaucagcauuccaguugacauggugucuauaagugcagccaaagagggucaggccuuggcuuccgacgucgauuaccgacauuaucugcaccauuggagcuguuucccugaccaaaaugaugugauccaggcacgcaaggccuacgacuuacagucagauucuguuuauaaagcggaccuugaguggcugagaggcauuggguggaugcccgaaggaucggucgagaugaaccgggugaagguggcucaggaucucguaaaugaaaggcuguaccgcacgagaccggaggccuugagcuuuacauccaucgucgacaccccagaagugguucuggcaaaggccaacagucuccaaauuucugagaaacuuuaccaggaggcuuggaauaaggauaaaucaaacaucacuauaccuagcgacacccccgaaaugcugcaggcccacaucaaugcacuacaaauuuccaacaagcuguaucagaaagauuggaaugacacaaagcagaaaggcuacgauauccgggcugacgccauugagaucaagcacgcgaaggcaaguagggaaauagccucugaguauaaauacaaggaggguuaucgaaaacaguuagggcaucacaugggauuccguacucuccaagacgauccaaagagcgugugggcuauucaugccgcuaaaauccaguccgacagagaauacaagaaggcauaugagaaaucaaagggcauccacaacacaccccuggauaugaugagcauuguccaggccaaaaagugccagguguugguuucugacauagauuaccgcaauuaccuucaucaauggacaugucugccugaccagaacgaugugauccaggcgaaaaaggccuaugaccuccaguccgauaaucuguacaagagugacuuggaauggcugaaaggcauuggguggcuaccggagggaucaguagaagucaugcgggugaagaacgcucaaaaccuccuuaaugagaggcuguauagaaucaaaccagaggcauuaaaguuuacgagcauuguggauacccccgaaguuauccaggccaaaauaaacgcuguccagaucucggagccucuguaccgcaaugccugggaaaaggagaaggcaaacgugaauguacccgccgacacuccacucaugcugcaauccaaaauuaacgcuuugcagaucucuaauaagcgguaucagcaggcgugggaagaugugaaaaugacagguuacgaccuuagggccgacgcaauuggcauccaacacgcuaaggccagucgagauauagcaagcgacuaucuguacaaaaccgccuacgagaagcagaaggggcacuauauuggaugcagaucagcuaaagaggauccuaagcucgucugggcggccaacgugcugaaaaugcagaaugaccggcuauacaagaaagcauauaacgaucauaaggcuaaaaucuccauucccguugacauggugucuaucagcgccgccaaggaaggccaggcuuuggcaagugaugucgacuacaggcacuaucugcaucacugguccuguuucccagaucaaaaugacgugauccaggcccgcaaggcguacgaucuccagagcgacucuguuuauaaagcugaccuugaguggcugcgugguauuggguggaugccugaaggcucaguggagaugaacagaguaaaggucgcccaggauuuagugaaugaacgacuguacaggacucggccggaggcacucuccuuuacaagcauaguugacacccccgaggugguccuggccaaagcuaacaguuugcaaaucucugaaaaacuuuaccaggaggcauggaauaaagauaagucaaacauuacgaucccauccgacaccccugaaaugcugcaggcccacauuaacgcucuccagaucagcaauaagcuguaucaaaaagauuggaacgacacaaagcagaaaggauacgauauacgcgccgacgcgaucgagauuaagcaugcaaaagccucgagagagaucgcuucugaauauaaguacaaggagggcuauaggaaacagcuagggcaccauaugggauuccggacuuuacaagaugaccccaagagugugugggccauucacgcagcuaaaauacaguccgaucgcgaauacaagaaagccuaugaaaagagcaaggguauccauaauaccccacuggacaugaugucaauuguacaggcgaaaaagugccagguguuggucucugauaucgacuacagaaacuaccuccaccaauggacaugucugccugaccagaaugauguuauccaggccaaaaaggcauaugaccuucagagcgauaaccuguacaaauccgaccucgaauggcugaagggcauugggugguugcccgagggaaguguggaggugaugcgagucaaaaaugcucaaaaccuucugaaugaaaggcuauaucggauaaagccggaggcccucaaguuuacuucaaucguggauaccccagaaguuauucaggcuaaaaucaacgcaguacagauuagcgagccucuguaccgugacgccugggaaaaggagaaagccaaugugaacguccccgcugauacaccauuaaugcugcaguccaagaucaaugcauugcaaauaucuaacaaacgcuaucagcaggccugggaggacgugaagaugaccggcuacgaucucagagcggacgcuaucgguauucaacacgccaaggcaaguagggauaucgccagcgacuaucuguacaaaacugcuuacgaaaagcagaaagggcauuauauuggcugccgguccgccaaggaggaucccaaacuuguuugggcagcuaaugugcugaagaugcagaacgacagacucuacaagaaagccuauaacgaccacaaggcgaaaaucucaauaccugucgauauggugucuauuucggcagccaaggaaggacaggcuuuggccagcgacguagauuaccgccauuaucugcaccgaugguccuguuuccccgaccaaaaugaugugauccaggcaaggaaggcuuacgaccuucagagugaugcccuguauaaggcggacuuagaguggcuacggggcauuggguggaugccacagggaucuccugaaguccucagaguuaagaacgcccaaaauaucuuuugcgauagcguguaccguacgccggucgugaaccugaaauacacaucaauaguugacacccccgaggugguacuggcuaaguccaaugcagagaacaucagcauuccaaaauaucgcgaagugugggauaaggacaaaacuucuauccauauuaugccugacacccccgagaucaauuuggccagggcuaacgcccucaaugucaguaacaagcuguaccgggaagguugggaugagaugaaagcaggcugugacgugagacuugaugccauaccaauucaggcugcgaaggccucccgagagaucgcaucagacuauaaguacaaacuggaucacgaaaagcagaaagggcacuauguuggaacauuaacggcuagggacgauaauaagauccgcugggcccucauugcagacaaacugcagaacgagcgggaauacagauuggauugggccaaguggaaggcuaaaauccaaagcccugucgacaugcuuucuauucugcauucgaaaaauucccaggcgcuagugagugauauggacuauaggaacuaccuccaccaguggaccugcaugcccgaucagaaugacgugauacaagccaaaaaggcauacgagcugcagagcgacaacguauauaaagcugaucuggaaugguugcgcggcaucgguuggaugccgaacgacucagucucugugaaucaugccaagcacgccgcagauauuuucuccgagaagaaauaccguacuaagaucgagacacucaacuucaccccuguugacgaucggguggacuaugucacugcuaaacagagcggggaaauucuggaugacaucaaguacagaaaagauuggaaugccacaaagaguaaguauacccuuacagagacuccacuguuacacaccgcgcaagaagcugcccgaauacucgaccaguaccuguauaaagagggcugggaaaggcagaaggcaacgggauacauccuacccccugaugccgugccauuuguucaugcucaccauugcaacgacgugcagucagaguugaaauacaaggcagagcacgucaaacaaaagggccauuauguggggguacccaccaugcgcgaugacccuaagcuggugugguucgaacacgccggacagauucagaaugagcggcuuuacaaagaagacuaucacaagacaaaagcuaagaucaacauuccagccgauaugguuuccguccucgcggcaaaacagggccaaacucuggugagcgacaucgauuacagaaauuaucugcaucaguggaugugucaccccgaccagaacgaugugauacaggccaggaaggcuuacgacuugcaaucugauaaugucuaucgcgccgaccuugaguggcucagagguauuggguggaucccgcuggauaguguugaccaugugcggguaaccaaaaaccaggaaaugaugagccagaucaaguacaagaaaaaugcauuagagaacuacccuaauuuucgauccguggucgaucccccagagauugugcuggcuaagauaaacucuguuaaucaaucagacgugaaauauaaggaaacauucaacaaagccaagggaaaguacacuuuuagccccgacaccccucacaucucccacucgaaagauaugggcaagcuauauucuacgauucucuacaaaggugcgugggagggcacaaaggccuauggguacacccuggacgaaagguauaucccaauugucggagcaaaacaugcugauuugguaaacagugagcugaaguacaaggagacuuacgaaaaacagaagggccacuaucuugccgggaaagugaucggagaguuccccggcguugugcauugccucgacuuucagaagaugcguagcgcucugaauuacagaaaacacuaugaagauacaaaggcaaacguccauauaccuaaugacaugaugaaccacguguuagccaagcggugucaguacauccugucagauuuggaguaucgccacuacuuccaucaauggaccucccuccuggaagaaccaaaugugauuaggguccgaaacgcccaggagauccuuucugacaauguuuacaaagaugaccugaacuggcuaaaggguauugggugcuaugugugggauacuccgcagauccuccacgcuaaaaagagcuacgaccugcagucccaauugcaguauaccgcagccggaaaagaaaaucugcagaacuacaaucuuguaacagauacgccccucuaugugaccgcgguccagaguggcauaaacgcuucagagguuaaguacaaagaaaauuaucaucaaauuaaggacaaguacacuacagugcuggagaccguggacuacgauagaacucggaaccugaaaaaucuauauagcucuaacuuguacaaggaagccugggaccgcgucaaagcaacauccuauauccucccuaguagcacccugucacuuacgcacgccaagaaccagaaacaucuggcuucucacaucaaguacagggaggaguaugaaaaguuuaaagcacuauacacacucccaagauccguagaugacgaucccaauaccgcccggugucugcguguggguaaguugaacauugaccgccuguauaggucgguuuacgagaaaaauaagaugaaaauccacauugugccugauauggucgaaauggugacugcgaaggacagccagaagaaaguuagugagauagauuaccgacuuagauuacaugaauggaucugccacccagaccugcaagugaacgaucauguccggaagguaaccgaccagauuuccgacaucguguauaaagaugaccucaauuggcugaagggcauuggguguuacgucugggauacacccgagauccuacacgcuaaacacgccuaugacuugagggaugacauaaaguacaaggcacauaugcugaaaacucgcaacgauuauaagcucgugaccgacacaccgguuuacgugcaggccgucaaaucuggaaagcagcuuucagaugcuguguaucacuacgacuacguacauagcgugagaggcaaaguugccccuacgacuaagaccguggaucuggaccgggcacuccacgcuuauaaacugcaauccucuaauuuauacaagaccagcuugaggacccugccaacuggguaucgccuucccggagauacaccucauuucaagcacaucaaagacacccgauacaugaguucauauuuuaaguacaaagaggccuaugaacacacgaaggcguacggcuacacucugggucccaaagacgucccauucgugcauguuagacgugucaacaaugugaccuccgagcggcucuauagggaacuguaccacaagcuaaaggauaaaauucauacaaccccggacacuccugagauccgccagguaaagaaaacacaggaggccgugagcgaacuuauuuauaagucugacuuuuucaaaaugcaggggcacaugauaagucugcccuacaccccacaagucauccacugcagauaugugggagacauuacauccgauaucaaguacaaggaggaccuccagguuuugaaaggcuucggcuguuuucuguaugauacucccgacauggugcggagcaggcauuuacgaaagcuguggucaaacuaccucuacaccgauaaagcuagaaagaugcgcgacaaauauaaggucgugcuugauacgccugaauaccggaagguacaggagcugaaaacacacuugucggaacugguuuauagggcagccgggaagaaacagaagucuaucuucaccagcgugccagacacucccgaucuccuacgugcuaaaagaggacaaaagcugcagucccaguaccuuuaugucgagcuggccaccaaggagcgcccucaucaccaugcagguaaucagacaacugcgcucaaacacgccaaggacgugaaagacauggugagugaaaagaaauacaagauucaauaugagaaaaugaaggauaaguacacgccaguuccggacacccccauauugaucagggcuaaacgggcauacuggaacgccucagaucugcgauauaaggaaacauuucagaaaaccaagggcaaauaccacacugucaaggacgcuuuagauauuguguaucauagaaagguaacagacgauaucucuaaaauuaaguacaaagagaauuauaugagccagcuggggaucuggcgcuccauaccugacaggccagaacacuuccaucaccgggccgugaccgauacugucagugacgugaaguacaaagaggaucucacauggcuuaagggaaucggcugcuaugcauacgacacccccgacuuuacgcuggccgagaagaacaaaacuuuguacagcaaguauaaauacaaggaaguuuucgagagaaccaaaucugauuuuaaguauguggcugacuccccuauuaaucgucauuucaaguacgcgacacaacugaugaacgagaaaaaguaucgcgccgauuacgagcagaggaaagacaaguaucaccucgucguggaugaaccacggcaccuacuggcaaaaaccgcuggugaccagaucucacagauuaaguacaggaaaaacuacgaaaagagcaaggauaaauuuacuucgaucguagacacacccgagcauuuaagaaccacgaagguuaauaaacaaauauccgauauucuguauaagcucgaauacaacaaagccaagccuagaggguauacaacuauccacgacaccccgaugcuuuugcaugugcgcaaggucaaagaugaggugucugaccugaaguacaaagaaguuuaucagcggaauaagaguaacuguacaauugagcccgaugccgugcacaucaaagcagcuaaggacgccuacaaggucaauaccaaccuggacuauaaaaagcaguacgaggcgaauaaagcucacuggaaguggacuccagauagaccugacuuccuccaggccgcaaaaucaagccuucaacaguccgauuuugaauacaagcuggaccgagaguucuugaagggaugcaaacugucugugacggaugacaagaacaccguacucgcccuaaggaauacacugauagaaagcgauuuaaaauauaaggagaaacaugugaaggaacggggcacuugccacgcuguccccgacaccccacagauccuucuggcaaaaacaguuaguaaccucgugucagagaauaaguacaaggaucaugugaaaaagcacuuggcccagggcuccuauaccacucugccugagacacgcgacaccguccaugugaaagaaguuacgaagcacguaagcgauacuaacuacaaaaagaaguuugugaaagagaaggggaaaucuaauuauuccauuaugcuggaacccccagaggucaagcacgcuauggaaguggccaaaaagcaaagugacguugcauacagaaaggaugcgaaagagaaccuccauuauacaaccguggccgaccguccggacaucaagaaagcuacucaggccgcaaagcaggcuagcgaggucgaauacagggccaaacaccggaaggagggaucacauggucuuucuaugcugggcagaccugauauugaaauggcgaagaaagccgcaaaguuguccagccaagugaaauaccgcgagaauuucgacaaggaaaaagggaagacccccaaguauaacccaaaagauucgcagcuauacaagguaaugaaagacgcuaacaaucuggccagugaggucaaguauaaagcagaucucaagaaauuacacaagcccgugacagacaugaaggagucucugaucaugaaccacguucuuaauaccucacagcuggcuuccagcuaccaguauaaaaagaaauacgaaaagucuaaaggacauuaucacacgauaccugauaaccucgagcaauugcaucugaaggaagccacagagcugcagagcauugugaaguacaaagagaaguacgaaaaagagaggggcaagccaaugcucgacuucgaaacucccaccuauaucacagccaaagagucccagcagaugcaaagugguaaggaauaccgaaaggauuaugaggagucaaucaaagggcggaaucuaacuggacuggaagucaccccugcucuuuugcacgugaaguacgcaacaaaaauugccagcgagaaggaauauagaaaagaccuggaggaauccauccgcggcaagggccucaccgagauggaggauacuccggacauguuaagggcgaagaacgcuacgcagauucugaaugaaaaagaguacaagcgugaccuugaacuggagguuaaagggagaggacucaacgccauggcaaaugaaacccccgauuuuaugcgggcccgcaacgcuacagacauagcaucucagaucaaguauaaacagagugccgagauggagaaggcgaauuucacuucagugguagauaccccagaaauuauccaugcucaacaggugaaaaacuugagcucccagaagaaguacaaagaggacgccgaaaagucuaugucguacuaugagacaguccuggauaccccugagauucagagggugcgagaaaaucagaaaaacuuuagccuacugcaguaccagugugaccucaaaaauuccaaagguaagaucacuguuguccaagauacacccgagauauuaagagugaaggaaaaccagaaaaauuucaguucagugcuguauaaggaggacguaucuccaggcacggcaaucgggaaaaccccugaaaugaugcgggucaagcagacucaggaucacauuagcuccgugaaauacaaggaggccaucggacaaggcacacccauuccagaccuuccggagguuaagcgcgugaaagaaacccagaagcacaucaguucugucauguauaaagagaaccuggguaccgggauaccuacuacagugacgcccgaaauugagaggguuaagagaaaccaggaaaauuuuagcucaguguuguacaaagagaaccucggaaagggcaucccaaccccuaucacacccgagauggaacggguaaagcguaaucaggagaacuucuccagcauucuguauaaagaaaaucuuucuaagggcacuccacugccugucacccccgagauggaacgagugaaacucaaccaagagaauuuuucaaguguguuguacaaggagaacguugggaaaggaauaccgaucccaauuacacccgaaauggagagggucaagcauaaucaggaaaacuucuccagcgugcuguacaaagagaauuuagguacuggcaucccuauuccaaucacccccgagaugcagcgcguaaagcacaaccaggaaaaucugucgucugugcucuauaaggagaacauggggaaaggaacgccucuaccggucacacccgaaauggagagaguuaagcauaaucaagaaaacauauccagcgugcuguacaaagagaacaugggcaaggguaccccacuuccugugacucccgagauggaacgggucaaacacaaucaggagaacaucucaaguguguuguauaaggaaaauauggggaagggaaccccacuggcuguuacaccugagauggaaagggugaaacacaaccaggagaauauuucuuccguacucuacaaggagaacgucggcaaagccacugcaacccccgugacaccagaaaugcaacgcguuaagagaaaucaggagaacaucagcucagugcuguauaaagaaaaucuuggcaaggcuacgccuacccccuuuacuccggagauggagcgggucaagcgaaaccaggaaaauuucaguuccgugcuguacaaagagaacaugaggaaggccacaccuaccccaguaacucccgaaauggagagagcgaaacgcaaucaggaaaacauuagcucugugcucuauucggauagcuuucguaagcaaauccaggggaaagccgcauacgucuuggacacaccugagaugcggaggguuagagagacccagcgccauauauccacggugaaguaccacgaagauuucgagaagcauaaaggaugcuuuaccccaguggucacagaccccauuacugaacggguuaagaaaaauaugcaggacuucucagauaucaacuaucgagguauccaaaggaaggugguagagauggaacagaaaagaaacgaccaggaucaggagaccauuacaggccugcgcguguggcggacuaauccggggucugucuucgacuacgauccugcugaggacaacauccaaaguaggagcuuacacaugauaaaugugcaggcccagcguagaucccgagaacaaucucgcucagcuagcgcccuaaguauuuccggaggcgaggaaaagucugagcauagcgaagcacccgaucaccaccuguccaccuauucagacggugggguuuuugcggugaguacagccuacaagcaugcuaaaacgaccgagcucccacagcagcggaguucuuccgucgcaacucagcaaacaaccgugucgagcauccccucacacccuaguacugccggaaagauuuucagggcuauguaugauuacauggccgcagacgccgaugagguauccuuuaaagacggcgaugcuaucauaaacguucaggcgaucgacgaaggcuggauguaugggaccgugcagagaacaggacggacggguaugcugccagccaauuacgucgaggcaauuuga

SEQ ID NO: 59607 - RNA, 3045 nt, Artificial Sequence
  derived and/or modified sequence opt3 from NEBL__Homo_sapiens__NP_006384
augagagugcccgucuucgaggacaucaaggaugaaaccgaggaagagaaaauuggcgaagaggagaacgaagaggaccagguauuuuacaagccugugauagaagaucugagcauggagcucgccaggaaaugcacagagcuuaucuccgacauucgguauaaggaagaguucaaaaagucuaaggauaaauguacuuuuguaacggacucaccaaugcugaaucacgugaagaacaucggggcuuucauuagugaagcaaaauacaagggaaccaucaaagccgauuugagcaauuccuuauauaagcgcaugccggcgacaauagacucugucuuugcuggugaggugacucaacugcagucggaaguugccuacaagcagaaacaugaugcagccaagggcuucucagacuaugcucacaugaaagagcccccugaggugaagcaugcaauggaagucaacaaacaccagagcaauaucaguuaccgaaaggaugugcaagacacccauacauauuccgccgagcuagaucguccagacauuaaaauggcuacccagaucucuaagauuaucagcaacgccgaauacaagaaagggcagggaauaaugaauaaggagcccgcgguaauuggcagaccugacuuugaacacgcaguugaggccuccaaacucucaagucagaucaaguacaaagagaaguucgauaacgaaaugaaggacaaaaagcaccauuauaauccacuggagagcgcuucuuuuaggcaaaaccagcuugccgcaacucuggcuuccaaugugaaauacaagaaagauauucagaacaugcacgaccccgucucagauuugccuaaucuccuguuccuggaccaugugcucaaggccagcaagauguuaaguggucgggaauauaaaaagcuguuugaggaaaacaaagggauguaccacuucgaugcggacgccguggagcaccuucaucacaagggaaaugcagucuugcagucucaaguuaaauauaaggaggaauacgagaagaacaaaggcaagccaaugcuggaauuuguggagacaccguccuaucaggcuagcaaagaggcccagaagaugcaaucggaaaaaguauacaaggaggauuucgaaaaagagaucaagggccgcaguucccuagaccucgauaagacccccgaguuccugcaugugaaauacaucacgaaccuucugagagaaaaggaguauaaaaaggacuuggaaaaugagauuaaagggaagggaauggaacucaacucagagguccuggacauacagagggcuaagcgggccagugaaauggcaagcgagaaagaguacaagaaagauuuagaauccaucauuaaggguaaaggcaugcaggccgggacugacacccuggagaugcagcacgcuaagaaggcggcagaaaucgccucugagaaagauuauaagcgcgaccucgaaacagagauaaaaggaaagggcaugcaagugagcacugauacccuugacguucagcgagcuaaaaaggccucagagauggcaagucagaagcaguacaaaaaggaucuggaaaaugagauuaaagguaaggggaugcaaguguccauggacaucccugauaucuugagagccaaaaggacaagcgaaauuuauucucagcggaaguacaaagacgaggcugagaagaugcuaucaaacuauaguaccaucgccgauacgccagaaauucagcguauaaagacuacacagcaaaauaucagcgcagucuuuuacaaaaaggaggugggagcgggcaccgcuguaaaagacucccccgaaauugagcgcguuaagaaaaaccagcagaauaucucuucggugaaguacaaggaagagaucaaacaugccacugcaauuagcgauccuccagagcugaagagagucaaagaaaaccagaagaauauauccaaccuccaauauaaagagcagaauuacaaggccacacccgugucaaugaccccggaaaucgagaggguccggcgaaaccaggaacaacugagugcugugaaguauaaaggcgagcuucagcgcgggacggccauuucugacccucccgagcugaagagagcaaaagaaaaucagaagaacaucagcaauguuuacuauaggggacaguugggucgggcuaccacacucuccgugacuccagagauggaacgcguuaaaaagaaccaagagaacauuucaagcgucaaguacacccaggaccacaaacagaugaagggcagaccuucucugaucuuagauacacccgccaugaggcacgugaaagaagcgcagaaucauauauccaugguuaaguaucacgaggacuucgagaaaacuaaggggcguggauuuaccccaguggucgaugaccccgugacagaacggguacgaaagaacacccaagugguuagugaugccgcuuacaaaggcguccauccucacaucguggagauggacagaaggccagguauuaucguggaucugaaggucuggcgcacugacccggggagcauuuucgaucuagacccccucgaagauaauauccagucucggucccugcacaugcuuucagagaaagcaagucauuacagaaggcacuggagccgcucgcauuccucuagcacguuuggcacaggauugggcgacgaucgaucagagauaagugaaauuuauccuuccuucucuugcuguagcgagguuacccggccauccgacgaaggggcccccgugcugccuggagcuuaccagcagucacacagccaagguuauggcuacaugcaucagacuucugugucuuccaugcguagcaugcagcacucgccaaaccucagaaccuauagggccauguacgacuauucagcacaagaugaggacgaaguaucuuuucgcgauggggacuacaucgucaaugugcagcccauugaugacggauggauguacggcacaguucagcggaccgguagaacugggaugcugccggcgaacuauaucgaguucgugaauuga

SEQ ID NO: 59608 - RNA, 1056 nt, Artificial Sequence
  derived and/or modified sequence opt3 from NECAB1__Homo_sapiens__NP_071746
auggaggacagccaggaaaccucccccucuucaaacaauaguagcgaggaacuguccucugcccuccaccuuucgaagggcaugucaaucuuccuggauauuuugagaagggcugacaaaaacgaugacgggaagcugagcuuugaggaguucaaagcauacuuugccgauggaguguuaaguggugaggagcuacaugaacucuuccacacaauagacacucauaauacgaacaaucuggauaccgaggaacuuugcgaguauuuuucccaacaccugggcgaguacgaaaacgucuuggcggcucucgaggaccugaaucugucuauccucaaggccauggggaaaacaaagaaggauuaucaggaagcaagcaacuuagagcaguucguuacucgguuucugcuuaaagaaaccuugaaucagcugcaaucccuacagaacucacucgagugugccauggagacaaccgaagaacagacucgccaggaacgacaaggaccugcuaagccagaggugcugaguauucaguggccgggcaaacguagcucuagaaggguacagcggcauaauuccuucucacccaacagcccucaguuuaaugugagugguccagggcuucuggaagaggacaaccaauggaugacacagaucaaucgcuugcagaagcucauugauagacuggagaaaaaggacuuaaagcuggaacccccugaggaagagaucauagaaggaaacaccaaaucucacaucaugcucguccaaaggcagauguccgugauugaggaggaucuugaagaguuccagcuggcauugaagcacuacguugaaagcgccucgucucaguccggcugccuacggaucucaauucaaaaacugaguaacgagagccgcuauaugaucuacgaguuuugggaaaauuccucuguguggaacagccaucuccagacgaauuauucaaagacuuuccagcgaaguaacgucgacuuucuggagaccccagaacuuacauccacuaugcuggugcccgcuagcugguggauauugaauaacuga

SEQ ID NO: 59609 - RNA, 1089 nt, Artificial Sequence
  derived and/or modified sequence opt3 from NECAB3__Homo_sapiens__NP_112508
auggccugcgcuggccugcucaccgugugucuucugagacccccugcaccacagccgcaaccccagacaccuaggcacccacaguuggcccccgacccugggccagcgggacauacuuuauuccaggaugucuuucggcgcgcugacaagaacgaugacgguaaacugagcuucgaggaauuucaaaauuacuucgccgauggcguucuaucccucggggagcugcaggaacuuuucucuggaaucgacggccaccugacggauaacuuggagaccgaaaagcucugcgacuauuucucagagcaucuggguguguaccgacccguacuggcagcccucgagaguuuaaaucgugcugugcuggcagccauggaugcuacaaaacuugaauaugagagagccagcaaggucgaccaguuugugacuagguucuugcugcgggaaaccguuucccagcuacaagcgcuccagucuucgcuggagggggcaucagauacacuugaggcccaggcucacggauggcgcagcgacgccgaaaguguggaggcacaguccagacuguguggcucuaggcgggcuggccgccgagccuugagaagcgucuccaggucaaguaccuggagcccugggucuuccgauacuggacggucaagcgaagcggagaugcaauggcgucuccaggugaaccgccugcaggaauuaauugaccaacuggagugcaaagccccaagacucgagccgcuuagggaagaggaccuggcaaagggucccgauuugcauauacuaauggcucagcggcagguacagguugccgaagagggccugcaagacuuucaccgagcucuccgcuguuacguggauuucacaggggcccagagucacugccugcaugucucugcacagaagaugcuugacggagccuccuuuacccuguaugaauuuuggcaggaugaggcuagcuggagaaggcaccaacagucgccuggcucuaaagcguuucagcggaucuugauugaccaucuccgcgcaccagauacgcugacuaccguguucuuccccgccuccugguggaucaugaauaacaauuga

SEQ ID NO: 59610 - RNA, 828 nt, Artificial Sequence
  derived and/or modified sequence opt3 from NECAP1__Homo_sapiens__NP_056324
auggccaccgagcuggaauacgagagcgugcucugcgucaagcccgacguuuccguguauagaaucccuccaagggcuucuaaccggggcuaccgcgcaucagauuggaaacuugaccagccggauuggacagggcgacugcguauuacgaguaagggaaaaacugccuauauaaaguuggaagacaaaguaagcggugaguuauucgcgcaagcucccguggaacaguacccuggcaucgccgucgagaccgugacagauuccucuagauauuuuguuauuaggauccaggacgggacuggacggucggcauucauuggcaucgguuuuaccgaucgcggggacgccuucgauuuuaaugugucacugcaggaccacuucaagugggucaagcaagagagcgaaauaaguaaagagucccaggaaauggaugcuagaccaaagcuagaccucggauuuaaagagggccagacaaucaagcuguguauuggcaacaucaccaauaaaaagggaggggcaucuaagcccaggacugcccgggguggcgggcuuagccuguugccuccacccccuggaggcaaagugacaauuccaccgcccuccucaaguguagcuaucagcaaccauguuaccccuccacccauaccuaagucuaaucacgguggguccgaugccgacauucuccuggaccuggauucaccagcgcccgugacgacuccggcaccuacccccgucagcgugaguaacgaccucuggggagauuucucuacagccuccagcucggugccaaaucaggcuccucaacccucuaacuggguccaguuuuga

SEQ ID NO: 59611 - RNA, 1983 nt, Artificial Sequence
  derived and/or modified sequence opt3 from NEDD1__Homo_sapiens__NP_001128648
augcaggagaaccugagauucgccagcuccggcgacgauaucaagauuugggacgcuucuucaaugacccucguggauaaauuuaauccccacacaaguccucaugggauaagcuccaucugcuggucuucgaacaauaacuuccuugucacugcaucaagcaguggagacaagauuguuguguccucuuguaaaugcaagccaguaccgcuguuggaauuagccgagggucaaaaacagacgugugugaaucugaacagcaccuccauguaccuagucucaggcgggcucaauaacacagugaauaucugggaucugaagaguaagaggguucaccggagccuuaaagaccauaaggaucaggugacuugcgucaccuauaacuggaaugacuguuacauugcgucuggaucccugucaggcgaaaucauauugcacagcgugacaaccaaccucaguucuacucccuuuggucauggguccaaucagagcguacgccaccugaaauauucgcuguucaagaaaucucucuuaggauccguuucagauaacggcaucgugacacugugggacgucaauagucaaagcccuuaccacaacuuugauuccgugcauaaggcuccagccucuggcauuugcuucagccccgugaacgagcuuuuguuugucaccaucgggcuggacaagcgaauuauccuauaugauacgucaaguaaaaagcucguuaaaacucugguggcagacaccccucuuacagccguagacuucaugccagauggagcuacucuggcaauagguuccagccguggcaagauuuaccaguaugacuugagaaugcucaaaucucccgugaagaccaucucagcccacaaaacaaguguccaguguauugcuuuucaguacagcaccgugcugacgaaguccucuuuaaauaaggggugcucgaacaaaccuacuacaguuaauaagaggagcgugaacgucaaugccgcguccggaggcgugcaaaacucagguaucguacgggaagcaccagccaccaguaucgcuacuguucugccgcagcccaugacaucugccauggggaaaggaaccguggcaguccaggagaaggcuggccucccucgcagcauuaauacggauacccuuuccaaagagacagacucaggcaagaaccaggauuucagcucuuuugacgauacugggaaguccagucugggagacauguucagcccaauaagagaugacgccguggucaauaaagguucugaugaauccaucggcaagggggacggauuugacuucuugccccaacuaaacucaguguucccuccaaggaaaaaucccguuaccaguagcacaucggugcugcauuccucuccgcucaacguauuuaugggcagcccugguaaggaggaaaaugagaaccgggaucugacugcggagucuaaaaagauuuacauggggaagcaggaaaguaaagacuccuucaagcagcuugccaaacuggucaccucuggcgcagagagcggaaauuugaacacaucccccucaagcaaccaaacccgcaauagugaaaaguuugagaaaccagaaaacgagaucgaggcucagcucauaugugaaccucccauuaauggcucauccacuccaaaccccaagaucgccagcucggugacggcugggguugccucaucucugagugagaagaucgcagauuccauuggaaauaaccgacagaaugccccuuuaacaagcauccagauuagauucauacaaaacaugauccaggaaacccuggacgauuuuagggaggcuugccaccgggacauugugaaucuacaggucgaaaugaucaaacaguuccacaugcaacucaacgagaugcauucucugcuugagcguuauagcgugaaugaagguuugguagcggagaucgaacgccugagagaggaaaacaagaggcuccgggcacacuuuuga

SEQ ID NO: 59612 - RNA, 3960 nt, Artificial Sequence
  derived and/or modified sequence opt3 from NEDD4__Homo_sapiens__NP_001271267
auggcccagagccugagacuccacuucgcugcaaggcgguccaacaccuacccccuuucugagacaucaggcgacgaucuggacagucaugugcacaugugcuuuaagcgcccuacucgaaucagcacguccaaugucguucaaaugaaauugaccccacgucagacagccuuagcgccgcugauuaaggaaaacgugcagucucaggagagaucgucaguacccagcagugaaaaugugaacaaaaaguccucuugucuacaaauaagccuccagccuacuagguauuccggguaccugcagucaaguaauguccuugcugauagcgacgaugccucuuuuaccugcauccugaaagacggaauuuauuccucagcagugguugauaacgaguugaaugccgugaacgacggucaucucgucagcaguccagcuaucuguucuggcucccugagcaauuucucgacaucugauaacggguccuacucaaguaauggaagcgacuucggcuccugcgcaucuauuaccagcggugggucauauacuaacagugugaucuccgauuccucuucauacacauuucccccuagugacgauaccuuccugggaggcaaucucccaagcgacuccacgucuaaccggucgguacccaaucgcaacacuaccccuugugaaauauuuagcagauccacaucaacugacccauucguucaggaugacuuagagcacggccuggagaucaugaagcucccggugaguaggaacaccaagauucccuugaaacgguauucuagccuggucaucuuuccucgcuccccaucaacaacccgacccacgagcccuacuucucuaugcacacuccuguccaaggggaguuaccaaaccagccaucaguucauuaucucuccauccgaaauagcccacaaugaggauggaacuucagcuaaagguuuucuuaguacagccgugaacggccugagauugagcaagaccauuuguacgcccggggaagugagggacauccggccgcuccaccguaaaggaucgcugcagaagaagauugucuuauccaauaacaccccucgccagacaguuugcgagaaaucuagcgagggcuacucaugugugaguguacauuucacucaaagaaaggcggcaacccuggauugcgaaacaacuaauggugacuguaaacccgagauguccgaaaucaagcucaacucugauagcgaguauaucaaacuuaugcacaggaccuccgccugccugccaucaagccagaauguggacugccagauuaacauaaauggggaauuggagcggccucauagucaaaugaacaagaaucacggaauccuacgacgcucuauuucccugggcggcgcuuaccccaacaucagcugucucucgucacugaaacacaauugcucuaaagggggaccaagucagcuucugauaaaguuugccuccgguaacgagggcaaagucgauaauuugagcagagacucuaacagggauuguacaaacgaacucagcaauuccugcaagacccgggacgacuuccugggacagguggauguucccuuauauccucugccaacugagaacccgcgccuagaaagacccuacacguucaaagacuuugugcuccauccuaggucacacaagagucgugucaaaggguaucugcggcuuaagaugacauacuugccaaagaccagcggcucugaggaugacaaugcagaacaggcugaggagcuggaacccgguugggugguacucgaucaaccugacgccgcgugucaucugcagcagcagcaagagccaagcccccuuccgccugggugggaggaacgacaggauauucugggcagaacuuauuacguuaaccacgaaucaaggcgcacccaguggaaacggccaacaccccaggacaauuugaccgaugccgagaacggaaauauccaacuccaggcacagagagcuuucacuacaaggcgccagaucagugaggaaacggagagcguggacaaccgagaauccucugagaauugggagauuauccgggaagaugaggccaccauguacucgaaccaggcuuuuccuucacccccaccuagcuccaaucuggacguccccacucauuuagccgaggaacugaacgcacgucuaacaauuuucggcaauagugccgugucucaaccagcuagcuccucaaaccacucuagcagaagggggagucuccaggcguauaccuuugaggaacaaccgacacugccuguccuuuugcccacuuccagcggacugccacccgguugggaggaaaagcaggaugagcgcggccggucuuacuauguggaccacaauucaagaaccacgaccuggacaaaaccuacuguucaggcaaccguggaaacaucccagcucaccaguagccaaucgucugccgggccacagucccaggcuagcacuucagacaguggacagcaaguaacgcagcccucugagauagaacagggcuuccugccuaaggguugggaggucaggcaugccccgaacgggcgaccauuuuucaucgaucacaacacaaaaaccacuacaugggaggacccccgcuuaaagauuccugcacaucugcggggcaagaccucccuugauacuagcaaugacuugggaccacuucccccuggcugggaagagagaacccacacagaugggaggaucuuuuacaucaaccacaauauuaaacguacgcagugggaagacccgcgccuggagaacguggccauaaccggacccgcuguuccauauucacgggauuacaagagaaaauaugaguucuuuaggcgaaagcuaaagaagcaaaaugacaucccuaacaaguucgaaaugaaacugcggcgcgccacugugcucgaggauaguuacagaaggauuaugggugucaagcgggcagacuuucugaaagcgcgacuuuggaucgaguucgauggcgaaaagggguuggacuacggaggcguggcuagagaaugguucuuucugauuagcaaagagauguucaaucccuauuacgguuuauuugaguauuccgccacagauaacuacacccuccagaucaauccaaacucugggcugugcaaugaagaccaucuuagcuauuucaaguuuauaggccgcguagcaggaauggccguguaccacggcaaacuguuggacggguucuuuaucaggccuuucuauaagaugaugcuccauaagcccauuacacugcacgauauggaguccguugacucagaauacuacaacucucuacguuggauccuggagaaugauccaacugaacucgaccugcgguuuauuaucgaugaggagcuuuucggacagacccaucaacacgaauugaaaaacggcgguagugagauagucgugacgaauaagaacaaaaaggaauauauuuaccuggugauccaguggagauuugucaacaggauucagaaacagauggcugccuucaaggagggguuuuucgaauuaaucccgcaagaccucauaaagaucuucgaugagaaugagcuggaacuucugauguguggacuaggcgacguugaugugaacgacuggcgcgagcacacaaaauauaagaaugguuacucggcaaaccaucaggugauucagugguuuuggaaagcuguacucaugauggauagcgaaaagcgaaucagacuguugcaguucgucaccggcacuucccgggugccuaugaauggguuugccgagcuguauggaucuaacggcccccaaucauucaccguugaacagugggggacaccagagaaauuacccagggcgcacacuugcuuuaaucgccucgaccugccuccauacgagagcuucgaggaacuuugggacaagcugcagauggccauugaaaacacccagggauuugauggcguggacuga

SEQ ID NO: 59613 - RNA, 2928 nt, Artificial Sequence
  derived and/or modified sequence opt3 from NEDD4L__Homo_sapiens__NP_001138439
auggccaccggccugggggagcccguguacggacucagcgaagacgagggugaauccagaauccuuagggucaagguugugucuggcauugaucuggcuaaaaaggacauauucggggcaucagauccuuauguaaaauugaguuuauacguggccgacgagaaccgggaacuggcgcuaguccagacaaagacuaucaaaaagacgcucaauccaaaguggaacgaggaguuuuauuuccgcgugaauccgagcaaccaccgacugcuuuuugaaguuuucgaugagaaucgucugaccagagacgauuuucuaggacaaguggacgucccccucucccaucugccuacagaagauccaacuauggagaggcccuacaccuucaaagacuuucugcuccggccucgcucucacaagucgagagugaaaggcuucuuaaggcugaagauggcuuauaugcccaaaaacggugggcaggaugaggaaaauucagaccagcgggaugacauggagcauggaugggaaguaguugacagcaacgauagugccucccagcaccaagaggaacuucccccuccaccguugcccccuggcugggaggagaagguggacaaucugggccgcacauacuaugucaaccauaauaaccgaaccacucaguggcacagaccaucucuaauggaugugagcuccgaaucagacaauaacauuaggcagaucaaucaggaggcagcccaccggcguuuucgcaguagaaggcauauuagcgaagaucucgagcccgaaccuucugaagggggagacgugccagagcccugggaaacaaucuccgaggaagucaacauagcuggugauucacugggccuugcacugccgccucccccagccagcccugggagucggaccucuccccaagaguuguccgaggagcucagccgacgccugcagaucacgccagacucgaacggagagcaguucucuuccuuaauucagagagaacccucaaguaggcugcggagcugcuccguuacugaugcuguggccgagcaaggccaccucccuccaccgucugcgcccgcaggucgcgccagaagcucaaccguaacagggggagaggaaccuacuccaaguguggcuuacguccauaccacacccggccuuccuuccggcugggaggaaaggaaggacgccaaagggcguaccuacuaugugaaucacaacaaucggacgacuacauggacccgaccaaucaugcagcuggcagaggauggagcuagcgguucugccacuaacucaaauaaccacuugauugaaccccagaucagaaggccgcgcagucuaagcuccccuacaguuacccugucugcgccacucgagggcgccaaggacucgcccgugcggagagcagucaaagacacgcugagcaauccucaauccccacagccaucaccuuacaacagucccaagccacagcauaaagugacccagucuuuucuuccgccugggugggaaaugaggauagcucccaauggacgcccauucuuuauugaucacaacacaaagacuaccacaugggaggacccccgacugaaauucccuguacauaugcggagcaagacuuccuugaauccaaacgaucucggcccccugccuccggguugggaggaacguauccacuuagacgggagaaccuucuauauugaucauaauucaaagaucacacaaugggaggacccaaggcugcagaaccccgccaucaccggcccugcuguuccauacagccgcgaauuuaaacagaaguaugauuacuuccggaaaaaguugaaaaagcccgccgacauuccuaauagauuugagaugaagcuccacaggaacaacauauucgaagagucuuaucgacgcaucauguccgugaaacggccggauguccugaaggcaagacuuuggauugaguuugaaagugagaaaggauuggacuacggcgggguggccagggaaugguucuuucugcucagcaaggagauguucaaucccuacuauggacuguuugaauacucugcuacugauaacuauacgcuucagaucaauccaaacuccggucuguguaaugaggaccacuugucauacuucacauuuauaggccgugucgcggggcucgcaguguuccauggaaaacuguuagauggcuuuuucauucgcccuuucuauaagaugaugcuggguaagcaaaucacccuaaacgacauggagaguguugacagcgaauacuauaauucgcucaaauggauccuggagaacgaucccacugaacuugacuugauguuuugcauugaugaggagaauuucgggcagaccuaccagguggaccugaagccaaacggcuccgaaaucaugguaacaaaugagaacaaacgggaauacauugaucucgucauacaguggagauuugugaauaggguucaaaagcagaugaacgccuuccuggagggauuuaccgaauuacugccuaucgaccuuauuaaaaucuucgaugagaaugaguuggaacuccugauguguggccuaggggacguggaugucaacgacuggcgacagcacucuaucuauaagaacggauacugccccaaucauccagugauucagugguuuuggaaggcuguacugcucauggaugccgagaaacggauacgccugcuucaauucgugacugguacaagcagaguuccgaugaacggcuuugcagaauuguaugggucaaauggaccucagcuguucacgaucgagcaguggggcagucccgaaaaguuaccaagggcccacaccuguuuuaaccggcucgaccugcccccuuacgagacuuucgaggaucuucgagaaaaacuguugauggcugucgagaaugcccaagguuuugaagggguggacuga

SEQ ID NO: 59614 - RNA, 246 nt, Artificial Sequence
  derived and/or modified sequence opt3 from NEDD8__Homo_sapiens__NP_006147
augcugaucaaggugaaaacccucacaggcaaggagauugaaauagacaucgagcccacugauaaagucgaaagaauuaaggagaggguugaagagaaagaggggaucccuccacagcaacagcggcuuauuuacagcggaaagcagaugaacgacgaaaagacggccgcugauuauaaaauccuggguggcuccguguugcacuuaguacuggcacuacgcgggggaggcggucuccgacaguga

SEQ ID NO: 59615 - RNA, 2505 nt, Artificial Sequence
  derived and/or modified sequence opt3 from NEDD9__Homo_sapiens__NP_001135865
auguggaccagaaaccugauggccagggcucucuacgacaaugugcccgagugcgcagaggaacuugccuuccggaagggcgauauccugacagucauugaacagaacacugggggauuggaggguuggugguuauguagccugcacggccgccaagggauaguuccuggaaaucgagugaaacuacucaucggcccaaugcaggaaacggcguccucucaugagcagccggcuucaggucugaugcagcaaaccuuugggcagcagaaacuuuaucagguacccaacccucaagccgcaccacgugacacaauuuaccaggugcccccuaguuaucagaaucagggaaucuaccaagucccaacuggccacggcacccaggagcaggaaguguaucaaguucccccuagcgugcagagauccauugggggaacaucugguccacaugucggcaagaaggugaucaccccgguaaggacugggcacggauacguuuaugaguaccccucgcgguaccagaaagauguguaugacauaccuccaucacauacaacccagggcgucuacgauauucccccuagcagugccaaggguccaguguucuccgugcccgucggggaaaucaagccgcaaggaguuuaugacaucccucccacgaaaggcguguacgcuauuccaccuucugcaugccgcgaugaggccggccugagagagaaggacuaugauuuucccccacccaugaggcaggcugggcggccugacuugcgcccagaaggaguauacgauaucccgcccacuuguaccaaaccugccgguaaggaccuccacgugaaauauaacugcgauauaccaggcgcggcagagcccgucgcccgaagacaccagagccuguccccuaaucauccacccccgcagcuggggcaaucagugggaagucagaacgacgcuuacgacguuccuaggggcgugcaguuccucgaaccacccgccgagacaagcgaaaaggcaaauccucaggagcgggauggugucuacgacgugcccuuacacaacccaccugaugcuaaggggucucgugaccugguagauggcauuaaucgccuuuccuuuucaagcacuggaaguaccagaucuaacauguccacaagcucgaccucuuccaaagagucaaguuugagcgccucccccgcgcaagacaagaggcuguuccuagauccagacacggccaucgaacggcuccagcgacugcagcaggcacuugagaugggcguuucuagccugauggcuuuggugacuacagauuggcgcuguuauggguacauggaaagacauauuaaugagaucaggaccgccgucgacaaaguggaacucuuucugaaggaguauuuacacuucgucaaaggagcuguggccaacgcagccugccugccggagcucauccuucacaauaagaugaaacgggaacugcaacgcguugaggauucacaucagauuuugagucagacuucccacgaccuaaacgaauguagcuggucucugaacauacucgcuaucaauaagccucaaaacaagugcgacgaucuggacagauuugugaugguagcgaaaacaguccccgaugacgcaaagcagcuuaccacgaccauuaauacaaacgccgaggcucuguucaggccaggucccggcucauugcaucucaaaaaugggccugaaaguaucaugaacagcacugaguacccacacggaggcucccagggucagcuguuacaucccggggaucacaaggcccaagcacacaauaaagcccugccuccgggccuaucuaaggagcaggcuccagacuguucgagcuccgauggaucagaacguaguuggauggacgauuaugacuacgugcaucuccagggcaaggaggaauuugagcggcagcaaaaagagcugcuugaaaaggagaacauaaugaaacagaauaagaugcaguuggaacaccaucagcugucucaauuccagcuccuggagcaggaaauuaccaaacccguugagaacgauaucagcaaguggaagccuucccaaucacuuccaacaacuaauagcggggugucugcccaggaccgacagcuguugugcuuuuauuacgaucagugugagacccacuucaucucccuccugaacgcaauugacgcguuauucaguugcgucagcucugcucaacccccuagaaucuuuguggcccacuccaaauucguaauucugucagcacauaagcuaguguuuauaggagacacacucaccaggcagguuacugcccaggauauccgcaauaaagucaugaacaguagcaaucagcugugcgaacaacuuaagacgauugugauggcuacaaaaauggccgcauugcacuacccgucgaccacugcucugcaggagauggugcaucaggucaccgaccucucccggaacgcccagcuguucaagagaucuuuacuggaaauggcgacauuuuga

SEQ ID NO: 59616 - RNA, 3063 nt, Artificial Sequence
  derived and/or modified sequence opt3 from NEFH__Homo_sapiens__NP_066554
augaugagcuucggcggggccgacgcucugcucggagcacccuuugccccucuucacgguggcgggucccugcauuacgcguuggcuagaaagggaggcgccggugggaccaggucugcagccggaucaaguagcggcuuccacuccuggacacggacuucugugucgucagucagcgcuaguccaucccgcuuucgaggcgcaggggccgcuucuagcacggauuccuuagacacccugucaaacggaccggaggguugcaugguugccguggcgacaagucguagcgaaaaagagcagcuacaagcacucaaugauagauucgccggcuauaucgacaagguaaggcagcuggaagcucauaaccggucucuugagggggaagccgcagcucugcgccagcagcaagccggaagauccgcgaugggcgaguuguacgagagggaagugcgggagaugcgcggugccguccuccgacugggggcagcuagaggacagcugaggcucgaacaggagcacuuacuggaggauauugcccaugugcggcagcgucuugacgaugaagcucgccaaagagaggaagccgaggcagccgcuagggcguuggcacgguuugcccaggaagcugaggccgcacgaguugaccugcagaaaaaggcccaggcucuacaagaggaauguggcuaucuccgcagacaccaccaggaggaagugggcgagcugcuugggcagauacaaggaucaggugccgcacaggcgcagaugcaggcugaaacuagggaugcccugaaaugcgacgucaccagcgcauugcgggagauccgcgcccaacucgagggccaugcugugcagaguacacugcagucugaagagugguucagaguaagguuagaucgucuguccgaagccgcaaagguuaauaccgacgcuaugcggagcgcccaggaggaaauuacugaguaccgaagacaacuccaggcgaggacaaccgagcuugaagcccugaagucgacgaaagauucuuuggagcgccagcgguccgaacuagaggacagacaccaggcugacaucgcaucauaucaagaggccauucagcagcuggaugcugaacucaggaacacuaagugggagauggccgcacagcugcgcgaauaccaagaccuucugaaugugaaaauggcguuggauaucgagauagccgcuuaucgaaagcuccuggaaggggaggagugucggaucggauuuggccccauuccuuucaguuuaccagaaggucugcccaaaaucccuagcgucuccacccauauuaaggugaagucugaggaaaagaucaaaguggucgagaaaagcgaaaaggagacaguuauaguggaggaacagacugaggaaacccagguaacagaggaagugaccgaggaggaagagaaagaagccaaggaggaggaagggaaagaggaagagggcggagaagaggaggaagcagagggcggggaagaggaaacgaagucaccacccgcugaggaggccgcaaguccugaaaaggaggccaaauccccagucaaggaagaggcuaaaagcccggcggaagccaagucucccgagaaagaggaagcaaagaguccugcugaggugaagucaccagaaaaagccaagagccccgccaaagaggaggcuaaguccccuccagaagcaaaaucucccgagaaggaagaggccaagucgccggcggaaguuaaaagcccugagaaggcuaaaucccccgccaaggaggaagcaaaaucaccagccgaggcuaagaguccugaaaaggcaaaaucucccgugaaggaggaagccaaaagcccagcggaggcuaagucccccgucaaagaggaagccaagagcccugcagaggugaaaucaccagaaaaggccaagucuccgacuaaagaggaagcuaagucccccgagaaagccaagaguccugagaaagaagaggcaaagagcccagaaaaggcuaaaucucccguaaaggccgaggcgaaauccccugagaaggccaaaucaccaguuaaggcagaagcuaagagucccgagaaagccaagagcccggugaaagaagaggcuaagucgccugaaaaagcaaaguccccagucaaggaggaggccaaaucucccgaaaaggccaaaagcccugugaaggaggaagcuaaaacacccgagaaggcgaaaucaccagucaaggaagaggcaaagaguccugagaaagccaagucccccgaaaaagcuaagacccuagacgugaaaucuccagaggccaagacuccggcaaaggaagaggcccguagcccugcugauaaauuucccgaaaaggcgaaauccccaguuaaggaggaggugaaaucacccgaaaaggccaagagcccucucaaagaggacgcaaaggcuccagaaaaagagauucccaagaaagaggaaguaaagaguccugucaaggaggaagagaaaccgcaagaagugaagguuaaagagccacccaagaaagccgaggaagagaaggccccugcaacaccaaagaccgaagagaaaaaggauucuaaaaaggaagaggcucccaaaaaggaggccccuaaaccgaagguggaagagaagaaagaacccgcggucgagaagccaaaagaauccaagguggaggccaaaaaggaggaagcagaggacaagaaaaagguaccuacgcccgaaaaagaggcuccagccaagguggagguuaaagaagaugcuaagccuaaggagaaaaccgaagucgcaaagaaagagcccgacgaugccaaggcuaaagaaccaagcaagccggccgagaagaaagaggcagcgccugaaaagaaagacacaaaggaggaaaaagccaagaaacccgaggaaaagccaaagacugaggcuaaagccaaggaggacgauaaaacccugucgaaggaacccucaaaaccuaaggcagagaaggcugaaaaaucuaguuccacagaccagaaggauagcaaaccacccgagaaggccacugaagacaaagcagccaagggaaaguga

SEQ ID NO: 59617 - RNA, 1623 nt, Artificial Sequence
  derived and/or modified sequence opt3 from NEFM__Homo_sapiens__NP_001099011
auggccagacaccugagggaguaccaggaccuccuuaacgugaagauggcucuggauaucgaaauugcagccuaucggaaauuguuagagggcgaagagacccgcuucagcacauuugcgggguccauaacuggaccccuguacacgcaucgaccuccaaucaccauuucuucaaagauccaaaaaccgaaggucgaagcucccaaacuaaagguucagcacaaguucguggaggagauuaucgaagagacaaaaguagaagacgagaagagugagauggaagaggcccucacugcaauaaccgaggagcuggccgugagcaugaaagaagagaagaaagaggcugcagaagagaaggaagaggaaccugaggccgaggaagaggaagucgcugccaagaaauccccagugaaggcgacagcacccgagguuaaagaagaggagggugaaaaggaggaagaggagggccaggaagaggaagaggaagaggaugagggggccaaaucugaccaggcugaagagggaggcucggaaaaggaggguucaagcgaaaaagaggagggggaacaagaggaaggagagaccgaagccgaggcagagggcgaagaggcugaagccaaggaggagaagaaaguggaagagaagagugaagaggucgcgacuaaagaggaacuuguggccgaugcaaagguagagaaaccugaaaaggcuaaguccccaguucccaaaucuccuguggaggaaaagggcaaaagcccagucccgaagucccccguggaggaaaaagggaagucaccugugccaaagagucccgucgaggagaaaggaaagagcccuguuccaaaaucucccguggaagagaaggguaaauccccgguaucaaagagcccuguggaagagaaggccaaaagucccgucccaaagucuccuguggaagaggcuaaauccaaggccgagguuggcaaaggggaacagaaggaggaagaggagaaagaagugaaggaggcacccaaggaagagaaagucgaaaagaaagaggagaagccaaaagacgugcccgaaaagaagaaagccgagagcccuguaaaggaagaggcuguugcggaaguggucacaaucaccaaaucggugaagguccaucuggagaaagagacgaaggaagagggaaagccauugcagcaggaaaaagagaaggaaaaagcaggcggugaagggggaucugaggaagagggcuccgauaagggcgccaaagggucacguaaggaagacauugcugugaauggagagguugaggguaaggaagagguggaacaagagacuaaagaaaagggcagugggagagaggaggaaaaaggaguagucaccaacggccucgaucugagcccggccgacgagaagaaagguggggauaaguccgaagagaaagugguugugacaaagacugucgaaaagaucaccucugagggcggagacggcgcaacaaaauauauuaccaagagcgugacgguaacucagaaaguggaggaacacgaggaaacauuugaggaaaagcugguuucaaccaaaaaggucgagaaggugacaagucaugccaucgugaaagaggucacucaguccgauuga

SEQ ID NO: 59618 - RNA, 1431 nt, Artificial Sequence
  derived and/or modified sequence opt3 from NEIL1__Homo_sapiens__NP_001243481
augggcagaaccgggcccagggccccucugcucccaaagacacggaucuggagccuuacuuucucccgcaaaacgucuccggugggagcucgacccggugcagccccucguugcggcgggggaaaggucagagcgucagcuguugccaaauguccacugcccuugaaggcacacuuaaggcugcgguuucgcaccgccagaggccagaggcaaguggcuaaacagggugggcggcgcacacuaccuccaagucuccgaaugcccgagggaccugaacugcaucuugcaagccaguucguaaacgaggccugcagagcucugguguuuggcggcugugucgaaaaguccucugugucgaggaauccagagguuccguucgaaucaagcgccuaccggauuagugcguccgcacgugggaaggaguugcgccucauacugucuccccugccuggagcccagccacaacaggagccccucgcuuuaguguuuagauucgguaugagcggcuccuuucagcuggucccuagggaggaacuuccacggcacgcccauuugcgauucuauacugcacccccggggccucgccuggcucuaugcuuuguggacaucagaagguucggacggugggaucucggcgguaaauggcagcccgggcgcggaccauguguacugcaagaauaccagcaguuuagagagaacguucuuaggaaucuggccgacaaggcguucgaucguccuauuugcgaggccuugcucgaccagcgguuuuucaacggcaucggcaauuaucugcgagcagaaauuuuauacagacugaaaauacccccauucgagaaggcuaggucagugcucgaagcccuucaacagcaccgccccaguccugagcugaccuugagccagaaaauccggacaaagcuacaaaacccagaucugcucgaacugugucauucugucccgaaggagguggugcagcuugggggaaaagguuauggcuccgagucaggggaagaggacuuugcugccuucagagcauggcugaggugcuacggaaugcccggcaugagcaguuugcaggaucgccacggucgaaccaucugguuucagggggacccuggcccacucgcccccaagggacggaaaucucguaagaaaaaguccaaagcuacucaacugagcccugaagauagagucgaggacgcguuaccacccucgaaggcaccgucuaggacacgccgggccaagagagaucugccuaaaaggaccgcuacgcagcgaccagaaggcacuucccuacagcaggaccccgaggccccuaccguucccaagaaagggcgccggaagggaagacaagcagccucaggucacuguaggccacguaaagugaaggcugauauuccuagucucgagcccgaaggcacaagcgccuccuga

SEQ ID NO: 59619 - RNA, 816 nt, Artificial Sequence
  derived and/or modified sequence opt3 from NEIL2__Homo_sapiens__NP_001129219
auggggcccccuggcagcuccccaaccccggagcccccucagaaggaagugcaaaaagagggagccgcugacccaaagcaggucggugaacccucuggccagaaaacacuggaugggucaaguagaagcgcagagcucguuccucagggagaagacgauuccgaguaccuugagagggacgccccagcgggcgaugcuggucgguggcugcgcgugucuuucggguuguuuggaucgguaugggugaacgacuucucacgagccaagaaagcaaauaagcguggcgauuggagagaccccagcccuagguuaguccugcacuuuggcgggggagguuuccuagccuuuuauaacugccaacucaguugguccucuagcccagugguuacuccgacgugugauauccuguccgaaaaguuccaucggggccaggcucuugaggcacuggggcaggcccagcccgugugcuacaccuugcucgaccaacgcuauuuuucaggacugggcaauauuaucaaaaacgaagcucuguacagagccgguauacacccucucaguuuagggagcguccugucugcguccaggcgggaggugcuuguagaucauguuguggaguucucaacagcaugguugcagggaaaguuucagggccgcccacagcacacucaagucuaucagaaagaacagugucccgccggccaucaagugaugaaggaggcuuucgggccugaagacggacugcagcgacuaaccugguggugcccacagugucagccccaacucagcgaggaaccggagcagugccaguuuaguuga

SEQ ID NO: 59620 - RNA, 1818 nt, Artificial Sequence
  derived and/or modified sequence opt3 from NEIL3__Homo_sapiens__NP_060718
augguggagggccccgggugcacccugaacggagaaaagaucagagccaggguccucccuggucaggcuguuacaggcgugcgggggagcgcacuucgcucccugcaaggacgagccuugcguuuagcggcuucuacuguaguggucucaccacaggccgcagcccugaauaacgacaguagccagaaugugcuaucccucuucaacggcuacguuuauucugguguggagacgcuggggaaagaacuuuuuauguacuucggaccgaaggcucugaggauucacuuuggcaugaaaggcuucauaaugaucaaucccuuggaguauaaguacaaaaacggggcaucgccuguccucgaagugcagcugaccaaggaucugauuugcuuuuucgacucaagcguagagcucagaaauaguauggagucccaacagcggauccgcaugaugaaggaauuagauguuuguucuccagaguuuagcuuccugagagccgaauccgaggugaaaaagcagaaaggaaggaugcuuggugacgucuugauggaucagaacgugcugcccggcguggggaauauuaucaagaacgaggcucuauuugacucaggacuccauccugccgucaaaguuugucaacugacagaugaacagauacaccaucuuaugaagaugauccgggacuucaguauucuguuuuaucgcugccgaaaggcgggcuuggcacucagcaaacacuacaagguguauaaaagaccaaauuguggucagugccauuguaggaucacuguaugccgguucggggauaacaaucguaugaccuacuuuuguccccacugccagaaggagaacccucaacacguggacauuuguaaacugccaacacgcaauaccaucauaucuuggacuuccucaagagucgaucaugugauggacagcguugccaggaagagugaggaacacuggacaugcguggucugcaccuuaauuaacaaaccgucuuccaaggcuugugaugccugccugacgagccggcccaucgacucggugcucaagucugaagagaacuccacuguauucucacaucuuaugaaauacccuuguaauaccuucggaaagccacacacagagguuaaaauuaaccgaaagacugcauuuggcaccacaacccugguguugacggacuucaguaauaaaagcuccacucuagaacgcaagacaaagcagaaccagauccuggaugaggaauuucaaaauucucccccugcuagcgucugccucaacgacauccagcacccaaguaaaaagaccacuaaugauauuacacagcccucauccaaagugaacauaagcccgaccaucucuucagagaguaagcuguucagcccugcccauaaaaagcccaagacggcgcaguauuccucuccagaacuuaaaucguguaauccuggcuacagcaacuccgagcugcaaauuaauaugaccgacgggcccagaacauugaacccagauucacccaggugcaguaagcacaaucggcucuguauccugcgcgucgugagaaaagacggagagaacaaggguaggcaguuuuaugccugcccuuuaccacgugaagcacaguguggcuucuuugagugggcugaucugucuuucccguuuugcaaucaugggaaacggagcacuaugaagaccguucuaaagauaggacccaacaacggcaaaaauuucuuuguguguccucucgguaaggaaaaacagugcaacuucuuucaaugggccgagaaugggccaggcauuaagaucauccccggaugcuga

SEQ ID NO: 59621 - RNA, 1425 nt, Artificial Sequence
  derived and/or modified sequence opt3 from NEK10__Homo_sapiens__NP_001026911
auggugcccguccagccugccgagccaccggaaguucuuaagagcgagcccuacggcgaaaaagcugacgugugggcaguagggugcauccucuaucaaauggccacccuuuccccuccauucuacucuacaaacaugcugucauuggcgacuaagauuguggaggcugucuaugaacccgugccugagggaauauacagugagaaaguuacggauaccaucagcagauguuuaacaccagacgccgaagcaaggcccgauauuguggaggucuccucuaugaucucggacgugaugaugaaguaucuggauaaucuaucaacuagccagcucagucuggaaaagaagcuggagcgggagcgccgacguacccagagauacuuuauggaagccaacaggaauacaguaaccugccaccaugagcuggcuguuuugucccacgaaacuuucgagaaggcaucucucagcuccucaaguagcggugccgcuucucugaaauccgaacugucagagagcgccgaccucccuccagagggcuuucaggcgaguuaugggaaggaugaagaccgggcaugugaugagauuuuaucugacgauaacuucaaucuggaaaacgccgagaaagacacauacuccgaaguggaugacgagcuugacaucagcgauaauucgucuuccucaaguagcuccccguugaaggagucuaccuuuaacauacugaaacgcagcuucucagcuaguggaggcgaaagacaaucccagacgagggacuuuacuggugggaccggaagccggccccgcccugcccuacucccacuggaucuucuguugaaggugcccccucauaugcuccgagcacacaucaaggagauugaagcugagcuggucacaggcuggcagucucauucauuaccagccgugauccugagaaaucucaaagaccacgcgagugccggcauugcagucagccagaggaagguucggcaaaucuccgaucccauacagcagauucuuauccagcugcacaaaauuaucuacaucacucaauugccgccugcucuacaucacaaccugaagcgucgcgugauugaaagauucaaaaagucucucuuuucgcagcagagcaaucccugcaaccugaaauccgagauaaagaaacuuucacaagggaguccagagccuaucgaacccaauuucuuuaccgccgacuaucaucuguugcacaggucuagcggagguaacucccucucaccaaaugaucccacaggccugccuaccagcauugaguuagaagaggggaucacguacgagcagaugcagacuguaauagaagaggugcuggaagagucuggauauuacaacuucacauccaaccgguaucacaguuacccauggggcaccaaaaaucauccgacuaagcgauga

SEQ ID NO: 59622 - RNA, 1800 nt, Artificial Sequence
  derived and/or modified sequence opt3 from NEK11__Homo_sapiens__NP_001139475
augcugaaguuccaggaggccgcuaaaugcgugagcggcuccaccgcaaucucuacauaccccaagacucucauugccagaagguauguccuucaacagaaacuggggucaggaaguuuugguacgguuuacuuggugagcgacaagaaagcgaagcggggcgaagaguuaaagguacugaaagaaauauccgugggggagcuaaacccuaaugaaaccguccaggcuaaccucgaggcccagcugcuuucuaagcuggaucacccagcaaucgugaaauuccaugccucguuuguugagcaagacaauuucuguauuaucacagaauauugcgagggacgcgauuuggacgauaagauucaggaauacaaacaggcuggcaagaucuuuccggagaaccagauaaucgagugguucauucaacuccugcuggguguggacuauaugcacgaacgacguauccuccauagagauuuaaagagcaaaaaugucuuucugaagaacaaucuuuugaaaauuggggacuucggagugucaaggcugcuaaugggcaguugugaucucgcaacuacccugacaggcacuccccacuacauguccccugaggcccuuaagcaucagggguaugacaccaaaucugauaucuggagccuggcuugcauauuguacgaaauguguugcaugaaccacgccuuugcgggauccaauuuccucucaauuguacugaagaucguugagggugacacaccaaguuuacccgaacgguacccuaaagagcugaacgcaauuauggagagcaugcucaauaagaacccaucucuucgccccuccgccaucgaaauccugaagauuccuuauuuggaugagcagcuacagaaucugauguguagauacucagaaaugacccucgaggacaaaaaccuggacugccaaaaggaagcugcccacauaaucaaugcaaugcagaaaaggauucaucuucagacgcugcgggcuuugagcgaggugcaaaagaugacuccacgcgagcgaaugagacucaggaaacugcaggccgcggaugaaaaggcccggaagcugaaaaagaucgucgaggaaaaauaugaggaaaacaguaagcguaugcaggaguuacgcucuagaaacuuucagcaacuauccguggacgugcuccacgagaaaacccaucugaagggcauggaagagaaggaggaacagccggaggggaggcuuagcuguucgccccaggaugaagacgaggaacgguggcagggacgagaggaagagucugaugagccuacauuggaaaaucugccagagucccaacccauaccuucaauggaccuccacgaacuggagaguauugucgaagaugcaacuagcgaccuuggcuaccacgagaucccagaggauccccugguugcugaagaguauuacgccgacgcuuucgauuccuauugcgaagagucugacgaagaggaggaagagaucgccuuggaacgcccggagaaagagauuagaaacgaagguagccagccugcauacaggaccaaucagcaggacucagauaucgaggcccucgcucggugucuggaaaacguguuagggugcacaagucuggaccaacccugccgcuccuggggacagaaguaccuaaaaagaagcauuauaaccucuagggagcagggcauccguaugcucgcgaagcagcggucagcaaguguauggaaaaaguggugucugaagccagccacggugcuuaaauggacuagcuccugcacauugaagucuucguguuga

SEQ ID NO: 59623 - RNA, 3861 nt, Artificial Sequence
  derived and/or modified sequence opt3 from NEK1__Homo_sapiens__NP_001186326
auggagaaguacgugagacugcagaaaaucggcgaagggagcuucggaaaggccauucucgucaaauccaccgaggacgguaggcaauauguuauaaaggaaaucaacauuucucggaugucaaguaaagagcgcgaagagagccgacgugagguggcuguacuugcaaauaugaagcaccccaacaucgugcaguacagagaauccuuugaggaaaauggcucucuguauauugucauggauuacugcgaagggggagacuuguucaagaggaucaacgcccagaaaggcguguuauuucaggaggaucaaauacuggacugguucguucagaucugucuagcgcucaagcaugugcacgaucggaaaauucugcaucgcgacaucaagucgcagaauauuuuucuuacaaaagaugguacuguccagcugggggacuucggaaucgcuagaguguugaacucaacgguagaacucgccaggaccugcauaggcacaccuuauuaccugagcccagagauuugugaaaauaagccguauaacaauaagagugauaucugggcacugggcugcguucucuacgaguuauguacucugaaacacgccuuugaagcuggguccaugaagaaccuuguguugaaaauuaucucuggaaguuuucccccugucucccugcauuacucauaugaccuacggagucucgugagccaacuguucaagcgcaauccacgagauagacccucugugaacuccauccuugagaaagguuucauugcaaagaggauagagaaauuucugucaccucaguugaucgccgaagaguucugccucaagaccuuuagcaaguucggcagucagccaauucccgcuaaacggccugccucugggcaaaauuccaucagcgucaugccagcgcaaaagauaacaaaaccggcagccaaguacggcauuccccuggcuuauaaaaaguacggagacaagaaauuacacgaaaagaaaccucugcagaagcacaaacaggcccaucaaaccccagagaagcguguuaacacuggugaggagcgcagaaagaucucggaggaagcagcuaggaaacggcgacucgaguucaucgaaaaggagaaaaagcagaaagaucagauuaucucucuuaugaaggccgaacagaugaagcgccaagagaaagagagacuggaaaggauuaaucgggcgcgcgagcagggguggagaaacguguuguccgccggaggcucaggcgaaguaaaggcacccuuucuagggaguggagguacaauagcuccuagcuccuucucuagcaggggccaguaugagcacuaccaugccaucuuugaccagaugcaacagcagcgugcugaggacaacgaagccaaauggaagcgggagauuuaugggcgaggacugccagaaagaggcauccuccccggugugaggccgggguucccuuacggcgcagccggacaccaccauuuucccgaugcugacgauauccgcaaaacccugaagcggcuuaaagcggucucaaagcaggcaaaugccaacagacaaaagggccagcuggcuguggagagggccaaacagguugaagaguucuugcagcgcaagcgagaggcaaugcaaaauaaagcccgggcugaagggcacauggguauucuccagaaccuggccgcaauguacggaggccguccaaguuccagcagagggggaaagccuaggaauaaagaggaagagguguauuuagcgcgccugcggcagauaagacuacaaaacuuuaaugaaaggcagcagaucaaggcuaagcuccgaggcgagaaaaaggaggccaaccauucugaaggucaggaggggucagaagaggcagacaugcgccggaaaaagauugaaagucugaaagcccacgcuaaugccagagcagcuguccuuaaggagcaauuggagaggaagcguaaagaagccuacgagcgcgaaaagaaagugugggaggagcaucugguagcgaagggcguuaaaagcuccgaugugucucccccacucggacagcacgaaacgggcgggucgcccagcaagcagcagaugcgguccgucaucucagugacuagcgcccugaaggaggucggaguggacucuagccuuaccgauacaagagaaacuuccgaggaaaugcagaaaaccaacaaugcuauuucaagcaagagggagauccugcgacgguugaacgagaaucucaaagcacaggaagacgagaaggguaaacagaaccugucugauacauucgaaauaaauguucacgaggacgccaaggaacaugagaaagagaaguccgugaguagcgaucgcaagaaaugggaagcuggcgggcaguuaguaaucccucuggacgagcuaacccucgacacgucuuuuuccacuacagaaagacacaccgucggagaggugauuaagcugggcccaaacgguucaccgaggcgggccugggggaaaagucccacugauagcguucuuaagaucuugggcgaagcagagcugcaacuccagacagagcuguuagaaaacaccacgauucgaucggagaucuccccugaaggagagaaauauaagccacugauaaccggcgagaagaaagugcaguguauuucucaugaaaucaaucccagcgcgauugucgacucaccuguggagacaaagaguccagaguucuccgaagccucuccccaaaugagccuuaaauuggaagggaaccucgaggagccggaugaccuggaaacugagauccuacaggaaccuuccggaaccaauaaggaugagucacugccaugcacaauaacugacguauggaucagcgaagagaaagagaccaaggaaacacagagugcugauagaauuaccauccaggagaacgaagugucugaggacggcguuuccagcacugucgaucaacucucggacauucacaucgaacccgguacgaaugauucacagcacucuaagugugacguggauaaaagugugcagccugagcccuuuuuccauaaggucguucacuccgagcaucugaaccuugugccacaggugcaaagcguacagugcucuccugaagagagcuuugccuuccgcucccacucacauuugcccccgaaaaauaagaacaaaaauagucuguuaauagggcucagcacaggacuguucgacgcaaacaauccaaagaugcuuaggaccuguucucugccugacuuguccaagcucuuucguacucugauggauguccccaccgugggcgacguucggcaggauaaccuagaaauugacgagaucgaggaugaaaauaucaaagaggguccaucagacagugaagauauuguguucgaggaaacagacaccgaucugcaggagcuccaagcuagcauggagcagcugcuuagagaacagcccggcgaggaauacuccgaggaagaggagucugucuugaagaacucggacguggaaccuacugccaaugggacagauguugcagacgaggaugacaacccaagcucagaauccgcccugaacgaggaauggcacagugacaauucugauggagagaucgcuagcgagugcgaaugcgacuccguguuuaaccacuuagaggaacucaggcugcaucuugagcaggagaugggcuucgaaaaauuuuucgagguauaugaaaagauuaaagcgauacacgaggaugaagacgagaauaucgagauuuguucaaagaucguccaaaacauucuggggaaugaacaucagcaccuauacgccaagauccuccaucuggugauggcagauggagcuuaucaggaggacaacgaugaauga

SEQ ID NO: 59624 - RNA, 1155 nt, Artificial Sequence
  derived and/or modified sequence opt3 from NEK2__Homo_sapiens__NP_001191112
augcccagcagagccgaggacuacgaagugcuguauaccaucggcacaggguccuacggaaggugccagaagauucggcgcaaaucugaugguaagauacucgucuggaaagagcuugacuauggcucaaugacugaagcugagaagcaaaugcugguuagugaagugaacuuguuacgagagcugaaacacccuaauaucguacguuacuaugauagaauuaucgacaggacgaacaccacacuauacauugugauggaguauugugaagggggagaucucgcaagcgucaucacuaagggcaccaaggagcggcaguaccuggacgaagaguucgugcuucgcguuaugacacagcugaccuuggcccucaaagagugccauagaagguccgauggugggcacacugugcugcaucgggaccugaagccagcgaaugucuuucucgauggaaaacagaacgugaaguuaggcgacuucggccuggcucgcauacuuaaucacgauacaucuuuugccaaaaccuucguagggacgccguacuauaugucgcccgaacaaaugaaccgaaugucauacaaugaaaagagcgacaucuggaguuugggaugucugcuauaugagcucugcgcacugaugccuccauuuacugccuucucccagaaggagcuugcugguaaaauuagagaaggcaaguuuaggcggauccccuaccguuauucugaugagcugaacgagauuaucacccgcauguugaaucucaaagacuaccauagaccuagcguugaagagauacuggaaaacccauuaauugcagaccugguggccgaugagcagaggcggaaucucgaacgacgcgggagacagcuuggagagcccgagaagucccaagacucaaguccuguccugagcgaauugaaacuaaaggagauccagcugcaggaaagggagcgggcucucaaagcccgcgaagagagacuggagcagaaggaacaagagcuuugugugagggaacgucuggcggaggauaaguuggcacgggccgagaaccuccugaaaaauuauucuuuacugaaggaacgaaaauuccuaucccucgcuucaaacccaggcaugagaauuaaucuggugaacaggagcuggugcuacaaguga

SEQ ID NO: 59625 - RNA, 1521 nt, Artificial Sequence
  derived and/or modified sequence opt3 from NEK3__Homo_sapiens__NP_002489
auggacgauuacauggugcugagaaugaucggcgaggggagcuucggaagggcccuccuuguccagcacgaauccucuaaccaaauguuugcuaugaaggagauucggcugcccaaaucauucaguaauacccagaacagccgcaaggaagcaguuuuguuagccaaaaugaagcauccuaauauaguggcguuuaaagaguccuucgaagcugagggucaccuguauaucguaauggaguacugcgacggcggggaucuaaugcagaagauuaagcagcaaaaaggaaagcucuuuccagaagacaugauccugaacugguucacacagaugugucuuggcgugaaucauauucacaaaaagcgaguccugcaucgugauaucaaaucuaagaacauauuuuugacucagaaugguaaggugaaacucggggacuucggaucggccagacugcugucaaacccgauggcauuugccugcacguauguuggcacccccuacuaugugccuccagagaucugggaaaaucuccccuacaacaauaagagcgauauuuggaguuuaggcuguauccuguaugagcuuugcacauugaaacacccuuuccaggcuaacuccuggaagaaucugauucuaaaagucugucaagggugcaucucuccacuccccagccacuacuccuacgagcugcaguuucuugugaagcagauguucaaaaggaacccuucacaucggccaagugcaacuacccuguugagccgcggaauaguagccagacucguucagaagugucugccgcccgaaauuaucauggaguauggugaagagguguuagaagagauuaaaaauucuaagcacaacacaccuaggaagaaaaccaacccaucccggauccgcaucgcucugggcaaugaggccucaacuguccaagaagaggaacaggaccgaaaggggagccauacagaucucgagaguauuaacgaaaaucuuguggagucugcgcugagaagggugaaccgggaggaaaaaggaaauaaguccguccacuugcguaaggcaagcucgcccaaccuacaccgcagacagugggagaaaaauguuccuaacaccgcccugacggcucucgaaaaugccucuauacugacuuccucacuuaccgcagaggacgauaggggcgguagugugaucaaguacagcaaaaacacaacucggaagcaauggcugaaagaaaccccagacacauugcucaauauucugaagaacgcugauuuaucccuggccuuucagaccuauacgaucuaccgacccgggucugagggauuccuaaagggcccgcucagcgaggaaacugaggcgucagacaguguagacggcgggcaugauuccgugauacuggacccugaacgccuugagcccggauuggaugaggaagacacagauuucgaggaagaggacgauaauccagacugggucagcgaacugaaaaagagagccgguuggcagggccucugcgauagguga

SEQ ID NO: 59626 - RNA, 2259 nt, Artificial Sequence
  derived and/or modified sequence opt3 from NEK4__Homo_sapiens__NP_001180462
augccccuggccgcuuacugcuaucucagaguggucggcaaggggagcuacggagagguuacccuugugaaacacaggcgggacgguaagcaguaucugcaugaaaaacacaucuugcaucgcgauuuaaagacacaaaacguauuccugacucgaacgaauauuauaaaagugggcgaccuagggaucgcacguguccucgagaaccacugugauauggccuccacccugauuggaacaccuuacuauaugucuccagaacuuuucucaaauaagccguacaacuauaagagugacgugugggcgcugggcugcuguguuuacgagauggcuacuuugaaacaugccuucaaugcaaaggauaugaacagccucguguacagaaucauugaagguaaacugcccccuaugccaagggacuauucccccgagcuggccgagcucauccggaccauguuaucuaagcgcccugaagagagaccaucggucaggucaauacugcggcagcccuacaucaaacgccagauuagcuuuuuccuugaagcuacaaagaucaagaccaguaaaaauaacauuaagaauggggauucccagucuaaaccuuuugcaacugugguaagcggagaggccgaguccaaccacgaaguuauccacccacaaccguugucaagugagggcagccagacauauauaaugggcgaagggaagugccugucucaggagaaaccccgagcuuccggacuacucaagagcccugccucacugaaagcgcauaccuguaagcaggaccuuaguaauacgacugaacuggcaaccauuucuuccgugaacaucgauauuuugccagccaaggguagagacagcgucucggauggcuucgugcaagagaaucagcccagguaccucgacgcuucuaacgagcuugggggaaucugcuccaucucacagguggaagaggaaauguuacaggauaauacaaaaaguagcgcccaaccugagaaccugauuccaaugugguccucugacauagucacuggcgaaaagaacgagcccguuaaaccgcuccagccucuuaucaaggagcagaaacccaaggaccaaagccuggcauugucaccaaagcuagaauguagugguaccauucuggcucacuccaaucuccggcugcuugggagcucugauaguccugccucagcgagccguguggccggaaucacaggcguaugccaucacgcacaggaccagguggcuggcgaguguauaauugaaaaacaggggcgcauccaccccgaucugcaaccacauaacuccggaucugagcccucguugagcagacagaggcggcagaagcgacgcgaacagaccgagcacagaggugagaaaaggcaaguccggcgcgaccucuuugccuuccaggaauccccuccaagauuucugccgucacaucccaucgugggcaagguugaugugacgaguacucagaaagaggcugaaaaucagaggcgugucgugacagggucuguaagcuccucacggagcucugagauguccaguagcaaggaccgaccuuuaucugccagagagaggcgccggcugaagcaaucccaggaagagaugucaaguagcggaccaucgguuagaaaagcaucccuaucuguggccggccccgguaagccucaggaagaggaucagccacuccccgcuaggcgccugagcucagacugcagugucacccaagaacgaaaacagauucacugucuuuccgaggaugaguugucuagcuccacuucaagcacagacaagagugauggggacuauggcgaaggaaaaggccagaccaacgagaucaaugcgcuggugcaacucaugacgcagacccugaagcuggacucuaaggaauccugcgaggaugucccgguggcaaacccuguuagcgaauuuaaacugcaucggaaguaccgugacacauugauucuccacgggaaaguggccgaggaggcugaagagauacacuuuaaggaacugccaucggccaucaugcccggaucagagaaaauuagaagguuaguagaaguccugcgcacugaugugauccggggucuaggcguucagcuccuggaacagguguaugaccuuuuggaggaagaggaugaguucgacagagaggucaggcugcgagagcauaugggggaaaaguacaccacauacucugugaaagcacgccaacucaaguuuuucgaggaaaauaugaacuucuga

SEQ ID NO: 59627 - RNA, 1044 nt, Artificial Sequence
  derived and/or modified sequence opt3 from NEK6__Homo_sapiens__NP_001138473
augcccagaagggaggugugcugggaagccgcucacuuccggcaggaggaacaaagccugccucgcccacgaguccgugcacucguuagacuugccuguaggauggcgggccagccggggcauaugccccacggagguuccucuaacaaucugugccauaccuugggcccugugcacccacccgacccucagcggcauccaaacacauuaucauuucgcuguagucuggcugauuuccagaucgagaagaaaauugggagaggacaauuuagcgaaguauacaaggccacuugccuacucgacaggaaaacgguggcacugaagaaaguccagauauucgagaugauggaugccaaggcucggcaggacugugugaaggagaucggccuucugaaacaguugaaucaccccaacauuaucaaguaucucgauuccuuuauugaagacaaugagcugaacaucguucuggaacucgcagaugccggugacuuaucucaaaugauaaaauacuucaagaaacagaagcgccugaucccugagcgaaccguguggaaguauuuuguccagcuuugcucggcuguggagcacaugcauucaagaaggguaaugcaccgggauauuaaaccagccaauguuuucaucacagcgacugggguggucaaguugggagaccugggccuaggccgcuuuuucagcagugaaaccacagcagcccauucccucguggggaccccguacuauaugucucccgagcguauucacgaaaacggauacaauuuuaaaagcgauaucuggucccuggguugucuucuguaugagauggcugccuugcagucaccuuucuacggcgacaagaugaaccucuuuagucugugccagaaaauagaacaaugugauuacccacccuuaccuggggagcacuauagcgagaagcugagagaacucgugucuaugugcauuuguccagacccccaucagaggccggacaucggauacguccaccaaguugcaaaacagaugcauauuuggauguccucaacuuga

SEQ ID NO: 59628 - RNA, 909 nt, Artificial Sequence
  derived and/or modified sequence opt3 from NEK7__Homo_sapiens__NP_598001
auggacgagcagagccaaggcaugcaggggcccccugugccacaguuccagccgcaaaaggcccugagacccgauaugggauacaacacccucgcuaauuuuaggaucgagaaaaagauuggucggggccaguucuccgaagucuaucgcgcagccugccuucuggacgggguuccuguggcguugaaaaagguacagauauuugauuuaauggacgcuaaagcccgagcagauuguaucaaggaaauugaccugcuaaagcagcucaaccacccaaaugugaucaaauacuaugccucuuucauugaggauaacgaacugaauaucguccuugagcuggcugacgcaggagauuugucacguaugauaaagcauuuuaaaaagcagaaaagacucauccccgagaggacaguguggaaguacuucguucaacugugcagugcccuggaacacaugcauagccggcgcgugaugcacagagacauuaagccugcuaacgucuuuaucacugccacgggcgugguaaaacucggugauuuagggcugggaagguucuuuuccucuaagaccacagcggcacauucgcuuguuggcacuccauauuacaugucacccgagcggauucacgaaaauggcuauaacuucaaaagcgacaucuggaguuuggggugucugcuauacgagauggccgcucuccaguccccuuuuuacggagauaagaugaaucuguauucucuuugcaaaaagauagagcagugugacuacccaccgcugcccagcgaccacuauuccgaagaguugcgccaacucgugaacaugugcauuaauccugauccagaaaaacgacccgacgucaccuacguguaugauguggccaagagaaugcaugcauguacagcuucaaguuga

SEQ ID NO: 59629 - RNA, 2079 nt, Artificial Sequence
  derived and/or modified sequence opt3 from NEK8__Homo_sapiens__NP_835464
auggagaaguacgaaagaaucaggguggucggccgaggggccuucggaauuguucaccugugccuccgcaaagcugaccagaaacuugugauaaucaagcaaauucccguagagcagaugaccaaggaagaacgacaggcagcccagaacgaaugucaagugcugaaauuguuaaaucauccuaacgucaucgaguauuacgagaauuuucuggaagauaaggcgcuaaugauugcuauggaguaugccccagguggcacacucgcagaguucauccagaagcguugcaacagccugcuugaggaggaaacuauacugcacuuuuucgugcagaucuugcucgcccugcaucacguucauacgcaccugauucuccacagagacuuaaaaacccagaauauccugcuugauaagcauaggaugguggucaaaauuggggacuuuggaaucuccaagauauugucuucaaaaaguaaggcuuacacagugguaggcacuccguguuauauuagccccgagcugugcgaagguaagccuuacaaccaaaaauccgauaucugggcacuaggguguguucucuaugagcuggccucucuuaagcgggcuuucgaagccgcgaaucugccagcauuggugcucaaaauuaugucgggaaccuuugcccccaucucagaccgcuacagcccugagcugagacaguuaguccugagucuccuuucccuggagccagcucagaggcccccuuugucucacaucauggcccagccacuaugcauucgggcacugcucaaccugcauacagaugugggcagcgugcgcaugcggagagcugaaaaguccgucgccccgucaaauaccggcaguaggacuacaagcguucggugucgugggauaccccgcggaccugugagaccagcgauucccccuccacuuucuuccguauacgccugggguggcgggcugggaacccccuugaggcucccgaugcugaacacggaggugguccaaguggcagcuggccggacucagaaagccgguguuacccgaucagggcgcuuaauccugugggaagcuccuccccuaggagccggcggcgggagccuccugccaggagcaguggagcagccucaaccccaguucaucaguagauuucuugaaggucagucuggcgucacaauaaagcacguggccugcggggacuucuuuacugcuuguuugaccgauaggggaauuaucaugacauucggcuccgguagcaaugggugccugggccacggaucgcucaccgacaucucucagccaacgauuguagaggcgcugcuuggcuaugagaugguucaaguggcauguggggccucccauguccuggcuuugucaacugaacgggagcucuuugccuggggacgcggugauaguggcagacugggguuaggaacaagggaaagccacuccugcccccaacaggugccuaugccaccgggccaggaggcacagcgugucgugugcgguaucgacucuagcaugauucugaccguucccgggcaggcccuagcuuguggcucaaaccgguucaauaaacucggacuggaucaucuuaguuugggcgaggaaccugugccacaccagcagguagaggaagcccuguccuucacucuccuggggagcgcacccuuagaccaagagccucugcuuucuauagacuugggaacagcgcauucagcugccgucaccgcaaguggugauugcuacacguuuggcagcaaccagcacgggcagcucggaaccaauacacgaagaggcuccagggccccauguaaggugcagggucuggaagggaucaagauggcuaugguugccugcggcgacgcauucacuguggcuauuggagccgagucugaggucuauucguggggcaaaggggcgcgcggacggcuaggcagaagggaugaagacgccggucugccccgcccggugcaacucgaugagacccacccuuacacaguaacuagcguguccuguugccaugggaacacccugcuugcuguucgaucagucacagacgaaccagugcccccuuga

SEQ ID NO: 59630 - RNA, 2940 nt, Artificial Sequence
  derived and/or modified sequence opt3 from NEK9__Homo_sapiens__NP_149107
augagcgugcugggcgaguacgaaagacacugcgacuccaucaacucugauuucgggucagagaguggagguuguggcgacagcucccccgggccuucugccucgcagggaccaagggcuggcgguggggcagccgaacaagaggaacuccauuauauuccgauacggguccuuggacgcggcgcguuuggcgaggcuacccuguaccgacguacagaggaugacucauugguuguguggaaggaaguagauuuaacuagacugagcgagaaagaaaggcgggacgcccuaaaugagaucgugauucucgcacugcuucagcacgauaacaucauugccuauuacaaucauuucauggacaacacgacccuguugaucgagcucgaauauugcaaugggggaaaccuguacgauaagauacugcgccagaaagacaagcucuuugaggaagagauggucgugugguauuuauuccagaucguuagugcuguguccuguauucacaaagcagguauccugcauagagauauuaagacacuuaauaucuuuuugacuaaggccaaccugauaaaacuaggcgacuacgggcucgcuaagaaacugaauagugaauacagcauggccgagacccuugucggaacacccuauuacauguccccugagcugugccaaggcgugaaguauaacuucaaaucagauauuugggcgguagguuguguuaucuuugaauugcucacccugaagaggacuuucgacgcaacaaauccauuaaaccugugcgugaagauuguccaggggauccgggccauggagguggacaguagccaguacucucucgaacuuauccagauggugcacuccugucuggaucaagaccccgagcagcgcccuaccgcugaugaauugcuagaccgaccacugcucagaaaaaggcggcgugagauggaggaaaaggucacgcugcuuaaugcccccacuaaacgcccuagaucaagcaccguuacagaggcaccaauugcugugguaacuucuaggaccucugaaguguaugucuggggaggcggcaaguccacaccgcagaaacuggaugugauaaagagcgggugcucggcccggcagguuugugcgggaaacacccacuuugccguggucacgguggagaaagaauuguacacuuggguaaauaugcaagguggcacaaagcuccaugggcagcugggacacggcgacaaggcaucuuaucgacagcccaaacauguugagaaguuacaagguaaagcuauccgccagguguccugcggggaugacuucaccgucugugugacugaugagggccagcuguacgccuuuggaucagacuacuauggcugcaugggggucgauaagguggcuggaccugaaguucuagagccaaugcagcucaacuucuuucugaguaaccccguggaacaaguaagcugcggugacaaucacgucgugguucuuacaagaaacaaagagguguacuccuggggcuguggggaguauggaagguugggccuggacucugaagaggauuacuauaccccucagaaggucgacgugccaaaggcccucauuaucguagcagugcagugcgguugugaugggacguuccugcuuacccagagcggcaaaguucuggccugcggauugaaugaauuuaacaagcucggccugaaucaauguaugucagggauaauuaaccacgaggcuuaccaugaaguccccuauacaacuuccuucaccuuagcgaaacagcuguccuucuacaagauccggacaaucgcaccgggaaaaacucacaccgccgcuauugacgagcgcgguagacuacucacauuuggcugcaauaagugugggcagcugggagugggcaacuacaagaaaaggcuugguaucaauuugcucgggggcccucugggaggcaaacaggugauucgugucagcugcggggaugaguucaccauagccgcaacugacgauaaccauaucuuugccuggggaaauggcgguaacgggcggcuggcuaugacgcccacagaacgaccacacggaucugacauuuguaccucauggccuagacccaucuucggcaguuuacaucacguuccagaucugagcugcagggguuggcacacuauccuuauuguggagaagguguugaauaguaagaccauacgcucuaacucgagcggccucuccaucgggacaguauuucaaucaaguucucccggaggcgggggaggcggugggggaggcgaagaggaagacagccagcaggaguccgagaccccugauccaucagguggcuuccgggggacuauggaagccgacagaggaauggagggccugauuagcccgacagaagcaaugggaaauucuaacggggcguccaguagcugucccggcuggcuaaggaaagagcuggaaaacgcugaguuuaucccuaugccagauucucccuccccucucucagccgcauucagugagagcgaaaaggacacgcugccauaugaggaacuucaggguuugaaggucgccucggaggcuccccuggagcauaaaccgcaaguggaagccuccucuccucgcuuaaauccagcaguuaccugcgcugggaagggaacuccccucacaccucccgccugcgcguguagcucacuucagguggaggucgaacgacugcagggccugguguugaaaugccucgccgagcaacagaagcugcagcaggaaaaccuacaaauuuuuacccagcugcagaaacucaauaagaaacuggaggguggccagcaaguugggaugcacaguaagggaacacagacugcuaaggaggaaauggagauggacccaaaaccugaucuugacuccgauucuugguguuugcugggcaccgacagcugccggcccuccuuauga

SEQ ID NO: 59631 - RNA, 1620 nt, Artificial Sequence
  derived and/or modified sequence opt3 from NELFA__Homo_sapiens__NP_005654
augcccggccagagaagggcccugagcccuaagauggcuuccaugcgggagucugacaccgggcucuggcuucacaacaaacugggagcaacagaugaauugugggccccaccgucaaucgcgaguuuacugacugcugccgugauugacaauauacgccuaugcuuccauggucucagcuccgcagucaagcugaaacuucuguugggcacgcuccacuugccccgacguaccguugaugagaugaagggggcccugauggaaaucauucaacucgcuucuuuagacucggauccuugggugcugaugguagcagacauccuuaaaucauuuccagauacaggaagccugaaccuggagcuagaggaacagaaucccaacgugcaggacauucucggcgagcugagagaaaaggucggugagugugaagccagugcuaugcuuccucuggagugccaguacuugaauaagaacgcccucacuacccuggcggggccauuaacacccccugugaaacauuuccaacugaagaggaaaccaaaguccgcaacccuccgggccgagcuucugcagaaaucuacugaaacagcucagcaguugaagcgcagcgccggaguuccguuucacgcaaagggcagaggccuacugaggaaaauggauaccacgacuccccucaaggggaucccuaaacaagcuccauuccggucccccaccgccccuucaguguuuaguccaacaggaaaucgcacucccauaccgccuagccgaacccugcuuagaaaggagaggggugucaaacuguuggacaucucugaacucgauauggugggcgcggggcgggaggccaagcgucgcagaaaaacacuggacgcagaaguaguugagaagcccgcuaaggaggaaaccguggucgagaacgccacgccagauuaugcugccggauuaguguccacucagaaacugggcucacuaaauaacgaaccugcacuccccagcacaaguuaccugccaucuacccccuccguggucccugccagcucguauauuccaucuuccgagacuccgcccgcuccuucaaguagggaagcgagccggccacccgaggagccuuccgcaccaucucccacacuuccggcccaguucaagcagcgagcuccuauguacaauagcgguuugucaccagccacccccacgccugcagcccccaccaguccacugacaccuacuacacccccagcuguugccccgaccacucaaaccccucccguggcaaugguagcgccacagacacaggcucccgcccaacagcagccuaaaaagaaccucucccugacccgcgaacagauguuugcagcccaagagauguucaaaacugcuaauaaggugacgagaccagaaaaggcccuuauccugggguuuauggcaggaagcagggagaaccccugucaggaacagggcgacgucauucagaucaaauugucugagcauacagaggaccucccuaaggcugauggccaagggucaaccacuaugcugguggacaccguuuucgaaaugaauuaugccacaggacaguggacccgguuuaaaaaguacaaaccgaugacuaacgugaguuga

SEQ ID NO: 59632 - RNA, 1887 nt, Artificial Sequence
  derived and/or modified sequence opt3 from NELFB__Homo_sapiens__NP_056271
auggccgagcuggaaggcgcuggggagagaggaagcgguggccccagggggccugcagaacgggccuccggagugucugcggcugccccaggcgagcgcgccggugacggggcaccgucacgagcugucgcaggagccagugcuauguucgccggccuccaggaucuuggcguugcgaacggggaagaccugaaggagaccuugacaaauugcacugagcccuuaaaagcaaucgaacaauuucagacggagaacggagugcugcuaccuagccuccaguccgcccugccauuccuugaucugcacgguacaccccguuuggaauuucaucagucuguauucgacgagcucagagauaagcugcuggagagggugucggcuauugccucagaaggcaaagcagaggaacgguacaagaaacucgaggacuuacuggaaaagagcuuuagucuugucaagaugccuuccuugcaaccagugguuaugugcgugaugaaacaucugcccaaggucccugagaaaaagcuaaaacucgugauggcugauaaggagcuguaucgcgccugcgcgguagaaguuaagagacagauauggcaggacaaucaggcccuuuucggggaugaggugucuccacuguugaaacaauacauccucgaaaaggagagcgcacuguuuuccaccgaauuaucaguccugcacaacuucuuuaguccgagccccaaaacuaggcggcagggagagguggugcagcgccucacccgaauggucggcaagaauguuaaacuuuaugacauggugcugcaguucuugagaacacuauuucugaggacccggaacguacacuacuguacucuccgugcugagcugcuuaugucucugcaugauuuggacgugggugaaauuugcacagucgauccuugucacaaguucaccuggugccucgacgccuguauccgcgagagauuuguggacuccaaaagggcucgggaacugcaaggguucuuagauggaguuaagaagggccaggaacaggugcugggcgaccuaucaaugauucucugcgauccauucgccaucaauacgcuggcacuuagcacuguccgacacuugcaagagcugguggggcaggagacccucccccgcgacaguccugaucugcuucuguugcucagacuguuagcccugggacagggugcuugggacaugauagauucucagguauuuaaagagccaaagauggaaguugagcuaaucacaagguuccuccccaugcugauguccuuucuuguggacgauuauacuuucaacgucgaccaaaaauugccggcggaagagaaggcaccugugagcuaccccaauacccugccagagucguuuacaaaauuccuccaggaacagcggauggccugugaggucggccuguauuacguguuacauauuaccaagcagcgcaacaagaaugcucugcuuagauugcucccugggcugguugaaacguuuggagaucuagccuucggcgacaucuuucugcaccuccugacugguaaccuugcauugcuggccgacgaguucgcuuuagaagauuuuuguucuucccucuucgacggguuuuuccugacagccucacccaggaaagagaaugugcaucgucacgcacuucggcuguugauucaccuccauccacgaguagcgcccaguaagcuggaggcucuacaaaaagcccuggaaccuaccggccagagcggagaggcagucaaggaacucuacucccagcugggcgagaaacuugaacaguuggaucacagaaagccaucuccggcccaagcugccgagacucccgcacuggaguuaccucucccaagcgugcccgcuccugccccacuguga

SEQ ID NO: 59633 - RNA, 1800 nt, Artificial Sequence
  derived and/or modified sequence opt3 from NELFCD__Homo_sapiens__NP_945327
augagaagggcccggagccgcgagggcauggcuggggcagugcccggagccaucauggacgaagauuacuaugguuccgcggcugaguggggcgacgaagccgaugggggacagcaagaggacgauucuggcgaaggugaggacgaugcagagguccagcaggaaugccugcacaaguucucaacccgagacuacauuauggagccuaguauauuuaacacacucaaacguuauuuccaggccgggggaagcccagaaaauguuauccaacuucuguccgagaacuacacugcuguggcacagacgguaaauuuguuagccgaguggcugauucagaccggcguggaaccgguccaggugcaagagacaguugaaaaccaucuaaagucucuccugaucaaacacuuugaucccagaaaggcugacucgauuuucacugaggaaggcgagaccccugccuggcuugagcagaugaucgcgcauacaaccuggagggaucuguuuuauaaauuggcagaagcccacccagacugucucaugcugaauuucacugugaagcugauaucagaugcuggguaccagggagagaucacaagcgucaguaccgccugccagcaacucgaaguguuuucccggguauuacgcacgucucuggcaacuauucuugacgguggcgaggaaaacuuggagaagaaucugcccgaguucgcuaaaaugguuugucauggggaacacaccuaucuauuugcccaggcgaugaugagcgugcucgcccaggaggaacaaggaggcuccgcagucagaaggaucgcucaggaggugcagcgguucgcccaggaaaagggucacgacgcuucacaaauuacacuggcccuugggacugcagccaguuacccucgcgcuugccaggcgcugggagcaauguugagcaaaggcgcccucaacccagcugauaucaccgugcuguuuaagauguucacaucuauggaucccccuccagucgaguuaauacgaguuccggccuuucuggaccucuucaugcagucccuuuucaaacccggcgcaagaauuaaucaggaccauaagcacaaguacauccauauucuggccuaugcugccucagugguagagaccuggaaaaagaacaaaagggugagcaucaauaaggaugaauugaaaaguacgucuaaggcagucgagacugugcacaaccuauguugcaaugaaaacaaaggggcguccgagcugguugcugagcucagcacacuguaccaauguauccgguuuccuguggucgccaugggagugcuuaaguggguagacuggaccguuucggaaccacguuauuuccagcugcagacugaucacacacccgugcauuuggcacuccuggacgagauuucuaccugccaccaguuacugcauccucaaguccuacagcuccuggugaaacuuuuugaaacggagcacucccaguuggaugucauggaacagcuggagcucaagaagacccugcuugaccgcauggugcaucuguugucaagagguuacguucucccagugguaaguuauauaaggaaaugucuggagaaguuagauacagacaucagccugauucgguacuucgucacugaagugcuagacguuaucgcucccccguauaccuccgauuuugugcaacucuuccugccuauacuugagaaugacucuauugccggcacaaucaaaacugaaggggagcacgaucccgucaccgaauuuaucgcccacugcaagagcaacuucauuauggugaacuga

SEQ ID NO: 59634 - RNA, 1143 nt, Artificial Sequence
  derived and/or modified sequence opt3 from NELFE__Homo_sapiens__NP_002895
augcuggugauucccccuggccucagcgaggaagaggaagcccuucagaagaaauucaacaagcugaaaaagaaaaagaaggcuuuguuagcacugaaaaagcaauccucuucaaguaccacaagccagggcggagucaaaagaucccuaucugagcagccaguuauggacacugccacggcgaccgaacaggcuaagcaacucgugaaaucgggugccaucucagcaauaaaggccgagacaaagaauagcggcuuuaaaaggagucggacucuggaggggaaacuuaaggauccggaaaagggacccguaccuaccuuccagccauuucagcgcuccaucucugcugacgaugaccugcaggagagcucccgacguccccaaagaaaaucauuguacgaaaguuucgugucuagcuccgauaggcuccgggagcugggcccugacggugaggaagcagaggggccaggagccggcgaugggcccccucgcucauuugacuggggguaugaagagagaagcggagcucacaguucugccuccccaccgaggagccggucgcgcgaucgaucucaugaaagaaacagggaccgggaucgugaccgcgagagagauagggaccgggaccgagaucgcgacagagagagggaucgggaccgcgauagagacagggaucgugaccgggaacgagauagagacagggagcgcgaucgggacagagacagggaaggucccuuccgccgauccgauucauuuccugagcggcgugcgccaagaaagggcaauacacuguacgucuauggggaagacaugacccccacucucuuaaggggagcauucaguccuuuuggcaacauuaucgaucugagcauggacccaccccgcaauugcgccuucgugacauacgagaaaauggaguccgcugaucaggccguugcagaacuuaacgguacccagguggagucuguccaguugaaggugaauauugcucggaagcaaccgaugcuggacgccgcgacggggaaaagcguauggggaucacuagccguucagaacaguccuaagggcugucacagagauaaaaggacucagaucguguauuccgacgaugucuacaaggaaaaucucguggacggcuuuuga

SEQ ID NO: 59635 - RNA, 2262 nt, Artificial Sequence
  derived and/or modified sequence opt3 from NELL1__Homo_sapiens__NP_001275643
augcccauggaccugauccucguggucugguucugcguuuguaccgccagaacagugguaggcuuugggauggauccugaccuucagauggauauugugacugagcuggacuuggucaacacgaccuuaggaguggcucaaguuagcgguaugcacaaugcauccaaggccuuccuguuucaggauauagaaagggagauccaugcggcuccacacgugucugaaaaacuaauucaacucuuccggaacaagucagaguuuacaauccuggccacuguccagcagaaaccgaguaccagcggcgugauucuuuccauccgcgaacuggagcaucgaauauacgagcguguaaucgaucccccugacacaaauuugccacccgggauuaaccucuggcugggacagagaaaucagaagcacggccuguucaaagguaucauucaggacgggaagaucauauuuaugccuaacggauauauuacccaaugcccaaaucucaaccauacuugucccacaugcucugauuucuuaucgcugguucagggcaucauggaccuucaggaauugcuggcaaagaugaccgccaaacuaaauuacgcugagacgaggcucucacagcuggaaaacugucacugcgagaagacuugucaagugagcggccuucuguaucgggaucaggacaguugggucgauggggaccacugccgcaauuguaccugcaaauccggagcaguggaguguagaaggaugucuugcccuccauugaacugcagcccggacucccuccccgugcauauugccggucaguguugcaaggucugucggccuaaaugcaucuacggcgggaagguucuggcugaaggacaacgcaucuuaacaaagucaugucgagagugcagaggcggugugcugguaaaaauuacugaaauguguccaccccucaauugcagugagaaggaucacauacuuccugaaaaccaguguugcagggugugucgggggcauaauuuuugcgccgagggaccaaaaugcggcgagaacagcgaauguaagaacuggaauaccaaagcgacaugcgaguguaagucuggcuauaucuccguccagggggacucagcauacugcgaagauauugacgagugugccgcuaaaaugcacuauugccacgccaacaccguguguguuaaucugcccggauuguaccguugcgauugugugccggguuacauccgcgucgacgauuucagcugcacggaacaugacgaguguggcagugggcagcacaacugcgaugagaaugcaauaugcacuaacacagugcaaggacauucuuguaccugcaagccuggcuauguagguaaugggacuauuuguagagcuuuuugcgaagagggcuguagguacggaggcacaugcguugcccccaacaagugugugugcccauccggguucaccggaagccacugugaaaaagacaucgaugagugcucggaagguaucauugagugucauaaucacucucggugcgucaaccuaccuggcugguaucacugcgagugucgauccggguuucaugacgacggaacguacucacugaguggcgaaagcugcaucgauauugacgagugugcgcuccgcacccacacaugcuggaaugauuccgccuguauaaaccuggcugguggguucgacugccuuugucccucuggcccaagcugcucaggagauuguccccaugaaggcgggcugaagcacaauggacagguguggacuuugaaagaggacagaugcagugucuguuccugcaaggaugguaaaaucuucugcaggcggaccgcaugugacugccagaacccuagcgccgaucucuuuuguugcccagagugugacacacgcgugacuucucagugccuggaucaaaauggccacaaguuauauagaucaggggacaacuggacccauaguugucagcaguguaggugccuggaaggagagguugauugcuggccgcuaacaugucccaaccucagcugcgaauacaccgcuauucuggagggcgaaugcuguccucguugcguguccgacccaugucuugccgacaauaucacuuaugauauccggaagacgugcuuggacucuuacgguguaucgcgacugagcggguccgucuggacaauggcaggcucacccuguaccacuugcaaauguaagaacggaagagugugcuguaguguugauuucgagugccuccagaauaacuga

SEQ ID NO: 59636 - RNA, 2601 nt, Artificial Sequence
  derived and/or modified sequence opt3 from NELL2__Homo_sapiens__NP_001138579
augggcuuucccccucugcucaaggggcaggccagcgcuaccagauccucucuugcaucaugcaguuggguggucuucuuccugagcuguuuguccaggcacgccccagagaucgaaggaggucggcgcuggacagaguuaauucgaacuauggaaucucguguucugcuaagaacguuuugccucauauucggccugggggcgguguggggacuuggcguagacccgucgcugcaaaucgauguguugaccgagcucgaacugggugagucaacaacuggggucaggcaagugcccggacugcauaacggcaccaaggcuuuucucuuccaggacacaccucggagcauuaaggccaguaccgcaacugccgagcaguuuuuccagaaauuacgcaauaagcacgaauuuacaauccugguuacccuuaaacagacgcauuugaacuccggcgugauucugucuauccaccaucuagaucacagauaccucgagcuggaaagcuccgggcacaggaaugagguccggcuucauuaucgcucaggaagucaccgaccacauacugagguguuccccuacauacuggcugacgauaaguggcacaaguugagccucgcaaucucugccucccaccugauuuuacauaucgacuguaacaaaauuuaugaaagaguaguugagaagccuucaaccgaucugccacucgguacaacuuuuuggcuuggccagaggaauaacgcucacggguacuucaaaggaaucaugcaggacgugcaacuguuggucaugccccagggcuuuauagcccagugcccugaucuaaaucggaccuguccaacaugcaacgacuuccauggucuggugcagaagauuauggaacuccaagauauccuggcgaaaaccagcgcaaaacuuagucgugccgagcagcgcaugaauagacuggaccaguguuauugcgaaaggacguguacuaugaaggggacaaccuaccgggaguucgagucuuggauugauggaugcaaaaacuguacuugcuugaauggcacaauccaaugcgaaacccucaucuguccgaaccccgacugcccucugaaguccgcuuuagccuauguggacggcaaauguugcaaggaguguaaaagcauuugccaguuucaggggcgaacguacuucgaaggagagcgcaauaccgucuacucgucuuccgguguuugugugcuguaugaaugcaaggaucagacaaugaagcuaguagagucaaguggcuguccagcacucgacugccccgagagccaccaaauaacucugucccauucuuguugcaaagugugcaagggguacgauuuuuguagcgaaagacacaacugcauggaaaauucaaucuguaggaaccuuaacgaccgggcugucugcaguugucgcgauggauucagagccuugagggaggacaaugcguauugcgaggauauugacgaaugugccgagggccgucacuacugccgggagaacaccaugugugugaauacaccugguuccuuuaugugcaucuguaaaacuggguauauacgaauugaugacuacagcugcaccgaacaugaugagugcaucacaaaccagcacaauugugacgaaaacgcacugugcuucaauaccguuggcggacauaacugugugugcaagccaggcuauacugggaauggaacgacauguaaggcuuuuugcaaagacgguuguagaaacggcggggccugcaucgcugccaaugucugugcaugcccccagggauucaccggcccgucuugugagacugauauugacgagugcucagaugguuuugugcagugcgacaguagggccaacuguaucaaucucccugggugguaccacugcgaaugucgcgauggcuaccacgacaacggaauguucagccccuccggcgagucuugcgaagauauugacgagugugggaccggacggcauucgugcgcuaaugauacaauauguuuuaaccuggacgguggcuaugauugcagauguccacacgggaaaaacugcaccggagacuguauccaugauggcaagguaaagcacaauggucaaauuuggguucuugaaaacgacaggugcagcgugugcuccugucagaauggguucgucaugugccgccgaauggugugugacugcgagaacccuacugucgaucuguuuuguugccccgagugugacccacgguugucaagucagugccuccaucagaauggcgaaacacuguacaacucuggagauacgugggugcaaaauugucagcagugccguuguuuacagggcgagguugacugcuggccccugccuugcccagauguggaaugugaguucagcauccuaccggaaaacgagugcugucccagaugcguaaccgacccuugucaagcggauacuaucaggaaugacauuacaaaaaccugccucgaugagaugaacgucgugcgcuucacaggguccucauggauaaagcacggaacugaauguacccugugccaguguaaaaauggccacaucugcuguagcguugacccacagugccuucaagaguuguga

SEQ ID NO: 59637 - RNA, 3168 nt, Artificial Sequence
  derived and/or modified sequence opt3 from NEMF__Homo_sapiens__NP_001288661
augaaaagcagauucuccaccaucgaccugagggccgugcucgcugagcuuaacgcaucucuguugggcaugcgggucaauaacguuuacgauguggacaauaaaacauauuuaauucgccugcagaagcccgauuuuaaagccacucuacuccuggaaucagggauacgaauccacacgaccgaguucgaauggccuaagaacaugaugccaaguagcuuugcgaugaaaugccguaagcaucuuaaguccagaaggcugguaucugcuaaacaauugggaguggaccggauugucgauuuccaguuugguucggacgaggccgcauaccaccucaucauugaacuguaugaucgcggcaauaucgugcugacagacuacgaguauguuauacucaacaucuuaagauucaggacugaugaggccgacgaugugaaguuugcuguccgggaacgcuacccgcuggaccaugcacgagccgcugagccccuuuugacccuggaaagacuaacagagauuguggccucagcgccuaaaggggagcuccugaagaggguacuuaauccacuguugcccuauggaccugcacucaucgaacacugucuguuagagaacggcuucagcgguaauguuaaaguggaugaaaagcuggagaccaaggacauugaaaaaguccucgugagucuucagaaggccgaggacuacaugaaaacuacauccaacuuuucugggaagggauacaucauacagaaacgggagauuaagccaugccuggaagcugauaaacccguggaggacaucuugaccuaugaagaguuccauccuuuucuauucagccaacacucccaguguccauacauugaauuugagucauucgauaaggccgucgacgaguucuauaguaagaucgaaggccagaaaaucgaucugaaggcacuccagcaagagaaacaggcucugaagaaacuugacaauguucguaaggaucacgaaaaccgccuggaggccuugcagcaggcgcaagaaauugacaagcucaaaggcgagcugauagagaugaauuuacagaucguggauagagccauucagguagugaggagcgcacuggcuaaccaaaucgacuggacggaaauagggcuaauugucaaggaggcccaggcucagggagauccgguggccucugcaaucaaagaacucaagcugcagacuaaucauguuaccaugcuuuugcggaaccccuaccugcucuccgaggaggaagacgacgauguggacggugaugucaacguggagaaaaaugaaacagagccuccaaagggcaagaaaaagaaacaaaagaacaaacagcugcagaagccccagaagaauaaaccucuucugguagacguugauuugucacucagcgccuaugcuaacgcgaagaaauacuaugaccacaagcgauacgcagccaaaaagacucaaaagaccguggaagcugccgagaaggcauuuaagagugccgagaaaaagacaaaacagacccugaaggaaguccagacggugacuucuauccagaaagcucgcaaggucuacugguucgagaaguuuuuaugguucauuuccagcgaaaauuaucugaucauugggggaagagaucaacagcagaacgagauaaucgugaaaagguaccuaacaccaggcgaacccauuccgccucggacccucacugaggccgguacaauggcacugugcuauucggcggcuugggacgcccgcguuaucaccucugcaugguggguguaccaucaccagguauccaagacggcccccaccggggaguaucuuacaacuggaucauuuaugaucagaggcaaaaagaauuucuugccaccuaguuaccugaugaugggcuuuagcuuccucuuuaaagucgaugaauccuguguguggaggcaccaaggggagcguaagguucgggugcaggacgaagauauggagacccuggcuucuugcacaagcgaauuaauuucagaggagauggaacagcuggacggaggugauaccaguuccgacgaggacaaggaagaacaugagacucccgucgaaguggagcuuaugacacaaguagaucaggaagacauaaccuugcagagcggccgagaugagcucaacgaggagcugauccaggaggaaucuucagaggacgaaggggaguaugaagaggugagaaaagaucaagacaguguuggagagaugaaggaugaaggcgaggaaacucuaaauuacccagacacgacaauugaucugagccaccuccagccccagagguccauccagaaacuggccucuaaggaggaaucgagcaacuccucagacaguaaaucucaaagccgccggcaucuuuccgcaaaggagagaagggagaugaagaaaaagaaauugccuucagauagcggugaccuggaggcuuuagaagggaaggauaaagaaaaggagucuaccguccacauugagacucaucagaauaccuccaaaaacguggccgcggugcagccaaugaagcgcggccagaagaguaaaaugaagaaaaugaaggaaaaauacaaggaccaagacgaggaagaucgagagcucaucaugaagcugcuuggaagcgccggcucuaauaaagaagagaaggggaaaaaggguaaaaagggaaagacaaaagacgagccggucaagaaacagccccagaagccucggggcgggcaacguguuuccgauaacaucaaaaaggaaaccccauuccuggaggugauaacucacgaauugcaggacuuugcuguggaugacccccacgaugacaaggaggaacaggaucucgaccagcaaggaaaugaggagaaccuguucgauucacuaacaggccagccucauccagaagacguacugcucuuugcaauucccaucugugccccguauacgaccaugacuaacuacaaauauaaggucaaacugacaccuggugugcagaagaaagggaaggcugccaagaccgcacuuaauaguuucaugcacagcaaagaggcgacagccagagaaaaggacuuguucaggucgguuaaagauacugaccugucccgcaacauuccaggcaaggugaaagucucugcucccaauuuacucaacgugaagcggaaauga

SEQ ID NO: 59638 - RNA, 4227 nt, Artificial Sequence
  derived and/or modified sequence opt3 from NEO1__Homo_sapiens__NP_001166094
auggccgcugagagaggcgcaaggcggcugcucagcacccccuccuucuggcuuuacugccuguuguuacuggggcgccgagccccuggagcggcugccgcacguucugguucagccccacagaguccgggcgcuagcaucagaacauuuacucccuucuauuuucuaguggaaccugucgacacgcucuccguuagggggucuucggugauucugaacuguucagcauacagcgagccaagucccaagauagaauggaaaaaggauggaaccuuccuuaaucugguauccgacgaucggcgccaauugcucccugacggcucucuguuuaucagcaacgugguccacuccaaacauaauaagccagaugaggguuauuaccagugcguggccacaguugaaucacuggggacuauuaucaguagaaccgcuaaacucauuguggccggauuacccagguucacaagccagccugagccaucuuccgucuaugcgggcaacaaugcaauccugaacugugaggugaaugccgaccuuguaccguuuguucggugggaacagaaccgccaacccuugcugcuagaugaccgagugauaaagcucccuucaggcaugcuggucaucagcaaugcuaccgagggggauggaggucuuuacagaugcgugguggaaaguggcgggccacccaaguauucugacgaggucgagcugaaaguuuugccugauccagaagugauuuccgaccucguauuccugaagcagcccagcccguuagugagggucaucggacaggaugugguucugccuuguguggccucgggccuccccacuccaacaauuaaauggaugaagaacgaggaagcacuugacaccgagucuuccgaacggcuggucuugcuagcuggugggucacuggagaucagugacgugacggaggaugacgccggaacuuacuuuugcauagcggauaauggcaacgaaaccauugaggcccaggcagaacucacaguacaagcucagccugaguuccugaaacagcccacuaauaucuacgcccacgaaagcauggacauuguuuuugagugugaggugaccggcaagccaacacccaccgucaagugggugaaaaacggggauauggucaucccuuccgacuauuucaagaucgugaaagaacauaaucuucagguucugggauuggugaagucugaugaggguuuuuaccaaugcauugcugaaaacgacguaggcaacgcccaggcaggggcccagcucauaauccuggagcacgcuccagcgacgacuggaccguuacccagcgcaccucgugaugucguggccucacugguuaguacacgcuucauuaaacuaaccuggagaacuccagcuuccgacccccauggcgauaaucucacauauagcguguucuacaccaaggaagguaucgccagggagcgggucgagaacacgucucacccuggggaaaugcaagugaccauacagaaucugaugccagcaacaguauauauuuuucgagugauggcccagaacaaacacggcucaggagagaguagcgcuccccuucgcguugaaacucagccggagguccaauugccuggcccagcccccaaucugagagcauacgcggcuuccccuaccucuaucacagugacuugggagacccccgugucggggaacggagaaauccagaauuauaagcucuacuacauggagaaggguacagacaaagaacaggacgucgauguuagcucccauucauauaccauuaacggccugaagaaauacacugaguauaguuucagggugguggccuacaauaagcacgggccaggaguaucuacgccugacgucgcagugcggacacuuagcgauguucccuccgccgcuccacagaaccugucauuggaagugcgcaauagcaaaucuaucaugauucauuggcaaccgccugcccccgcaacccagaacggccagauaacugguuauaagaucagauacaggaaggcuucccguaaaagugacgucaccgagacacucgugagcgggacccagcugucucaauuaauugagggccuggaucggggaacugaauauaauuuucgaguugccgcgcuaacaaucaacggcacggggccagccaccgacuggcucuccgcugagacuuucgaaucagaucuggacgagacaagagugcccgaaguaccuaguagccuucacgucaggccauuggugaccucgaucguggucuccuggacacccccugagaaucagaacauuguugugcgcggauacgcaauagguuacggcaucgggucuccgcacgcccagacuauuaagguagauuauaaacagcgguacuauaccaucgagaaccuggacccaagcucacauuacgugauuacgcucaaggcuuuuaauaacgucggagaaggcaucccccuguaugagagugccgugaccagaccucacacagauacuuccgaaguugacuuauucgugauaaaugcaccauacacccccgucccugauccgacacccaugaugccaccuguggguguucaagcgucuauccugagccaugacacuauuaggaucaccugggccgacaacucccuucccaaacaccagaagauuacggauucacgcuauuacacagugcgauggaagaccaauaucccagcuaacacuaaauacaagaaugccaacgcaacaaccuugagcuaucucgucacugggcugaaaccuaauacccuauacgaguuuaguguaauggugacaaagggccggcguucuuccacguggagcaugaccgcucauggaacuacauucgaacugguucccaccucgccaccgaaagacgugacagucgugucaaaggagggcaagccuaaaacuauaauuguaaacuggcagcccccaucugaggccaaugggaagaucaccggauauauuaucuacuauaguacggaugugaacgcagaaauacacgacugggucaucgagcccguugugggcaauagacucacacaccaaauucaggaacugacccuugauacuccuuacuauuuuaaaauccaggccaggaacuccaaggguauggggccaaugagcgaggcugugcaguuccgcacccccaaagcggacucuagcgauaagaugccuaaugaccaagccuccggaucaggcgguaaaggcagucgguugccggaucuggggagcgacuacaagccacccaugucuggauccaacucaccucauggcagucccacaagcccauuagauuccaacaugcuccuggucauuaucgugucuguugggguaauaacuauuguggucgugguuaucaucgcaguguuuuguaccagaaggacaacgucgcaccagaagaaaaagcgagcugccugcaaaagcgucaauggaucacauaaguacaaaggcaacuccaaggacgugaagccucccgaucuuuggauucaccacgagcgccuggaauugaaaccaaucgacaagaguccugacccgaaucccauuaugaccgauacuccaauaccucggaacucucaggacaucacacccguagauaauagcauggacuccaacauucaucagagacguaauucauauaggggucacgagucugaagauagcaugaguacccucgccgggcgccggggaaugagaccaaaaaugaugaugccuuucgacucccaacccccgcagcagagcgucaggaacacuccaucuacagauaccaugccugcuucauccagucagacguguugcacugaccaucaagaucccgagggcgcaaccagcucgucuuaccuggccuccagccaggaagaggacucaggucagagucuaccaacagcgcacgugcgacccucucauccucugaaguccuuugcuguuccggccauucccccaccugggcccccuaccuaugauccagcacuccccagcacuccucugcuuucacaacaggccuugaaucaccacauccauagugugaaaacagcuagcaucggcacccugggacggucccgcccacccaugccggucgugguuccuucugcaccagaggugcaggaaacaacuagaauguuagaggacagcgaauccucauacgagcccgacgaacucaccaaggagauggcccaccuggagggccuuaugaaggaucugaacgcgauaacgacagcuuga

SEQ ID NO: 59639 - RNA, 4866 nt, Artificial Sequence
  derived and/or modified sequence opt3 from NES__Homo_sapiens__NP_006608
auggagggcugcaugggggaagagagcuuccagaugugggaacugaacagaaggcucgaggccuaccuugcucgggugaaggcacuggaagaacaaaaugaguuguuauccgccgaacugggaggucuacgcgcgcagucugcugacaccucauggcgagcccacgcagaugacgagcucgccgcucugcgugcacuugucgaucagagauggagggaaaaacaugccgcugagguugcccgggacaaccuggcggaggaauuggagggcguggcagggcgcugucagcaacucagacuggccagggaacggacaacugaggaaguagcucgcaauagacgagccguggaggcagagaagugcgcuagggccuggcugaguagccaggucgcggaacucgagcgggaauuagaggcccugcguguggcacacgaagaggagcgcguuggacuuaacgcucaggccgcuugugcccccagaugcccugcaccaccgagggggcccccugccccagcucccgaaguggaggaauuggcgcggcgacugggugaggcauggcgcggggccgucagaggauaucaggaaaggguggcucauauggagacgucccuaggccaagcccgggagcgccucggcagagcaguacagggggccagggaaggacgucuggagcuucagcagcugcaagcugaacgggguggcuugcucgagagacgagccgcacuggagcagagguuagaagggcgcuggcaggagcggcugagagcgaccgaaaaauuucaacucgcuguugaggcccuugaacaggagaagcagggacugcagucucaaaucgcacagguguuggagggcaggcagcagcuagcccaccugaaaaugucgcucucacuggaagucgcuacauaccgcacucuucuggaggccgaaaauagccgauugcaaaccccuggugggggaaguaagacaucccucucuuuccaggauccaaagcuggaguuacaguuuccccggaccccugaaggccguagacugggcagccuacucccagugcuguccccgacuucacuucccaguccuuugccagcaacacuggagacccccgugccugcuuuccucaaaaaccaggaguuucugcaagccaggacgccaacucuugcgagcacccccauuccgccuacaccccaggccccaucuccugcugucgacgcagaaauacgcgcccaggaugcuccccuguccuugcuccagacucaagggggacggaagcaggccccagagccccugagagcagaagcgaggguugccaucccugcuucaguguuaccagguccggaggaacccggcgggcagcgacaagaggccagcaccggacagaguccugaggaccaugcaucucuggcuccaccccuauccccugaucacagcucgcucgaagccaaagacggcgagucuggugggucccgcguauucucaauuugucggggcgaaggagagggccagaucugggggcugguggagaaggaaacagcaauugagggaaaagucgugaguagccuucagcaagaaaucugggaggaagaggauuugaauagaaaggagauacaggacucccagguuccacuggaaaaggagacccucaaaucucugggugaagagauccaggaaagccuuaagacgcuggagaaccaaucacacgagacucuugaaagggagaaucaggaaugcccccguaguuuggaggaagaucucgagacacugaaaucccuagagaaggaaaacaaagagcugcucaaggacguggaagucgugcgcccgcuggagaaagaggccguaggccagcuuaagccuaccgggaaggaagacacucagacauugcaaagccugcagaaagagaaucaggaauuaaugaagucucucgagggaaaccuggaaaccuuucuuuucccaggcacggagaaucaagagcugguuucaaguuugcaggaaaaccucgagagccugaccgcucuagaaaaagagaaucaggaaccccugcgguccccugaggugggugaugaggaagcgcucagaccccugacaaaggagaaccaggaaccacuuaggucuuuggaggacgaaaacaaagaggccuuucgaucgcuggagaaggaaaaucaagagccuuuaaagacucucgaagaggaggaucagagcauuguccggccccuggaaaccgagaaccauaaaucccuucgcucacuggaggagcaggaccaggaaacacuaagaacucucgagaaggagacccaacagaggcggcgaagucugggggaacaggaucagaugacauugagaccaccggagaaaguggaccuggaaccuuuaaagucucucgaucaagagaucgcacgcccccuggaaaaugagaaccaggaguuccuuaaaagccugaaggaagaguccgucgaagcugugaagucauuggagaccgaaauucucgagagccugaaaucugccggccaggagaaucuagaaacucugaaguccccagagacgcaggcccccuuauggacaccugaagagaucaaccaaggagcuaugaauccacucgagaaagaaauacaggagccccuggaaaguguugaggugaaccaggaaaccuuuagguugcuggaggaggaaaaucaagagagcuuacguucucucggcgcauggaaccuggaaaaucuucgguccccugaggaaguagacaaggagucacagagaaaccuggaggaagaggaaaauuuggggaaaggagaguaucaggaaagucucaggagccuggaggaggaaggucaggagcuaccgcaaucggccgauguccagcgcugggaagacacuguggagaaggaucaggagcuggcgcaggaauccccacccggcauggcugggguugagaacgaagacgaggccgaacuuaaucuccgagagcaagacggauucaccggcaaggaggaaguggucgagcagggugaacugaacgcaacagaggaaguguggauuccuggggagggccacccagagucucccgaaccuaaagagcagagaggauugguagaaggcgccagcgugaagggcggagcugagggcuuacaggauccggaaggucaaucacagcagguuggggcacccggacugcaagccccacagggccucccugaggcgaucgagccccuggucgaagacgauguggcuccagguggcgaccaggccaguccugaggugaugcuuggguccgaacccgcaaugggagagucugccgcuggcgccgagccagggccgggacagggcgucggugggcugggagauccuggccauuugacccgggaagagguuauggaacccccacuagaggaagagagccuggaggcaaaaagggugcaaggucucgaaggcccccgcaaggaccuggaggaagcugggggacuuggcacugaguuuuccgaauuaccugggaaaucacgugauccaugggagcccccuagagagggacgggaagagagcgaagccgaggcgccgaggggcgccgaagaggcauucccagcugagacacugggucacacggggagugacgcccccucuccuuggccccucggauccgaagaggcugaagaggaugugccaccuguauuggucagccccucgccaaccuacacuccuauucuggaggacgcaccgggcccccagccacaggccgaagguucacaggaggccucuuggggcgugcaagggcgcgcugaagcgcucggaaagguugagagugaacaggaggagcugggcuccggggaaaucccugagggaccccaggaagagggcgaagagagccgagaggaaucugaggaagaugagcuuggugaaacacugccagacagcaccccuuugggguucuaucuaagaucccccacaucaccgcggugggauccaacuggagagcagaggccucccccacaaggcgagaccggcaaagaagggugggaccccgcagugcuggccagugagggacucgaagcuccuccgagcgagaaggaggaaggugaggaaggcgaggaagagugugggcgcgacucugauuuauccgaggaauuugaggaccugggaacggaagcccccuuccuuccaggcgucccuggugagguggcagaaccccuggggcagguuccucagcucuugcuggauccagccgcuugggacagagauggagagucagacggcuuugcggaugaggaagagaguggcgaagagggggaagaggaccaggaggaaggaagggagcccggugccggccggugggggccuggaagcuccgugggcucucuccaagcacugucgagcucacagcguggugaguuccuugaauccgauaguguaucugucagcgugccaugggacgauucccuacgcggggcuguggccggagcacccaagaccgcccuggagacagaaucacaggacucugcugagccgagcggcagugaagaggaauccgauccugucagcuuggagcgagaggacaaaguuccaggccccuuagaaaucccuucugggauggaggacgccggaccaggugcggauauuauaggcgugaacgggcaaggacccaaucuggaaggcaagucacagcacguaaacgguggggugaugaauggacucgagcaguccgaagaggucggccagggcaugccgcuggugagugagggggacagaggaagcccuuuucaagaagaggaagguucggcacuuaaaacuucuugggccggcgcucccguucaucuggggcagggacaguuccucaaguuuacccagagggagggcgaucgggaauccuggagcucaggugaggacuga

SEQ ID NO: 59640 - RNA, 1791 nt, Artificial Sequence
  derived and/or modified sequence opt3 from NET1__Homo_sapiens__NP_001040625
auggagcccgaacuggccgcucagaagcaaccuagaccaaggcggcgcagccgacgugcauccggccucucuaccgagggggccacaggaccgucagcggacacuagcgguagugaacuugauggcagaugcucccugaggcgggggucuucguucacguuuuugacccccggaccuaacugggacuucacauuaaaacgcaagagaagggagaaagaugacgauguggucucacugagcagucuagaccucaaggaaccauccaauaaacggguucgcccccuggcucgagugacuucucuugccaaccugaucagcccuguaagaaauggcgcagugaggcgguuuggucagaccauucaguccuucacauugcguggggaucaccgcucaccagccagugcucagaaguuuagcucuagauccaccguccccacuccugcaaagaggcggucaagcgcccucuggagugagaugcuggacauaacaaugaaagagucucugaccacgcgagaaauccgcagacaagaggcuauuuacgaaauguccaggggagagcaggaucucaucgaggacuuaaagcuggcccggaaagcguaucaugauccaaugcuuaaguugagcauuaugucggaagaggaacugacucacaucuucggcgaccuagauucuuacauaccgcuccaugaggaccugcuuacccgcaucggcgaagcaacaaaacccgacgggacuguggagcagauuggacacauccugguuuccugguugccuagacucaacgccuauagggguuacuguucaaaucagcuggcugccaaggcauuacuggaucaaaagaaacaggacccacgugugcaggauuuucuccagcggugccuugagagucccuucagccgaaagcuggacuugugguccuuucuagauauuccuagaucuaggcuggucaaauauccacuccugcuuaaggaaauccugaaacauacccccaaggagcacccggacgugcaauugcucgaagaugcuauacugauuauccagggcguauuaagcgacauuaaccugaaaaagggggagucagaaugucaguacuauaucgauaagcuagaguaccucgacgagaaacaacgcgauccucggaucgaagccaguaagguucugcuuugccacggagaguugagauccaaaagcggccauaagcuguacauuuuccucuuucaggacauacuggugcuuacaaggcccgucacccgcaaugaacgacacucuuaucagguguaccggcagccaaucccugugcaagagcuggucuuggaagaccuccaggauggugacguucguaugggagggucauucagaggcgcguuuaguaacagcgagaaagccaagaauauuuucaggauccgcuuccaugaucccuccccagcacagucucacacgcugcaggcuaacgacguguuucacaagcaacagugguucaauuguauacgggccgcuauugcccccuuucagucggcaggcagcccuccagaguuacaggggcugccggaacuacaugaggaaugcgagggaaaccaccccuccgccagaaaacucacugcucaaaggcgagcgucaacaguaaguucugugacccaggucgagguggaugaaaaugcauaucgcugugguagcggcaugcagauggccgaggacuccaagucacugaaaacucaucagacacaaccugggauccggagagcuagggauaaggcccuuagcggaggcaaacguaaggaaaccuugguuuga

SEQ ID NO: 59641 - RNA, 471 nt, Artificial Sequence
  derived and/or modified sequence opt3 from NETO1__Homo_sapiens__NP_620552
augcuggccgagcccuucccuaagguggucgcuagccucaucauucuucaccuguccggcgcaaccaaaaaggggacagaaaaacagacuacgucugagacccaaaagucaguucagugcggaacauggacuaaacaugccgaagguggcauauuuaccaguccaaacuacccgagcaaguaucccccugacagagaguguaucuacauuaucgaagcggcuccaaggcagugcauugaguuguauuucgaugagaaguacuccaucgaacccucuugggaguguaaauuugaccacauagaagugcgggaugggccuuucggauuuucgccaaucauuggccgcuucugcggucagcaaaaucccccuguaaucaagucaagcgggcgauuuuuauggauuaaauucuuugccgacggagagcuggagaguaugggcuucuccgcacguuauaacuuuacaccagaauga

SEQ ID NO: 59642 - RNA, 1578 nt, Artificial Sequence
  derived and/or modified sequence opt3 from NETO2__Homo_sapiens__NP_060562
auggcccuggagagacucugcagcgugcuuaagguccuguugaucaccguuuuagugguagaaggcauugcuguggcacagaaaacacaagacgggcagaacauaggaaucaagcacauucccgccacucagugugguaucugggucaggacguccaauggcgggcauuucgcgucuccuaacuacccagauucauauccgcccaauaaagagugcauuuacauccuggaagcugccccucggcagcgcauagagcuaaccuuugacgaacacuauuacaucgagccaaguuucgagugucgauuugaucaucucgaagugcgugacggacccuucggcuuuagcccucugauugauagauauugcgguguuaaguccccaccccuuaucaggucuacagggcgguucauguggauuaaauuuucgucagacgaggaacuggagggauugggcuuccgcgcaaaguacagcuuuaucccugauccagacuucacuuaucucggcgggauacugaacccgauucccgauugucaauuugagcugaguggagccgacgguaucgugagauccucucaggucgaacaggaggaaaagaccaaaccuggccaggcuguggauugcauuuggacaaucaaggcaaccccaaaagccaagaucuaccucagguucuuagacuaccaaauggagcacagcaaugaauguaaacggaacuuuguagcuguuuaugauggguccucaaguauugagaaucugaaggccaaguucugcagcacuguggcgaacgacgucaugcuuaaaacaggaauaggcgugauccgcaugugggcagacgaggguucucgauuguccagauucaggaugcuguuuaccucauucguggaacccccuuguacgagcaguaccuuuuucugccauucuaauauguguauuaacaauucccuagucugcaacgggguucagaauugcgccuacccaugggaugagaaccacuguaaggagaaaaagaaagcuggaguguuugagcagaucacuaagacacacggcacuauaauuggcaucaccagcgggaucguacucgugcugcuuauuaucucgauucugguccaggugaaacaaccccggaagaagguuauggccugcaaaacagcauucaauaagaccggauuucaggaaguguucgacccgccucauuaugaguuguuuucucuccgugauaaagagauauccgcugaccuggccgauuuaucagaagaacuggacaacuaccagaagaugcgcagaaguagcacggcguccagguguauccacgaucaucacugcgguucucaagccagcucagucaaacagagucggacuaaccucuccagcauggaacuucccuuccgaaaugacuuugcacagccacagccuaugaagacauucaacucuaccuuuaagaaaucaaguuauacuuucaagcaaggccacgagugucccgaacaggcucuggaggaucgcgugauggaggaaauuccaugcgagaucuacguaagagggagggaagacagcgcccaggcuuccaucucuauugauuucuga

SEQ ID NO: 59643 - RNA, 1248 nt, Artificial Sequence
  derived and/or modified sequence opt3 from NEU1__Homo_sapiens__NP_000425
augaccggcgagagacccagcacagcccugccugacaggcggugggggccacgcauccucggauucugggguggcugccgagugugggucuuugcugcaauuuuccuucuguuguccuuagccgcgucuuggucaaaggcugaaaacgauuuugggcugguucagccgcuagugacuauggagcaacuccuguggguaaguggacgucagauaggcagcguggacacguucagaaucccccuuauuaccgccacaccuagggguacucuguuggcauuugccgaagcucggaaaauguccucuucggaugagggggcaaaguucaucgcccuccgcagaucaauggaccagggaagcaccuggaguccaacagcuuuuauugucaaugauggcgacgugcccgauggccugaaccugggggccguuguguccgacgucgaaaccggagugguauuccucuuuuacucuuuaugugcgcacaaagcagguugccagguugccagcacuaugcuggugugguccaaggaugacggcgucucauggaguacaccuaggaaucuuagcuuggauaucgggaccgagguguucgcuccaggacccggcucugguauacaaaaacagcgggagccucgcaaggggcgacugaucguguguggacauggcacgcuagaaagagacggcgucuuuugccuccuguccgaugaccacggggccucauggagguauggaagcgguguuaguggcauuccauacgggcagccgaagcaggagaacgacuucaaucccgaugaaugucaaccuuaugagcuuccagacggaucugugguaaucaacgcacggaaucagaacaauuaccauugccacugucguauugugcugcgcuccuaugaugcuugcgacacuuugagacccagggaugucaccuuugacccugagcucguggauccaguuguggccgcgggcgccgucgugacaagcucggguaucguauucuucucuaaccccgcacauccggaauuucggguuaaucugacuuuacgaugguccuucucaaacgggaccaguuggcgcaaagagacagugcagcuguggccuggccccagcggauacuccucucucgcuacccuugaaggcagcauggacggggaggaacaggccccacaacuguaugucuuguacgagaagggaagaaaucacuacacggagucaauaaguguggcuaaaauuuccgucuaugguacucuauga

SEQ ID NO: 59644 - RNA, 1386 nt, Artificial Sequence
  derived and/or modified sequence opt3 from NEU3__Homo_sapiens__NP_006647
augagacccgccgaccugccuccaaggccgauggaggaaagccccgcuuccucuucagcaccuaccgagacagaggaaccaggcaguagcgccgaagugauggaggaggucacuacgugcuccuucaacucuccccucuuucggcaggaagaugaccgcgggaucaccuaccguauuccugcgcuucuguauauaccacccacacacacuuucuuggcuuuugccgagaagcgaucgaccagaagggaugaagacgcauuacaucugguucuacggcgcggacucagaaucggucaacuggugcaguggggcccucuuaaaccacugauggaggccacauugccggggcacaggaccaugaaucccuguccuguaugggagcagaagucaggaugcguguuccucuuuuucauuuguguccggggccaugugacugaacgccagcaaaucguuagcggucgaaacgcugcaagacugugcuuuauuuacagucaggaugccggguguuccuggucugaggugagggaccugacagaagaggucaucggaagcgaacucaaacacugggcuaccuucgccgugggcccaggccaugggauacaguuacaguccggacggcugguaauccccgcguauacguacuauauuccuucaugguuuuucugcuuucaacuuccauguaagacucguccccacaguuugaugaucuacagcgaugaccuggguguuaccuggcaccauggccgccuaauuagaccgauggugacagucgagugcgagguggcagaagugacugggagggccggacacccuguccucuauuguucugcucggacccccaaucgaugccgcgccgaggcacuguccacagaucauggcgaagguuuccagagacuugcucugucaaggcaguugugugagccaccucacgggugccagggaagcguugugaguuuucggccccucgaaaucccacaccgcugccaagacucuuccagcaaagaugcccccaccauacagcagucgucuccuggcuccucacugagauuagaggaggaagcgggcacgccaagugagagcuggcugcucuacucccauccgacuucuaggaagcaacguguagaccuugggauuuaccugaaccagacacccuuggaagccgcauguuggagccggccuuggauccuacacugcggaccaugugguuauucagaucuggcugcccucgaggaagagggccuguucgggugccuuuucgaguguggaaccaagcaggaaugcgagcagauugcuuuucgacuguucacucauagagaaaucuugagucaccuccaaggcgacuguacaucccccgguaggaauccuagccaguuuaaaucuaacuga

SEQ ID NO: 59645 - RNA, 1725 nt, Artificial Sequence
  derived and/or modified sequence opt3 from NEURL1__Homo_sapiens__NP_004201
augggcaacaauuucagcuccauccccucucugccuagagggaacccaucaagggccccgcggggacacccccagaaucucaaggacaguauugguggcccuuuuccagugaccagccaucgcugccaccauaaacaaaagcacugucccgcuguccuuccuuccgggggacugccagcaacacccuuguuauuccauccucacacuaaaggcucucagauacugauggaucuaucgcacaaggccguuaaacgacaggcgucauuuugcaacgcuaucacguucagcaaucguccagugcucauuuacgagcagguaagacugaagaucaccaagaaacaauguugcuggaguggugcccuuaggcugggguuuacauccaaggacccgucucggauucaucccgauagcuugccuaaauaugcauguccagaccucgugucccagucaggauucugggccaaggcucugcccgaagaguuugcaaacgaaggcaauaucauagccuucugggucgauaaaaagggccgcguguuucacagaaucaacgacagugcuguuaugcuguucuuuagcggggugaggacugccgauccucucugggcguuagucgacguguacggacugacccgggguguacagcuuuuggauucugagcugguucuaccagacugccuccgcccccgauccuucacagcacugagaaggccgucacuucggcgugaagccgaugacgcucgccugagcgugaguuugugugaucucaaugucccuggcgccgacggggacgaggcagcucccgccgcgggaugcccaauuccucagaacucucuuaauucccaacauagcagagccuuacccgcacagcuggauggcgaccucagguuucacgcucugcgggccggugcucacgugcgaauccuggaugagcagaccguggcccgcgucgaacaugggagagacgagagggcauugguuuucacuucgcggccagugcgcguagccgaaacaauuuucgugaaggucaccagaucuggaggcgcuaggcccggcgcgcuauccuuuggggugacgacuugugauccuggaacccugcguccagcagaccucccguucucacccgaggcccugguugaucggaaagaguuuugggcugugugccgagucccugguccacuucacaguggcgacauccugggguuggugguaaacgccgauggagaacuccaucugagccacaauggcgcagccgcugguaugcaguuauguguugacgccucccaaccccuguggaugcuauucgggcuccauggcacaauaacucagauuagaauccugggaucuaccauucuugcagagaggggcaucccuagcuugccaugcucacccgcgaguacaccgaccuccccuagcgcucuggggucucgccucucagauccacugcuuaguacgugcagcuccggaccccuggguucuucggccggcgggacugcaccuaacagccccguguccuugccagaaucaccugucacacccggacucggccaguggagugacgaguguaccaucugcuaugaacacgccguggacacugucauuuacacauguggucacaugugccuguguuaugcuugcggguuacggcugaagaaagcccuacaugcauguugcccaauauguagaaggccgaucaaggauauuaucaaaaccuaccgcucuagcuga

SEQ ID NO: 59646 - RNA, 858 nt, Artificial Sequence
  derived and/or modified sequence opt3 from NEURL2__Homo_sapiens__NP_542787
auggccgcugcaagcgagcccguggacuccggcgcccugugggggcucgaaagaccugagccaccgcccaccagguuccaccggguccauggagcgaacauccgcguugauccuucugguacacgagcuacucguguggaaucauuugcccacggcguaugcuucaguagagagccacuugcacccggacagguguuucuggucgaaauugaggagaaggaauuggggugguguggccauuuaaggcugggucuaacggcccucgacccugcuagccuggcaccagugcccgaguucucccuuccugaucugguuaauuuggggcacaccuggguguuugccauaacacggcaucacaaccgcgucccaagagaaggaaggccggaggcugaggccgcggcacccucucggccuccaacucuccugguggaacccuaccugcgcaucgagcaauuccgaaucccuagagacaggcucguaggccggucgcguccaggcuuauauucacacuuacuugaucaguuguacgaacugaauguucuacccccgaccgcccgcagaagcaggcucggggugcuguuuugcccucggcccgacggaacagcugauaugcauauuauuaucaacggugaggacaugggcccaagugcccgagggcuuccugcagcucagccccuguaugccgucguggauguguucgcguccaccaaaucuguccgcuugguucagcucgaauacggacugccaagccugcaaacucuguguagacucgugauacagagguccaugguacaccggcuugccaucgacggccugcauuugcccaaggagcuaaaagauuuuugcaaguaugaguga

SEQ ID NO: 59647 - RNA, 1071 nt, Artificial Sequence
  derived and/or modified sequence opt3 from NEUROD1__Homo_sapiens__NP_002491
augaccaagagcuacuccgagucuggccugaugggggaaccccagccucaaggaccaccgucauggacagacgagugccucaguagccaggaugaggaacacgaagccgacaaaaaggaggaugaccuugaggcuaugaacgcagaagaggauucccugagaaaugguggcgaagaggaggacgaagaugaggacuuggaagaggaagaggaggaagaggaagaggaugacgaucagaaacccaagaggcgggggccuaaaaagaagaaaaugacuaaggcccgcuuagaacgauucaaacugcguagaaugaaggcgaacgcuagggagcggaaucgcaugcauggacuaaacgccgcacucgacaaucugagaaaaguggucccauguuauucuaagacgcagaaacuuucgaagaucgagacccugagguuggccaagaacuacauuugggcucucucagaaauacugcggagcggcaaaagucccgaucugguuuccuuugugcaaacacucugcaaggguuuaucucagccuacuaccaaucugguagcagggugucuucaguugaacccacgcacauuccugcccgagcagaaucaagacaugccuccacaccuaccgaccgccagcgcuuccuuucccgugcauccuuauucauaccagaguccaggacuccccagcccuccauauggcacuauggacucuucccacgucuuccaugugaaacccccgccucacgccuacucagcggcacuggaacccuuuuucgagagcccacuuacagauugcaccaguccuucuuuugacggcccccuguccccacccuugagcaucaacgggaauuucucguuuaagcacgaaccuucugccgaguucgagaaaaacuaugcuuuuacgaugcauuacccagccgcaacucucgcuggagcccagucccacgguucaauuuucaguggcaccgcggccccgcgaugugaaauccccauugauaauaucaugagcuuugacucccauucucaccacgagagaguuaugagcgcacagcugaacgcuauauuccaugauuga

SEQ ID NO: 59648 - RNA, 1173 nt, Artificial Sequence
  derived and/or modified sequence opt3 from NEUROD2__Homo_sapiens__XP_005257466
augaugcccccuagccugggcaccaugcucacaagacuuuucuccgagccagggcuguugucugacgugccgaaguuugccucauggggagauggugaagacgaugagcccaggagugacaaaggcgaugcuccuccacccccuccacccgcaccugggccaggagccccgggccccgcgcgggcugccaagccugucccauuacgcggugaagaggggacugaagcaacgcuggccgagguuaaagaggaaggagagcuaggcggcgaagaggaggaagaggaagaggaagaggaggggcucgacgaagcugagggagaacgacccaagaaacgugguccuaagaagagaaaaaugaccaaggcaaggcuggagcggagcaaacuucgcagacagaaggccaacgcuagggaacggaaucgcaugcacgaucugaacgccgcguuggacaaucuccgaaaagugguaccaugcuacuccaagacacaaaagcugucuaaaaucgagacucugagacucgcaaagaacuauauuugggccuuaucggagauacugaggucaggcaaacggcccgaucuugugagcuacguccagaccuuguguaaggggcugagucagccgacaaccaaucuaguggcuggaugccuccagcugaacucccguaauuuccuuacugaacaaggcgccgacggugcagggcgcuuucauggaucuggcggcccuuucgcuaugcaccccuauccauacccuuguagcagacuggccggggcgcagugccaggccgcaggagguuugggcgggggagcugcccaugcucucaggacacacggcuauugugccgcauacgagacccuguaugccgcugcgggugggggcggagcaucccccgauuacaacucaagugaauacgagggcccauuaucucccccucugugccucaaugggaacuuuagccuuaaacaggacuccucaccagaucaugaaaagagcuaucacuacaguaugcacuauucugcccugccgggaucccggcccacgggucauggcuugguuuucgggagcucggcugugcgaggaggcguccacucugagaaucuacuguccuacgacaugcaucuccaccacgaccgcgguccuauguaugaggaacugaacgccuuuuuccauaauuga

SEQ ID NO: 59649 - RNA, 996 nt, Artificial Sequence
  derived and/or modified sequence opt3 from NEUROD4__Homo_sapiens__NP_067014
augagcaagaccuucgugaaauccaaggagaugggcgaacuggucaacacacccucuuggauggacaaagggcucggaucacagaaugagguuaaggaagaggaaaguagaccugguacuuacggcaugcuuagcucccugacggaggagcacgauucuaucgaagaggaagaggaggaagaggaagacggggagaaaccaaagaggcggggaccgaagaaaaagaaaaugaccaaggcccgcuuggaacgauuucgugcuagaagggugaaagcaaacgcccgggagcgcacaagaaugcauggcuuaaaugaugcgcuggacaaccuaaggcggguaaugcccugcuauucgaagacucaaaagcucucaaaaauugagacccugcgccuugcucgaaauuacauaugggcccugagcgaaguguuggagacaggucagaccccugaagggaagggauucgucgagaugcucuguaaaggccugagucagccaacuuccaaccugguggcaggcugccuccaguuagggccccaaucuguucugcuugaaaagcacgaggauaaaagcccuaucugugacuccgccauuucagugcauaauuuuaacuaucagaguccaggauugcccagcccuccauacggucacauggagacacaucugcuacaccucaagccgcaggucuucaaaucucugggcgaauccucauuugggagccaccuucccgauugcaguaccccuccauaugagggaccccugacgccuccauugucuaucuccggcaauuucagccucaagcaggacgguucgcccgaucuggaaaagucuuacuccuuuaugccgcauuauccuucaaguagcuuauccucugggcacgugcauagcacucccuuccaagcuggaaccccaagauacgacguaccuauugauaugucauacgacaguuauccccaccacggcaucggcacacagcugaacacuguuuuuaccgaguga

SEQ ID NO: 59650 - RNA, 1014 nt, Artificial Sequence
  derived and/or modified sequence opt3 from NEUROD6__Homo_sapiens__NP_073565
augcugacccuccccuucgacgagagcguggucaugccugaaucccagaugugcagaaaguuuucuagggagugugaagaucaaaaacagaucaagaaaccagagucauucaguaagcagauuguucuucggggcaaaagcauaaagcgcgccccgggggaagagacagagaaggaagaggaagaggaggaccgagaagaggaagaugagaacggacugccccguagaagggguuugcggaaaaagaaaacuacgaaguuacgccuggaaagagugaaauuuaggcggcaggaggcuaaugcacgcgagcgaaacagaaugcacggccuaaaugacgcccucgauaaccugaggaagguagugccuugcuacuccaagacccaaaaacuuucuaagaucgaaacacugcgguuggcgaaaaauuauauuugggcucucucggagauccugcguauugggaagcgcccagaccugcucacuuucguccagaacuuauguaaaggacugucacagcccaccacaaaucuuguggccggcugcuugcagcugaacgcacgcagcuuucuaaugggucaagggggagaagccgcucaucacaccaggaguccuuacuccacuuucuauccacccuaccauucuccugagcucacaaccccaccgggccacggcacgcuggauaauagcaaguccaugaaacccuauaacuacuguucagcauaugaaaguuuuuacgagagcacuucuccugagugcgccuccccacaguucgaagggccccuuucaccuccacccaucaauuacaacggaauauuuagccugaagcaggaggaaaccuuggacuaugguaagaauuacaacuauggcaugcauuacugugcuguuccgccucgggggccccucggacagggcgccauguuccgacugccaacagauagucacuuuccuuaugacuuacaccugagaucucaaucccucacuaugcaggaugagcuuaaugcgguguuccauaacuga

SEQ ID NO: 59651 - RNA, 714 nt, Artificial Sequence
  derived and/or modified sequence opt3 from NEUROG1__Homo_sapiens__NP_006152
augcccgccagacuggagaccugcaucagcgaccucgauugugcuuccucuucaggcagugaccuuagcggguuccugacagaugaagaggacugcgcaagguugcagcaagccgcguccgcuucuggaccuccagccccggcacggcgcggugcccccaacauuucgcgagcuucagaagugccuggcgcacaggaugacgagcaggaacguagaaggcggcgcgggagaacuaggguccggagcgaggccuuacugcacagucuacgccgauccagaaggguuaaggcuaaugaucgggagcguaaccgcaugcauaaucucaacgccgcgcuggacgcacuuagaucugugcugcccagcuuuccagaugacacgaaauugaccaagauagaaacacucagguucgccuacaauuauaucugggcucuggccgagacucugcggcucgcagaucagggauuaccuggcgguggggcucgagaacgccugcuuccaccccaauguguaccuugcuugccaggaccgcccuccccugccucagacgcggagaguuggggcagcggcgccgcagcugccucuccacuguccgaucccucaagcccugcugccagugaggacuuuaccuacagaccaggggaccccguguucucuuuuccgucccuaccuaaagaucuccugcacacaacccccuguuucauuccauaucauuga

SEQ ID NO: 59652 - RNA, 819 nt, Artificial Sequence
  derived and/or modified sequence opt3 from NEUROG2__Homo_sapiens__NP_076924
auguucgucaagagcgagacccuggaacucaaagaggaagaggacgugcuuguucuguugggcuccgccucucccgcuuuagcagcccugacaccucuaucaaguagcgcggaugaagaggaggaagaggaaccaggggcuuccggaggugccagaaggcagcggggcgcagaggccgggcaaggagcucgcggcgguguggcagccggggcugagggaugccgaccggcccgucuccugggccuuguacacgacuguaagagaaggcccucucgggcgcgcgcagugucgagaggcgccaaaacugcugaaacgguccagaggaucaagaaaacccggcgccugaaggccaacaaucgagagagaaacaggaugcauaauuugaacgcagcucucgaugcccugcgggaagugcugccuacauuuccagaggacgcgaagcucacuaaaauugaaaccuuacguuucgcccacaauuacauaugggcacugacagagacccuucgcuuggcugaucauugcgggggagguggcgggggacugcccggcgcccuauuuucagaggcuguucuccugagcccugguggggccagugcagcccuuuccucuagcggagacuccccaucacccgcuaguacuuggagcuguacaaacucuccugcgccauccucaagcgugaguucuaauuccaccagcccguauucgugcacgcugucucccgcauccccugccggcucagauauggacuacuggcagccacccccuccagauaagcacagauaugcuccccauuugccgaucgccagggacuguauuuga

SEQ ID NO: 59653 - RNA, 645 nt, Artificial Sequence
  derived and/or modified sequence opt3 from NEUROG3__Homo_sapiens__NP_066279
augacaccccagccuagcggcgccccaaccgugcaagucacuagagagacggaaagguccuucccgcgggcuucugaggacgaaguuaccugccccacaucagcaccuccaagucccacucgcacccgagggaacugugccgaggcggaagagggagguugccguggcgcuccuagaaagcugagggcccggcgcgggggaagaagcaggccaaaauccgagcucgcacuuucuaagcagcggcgcucgcgaaggaaaaaggccaaugauagagaacggaaccguaugcacaaucugaacucagcuuuggacgcauuacgcggcgugcugcccacauuuccugaugacgccaaacuaaccaagaucgagacucucagauucgcucauaauuacauuugggcccugacacagacccuuaggauagcggaucacagccuguaugcauuggaaccaccggcuccccauuguggugagcucgggaguccuggaggcuccccaggcgacugggggucucuguacagccccguaucccaggccggaucacugaguccugccgcaagccucgaggaacggccagguuuacugggcgcuacguuuucugccugccuuucccccgggucauuggcguucagcgauuuucuguga

SEQ ID NO: 59654 - RNA, 8457 nt, Artificial Sequence
  derived and/or modified sequence opt3 from NF1__Homo_sapiens__NP_000258
auggccgcucacagacccguggaauggguccaggcuguugugagcagauucgacgaacagcugccuaucaagacaggccagcagaacacacacacuaagguguccacggagcacaauaaggaaugccucauuaacauaucuaaauacaaguuuucacuugugaucagcgggcugaccacaauuuugaaaaaugucaacaauaugcggaucuucggcgaggccgcggaaaagaacuuauaucugagccagcuaauuauccucgauacucuggagaagugucuugcuggucaaccaaaagacaccaugcgccuggaugagacaauguuggugaagcagcuccugccggaaauaugccauuuucugcacaccugucgagagggcaaucagcaugccgcagaacuccguaacuccgccucugggguuuuauucucgcugucaugcaauaacuuuaaugcuguguucagcagaaucaguacuaggcuucaggaguugacagucuguuccgaggacaacguggauguacacgacauugaacugcuacaauacaucaauguugauugcgcaaaacucaagcggcugcuuaaagagaccgccuuuaaguucaaggcucugaaaaagguggcccaguuggcggucauuaacucucucgaaaaagcauuuuggaauuggguggagaacuaucccgacgaguucacgaagcuguaccagaucccucagacugauauggccgagugugcugagaaauuauuugaccugguggauggauucgccgaaagcaccaagcgcaaagcagcugucuggccacuccaaauaauucuucugaucuugugccccgagauuauccaggacaucuccaaggauguuguggacgaaaacaauaugaacaagaaacuauuucuggacucacucagaaaggcccuggcgggccacggugggaguaggcagcuuacagagagcgccgcaauugcuuguguaaaacugugcaaggccucuacuuauauaaauugggaagauaacuccgugaucuucuugcucguccaaucaauggugguugaccugaaaaauuuacuguucaacccuagcaagccauuuagucggggaucucagcccgcugauguggaccuaaugauugauugucucgucuccugcuuccgcaucagcccucauaauaaccagcacuuuaagauaugccuggcccaaaauucgccaucuaccuuccauuacgugcuuguaaacuccuugcaccgaauuaucacaaauucagcacuggacugguggccgaaaaucgaugccguuuauugucacaguguggagcucagaaacauguuuggcgagacccugcauaaggcuguccaaggcugcggggcgcaccccgcaauuaggauggccccuagccuuacguucaaagaaaaggugacuucccugaaauuuaaggagaagccaacagacuuggaaacccggucuuacaaauaccuccuguuaagcauggucaagcugauccaugcugaucccaaacuacuccuguguaauccucguaagcagggaccagagacucaggguucaacagccgaacuuauuaccggcuuggugcagcugguuccccaaagucacaugccggagauagcacaggaggccauggaagcucuccugguguuacaucagcuggacuccaucgaucuuuggaacccugacgcccccguagagacguucugggaaauuagcucucagauguuguuuuauaucugcaaaaagcucaccucacaccaaaugcugaguagcacagagauccuaaaguggcugcgcgagauucucauauguagaaauaaauuccugcuuaagaacaaacaggcagacagguccucuugccacuuuuugcuguucuacggggucggaugugauaucccaucgagcggcaacacuucccagaugucaauggaccaugaagaguuacuccggaccccuggugcgagucugcgaaaggggaaaggaaauucuagcauggauuccgcugccggcugcucaggcacacccccaauuugucgccaggcacaaacuaaacuugaaguggcccuguauauguuuuuguggaaccccgacaccgaggcuguucucguggccaugagcugcuucagacaccugugugaagaggcagauaucaggugcggggucgacgaggugucuguacauaaucuacugccuaacuacaauacauucauggaauuugcuuccgugaguaacaugaugagcaccggacgggccgcgcuccagaagcgcguuauggcccugcuuagaaggauugagcacccaacugcugguaauacggaagcaugggaggauacacacgccaagugggaacaggcuaccaaguugauccugaacuauccgaaagccaagauggaggacggccaagcagcggagucuuuacauaaaacuauagucaagcgucggaugucccacgugucagggggaggcaguaucgaucucagcgacaccgauucgcugcaggaauggauuaauaugacagguuuccuuugcgcccuagggggcgugugucuacagcagcgauccaacucuggacucgcuaccuacagucccccuaugggcccagucucagagagaaaagggaguaugaucuccguuaugucuagcgaaggaaaugccgacacucccguguccaaguuuauggauaggcuguugucacugauggugugcaaccaugagaagguagguuuacaaauucgcacaaaugucaaagaccucgugggccuggaacuuagcccugcacuguauccaauguuguucaacaagcucaaaaauacgaucaguaaguuuuucgacucucaggggcagguucugcuaaccgauacuaacacacaguuuguggagcaaaccauagcuauuaugaaaaaccugcuugacaaucacacagagggauccagcgaacaucucggccaggccucgaucgagacuaugaugcugaacuugguccgguacgugagaguucuggguaauauggugcacgcaauucagaucaagaccaaguuaugucagcucguagaagucaugauggccaggcgcgaugaccugucauucugccaagagaugaaauuucgaaacaagaugguggaguaccuuacggauugggugauggggaccucuaaucaggcugcggacgaugacgucaaaugucugacacgggauuuggaccaggccaguauggaagcaguugugucccuccuggcuggccuaccccugcaaccggaggaaggagauggcguagagcuuauggaagccaagagccaacucuuccugaaauauuuuacuuuguucaugaacuuacugaaugacugcucugagguggaggaugaaagcgcccagaccgggggacguaagagagguauguccaggcgccucgcuucacugcggcacuguacaguccuugcaaugaguaaccuguugaaugccaacguggacagcggccuaaugcauucuauagggcugggauaccacaaggaccuccagacuagagcgaccuuuauggagguucugacgaaaauccuucaacagggcacagaguucgauaccuuagcugaaacugugcuggccgacagguucgaacgacucgucgaguuggugacaaugaugggugaucagggggagcugccuauugcaauggcccucgcuaauguugugccaugcucccagugggacgaacuggcacgcguccuuguaacccuguuugauucacggcauuugcuauaucaacugcucuggaacauguucaguaaggagguggaauuagccgacagcaugcagacucuguuuagaggcaauucccuugcgucuaaaaucaugaccuucuguuuuaagguuuacggagcuacauaucugcagaaacucuuggauccccugcucaggauugugaucacgucgagcgacuggcagcacgucucauucgagguggauccuacccgucuggaacccuccgagagucuugaggaaaaccaacgcaaucuacugcagaugacugagaaguuuuuccaugccauaauuucuagcuccucagaauuuccaccucaguugcggucuguaugccacuguuuauaccagguggucagccaaagauucccccagaacaguaucggcgcaguuggguccgccauguuucugagguucaucaacccagcuauugugagcccguaugaggccggaauccucgacaaaaagccucccccacgaauugagcggggccugaaacuuaugucuaaaauacugcagucaaucgcaaaucacguacucuucacaaaggaagaacacaugcgccccuuuaacgauuucgucaaauccaauuuugacgcugccagaagguucuuuuuggacauugcgagugauugcccuaccagcgacgccgugaaccacucgcugucuuucaucuccgaugguaauguucuagcacugcaucggcuccuuuggaacaaucaagaaaagauugggcaguaccugagcucaaaccgagaccacaaagcuguaggaagacgcccauuugauaagauggccacauuauuggcuuaccugggacccccugagcacaagccgguggcagacacucauuggaguucucucaaucugaccuccagcaaauucgaagaguuuaugacgaggcaccagguccaugagaaggaagaguucaaagcccuuaagacacugucaaucuuuuaucaggccgguaccaguaaagcuggcaacccaauauucuacuauguggcgcgucgguuuaagacugggcaaaucaauggagaucucuugauuuaccacguucuguuaacccuaaagcccuauuacgcaaaaccuuaugaaaucguggucgaccugacacauacuggcccaagcaacagauucaagaccgauuuccucuccaaaugguuugugguauuccccggguuugccuacgacaaugucucugcuguguacauuuauaacugcaauagcuggguuagggaguacacaaaguaucacgaacgccuucugacgggauugaaaggcuccaagcgacugguguucaucgauuguccugguaagcucgccgagcacauagagcaugaacagcagaaacugccggcagccacccuugcucucgaggaagaccugaaggucuuucacaacgcguugaaacuggcccauaaggauacuaaagugucaauuaagguugggucuacagcagugcaggucaccagugcugagagaacuaagguguuaggacaaucgguauuccuaaaugacaucuacuaugccagcgaaaucgaggagauuugccugguggacgaaaaccaguuuacacucaccauagcaaaccagggcacgccccuuacuuucaugcaccaggagugugaagccaucguucaauccauuauccacauucggaccaggugggagcugucucagccagauucaaucccucagcauacaaaaauacgccccaaggacgucccagguaccuugcugaauaucgcucuccugaaccuuggcagcuccgauccuaguuuacguucugccgcguacaaucugcucugcgcauugacuuguacauuuaaccugaaaauugaggggcaacuacuggaaaccagcggacucugcauccccgccaauaacacacuuuucauugugucaaucuccaagacucuggcugccaaugagccacacuugacccuggaauuucucgaggaauguauaaguggcuucagcaaaucuuccauugagcugaagcauuuaugccuugaguauaugacgccguggcugucaaaccucgugagauuuuguaaacacaaugacgaugcuaagcggcagagggucacagcaauccuagacaagcugaucaccaugacuauuaacgaaaaacagauguacccuagcauccaggccaagauaugggggucguugggacaaauuaccgaucugcucgacguagugcuugauucuuucaucaaaacaagugcuacuggcggucugggguccauuaaggccgagguuauggcagacaccgcgguggccuuggcuagcggaaaugucaaacuggugucauccaagguuaucggccgcaugugcaagauaauugauaaaacgugucucucucccacaccaaccuuagaacagcaucugaugugggacgauaucgccauccuugcacgauacaugcugaugcugagcuucaacaauagucucgacguggcugcccaucugcccuauuuguuucacgucgugacuuuccugguagcaacagguccucucucccuuagagccagcacccauggccuggugauuaacaucauucacucuuuaugcacuugcucacagcugcauuuuagugaggaaacaaagcagguuuugcggcucucccugaccgaguucagccuaccaaaauuuuaccuucuguucgggauaucuaaggucaaaucggcugcggugaucgccuuuaggucaagcuaucgcgacagauccuucagucccggaucuuacgagagggaaacguuugcacucacuagccuggagaccgugacagaggcuuugcuggagauuauggaagccuguaugcgggauaucccuaccugcaaguggcucgaccaauggacagagcuugcccagcguuucgcauuucaguauaauccgucccugcagccacgcgcuuuagucguuuucggcuguaucucaaagcgagugagucacgggcaaauuaaacagauaaucaggauucugucuaaggccuuggagagcugccucaaaggacccgauacuuacaacucccagguacugaucgaagcgaccgugauugcucuaacgaaacuucagccucugcucaacaaagacucaccccugcacaaggccuuguuuugggucgcaguggccguuuuacaacuggaugaggugaaucucuauagcgcuggcacagcacuucuggaacagaaccuacauacucuggacucucucaggaucuucaaugauaaguccccagaggaggucuucauggccauacggaacccuuuggaauggcacuguaaacagauggaccauuuuguaggucugaauuucaacaguaauuuuaacuucgcgcuuguggggcaucugcucaagggauaccgccaucccagcccagcuaucguugccagaaccgugaggauuuuacacacacuguugacccuggucaauaaacaccggaacugcgauaaguuugaggugaauacucaaucggucgcauaccucgccgcacuucugaccguguccgaagagguucgaucuagauguucacuaaaacaucgcaagagccugcucuugacagacaucaguauggaaaacgugccuauggauacguauccgauucaccauggcgaccccuccuacaggacucugaaagagacccagccauggucuagcccuaagggcucagagggguaucuugccgcaacauaccccaccguaggacagacuuccccacgggcucguaagaguaugagccuggacaugggucagccuucucaagccaauaccaagaaguuacucggcaccagaaaaucauucgaucaccugaucuccgacacgaaggcgcccaaaaggcaggaaauggagagcgggauaacuacaccgccaaagaugcgccggguggccgaaaccgauuaugagauggaaacccagcgaauuucuaguucgcagcaacauccucacuugagaaaggucuccguuagcgagucaaacgugcugcucgacgaggaaguccuuacugaucccaaaauccaggcacugcuacugacagugcucgcuaccuugguaaaguacacaacugacgaguuugaucagaggauucuguaugaauacuuagccgaggcaucugugguuuucccaaaaguguuucccgucgugcacaaucuucuggacagcaagaucaacacgcuccuguccuugugccaggauccuaaccugcucaauccgauacauggaaucguccaaagugugguuuaccacgaagagucacccccacaguaucagaccucuuaccuucagagcuucggcuuuaacggucuguggcgcuucgcugggccuuuuuccaaacagacacagauucccgacuaugccgagcuaaucguaaaguuccuggaugccuuaauugacacuuaccucccuggaaucgaugaagagaccagugaagagagccuguugacaccaaccucccccuauccuccagcgcuucagucucaacugucaauaacugcuaaucucaaccugagcaauucgaugacguccuuggcaaccagucagcauucucccggcauugacaaggagaacguggaacugagcccgacaacuggccacuguaauucagggcggaccagacacggauccgccucucagguccagaaacaacguagugcugguagcuucaagaggaacuccaucaaaaagaucguguga

SEQ ID NO: 59655 - RNA, 1788 nt, Artificial Sequence
  derived and/or modified sequence opt3 from NF2__Homo_sapiens__NP_000259
auggccggcgcuaucgcaagcagaauguccuucucuucacugaagaggaaacagcccaagaccuuuacagugcggauugucacuauggacgccgagauggaauuuaacugcgagaugaaauggaaggggaaagaucucuuugaccuuguuugucgcacgcugggauugcgagaaaccugguucuuugguuuacaauacacaauaaaggauacuguggcguggcugaagauggacaaaaagguacuagaucacgacgugaguaaagaggaaccugucaccuuccauuuucucgcuaaguucuauccagagaaugccgaggaagaacuggugcaggaaaucacacagcaccuuuucuuccugcagguuaaaaagcaaauuuuggaugagaagaucuacugcccgcccgaggcaagcgugcuccuggccuccuaugcuguccaggcaaaauacggcgacuaugauccuucugugcauaagcguggguuucuggcccaggaggagcucuuaccaaaaagaguaauuaaccuguaccagaugacccccgaaaugugggaggaaaggaucacugcuugguaugccgagcaccggggacgcgcgagagacgaggcagaaauggaguaccuuaagauagcccaagauuuggaaauguacggcguuaauuauuucgcuaucaggaacaaaaaggguacagagcugcuacucgggguggacgcccugggacuucauauuuacgauccugaaaaucggcugaccccaaaaaucucguuucccuggaacgagauucgcaauaucucauauagcgacaaggaguucacgauaaagccuuuggacaaaaagauugaugucuucaaauuuaacaguuccaagcuccgagugaauaaacugaucuuacagcuguguauuggcaaccacgaccucuucaugagaaggcggaaggcagauucucuugaagugcagcagaugaaggcucaagcccgugaggaaaaagcgcgcaagcagauggagagacagaggcuggcccgggaaaaacaaaugcgagaggaggcagaacgcacuagagacgaguuggaaaggcggcuacugcagaugaaggaggaggcuaccauggccaaugaagcucucaugcgcagcgaggaaacagccgaucugcuugcagagaaagcccagaucacugaagaggaggcuaagcuguuggcgcagaaggcagccgaagcugagcaagaaaugcagagaaucaaagccaccgcaauuaggacagaggaagagaagcgucucauggagcagaaaguccuggaagccgagguuuuagcucugaagauggccgaagaguccgaacggcgagcaaaagaggcggaccagcuaaagcaagaucuccaggaggcuagagaagccgagaggcgcgcaaagcagaaacugcuugaaauagccaccaagccaacguacccgcccaugaacccuaucccagcucccuugccuccagacauucccucauuuaaucugaucggcgauagucucagcuucgacuuuaaagauacugacaugaagcggcugucuauggagauagagaaagaaaagguggaguauauggaaaaauccaagcaccuucaggagcaacugaacgaauugaagacagagauugaggcccucaaacugaaggaaagagagaccgcauuagacauccugcauaaugaaaacucagaucgcgggggaagcaguaaacacaacacuaucaagaaacuaacacuccagucugcuaaguccaggguagccuucuuugaggaacuguga

SEQ ID NO: 59656 - RNA, 813 nt, Artificial Sequence
  derived and/or modified sequence opt3 from NFAM1__Homo_sapiens__NP_666017
auggagaaccagcccgugagauggagggcccugccuggccucccacggccgcccgggcuuccugcugcaccauggcuguuguuaggaguccugcuacuccccgguacccugcgccuugccggcgggcaaagcguuacacacacuggacugccuaucauggcguccuuggcuaauacggccauuucuuucucaugccgaauaaccuacccauauacaccccaguuuaagguguucacuguaaguuacuuucaugaagaccuccagggccagcguagcccuaaaaagccaaccaacugucacccgggucuggggacagagaaucaaucccauacccuggauugccaggugacucucgucuuacccggagcaucugccacaggcaccuauuacuguucggugcacuggccucauucaacgguuagaggcagcgggacuuucauccuggugagggacgcuggauaucgggaaccaccccagaguccucagaaacuuuugcuguuugguuucaccggccuacucuccguccugucugugguagggacagcacuucuguuguggaacaagaaacgcaugagaggaccaggcaaggaucccacuaggaagugcccggacccucggagcgccuccucacccaaacaacacccaagugagagcguuuacaccgcucuccagcgccgagaaacagagguguaugccuguauugagaaugaagaugguucuuccccuaccgcgaagcagucaccccugagccaggagagaccacacagguuugaagacgauggggaguuaaaccuggucuacgagaaucucuga

SEQ ID NO: 59657 - RNA, 3723 nt, Artificial Sequence
  derived and/or modified sequence opt3 from NFASC__Homo_sapiens__NP_001005388
auggccagacagcccccuccaccgugggugcacgcugcauuccugcucugccuucugagcuugggcggggccaucgagauucccauggacccuuccauacaaaacgaauuaacccagccacccacaaucacuaagcagucugcgaaagaucauauugucgacccuagggauaauauccugauugagugugaagcuaagggaaacccagcccccucauuucacuggacgcggaauagucgcuucuuuaacaucgcaaaagacccucgaguuagcaugcguagaagguccgguacccuagugauagauuuccggucuggcgggcgcccagaggaauacgagggagaguaucagugcuuugccagaaauaaguucggcacagcucucucgaacaggauccggcugcaaguaucaaaaagcccgcuuuggcccaaggaaaaucuggacccuguggucgugcaggagggugcaccauugacucuccaguguaacccaccuccagggcugcccaguccgguuaucuuuuggauguccucuagcauggaaccuauuacccaggauaagcgcgugucccaaggacauaauggcgaccuguacuucucaaacgucaugcuccaggauaugcagacagacuauaguugcaaugcccgauuucacuucacccauacuauucagcagaaaaaccccuuuacauuaaaggugcugaccacgagaggcguagcugagaggacucccagcuucauguacccucaagggaccgccucuucccagaugguucuucggggaauggauuugcugcuagaguguaucgcgucaggugugcccacaccagacauagcaugguauaaaaagggcggggaucuccccagcgacaaagccaaguuugaaaauuucaacaaggcucugcguauuacuaaugucagugaggaagacucuggagaguacuucugccuugccuccaacaaaaugggcagcauccgccacaccauuucggugagagugaaggcagcuccuuauuggcuggaugaacccaaaaacuugauccucgccccgggugaggacgggaggcuggucugucgggcgaauggaaaccccaagccuacaguucaauggauggugaauggcgagccauuacagucugccccaccuaacccaaaucgagaaguagcaggcgauaccaucauuuuucgcgacacgcagauauccucaagagcuguguaccagugcaacacaaguaaugagcacggguaccugcucgccaacgcuuucgucagcgugcuugauguucccccgaggaugcuguccccucggaaucaauugauccgcgugauucuauauaacagaacaaggcuggacuguccauuuuucggaucucccaucccuacccuccguugguuuaaaaauggucagggcagcaaccuggaugggggaaauuaccaugucuaugaaaacggcucacuugagauaaagaugauucggaaagaagaccaggguaucuacacuugcguggccacaaauauccuggggaaggcagagaaccagguacgauuggagguuaaggaucccaccagaauuuauaggaugccagaagaccaaguggcccgccggggcacgaccguccagcucgaguguagagugaaacacgauccuagucugaaguuaacagucuccuggcugaaagacgacgaaccccuauacaucggaaacaggaugaagaaagaggaugacagccucacuauuuucggcguggcugaacgcgaucaggggucuuauaccugcguugcgucaacagagcuggaccaggaucuugcaaaggccuacuugacugugcuggcugaccaagccaccccaacaaaucgacucgcagcccugccgaagggacggccugaucgucccagagaccuugagcugaccgauuuggcugaaaggaguguacgccucacuuggauaccaggugacgccaacaauagccccaucacggauuacgucgugcaguuugaggaagaccaguuccagccuggcguuuggcaugaucacuccaaauauccagggucugugaacucggcaguccugcgguuaagccccuacgugaauuaucaauuuagaguaauugcgaucaacgaggugggauccucacacccuagucugccgucugagagguaccgaacaagcggcgcuccacccgaauccaauccuggugacguuaagggggagggcacccgcaaaaacaauauggaaaucacuuggaccccaaugaacgccacaucagcauucggacccaaucuacgguauauugucaaguggagaaggcgugagacccgcgaagccuggaacaaugugacuguguggggcagccgguacgucguugggcagacaccuguguaugugccguacgagauaagaguacaggcugagaacgacuuuggaaaaggucccgaaccagagucugucaucggcuacuccggggaagaucucccuagugcccccaggcgauuccgggugcgccaaccaaaucuggagacgauuaaccuugaaugggaccauccugagcaccccaacggaaucaugauuggcuauaccuugaaguacguugcauuuaaugguacuaagguggggaaacagaucgucgagaacuucagcccaaaucagacaaaguucaccgugcagagaacagauccgguuucuagguaucgguuuacucuguccgcucgaacccaagugggcucaggagaagccguaacggaggaaaguccugcgcccccaaacgaggccacccccacagcugcaccuccaacucugcccccuaccacagucggcgccacuggggcugugagcucgaccgacgccacggcaauagcggccacaaccgaagcuacuacagugccgaucauuccaaccgucgcccccacuaccaucgcaacaacgaccacuguugcuacaaccacaacuaccacggccgcagccacaaccacuaccgaguccccucccacaacuaccucuggaacaaaaauucaugagagcgcuccagaugaacagucaaucuggaaugugacgguacucccuaacaguaagugggcgaauauaaccuggaaacacaacuucggccccgguacugacuuuguggucgaguacauugauuccaaucauacaaagaagaccgugccaguuaaagcccaggcacagccuauccaauuaacugaccuguauccggggaugacauacacccuuagaguguauucucgcgauaacgaaggaauuagcuccacggucaucacuuucaugaccucaacagcuuacaccaauaaccaggccgacauagccacucagggcugguuuaucgguuugaugugcgcuauugcacuccuggugcuaauccugcucauuguuuguuucaucaagaggagccguggcgggaaauaccccgugcgggagaagaaagaugucccacugggaccugaggaccccaaggaagaggauggcaguuuugacuauucugacgaagauaauaaaccacuucaggggucccaaacuagcuuggacggaaccauaaagcagcaggagucggaugacucacugguagauuacggcgaagguggggagggacaauucaacgaggacggcucuuuuauuggucaguauacagugaagaaagauaaggaagagacugaaggcaaugagaguuccgaagccaccagcccuguuaacgcgaucuacucuuuagcuuga

SEQ ID NO: 59658 - RNA, 4647 nt, Artificial Sequence
  derived and/or modified sequence opt3 from NFAT5__Homo_sapiens__NP_001106649
augcccagcgacuucaucucccugcucucugccgaucuugaccuggagucaccuaagaguuuguacagcagagauuccuuaaaacugcacccaucucagaacuuucauagggcuggccuacucgaagagucgguguaugaccugcuuccgaaggaacugcaauugcccccuucacgggagaccagcgucgcaaguaugucccagacaucugggggagaagccgguagcccacccccugcgguuguggcugccgaugcauccucagccccaaguagcagcuccaugggcggggcuugcuccagcuucacuacgaguucuucccccaccauuuacagcacaucgguaacugacucuaaagcaaugcaaguggaguccuguucaagugccgucggagugagcaaucgcggcguuuccgagaagcagcucaccucuaacacagugcagcagcacccuagcaccccaaaacgacauacuguccuguauauaucaccgcccccugaagaucugcucgacaauagucguauguccugccaggaugaggguuguggguuagaaagcgagcagucuugcucaauguggauggaggacaguccaagcaacuuuuccaauaugucuacaucgagcuacaacgauaauaccgaagugcccagaaaguccaggaagcggaacccuaaacaacgcccaggaguaaagagaagggacugugaggaaucaaauauggauaucuucgacgcugacagugccaaagcgccccacuauguucugucucagcuuacgacugauaacaagggcaauagcaaagcaggcaacgggaccuuggagaaucagaagggaacaggugugaagaaauccccgaugcugugcggccaguacccugucaagucagaagggaaagagcuaaagauuguggugcaacccgagacucagcaucgggcccgcuaucucaccgaaggaagccgaggcucugucaaagacagaacacagcaagguuuuccaaccguuaagcuggaggggcacaacgaaccugugguacuucagguguucgucggaaaugauuccggcagggugaaaccccacggcuuuuaccaggcuugucggguuacggggcguaacacuacaccaugcaaggagguggacaucgaaggaaccacugucauugaggugggucuggaucccaguaacaauaugacauuggccguagacuguguuggcauccucaagcugcgcaacgcagauguggaggcuagaauagggaucgccggaagcaaaaagaaaucuaccagggcgcgguuagucuuccgagugaauauuaugcgcaaggacggcuccacgcugacccuccagacaccuucaaguccaauccuuugcacucaaccggccgguguccccgaaauucugaaaaagagcuugcauucguguuccgugaagggggaggaagagguuuuucuaaucggcaaaaacuuccugaagggaaccaaagugauauuucaggaaaauguaucugaugagaacagcuggaagucagaggcagaaauugacauggaacucuuccaccagaaucaucugaucgucaaagugccuccauaccacgaucagcacauuacacuucccguuagugugggcaucuaugucgugacuaacgcugggagaucccaugacguacaaccuuuuaccuacacaccagaccccgccgcuggagcccugaaugugaacguuaagaaggagaucucuagcccggcaaggccuugcuccuucgaggaggccaugaaagcuaugaagaccacugguugcaauuuggauaaagucaacauuauaccaaaugcgcucaugacgccccugaucccuucaagcaugauuaagagugaagacgugacacccauggaggugaccgcagaaaaacggucuuccacuaucuucaagaccacaaagagcgucggcucgacccagcagacuuuagagaacauaucaaauauugccgggaacggaucuuuuaguuccccaagcucuagccaucugccuuccgaaaacgagaaacagcaacagauccagcccaaggcuuauaauccagagacacuaacgaccauccagacucaagauauuucacagccgggcacauucccugccguuagugcaagcucucagcuccccaacuccgacgcccugcuucaacaggcuacccaguuucagacacgcgaaacucaaucaagagagaucuugcagagugaugguaccguggugaaucugagccagcucacggaagccucccagcaacagcagcagucuccacugcaagagcaggcacagacccuucaacagcagauuucgagcaacauauuccccucaccuaauuccguaagucagcugcaaaacacaauccagcaguugcaggcggggucuuuuacuggcagcaccgcuuccggaucaucuggcagcgucgaccucgugcaacagguucuggaagcccagcagcaauuaaguuccgugcuguucagcgcaccagaugggaaugagaacguccaggagcagcuaucugccgacauuuuucagcaagugucacagauccaguccggaguuagucccgguauguucagcucgacagaaccuacugugcacaccaggccggauaaucuccugccaggccgugcugagucuguacacccccaauccgaaaacacgcuuagcaaucagcagcagcaacagcagcagcaacagcaggucauggagucaagugccgcaauggugauggaaaugcagcaaucuaucugucaggcugccgcgcagauucaauccgaguuguuuccuagcacagccucagcuaacgggaaucugcagcagaguccaguguaccagcaaaccagccauaugauguccgcacucucuacuaacgaggacaugcagaugcagugcgaacuguucagcucacccccugccgucucaggaaaugagacaucuaccacuaccacacagcaaguugcuacgccgggcaccacuauguuucagacaaguucgagcggugauggggaagagaccggcacacaggccaaacagauacaaaacuccguguuccagacuaugguacagaugcagcacucuggagacaaccaaccccaggugaauuuauuuucaagcaccaaguccaugaugaguguccagaacucuggcacgcaacagcaggggaauggacuguuccagcaaggcaacgagaugaugagccuucagucagguaauuucuugcagcaguccagucacagccaagcacagcucuuucauccacagaacccuaucgcggaugcccagaaucugucucaagaaacacaggggucccuauuccacucacccaacccaauugugcauagccagaccucgacuaccucuagugagcaaaugcagccucccauguuucacucccagagcacaaucgcuguucugcagggaucauccgugccacaagaccagcagucuacuaauauuuuccucagccagaguccgaugaacaaucugcaaaccaacacagucgcccaggaagcauuuuucgcugccccuaauuccaucagcccccuucagucuacgucaaacagugagcagcaagcagccuuucagcagcaagcuccaauaucccacauccagacccccauguugagccaggaacaggcgcaaccuccacagcagggccuguuccagccccaaguggccuuagguucucucccuccgaauccaaugccccagucgcagcagggcacuauguuucaaucacagcauagcauuguugcaaugcaguccaacaguccuucucaggagcaacagcagcaacagcagcagcaacagcagcagcaacagcagcagcaacagagcauccuguucuccaaccagaauacaauggcuaccauggccucacccaaacaaccaccucccaacaugauuuuuaauccaaaccagaauccuauggccaaccaggagcagcaaaaucagaguaucuuccaccagcagucuaacauggcuccgaugaaucaagaacagcagcccaugcaguuucaaagccaguccacugugucaagccuucagaacccagggccuacacagucugaguccagucaaacgccccuguuccauagcucgccacagauacaguugguccaaggauccccuucuucacaggaacagcagguaacccucuuccugagccccgcaaguauguccgcccuacaaacuucuauuaaucagcaggacaugcagcaaagcccgcuguauucaccacagaacaauaugccuggcauccagggggcgaccuccaguccccagccacaagcuacacucuuucacaacaccgccggaggcacuaugaaucagcugcagaacagccccgguucuucacaacagacauccgggauguuccuuuuuggcauucagaauaacuguagccaguugcugaccucuggaccugcaacauuaccggaucaacucauggccaucagucagcccggucagccacagaacgagggccaaccucccgugacuacccugcuuucgcagcagaugccugaaaauuccccacuggcuagcucaauaaacacgaaucagaacaucgagaagauugaccuacucguuucucugcaaaaucaggggaacaauuugacaggaucuuucuga

SEQ ID NO: 59659 - RNA, 2832 nt, Artificial Sequence
  derived and/or modified sequence opt3 from NFATC1__Homo_sapiens__NP_001265598
augcccagcaccuccuucccugugccaucuaaguuuccgcugggccccgccgcugcagucuucgggagaggagagacacucgguccugccccaagggcgggcgggacuaugaaaucagcugaagaggaacacuacggauaugccaguagcaacguuucccccgcacuuccucugccaacggcccauucuaccuugcccgcuccuugccacaauuuacagacaucgacuccaggcaucauuccgcccgcagaccauccuucagguuacggggccgcucuggauggaggcccagccggcuauuuucuaagcagugggcacacccggcccgacggagcgccugcacucgaguccccacgcauagaaaucacaucuugucugggucuuuaccauaacaauaaccaauucuuucacgauguggagguagaggacgugcugcccagcuccaagcgaucaccgaguaccgccacuuugagccucccuucucuggaggcuuaucgugaucccuccugccugucaccagccagcagucucucuuccagaagcuguaauucggaagcaucuuccuacgaaucaaacuauaguuacccuuacgcuagcccccagacauccccauggcagucucccugcgucagcccuaaaaccacggacccagaggagggcuucccgaggggguuaggagccuguacucugcuuggcucaccccggcacaguccuuccaccagcccacgcgcgucugugacagaagagucaugguugggugccagaaguagcaggcccgcauccccuugcaauaagcggaaauauucucugaacgggcgccagccacccuacucgccgcaucacagcccuacuccaaguccccauggaucaccucgaguuagugugaccgaugacucuuggcuaggcaauacaacccaauauacgagcuccgcuauugucgccgcuaucaacgcccucacuacagauucaagccuggaccuuggcgauggggugcccguaaagucuagaaagaccacucuggaacagccaccuuccguugcauugaaaguggagcccgucggagaagaccucgguaguccaccgccucccgccgauuuugcuccagaggacuacagcucuuuccagcacauuaggaagggcggguuuugugaccaguaucuggcggugccccaacacccuuaccagugggcaaaaccaaagcccuuauccccuacaucauauaugaguccgacccugccagcccucgauuggcagcuucccagccauucgggaccuuacgagcugcggaucgaagugcagccaaaaucccaccaucgugcucacuacgagacggaaggcucucgcggugccgucaaggcaagcgccgggggccaucccauaguucaauugcacggauaucuagagaaugaaccucugaugcuccagcuguucaucggcaccgcugacgauagacuucugaggccgcacgccuuuuaccaggugcaucggauuacagggaagacuguaucaaccacaagucacgaggcaaucuuguccaacacuaaagugcucgagauuccccuguuaccagaaaauucuaugcgagcggucaucgacugcgcuggaauacugaagcuacgcaacagcgauauugagcucagaaaaggugaaaccgacaucggcaggaagaauacacgggugcgccugguuuucagagugcaugucccucaacccuccgggaggacccuuucacuccagguggccagcaacccaauugaguguagucagcguucugcacaggaacugccucucguagagaaacaauccacugauagcuaucccguugugggaggcaagaaaaugguccugucgggucacaacuuucuucaggacucaaaggugaucuucgucgagaaggccccagaugggcaccaugugugggaaauggaggcuaaaacggaccgggaucugugcaagccuaauucuuugguuguggaaaucccgcccuuccgaaaccagagaauuacaaguccaguacacgucuccuuuuacguguguaauggcaaaaggaagcgcagccaguaucaacgguucaccuaccuccccgccaacguuccuauaaucaaaacugagccaaccgacgacuaugagcccgcaccuacaugcggaccggugucucagggccugagcccauuacccagaccuuacuacucccagcagcuggcuaugcccccagauccuucaaguugccuagucgccggguuucccccauguccucaaaggagcacccucaugccggcggcccccggagugucuccaaagcugcaugaccuuuccccugcugcauauacuaaggguguagccucacccggccacugccauuuggggcugccacagccugcuggagaagcccccgcagugcaggauguuccgcgcccagucgcgacacacccuggcagucccggucagccacccccugcccuccugccgcaacaggugagcgcucccccauccucuucguguccucccggguuagagcacagccugugcccuucauccccaagucccccucuuccacccgccacgcaggaaccgaccuguuugcaaccuugcucuccagcaugucccccugcuacuggccgaccacagcaucuccccagcacagugcggcgugacgaguccccgaccgccggaccuagacugcuacccgaaguccacgaggauggcucaccaaaucuggcaccuauucccguuacagugaaaagggagccagaagaguuggaccagcuguaccuugaugacgugaacgaaaucauacgcaaugauuugucuagcacuuccacccauuccuga

SEQ ID NO: 59660 - RNA, 2706 nt, Artificial Sequence
  derived and/or modified sequence opt3 from NFATC2__Homo_sapiens__NP_001129493
augcagagagaggccgcuuucaggcugggccacugccauccccuccggaucauggggagcguggaccaagaggaaccuaacgcacacaaggucgccuccccaccgucuggacccgcguacccugaugacguucuugauuauggucugaaaccauacucacccuuggcuaguuuaagcggcgaaccuccagggcgcuuuggagagcccgaccgagugggcccucagaaguuccuguccgccgcaaaaccagccggugcuucugggcuaucgccgcguauugaaauaacccccucacaugagcucauccaggcaguaggaccucugagaaugagggaugccggccuucugguggagcagccacccuuggcuggcgucgccgcgagcccucgguuuacacucccagugcccggguucgaaggauaucgcgagccgcugugucugaguccugcauccucugguagcuccgccucauuuauuagugacacuuucagccccuacacgucuccaugcguuuccccuaauaacggcgggcccgaugaccucuguccacaauuucagaauauccccgcucacuauucaccuagaaccagcccaauuaugaguccgaggacaucuuuagccgaagauuccugccugggacggcauagccccgugccucgcccagcaucgcgaucuuccucacccggcgcuaagagaaggcacaguugugccgaggcgcuugucgccuugccuccaggugcaagcccccagcggucccguucuccgagcccucagccaucaagucacguggcuccccaagaccauggguccccugccggauaucccccaguagcuggcagcgccguuaucauggaugcacugaacucucuagccacugacucaccuugcggcauacccccaaaaauguggaagaccaguccggauccuagccccguguccgcugcgccaucuaaggcagggcucccccgccacaucuacccugccgucgaguuccugggaccaugugaacagggugagagaaggaauagugcucccgaaagcauucuucuggugccuccgacauggccaaaacccuuggugccugccaucccaauuugcuccauccccgucaccgcaucacucccuccgcuggaguggcccuuaaguucucagagcggcuccuacgaacugcggauagagguucagccaaagccucaucaccgagcccacuacgagacugaagggucacgcggagcugugaaagcccccacaggcggucauccaguagugcaacuccacggguauauggagaacaagccucuuggccugcagauuuuuaucggaaccgcagacgaaagaauuuugaaaccccaugcguucuaccagguccacaggaucacgggcaagacugugaccacaacuagcuaugagaagaucguugggaauaccaaagugcuagaaauuccacuggagccgaagaacaauaugcgggcuacaauagacugugccggaauccucaaacugcgcaacgcagauauugagcuuagaaagggugaaaccgacaucggcaggaaaaauacgcguguccggcugguguuucgaguacauauaccugagucuuccgggagaauuguuaguuugcaaacugccagcaaccccaucgaaugcucucagagguccgcucacgagcucccaaugguggaacgccaggauacagacucaugucuggucuacggaggccagcaaaugaucuuaaccggucagaauuucacuucggagagcaagguggucuuuacagagaaaaccacggaugggcagcagauuugggaaauggaggccaccguggacaaggauaagucgcaacccaacaugcuguucguugaaaucccugaguaucggaauaaacacauuagaacaccagugaagguaaacuucuacgucauaaacggcaaaaggaagcgcucccagccccagcauuuuacuuaucacccugugccggcaaucaaaaccgagccaacagacgaauacgaucccacucuaauuugcucuccuacccauggaggccucgggagccagcccuacuauccacaacacccuaugguugcugagucacccaguugccugguggccacaauggcgccaugucagcaguuccgaaccggacuuuccucuccugacgcccgguaccagcaacagaauccggcugcagucuuguaucagcguagcaagucccugucacccagccuccuggguuaccaacagccagcccuuauggcugccccucugaguuuggcagaugcgcacagaucugugcucguacaugccggcucccaggggcagagcucggcucuguuacaccccucaccaacuaaccaacaggccucuccugugauccauuauagucccacgaaucagcagcugaggugcggaucccaccaagaauuucagcauaucauguacugugagaacuucgcaccgggcacaacccgcccagguccucccccaguuagccaggggcagcggcuaucucccggcagcuauccuacugucauucaacagcagaaugcuaccucccaaagagccgcaaagaacggaccgcccgugucagaccagaaagaagugcucccagccggcgucacaauaaagcaggagcagaaucuggaccaaaccuaccuugaugacgaguugaucgauacucaccugaguuggauucagaacauccucuga

SEQ ID NO: 59661 - RNA, 3207 nt, Artificial Sequence
  derived and/or modified sequence opt3 from NFATC3__Homo_sapiens__NP_004546
augaccacagccaacugcggcgcucacgacgagcuggauuucaagcucguguuuggggaagacggagcacccgccccuccaccgcccgguagcagaccugcggaucuugagccagacgauugugcuuccaucuacauuuucaaugucgaucccccuccaucuacucugacgacccccuugugcuuaccucaucacggccugccaucacauaguagcguucuauccccgucuuuucagcuccaaucgcacaaaaacuaugaagggacaugugagauacccgaaucaaaguacagcccucugggaggcccaaaacccuucgagugcccuaguauccagauuacuuccaucucuccaaauugucaucaggagcuugacgcccacgaagacgaucugcagauuaacgaccccgagagggaauuuuuggagcggccgagccgcgaucaccucuaucugccucuggagcccuccuaccgagaaucaagucucagcccaucuccugcauccucaaucagcagucguucuugguucuccgacgccagcucgugcgagucuuuaucccauauauaugaugacguggacucagaacugaaugaggcugcagccagauuuacccuugguagucccuugacaagcccagggggaucccccggcggcuguccuggggaagagaccuggcaccaacaguacggacugggucauucucuaagcccaaggcagucaccgugccacaguccccgguccagcguaacugaugagaacuggcucucuccucgcccagcuucaggccccaguagcagaccuacauccccaugugggaagaggcggcacucuucggccgaagugugcuaugcgggaagccugucaccccaucacuccccggucccuaguccaggccauucuccccgcgguagcgugaccgaggacacguggcuuaaugcauccguucacgggggaucaggccugggcccugccguguuccccuuucaguacugugucgaaacugauaucccauugaaaacccgaaagacaagcgaggaccaagcugccauucucccugggaagcuggaauuaugcucugaugaccagggaucccugagucccgcaagagagacuagcaucgaugacggucucggcucucaguacccacuuaaaaaggauuccugcggggaccaguuccugucagugccgaguccuuuuaccuggagcaaacccaagccaggacauacacccauuuucaggaccucguccuugccuccacuagauuggccccugccugcucacuuuggccaaugugagcucaaaaucgaaguacagccgaagacgcaccaucgggcccacuaugagacugaagguucucguggggcgguuaaggccagcacaggcggacauccaguggucaaacugcuuggcuacaacgagaagcccauaaaucugcagauguucauugggaccgcagacgaccgcuauuugagaccucacgcuuucuaccaagugcacaggaucacuggaaaaacaguggccaccgcuucacaggaaauuaucaucgccaguacgaagguccucgagauuccacuguuacccgagaacaauauguccgcaucuauagauugcgccgguauccugaaacuacggaacagcgacauugaacuccgaaagggcgagaccgauaucgggcgcaaaaauacaagaguuaggcugguguuucggguacauauaccucagccguccggaaaggugcuuucauugcagauugcuagcauccccgucgaauguagucaacgcucugcgcaggagcugccacacaucgagaaguauuccauuaacagcugcucggugaauggcggucaugaaaugguugugacugggucaaacuuccucccugagucuaaaaucauuuuucuggaaaagggccaggacggaagaccccagugggaggucgaaggcaaaauaaucagggagaagugucaaggggcacacauugugcuugagguaccaccuuaccauaaccccgccguuaccgcugccgugcagguccacuucuaucugugcaauggaaaacguaagaagagucagucccagcgguuuacauacacuccaguguugaugaaacaagaacaccgagaggaaaucgaucucagcucugucccgagccugccugugccccauccagcacagacccagagacccuccucagacagugguuguagccacgauucuguuuuauccggccagaggucacugaucugcaguauuccucaaacauacgccagcauggugaccuccucucaucuaccacagcuccagugucgcgacgagucgguaagcaaggaacaacacaugauacccucaccuaucguccaucagccguuccaggugacuccaacgcccccuguuggguccaguuaucagcccaugcaaacaaacguggucuacaauggaccaaccugccugccuauuaacgcugccucuagccaggaguuugauuccgugcuuuuccagcaggacgcaacuuugucaggccugguaaaucucgguugucaaccccugucuagcaucccauuucacaguuccaacagcgggucuaccggccacuuacuggcgcauacaccucacucagugcauacccuuccgcacuugcaguccaugggauaucacugcaguaauacuggccagcggagccucucgucucccguugcugaucagauuacagggcaaccauccagccagcugcagccuaucacguacggacccucacauaguggcucugccaccacugcauccccagccgcuagccacccucuagccucaaguccccugagcgguccgccauccccucaacuccagcccaugccauaucagucucccagcuccgggacagcaucaucuccuaguccggcuaccagaaugcauucgggacagcacagcacacaagcccaguccacuggccaggguggccugucugcgcccucaagccuuauaugccauuccuugugugacccagccaguuucccucccgauggggcuaccgucucuaucaaaccugagccagaagacagggagcccaacuuugcaacgauuggacugcaggacaucaccuuagaugacgaucaauucauuagcgaccucgaacaccagccuucaggcuccgccgagaaguggccaaaucacagugugcugagcugccccgcuccguuuuggcgcaucuga

SEQ ID NO: 59662 - RNA, 2895 nt, Artificial Sequence
  derived and/or modified sequence opt3 from NFATC4__Homo_sapiens__NP_001129494
augaucaccacacugcccagccuccuuccugccucccuggcuucuauuucacacagagugacuaacuugccaaguaauagcuuaucccauaacccgggccugucuaagcccgacuucccuggaaauucgucaccagggcuacccagcaguuccucuccugguagggaucucggcgcaccagccgggagcaugggagcggcuuccugcgaggacgaagaacuggaauuuaaacuugucuucggcgaggaaaaggaggcacccccucugggugcagggggauugggcgaggaacucgauucagaggacgccccaccguguugccggcuggcucugggcgaacccccuccauacggggcagcccccauaggaaucccucgcccacccccgccucgacccgguaugcacaguccaccuccccguccagcucccagcccuggcacgugggagucucagccagccagauccguuaggcucgggggaccgggcgguggggcgggaggcgcaggcgggggacggguguuagagugucccucaauucgcaucaccagcauuaguccuacaccagaacccccugccgcucuggaggauaacccagacgccuggggugauggcucucccagagacuauccgccuccagaaggguuuggaggcuacagggaggccggugggcaaggcggaggcgcuuucuuuucccccagcccugggucgucuucccuuucaaguuggagcuucuuuuccgaugccucugacgaagcggccuuguaugcagcuugcgaugagguagagagcgaacugaaugaggccgcuucacgguucggacuagguaguccccucccauccccucgcgccagcccccgaccauggacuccggaagacccuuggucucuguacggccccucaccagggggaagaggccccgaggauaguuggcuucuguugagcgcaccugguccaacccccgccuccccuaggccggcuucuccaugugggaaacggcguuauucgagcuccggcacacccucaagugcgucuccugcacucagccgcagaggaucccugggcgaagaggggucagagccacccccuccgcccccauuaccucuggccagggaccccggaagcccagguccuuuugacuacgugggcgcucccccagccgaaucuaucccgcagaagacccggcgaacuuccagugagcaggcagucgcccucccucgcagcgaggagcccgcuucuugcaacgggaaacuuccacugggagccgaagaguccguggcacccccuggcgguucaagaaaggagguugcggggauggauuauuuggcugugccaaguccccuagccuggagcaaggcaaggauaggcggacauucgccuaucuuccggacauccgcccugccgccacucgacuggccccugccuucucaguacgaacaacuugagcugcgcauugaaguccagcccagagcucaccauagggcccacuacgagaccgagggcagccguggggcagugaaagcugccccaggaggccacccuguaguuaaguugcucgguuauucagaaaaaccccugacguuacagauguuuaucgggacugcggaugagcggaaucugcgaccacaugccuucuaccaggugcacagaauuaccggaaagauggucgcuacagcaaguuaugaagccgugguguccggcacuaaaguccuagagaugacccuccugccugaaaacaauauggcugccaacaucgacugugcagguauacuuaaguugcgcaauucugauauugagcugaggaagggcgagacagacaucgggcggaaaaacaccagaguuaggcucguguuucgcguacaugugccgcaaggaggcgggaaggucgugagcguucaggcggccuccgugcccauugaaugcucacagcgaagcgcucaggagcugccacaagucgaagccuacaguccuucugcauguuccgugcggggaggcgaggaacuuguacugacggguagcaauuucuugcccgauucgaaaguuguguucaucgagcgugggccagacggaaagcuccagugggaggaagaggcuacugucaacagacugcagucaaaugaagugacauuaacccugacugucccugaguauucuaacaaaagggugagucgccccguucaaguguacuuuuauguauccaacggccggagaaagaggagcccgacacagucuuuccgauuucuaccagucaucugcaaagaggaaccucuccccgauagcucccugcgcgguuucccaucagccagugcaacccccuuuggcacggacauggauuucagcccuccgcggcccccauacccuucuuacccccacgaggacccugccugugaaaccccauaucuuuccgagggguuuggauacggcaugcccccuuuguauccacagacagggcccccgccuucauacagaccaggacugaggauguuccccgaaacucguggcaccacagguugcgcucagccuccagcggugaguuuucucccccgcccguucccuagcgaccccuaugggggacggggcuccucuuuuucgcuggguuuaccauucagcccucccgccccauuuagacccccuccacugccggcaucacccccucuugagggcccauuccccucccaaagugauguucacccuuugccagcugagggguacaauaaggugggacccggcuaugggccuggagaaggcgccccggagcaggaaaagucuagggguggguacagcuccggauuccgagacucagucccaauucagggcauaacucucgaggaaggcgggugcggaaccgguggcugugagugcgagugugugcaggaaaucgcccugcauguaugcuga

SEQ ID NO: 59663 - RNA, 1122 nt, Artificial Sequence
  derived and/or modified sequence opt3 from NFE2__Homo_sapiens__XP_005268963
augagccccugcccuccacagcaauccagaaacagggugauccagcugucuaccucagagcucggcgaaauggagcuuacauggcaggaaauuaugaguauaacugagcugcagggguugaaugccccgagcgaacccuccuucgagccucaagcuccagcacccuacuuaggaccuccacccccuacgaccuauuguccaugcucuauccacccggacucggguuuuccccugccuccacccccuuacgagcuaccagccucaacaagccauguccccgauccgccuuauaguuacggcaacauggcgauucccguuuccaagccacucucucugagcgggcuucuguccgaaccuuugcaggacccccucgcucugcuggauaucggacucccagccggacccccuaaaccacaggaggacccggaaucagauagugguuuaagccugaauuauucugacgcagagucccuugaguuggaagggacugaggccggacggcgccgaucagaauacguggagauguaucccguagaauacccuuacagccugaugccaaacagucuagcucacucuaauuauacccuccccgcagccgagacaccucuggcucuugagccauccagcggccccgugcgugccaagccgaccgcgagaggcgaagcagggucgagggaugagcggcgcgcccuggcuaugaaaauuccuuucccaacugacaagaucgucaacuugcccguggaugacuuuaaugaacuccuggccagauacccuuuaacagagucucagcuggcacucguuagggauauacggcgccgaggcaaaaacaagguggcugcccaaaauuguagaaagaggaaacuugaaaccaucguccagcuggagcgggaguuggaacgucuaacgaacgagcgcgaaagacugcucagggcgcggggugaggccgaccgaacucuggaagugaugcgccagcagcuuaccgagcuguauagagauauuuuccaacauuugagggacgaguccggcaauucauacagucccgaagaguaugcacuccagcaggcugccgacgggacaaucuuucugguaccacggggaacuaagauggaagcuaccgauuga

SEQ ID NO: 59664 - RNA, 2319 nt, Artificial Sequence
  derived and/or modified sequence opt3 from NFE2L1__Homo_sapiens__NP_003195
augcugagccucaagaaauaccuuaccgagggccuguugcaguucacaaucuuacugucccuaauuggggugagagucgacguugauacuuaucucacgucucaacugcccccucuuagggaaauaauccugggaccaucaagugccuacacccagacacaguuucacaacuugcggaauacucucgacgguuauggcauucaucccaagagcaucgaucuggacaacuacuucaccgcucgccgacugcucucccaggugcgugcauuagauagauuucaaguacccacaaccgaggugaaugccuggcugguccacagggacccugaagggucugugucgggaucacagccaaacagcggccuugcguuggagaguuccucuggucugcaggauguuacugggcccgacaauggagugcgggaaagcgagacagagcagggcuucggcgaagaucuagaggaccucggggcugucgccccuccaguguccggagaucugaccaaagaagacauugaucuuaucgacauacuguggcgccaagacaucgauuugggugcaggcagagagguauuugacuauucacauaggcagaaggagcaggauguugaaaaagagcuccgggacgggggagaacaggauacgugggccggcgagggugcugaagcacuggcccgcaacuuacugguggacggggagacuggagagaguuuccccgcucaagucccuagcggcgaagaucagaccgcccucucucuugaggaaugccugcgauugcuagaggcgacauguccauuuggcgaaaaugcagaguucccggccgacauuuccucaaucacugaggcugugcccagcgaaagugagccuccagcccugcagaacaaucuccugucuccccuucugaccgggacagaauccccuuuugauuuggagcaacaguggcaggaccucaugagcauuauggaaaugcaggcaauggaggugaacaccucggcuucugagauccuguacuccgccccacccggagauccguuaucaacgaauuauagucuggcgccuaacacucccauaaaucaaaacgucagccuacaccaggccucccucgguggcugcucucaggacuuccugcuuuuuagcccagaaguugagucauugccuguggcaaguuccagcacacugcucccccuggcuccaucuaauucaaccagucuuaacagcacuuucggguccacaaaccugaccggauuguuuuucccgccucagcucaauggcacggccaacgacaccgcugguccagaacugccggaucccuuagggggccugcuagacgaggccaugcucgaugagauuucucugauggaccuugcaaucgaagagggauucaauccuguacaagccucgcaguuggaagaggaauuugauagcgacuccggccugucacucgauaguucucauagcccauccucacugagcagcuccgaggggaguucuucuuccucaaguagcucguccucuagcucaaguuccgcuucuagcuccgcgucaagcaguuucucugaggaaggagcaguggguuacuccagcgacucggagacauuagaucuggaagaggccgaaggcgcugucggguaccagcccgaguauucaaaguuuuguagaaugucuuaccaggacccugcccaacuuaguugcuugccauaucucgagcacgugggacacaaccauacuuacaauauggcacccuccgcccuggauagcgcugaccuaccgccuccaucugcccugaagaaaggcagcaaggaaaaacaggcagauuuccucgacaagcagauguccagggacgagcaccgggcgcgugcuaugaaaauucccuuuaccaacgauaagaucaucaaucugccuguugaagaguucaacgaacuuuugucaaaguaucagcugagugaggcccaauuaagccucauucgcgacauaagaaggcgggguaaaaauaagauggcagcccagaacugucgaaaacgcaagcuggauacaauccuuaaucuggagagagacguggaagauuugcagagggacaaagcucggcuccugcgcgagaaggucgaauuucuaagaucucugaggcaaaugaaacagaaggugcagucccucuaccaggagguauucgggcgucugcgggaugagaacggccgacccuauucaccaagucaauacgcccuucaguacgcaggagacggcagcguuuugcugauuccuagaacuauggcugaucagcaggccaggcgccaagaacggaagcccaaagacagaaggaaguga

SEQ ID NO: 59665 - RNA, 1770 nt, Artificial Sequence
  derived and/or modified sequence opt3 from NFE2L2__Homo_sapiens__NP_001138884
auggaccugaucgauauucucuggagacaggacauagaucuuggcgugagcagggaggucuucgacuuuucccaacggcgcaaggaauacgagcuggaaaaacagaagaaauuggagaaggaacgacaggagcaguuacaaaaagagcaggaaaaggccuucuuugcucagcugcagcuagaugaggaaaccggggaguuccuccccauccaaccugcacagcacauucagucugagacaucaggaagugccaacuauagccagguugcgcauaucccaaaguccgacgcucuguacuuugaugacugcaugcaacuucuggcccagacuuucccguuuguggaugacaaugaaguaucuucggcaacguuccagucauuggugcccgauauuccuggucacaucgagagcccagucuuuauagccaccaaccaagcucagagucccgaaacauccguggcacagguugccccuguggaccucgauggcaugcagcaagacaucgagcaggucugggaagaacugcugucuauuccagagcuccaguguuuaaauaucgaaaacgacaaacugguggagacuaccaugguacccagcccugaagcuaaacuuacagagguugauaauuaucauuucuacuccucaauuccaaguauggaaaaagagguggggaacugcagcccgcacuuuuugaaugccuucgaggacucuuuuuccucaauccugagcaccgaagaucccaaccagcuaacugucaauagucucaacucugacgcgacagugaauaccgauuucggagacgaguucuauuccgcauuuauagccgaaccuagcauuucgaacucuaugccaucccccgcuacgcugucacauagucuuagcgagcuguugaauggcccuaucgauguguccgaccucucucuguguaaggccuucaaccaaaaucacccagaaagcacugcagaguuuaacgauucagacagugguauuuccuuaaacaccagccccucugucgcuucaccggagcacaguguugaaagcuccucuuacggggauacacugcucggacuuucggacagcgagguggaggagcuggacuccgccccuggcucaguaaaacagaauggccccaagacuccagugcauaguucuggggauaugguccagccuuugagccccucccagggacaaucaacccacgugcaugacgcgcagugcgagaacacaccagaaaaggagcuacccguuagcccuggucaccguaaaaccccauucacgaaggauaaacacucuuccagacuggaagcccaucucacuagggacgagcugcgggcaaaggcccuucacaucccguuucccguggaaaagaucauuaaucugccugucguggauuucaacgagaugaugaguaaggagcaguuuaaugaagcucaguuggcucucauacgcgacaucagaaggcggggcaaaaacaagguagccgcacaaaauugucgcaagcgaaaacuggagaacauuguugaauuagagcaggaucuggaccaucuaaaggaugaaaaagagaagcuccugaaagagaagggggaaaaugacaagagccuucacuugcugaaaaagcagcucucuacacuguaucuugagguguucuccaugcugagagaugaagacggaaaaccauacucacccagugaguacagcuugcaacagaccagggauggcaacgucuuucucgugccuaagucgaaaaagccagacgucaagaaaaauuga

SEQ ID NO: 59666 - RNA, 2085 nt, Artificial Sequence
  derived and/or modified sequence opt3 from NFE2L3__Homo_sapiens__NP_004280
augaagcaccugaaaagaugguggagcgccggcgggggacuccuucaucugaccuuguuacugucccuagcuggucucaggguggaccuggaucuuuaccuguugcucccuccuccaacacugcugcaggacgagcucuuauuccugggcgggccggcaucuucagccuaugcgcuuagucccuuuagcgcuuccggaggcuggggucgggccgggcacuugcauccuaagggacgcgaacuggauccagcagcucccccugagggccaacuacuccgagaaguccgugcccugggcguuccauucgugcccagaacuucuguagacgcauggcuugugcacucggucgccgcugggucagccgaugaggcgcauggacuguugggugcagccgcugccagcaguacgggcggggcaggagcuuccguggacggcgguucucaggccguucaagggggaggcggcgauccuagggcggcccggagcgggccacucgacgcaggagaagaggagaaagcuccggccgaacccaccgcucaggugccugaugccgguggcugcgcauccgaggaaaacgggguccugcgcgagaagcacgaggccguggaccacucaagucagcaugaagagaaugaagagagaguaagcgcucagaaagaaaacucuuuacagcagaaugaugacgaugagaacaagaucgcggagaagccagacugggaagcagagaaaacaacugaauccaggaaugagcggcaccugaacggaaccgacacaucauuuagccucgaagaucuuuuccaacuguugaguucucagcccgagaauagucuagagggcauuagccugggugacauaccucucccagggucgaucucugauggcaugaacuccucagcccauuaccacguuaauuuuagucaggcuauuagccaggacgugaaccugcacgaagccauccuucugugucccaauaacaccuuccgccgagauccgacugcaagaacaucccaaucucaggagcccuuuuugcagcucaauagccauaccacgaaccccgaacaaacucugccaggaaccaauuuaacaggcuuccugucaccugucgacaaccacaugaggaaccuaacuucccaggaucuccuguaugaccuugauauuaauaucuuugacgagauaaacuugaugucccuggccaccgaagauaauuucgaccccaucgacgugagccagcucuuugaugagccagacucugauucagggcugagucuugacagcucccauaacaauacaucugugauuaagucgaacagcucccacucagucugcgaugagggagcuaucgguuacuguaccgaccaugaaaguucuagccaccacgaucuggagggcgccguugggggauauuaccccgaaccuuccaaauugugccaucucgaccagucagauagcgacuuccacggcgaucugacguuucaacauguguuccacaaucacacuuaucauuuacagccaacagcaccggagucuaccuccgagcccuucccuuggccagguaagagucagaaaauucggagccguuaccuggaagacacugaucgcaaccuaucuagagacgagcagagggcgaaggcucuccacauccccuuuuccguagacgaaauaguggggaugccugucgauucauucaauaguaugcugagccgguacuaucuuacagacuugcaagugucgcugauucgagauauccgcagaaggggcaagaacaaaguugccgcacagaauugucggaagcgcaaacucgacauuauccugaacuuagaggaugacgugugcaaucugcaggccaagaaagaaacccuuaagagagagcaggcucaauguaacaaagccaucaauauuaugaagcagaaguugcaugaucucuaccacgacauauuuuccaggcugcgugaugaccagggacggccagucaaccccaaccauuaugcacuacagugcacgcacgauggcucuauccugauugugccgaaagagcucguagcuagcgggcacaagaaagaaacccaaaagggaaaacgaaaguga

SEQ ID NO: 59667 - RNA, 1551 nt, Artificial Sequence
  derived and/or modified sequence opt3 from NFIA__Homo_sapiens__XP_011539817
auguacagcccccugugccucacccaggacgaguuccacccuuuuaucgaagcccuucugccacacgugagagcuuucgcauauacaugguuuaacuugcaagccaggaagcggaaauacuucaagaaacacgagaagcgcauguccaaagaagaggaacgagcggucaaggaugaguuacugucugagaagccggaaguuaaacagaagugggcuucacgucuacucgccaaacugagaaaggacauuaggcccgaguaucgggaagauuuugugcuuacuguaacgggcaaaaagccuccauguugcgugcugaguaaucccgaccagaaggggaaaaugcgcagaauagauuguuugaggcaggcagacaaggucuggcggcucgaucuggugaugguuauccuguucaaagggauuccucucgagagcaccgacggugagcgcuuagugaaguccccacaaugcucuaaccccggccuguguguccagccucaucacaucggggugucgguaaaagaacuugauuuguaccuggccuauuuuguucaugcugcagacucaagccagagugaguccccaucucagccgagcgaugccgacauuaaggaucaacccgaaaauggacaccuaggcuuccaggacuccuuugugacaucaggugucuucagugugacugagcucgugcgagucagccagaccccuaucgcugccgggacaggaccaaacuuuucucuguccgaccuugaaucaagcaguuacuauucuaugucccccggcgcgaugagaaggagccugccuucgaccucuuccacuucaaguacaaaacggcucaagagcguugaggaugagauggacuccccaggcgaagaacccuucuacaccgggcagggacguucuccggguagcggcucacaaaguuccggguggcacgaaguggagccuggaaugcccagcccaacgacuuugaagaaaucugaaaagucaggcuuuaguagcccuucccccucucagaccucgagccuggguacagcauucacucagcaucaccgcccaguaauaaccgggcccagagaguucaaaauggccccuuccaucuuaggaucaccauuuuggaagguguacagugcuucuccgcaugccacacccagcacccugcacuucccuacguccccaauuauccaacagcccggcccuuauuuuucacacccagcaauuagguaccauccccaggagacucucaaagaguucguccagcuugugugcccggaugcuggccaacaggccgggcagguuggauuucugaauccuaacgguagcucucagggcaaggugcacaauccauucuugcccacaccuaugcuacccccaccucccccaccgccuauggcgcggcccgucccacugcccgugccugacaccaagccacccacuacauccaccgagggaggagccgcaaguccuacgagcccgauccucguaccaggcauaaaaguugcugccucucaucaucccccugaucgaccacccgacccuuuuuccacccuguga

SEQ ID NO: 59668 - RNA, 1485 nt, Artificial Sequence
  derived and/or modified sequence opt3 from NFIB__Homo_sapiens__NP_001177666
augauguacagccccaucugccugacccaggacgaguuccacccuuuuauugaagcccuccuuccacaugugagagcuauagcauauacaugguucaaccugcaagccaggaagcggaaauacuuuaagaaacacgagaagcgcauguccaaagaugaagaacgagcggucaaggacgaauuguuaucugagaagccggagaucaaacagaagugggcuucacgucugcuagccaaacucagaaaggauauuaggcaggaauaucgggaggacuucguucugacugugacgggcaaaaagcaucccuguugcguacuuaguaauccugaucagaaggggaaaauccgcagaauugacugucugaggcaagcagauaagguguggcgguuggaccucgucauggugauccuguuuaaaggaauaccacuggaaagcaccgauggugagcgccucaugaagucuccccacugcacaaacccugccuuauguguucagccacaucacaucacuguguccgucaaagagcuggaccuuuucuuggcuuacuaugugcaggaacaggauucgggccaaucagggagccccagucacaaugacccugcaaagaacccaccgggauaccuggaggauuccuuuguaaaaucuggcguuuucaaugugagcgagcuaguccgaguguccagaacccccauuacacaggguaccggggugaacuuuccuaucggagagauuccaucacagcccuauuaccaugacaugaauaguggcgucaaccuccagaggagccugucuuccccuccaucaagcaagcggcccaagacuaucaguauagacgaaaauauggagccgucuccuacaggcgauuucuaccccuccccaagcucgccugccgcugggucucguaccuggcacgagcgcgaccaagauauguccucacccacgacuaugaaaaagccagaaaaaccccuuuuuaguagcgccuccccucaggacucuagcccaagacugucaaccuucccgcagcaucaccaccccgguauuccuggaguugcgcauagugugaucuccacaaggacuccacccccuccaagccccuugccguuuccuacccaagcaauucucccacccgccccuucuucauauuucagucaccccacaauccgguacccaccucaucugaacccccaggauaccuuaaagaauuauguaccaagcuacgacccguccucuccucagacgucgcagcccaacggcagcgggcaaguggucggaaaagugccaggccacuucacucccguucuggcuccuuccccacaucccucagccgugcgaccugucacacucaguaugaccgauacuaagccgaucacaaccucuacggaggcauauaccgcuagcgguacaucccaggccaaucgcuacguggggcuuucaccaagagaccccagcuuucugcaccagcagcaaucuugguauuugggauga

SEQ ID NO: 59669 - RNA, 1527 nt, Artificial Sequence
  derived and/or modified sequence opt3 from NFIC__Homo_sapiens__NP_001231931
auguacagcagcccccugugccucacccaggacgaguuccacccuuuuaucgaagcccuucugccacaugugagagcuuucgcauauacaugguuuaacuugcaagccaggaagcggaaauacuucaagaaacacgagaagcgcaugucuaaagaugaggaacgagcggucaaggacgaauuacugggcgagaagccggagguuaaacagaagugggcuucacgucuacucgccaaacugagaaaggauauuaggcccgaaugucgggaggacuuugugcuuaguauaacugggaaaaaggcaccuggaugcguacugagcaauccagaucagaaggguaaaaugcgcagaaucgacuguuugaggcaggccgauaagguguggcggcucgaccuggucauggugauucuguucaaaggcaucccccucgaauccacggauggggagcgcuuaguuaaggcugcacaaugcggacauccugugcuguguguccagccacaccauauuggcguggccguaaaagagcuugacuuguaucuggcuuacuuuguucgagaaagagaugccgagcagucugguucgcccaggaccgggaugggaucagaccaggaagauagcaagccuaucacacuagacacuaccgacuuccaagagaguuuugugacauccggcgucuucucugugaccgaacucauacaggugagccggacuccagucguuacaggcaccgggccgaacuuuucccugggagagcuucagggucaccuggcguaugauuugaaucccgcaucaacgggccuccgucgcacucugccuaguaccuccucuuccgggucaaaaagacacaagagcggaaguauggaggaagacguggauacaucuccaggcggugacuacuauacuucccccagcucgccuaccucuuccucaaggaacuggacagaggauauggaagggggaaucaguagcccaguaaagaaaaccgagauggacaagucccccuucaauucuccgagcccucaggauucaccccgguuaaguuccuuuacgcaacaucaccgaccagugauugccguccauagcggcaucgcucgcucuccucaccccucaagugcccugcacuucccaacuacaagcauucucccccagaccgcauccacuuacuucccucauacagcuaucagauacccaccgcaccuuaacccccaggacccucugaaagauuuggugucucuagccugcgacccagcgucgcaacagcccggcccucugaaugggagcggacagcucaagaugccaucccauugucugucagcccagaugcuugcacccccgccuccaggucugcccagguuggcucucccucccgccaccaaaccagcuacgaccagugaaggcggggccacaucuccuacuagccccuccuauucaccaccggauaccagcccugcaaaccggucuuuuguuggacugggcccccgcgacccagccgguauauaccaagcucaguccugguauuuaggguga

SEQ ID NO: 59670 - RNA, 1389 nt, Artificial Sequence
  derived and/or modified sequence opt3 from NFIL3__Homo_sapiens__NP_001276929
augcagcugagaaagaugcaaaccgugaaaaaggagcaggccagccucgacgcuuccucuaacgucgauaaaaugaugguucuuaauucagcacugacagaagugagugaggacagcacuacgggcgaagaguuguuacuguccgaagggucuguaggaaagaacaaaucgucagccugcaggcggaagcgcgaguucauccccgaugagaagaaagacgcgauguacugggaaaagcgacguaaaaauaacgaggcugccaagagaagcagggaaaaacggcgccuaaaugaucucgugcuggagaacaaacuuauugcacugggugaggaaaaugccaccuugaaggcugagcuccugagucugaagcucaaguuuggcuuaauauccucuacagcauaugcccaggaaauccagaaacugagcaacuccacugcugucuacuuccaagacuaucagaccucaaagaguaaugugagcucuuuuguugaugagcacgaaccuuccauggugucaagcaguuguauuucugucaucaaacauuccccacagagcucgcuuucugacguguccgagguaucaaguguugagcacacacaggaaagcuccgugcaagggucuugcagaagcccggagaacaaguuccagauuaucaaacaggaacccauggaguuggaaucauacaccagggagccucgggaugaccgcggaaguuauacugccuccauauaccagaauuauaugggcaacagcuuuucugguuacucacauaguccaccccugcuacaagucaaucgaagcuccucuaacucgccuagaacaagcgagaccgaugacgggguggugggaaaguccucagauggcgaagacgagcagcaggucccaaagggccccauccacaguccuguugaacucaaacaugugcacgcgacgguagugaaggucccagagguuaauucuagcgcacugccgcacaaacuuaggauuaaggccaaagcuaugcaaaucaagguggaagccuucgacaacgaguuugaggcaacucagaagcuguccucacccauugauaugaccagcaaacggcauuucgaauuggagaagcacucugcuccuuccauggugcauaguagccucacaccauuuucuguccaggugacuaacauccaggacuggucccugaaaucagaacacuggcaccaaaaggaguuaagugggaaaacccagaauagcuucaagacaggaguaguugagaugaaggauucggguuacaaaguguccgaccccgaaaaccuguaucucaagcagggcauagccaaucuuucugcggaggucgugagccugaaacguuugauugccacccagccuaucucagcaagugauuccggguga

SEQ ID NO: 59671 - RNA, 1533 nt, Artificial Sequence
  derived and/or modified sequence opt3 from NFIX__Homo_sapiens__NP_001257972
auggagaugagcugggccagacagucccuggcuggcauccccgcagccugcgacgaguuccacccuuuuauugaagcgcuccuuccacaugugagggcuuucucuuacaccugguuuaaccugcaagcccggaagcgcaaauauuucaagaaacacgaaaagcgaaugucaaaagaugaggaacgugcagucaaggacgaguuguuaggggagaagccggaaauaaaacagaagugggccaguagacugcuagcuaaacucaggaaggauauccggcccgaguuucgcgaagacuucguucugacaauuacuggcaaaaagccuccauguugcgugcuuagcaaucccgaucagaaggguaaaaucagaaggauugacugucugcggcaggcagauaagguauggcgcuuggaccucgugauggucauccuguuuaaaggcauaccucuggaguccacggauggggagcgacucuacaagucuccacaaugcucgaaccccggauuaugugugcagccucaucacaucggcguuaccauuaaagaacuggaccuuuauuuggccuacuucgugcauacaccagagucaggucagagcgauaguuccaaucagcaaggggacgcugauaucaagccgcugcccaacggacaccuaucuuuucaggacugcuucgucacuagcggcguguggaauguaaccgaacucguuagagugucccagacaccugucgccaccgcgucaggcccaaacuuuagucuggcagaccuugagagccccucuuauuacaauauuaaccaggugacucuggggaggcgguccaucacaucaccuccaagcaccaguacgacuaaacgucccaagucuauagaugacuccgaaauggagagcccgguggaugacgucuucuauccuggaaccggucgcucgcccgccgcuggaucuucccaaucaaguggguggccaaaugauguugacgccggaccugcuagcuugaagaaauccggcaagcucgauuuuuguucugcacugagcucacaggguaguucccccagaauggccuucacacaccauccauuacccgugcuggcggggguaaggccuggaagcccacgggccacugcaucugcucuccacuucccgucaaccaguauuauccagcaaagcucccccuacuuuacacauccuaccauucgauaccaccaccaucacggccaggacucucuuaaagaguucgugcaguuugucugcucggauggcagcgggcaggccacgggacaaccaaacgguuccggccaggggaaggugcccggaucauuccuguugccuccacccccgccuguugcucgcccagugccccuaccuaugcccgacaguaaaucuacuagcacagccccagauggcgcagcccugaccccucccuccccaucauuugcuacuacaggugcgagcucugcaaauagauucgucuccaucgggccgagggacggcaacuuucucaauaucccucagcagagucaaagcugguuccuguga

SEQ ID NO: 59672 - RNA, 2907 nt, Artificial Sequence
  derived and/or modified sequence opt3 from NFKB1__Homo_sapiens__NP_001158884
auggccgaggacgaucccuaccugggcagaccugaacagauguuccaccucgacccaagccuuacccauacaaucuuuaacccggagguguuccaaccccagauggcucugccuacugaugggccauauuugcagauuuuagaacagcccaagcaaaggggauuucgguuccgcuacgucugcgaggguccuucccacggcgggcugccaggagcaucuucagaaaagaauaagaaaaguuauccccagguuaagauauguaacuacgugggcccugccaaaguaaucgugcagcuagucacgaaugguaagaacauucaucuccacgcgcauagccugguggggaagcacugcgaggacggaaucuguaccguuacagcuggcccaaaagauaugguggucggcuuugccaaucuugggauucugcacgugacuaagaaaaagguauucgagaccuuggaagcacgaaugacagaggccugcauccguggauauaacccgggucuccugguucaucccgaccuggcuuaccuccaggcagaaggcgggggagauagacaauuaggcgacagggagaaagagcugauacggcaggccgcacuucagcagaccaaggaaauggauuuguccgugguccgccugauguuuacugccuuccuaccugacucuacagguucguuuaccagaaggcucgagccaguggugucagaugcgaucuaugacagcaaggcacccaaugccaguaaccugaaaauuguccggauggaucgcacggcuggguguguuacuggaggcgaagagaucuaccuucugugcgacaaggugcaaaaagacgauauucagauccgauucuacgaagaggaggaaaauggcgggguaugggagggauuuggugacuucuccccuaccgaugugcacagacaguuugccauagucuucaagacaccaaaauauaaggacauuaacaucacuaaacccgcaucuguguucguucaauugaggcggaaaagcgaucucgaaaccuccgagccgaagccuuuucuguacuaucccgaaauuaaagacaaggaggaggugcagcguaaacgccagaaguuaaugccaaauuucucagauaguuuuggcgggggaagcggcgcuggugccgggggcggaggcauguucgggucuggagguggcgggggaggcacagguuccaccgggccuggcuacucauuuccccauuauggauucccaacguacggcgggaucacuuuucaccccggaacaaccaaaagcaacgcggguaugaagcacggcacuauggacacagaaaguaagaaagauccugaggggugugacaagucugaugacaaaaauaccgucaaccuguucggaaaggugaucgaaacgaccgagcaggaccaagaaccauccgaggccacaguaggcaauggugagguuacucucaccuaugcaacagggacuaaagaagagagcgcuggcgugcaggauaaccuuuuucuggaaaaggccaugcaguuggcuaagagacaugccaacgcacuauucgacuacgccgucaccggagaugugaaaaugcugcucgcuguccagaggcaccugacagcggugcaagacgagaauggcgauucgguucuucaucuggcaauuauacacuugcauucucagcucgugcgggaccuguuagagguaaccuccgggcugaucucagaugacauuaucaacaugcgaaaugaucuauaccagacuccgcuccaccuggccgucauaacgaagcaggaagacgugguugaggaucuuuugcgcgcuggagccgaccugagucuccuggauagacuuggcaacagcgugcugcacuuggcagccaaagaaggucaugacaagguccucuccauucuguuaaaacacaagaaggcugcccugcuacucgaccaucccaauggggauggacugaacgcaauccaccuugcgaugaugucuaauagcuugccuugccugcuccuguuaguggcugccggcgcagacguaaacgcccaagagcagaaaucagguaggacagcucugcaccuugccguggaacaugauaauaucaguuuggcaggcugucuccugcuagagggggacgcucacguugauuccaccacuuaugacggaaccacaccacugcauauugccgcgggccgggggagcacccgccucgccgcucugcuuaaggcagccggagcugaucccuuggucgagaacuuugaaccucuguacgacuuagaugacucuugggagaaugccggcgaagaugaggguguggugccagggacuacaccccucgacauggcaacgucauggcaggucuucgauauccugaacggaaaaccguaugaaccugaguuuaccagugacgaccuucuggcgcagggcgauaugaagcaauuggccgaggacguuaaacuccagcuguacaagcuacuggaaauuccagaucccgacaaaaauugggcuacucucgcccagaagcugggucuuggcauauugaacaaugcauucagacugagcccugcucccuccaagacauuaauggauaacuaugaggugucugggggaaccgugagggaacucguagaggcccugcgucaaaugggcuacacagaagcaaucgaggucauucaggccgcuucgagcccagugaaaacuaccucccaggcgcacucacuuccucugagucccgccucuacgcggcagcaaaucgacgagcuacgagauagcgacuccguuugcgauucagggguggaaaccagcuucagaaagcucucuuuuacagagucccugaccaguggagcuagcuugcugacuuuaaacaaaaugccacaugacuauggccaggaagguccgcucgaggggaagaucuga

SEQ ID NO: 59673 - RNA, 2700 nt, Artificial Sequence
  derived and/or modified sequence opt3 from NFKB2__Homo_sapiens__NP_002493
auggagagcugcuacaaccccggccuggacgggaucauugaauaugaugacuucaagcucaauuccucuauaguggagccuaaagaaccagccccggagaccgcugauggacccuaccuugucaucguugaacagccuaagcaaagagguuuuagguuccgguauggcugugaggggccaucacacggaggccugcccggugcaaguagcgagaaagggcgcaagacauacccuacugugaaaauuugcaacuaugaaggaccagccaagaucgagguagacuuggugacgcauuccgaucccccucgagcgcacgcucauucuuuagucggcaagcaguguucggaacugggcauuugcgccgugucaguugggccaaaagacaugaccgcacaguuuaauaaccuaggagugcuccacgucacaaagaaaaauaugauggguacuaugauccagaagcugcaacgucagagacuuaggagccggccgcagggccugaccgaggccgagcagcgcgaauuggagcaagaagcuaaagagcucaagaaggugauggaucugaguauaguaagacugagguucuccgcauuucuccgggccucugacgggagcuucuccuuaccccugaaaccuguuaucucacagccaauucaugauaguaagagccccggagcuucuaaccuuaaaaucucccgcauggacaagacagccggcucagugcgagguggggaugaagucuacuugcugugugacaaagugcagaaggaugacauugaggugagauuuuaugaggacgaugaaaauggauggcaggcguucggcgacuuuagcccuaccgauguccacaaacaauacgcaaucguuuucaggacuccacccuaccacaagaugaagauagagcggccggugacaguauuucuacagcucaaacguaagcgcggcggggacgugagugauucuaaacaguucaccuauuacccucuggucgaagacaaggaggaagugcaaagaaaaaggcggaaggcccuucccacguuuucccagccauucggagguggcagccauaugggagggggcucggguggggcugccggcggauauggcggggcaggagguggcgggucucugggauucuuuccuuccucauuggcuuacagucccuaucagagcggcgccgguccaauggggugcuaccccggcggaggcgggggagcgcagauggccgcaacuguuccuucccgagauucuggugaggaggcugccgaaccaagcgcuccgucacgcacaccccaaugugagccucaggccccagaaaugcuccagagagcaagggaguauaacgcccggcuguucggcuuagcucagcgcagugcgagagcacugcucgacuacggggugaccgccgaugcuagggcccuucuggcaggacaacgucacuugcuaacugcccaggacgaaaauggcgauacaccccugcaucucgcuauuauccacggucagaccuccgucauugagcagaucguguacguaauccaccaugcccaagaccuggggguugugaaccuuaccaaucaucugcaccagacgccuuugcaccucgcagucauuacuggccagacaagcguggucucuuuucuguuacgggugggagcggacccagcucugcuagaucgacauggcgacucagccaugcaccucgcacugagagccggggcuggagcccccgagcuuuugagggcacugcuccagaguggcgcuccggccguuccucaacugcuucacaugccagauuucgaaggucuguaucccgugcauuuggcgguacgcgcccggagcccugagugccucgaccuguuagucgauuccggggcugaaguggaggcaaccgagagacagggaggcaggacugcccugcaccuagcuacagaaauggaggaacucggucugguuacccaucuugugacgaaguugcgcgccaacgucaaugcacgaaccuuugcgggcaacacaccccugcaccucgccgcugggcugggauacccaacuuuaacccggcugcuuuugaaagccggcgcagacauacacgcugagaaugaggaaccucucuguccccugccaucuccgccuacaucggauagcgacuccgauucagaggggcccgaaaaggacacucguaguucuuucagaggacauaccccacuagaucugacaugcagcaccaaagugaagacucuccugcuuaacgccgcacagaacacgauggagcccccuuugacaccacccuccccugccggcccgggucugucauuaggggacaccgcucuccaaaaucuggaacagcuucuggauggaccagaggcgcagggcagcugggccgaauuggcagagaggcucggucugcgcucucuaguagacacuuaucggcagaccacaucccccaguggcagccugcucagaucuuacgagcuggcugggggagaccuugccggcuugcuggaagccuuauccgauauggggcucgaggaaggagugaggcugcuucgaggcccugagacccgcgacaaacugccaucaacugaaguuaaggaggauagugcuuaugguagccaaucggucgagcaggaagcagagaagcuagggcccccuccggaacccccaggaggccucugucacggucauccucagccccaggugcacuga

SEQ ID NO: 59674 - RNA, 954 nt, Artificial Sequence
  derived and/or modified sequence opt3 from NFKBIA__Homo_sapiens__NP_065390
auguuccaggccgcugagagaccccaagaaugggcaauggagggcccuagggacgggcugaagaaagaacggcuccuugaugaccgccacgauagcggacuggacuccaugaaggaugaggaauacgagcagauggugaaagaguugcaggaaauccgauuagagccacaggaagucccgcgugguucugagcccuggaagcaacagcugaccgaggacggcgauucauuucuacaucucgccauuauacacgaagagaaagcgcugacaauggaaguuaucagacaggugaagggggaccuugcuuuccugaacuuucagaauaacuugcaacagacuccucuccaucuggccguaauuacgaaucagccagagaucgcagaagcccugcucggagcuggcugcgaucccgaguuaagggacuuccgggguaacaccccucugcaccuugcaugugagcaggggugcuuggccagugugggaguccugacacaaagcuguacuaccccacaucuacacuccauucucaaggcuacaaauuauaacggccauaccugccugcaccuugccucuauccacggcuaccuggggauaguggaauugcucguuucgcugggagcggaugugaaugcacaggagcccuguaacggucgcacugccuuacaucuggcugucgaccuccagaauccugaucuugugucacuguugcuaaaaugcggcgccgacguaaacagaguuacauaucaaggguacagcccauaucagcugaccuggggaaggccgaguacgcggauccagcagcaacucggccagcugacucuugaaaaucugcagauguugcccgaguccgaagacgaggagucuuacgauaccgaaagcgaguuuacagaguucacugaagacgaacucccuuaugaugacuguguguuuggugggcagcgccugaccuuauga

SEQ ID NO: 59675 - RNA, 1071 nt, Artificial Sequence
  derived and/or modified sequence opt3 from NFKBIB__Homo_sapiens__NP_002494
auggccggcguggcuugccuggggaaggcagccgacgcggaugaguggugugacagcggacucgguucccuuggccccgaugcugccgcaccugggggaccaggccugggugccgaauuggggccgggauuaucuugggcuccccuggucuucggcuacguuaccgaggacggcgauacagcacuacaccucgccgugauccaucagcacgaaccuuuucuggacuuccuucugggguuuucagcuggaacugaguauauggauuugcaaaacgaccucggucagacggcccugcaucuggcggcaauucucggcgaaaccaguacaguagagaaauuauacgccgcuggggccggacugugcguggcagagagaaggggccacacugcccuucauuuggcuugucgggucggugcgcacgccugcgcacgcgcucugcuacagccacgaccccguagaccuagggaagccccagauaccuaucucgcucaggggcccgaccggacaccugauaccaaucacacuccaguggcccuguacccggacagcgaucuugagaaggaagaggaggaauccgaggaagacuggaaacugcaauuggaggcagaaaacuaugagggacauacaccccuccacguugccgugauacauaaggacgucgagauggugcgccuguuaagagaugcuggcgcggaccuggauaaaccugaaccaaccuguggcaggucuccccuccaccuugcaguagaggcccaggcugccgacguucuggaauugcuacugcgggcaggggccaauccugcugcccgcauguacggaggucgaacgccacucggcucggcaaugcugagacccaacccgauccuugcgaggcuguugcgggcucacggggccccugagcccgaaggagaggaugagaagucaggcccaugcagcaguuccucugacagcgauuccggugacgaaggggaugaguaugacgauauugugguccauucaagucguagccagacucgccucccucccaccccagcaucuaagccccugccugacgacccaagaccgguguga

SEQ ID NO: 59676 - RNA, 1503 nt, Artificial Sequence
  derived and/or modified sequence opt3 from NFKBIE__Homo_sapiens__NP_004547
augaaccagagaaggagcgagucccggcccggcaaucaccgccugcaagccuacgcugaaccugggaagggagacucugguggcgcagggccacucucaggaagugcccgacguggcagaggugggggaggcgcgaucagggugcggcgcccgugcuggagcggcggggcuggaagagguggcgggcccgccugggcagucaggcuuccuaccguuacagccggauggacuuggccagcucugcggacguuguccucuuuacgcgcaggccccucggagccucauucaccaggucgaagacccccuagggccgggcggccacugugucaggcugauccgcagcccggaaaagccgcgcgucgcagccuagaaccugacccagcacagaccggccccagaccugccagggcugccggcaugagugaggcacggaaggggccagaugaagcugaggagucccaauaugacucuggaauugaaagccuccgaucccugcgcucacuucccgagaguacaagcgccccggcgucugguccuuccgauggcucaccccagccaugcacucacccucccgggccagugaaagaaccccaggagaaggaggacgccgauggagaaagagcagacagcaccuacggcaguucuucccugacauauaccuugagccuccugggugggccugaggcugaagauccagccccgaggcugccccucccucauguaggcgcuuuaucgccacagcaacuggaggcccuuacuuacauaucugaagacggagauacauuggugcaccuggcagucauccaugaggcccccgcugugcuacucuguugccuggcgcuucugccucaggagguuuuggacauucagaacaaucucuaucagaccgcacugcacuuagccgugcaccuggaucaaccaggcgcuguccgggcccucgugcuuaaaggggcaucccgcgcccugcaggacagacauggagacacggcuuugcacguagccugucagaggcaacaucuagcaugcgcgcguugucugcucgaaggucggcccgagccgggccgagggacuucacacagucuggaucuucagcugcagaacuggcagggauuggcuugccuccacaucgccacccugcaaaagaaucagccuuuaauggaacugcuacucagaaacggcgcagacauugauguucaggaggguacaagcgggaagacugcccugcaucuugcuguggaaacccaggagaggggcuugguccaauuccugcuccaggccggagcacagguggacgcucgcaugcugaauggcuguacaccacuucaccuggccgcggggcggggauugauggguaucuccucuacccucugcaaagccggcgcugauagccuguuaagaaacguggaggacgaaacgccccaggaucugacugaggaaagucuaguccuccugccuuuugacgaucuuaagauaucagggaaauugcugcucuguacagacuga

SEQ ID NO: 59677 - RNA, 1101 nt, Artificial Sequence
  derived and/or modified sequence opt3 from NFKBIL1__Homo_sapiens__NP_001138433
augagcaaccccuccccucaggugccagaggaagaggccucuaccucagucugcagaccgaagaguagcauggcuuccacaucuaggcggcaacgccgagaacguagauucaggcgguaccugucggcaggccgccucguuagagcccaggcgcuucugcagaggcaccccggguuggacguggaugcuggacagccuccacccuuacaucgggccugugcacgccacgacgccccugcucugugccuacuccugcgacuuggugcagauccagcccaucaagacagacacggcgauacugcucugcaugccgcggcaaggcaggggcccgacgccuauacggacuuuuucuugccucuccugucacgguguccaagcgcuaugggaaucaaaaauaaggauggcgagaccccgggucagauucugggguggggacccccuugggauagugccgaagaggaggaagaggacgaugcauccaaagaacgugaguggcgccagaagcuccaaggcgacgcuucucacgagacacaggaaccagagagcuuuuccgccuggucagauagauuagcgagggaacacgcccagaaaugccagcaacagcagcgggaggcagaaggcagucgacgacccccuagagcugaggggagcucucaauccuggaggcagcaggaggaagaacagcggcuguuccgcgaaagagccagggcuaaggaggaagaacuucgugagucacgggcccgcagagcacaagaagccuugggagacagggagccaaagcccacucgcgcugguccgcgggaggagcauccuagaggcgcggggaggggaagccuguggcgcuuuggcgacguacccuggccauguccuggugggggagaucccgaagcaauggccgcugcccuaguggcacgaggcccaccccucgaggagcagggcgcccugcggcguuaccuuagaguccaacaggugagguggcacccugaccgcuuccugcagcgguuuagaagucagauagaaaccugggaguuggggaggguuaugggagcugugacagcccucucucaggcacugaaccgacaugcggaggcuuuaaaauga

SEQ ID NO: 59678 - RNA, 1857 nt, Artificial Sequence
  derived and/or modified sequence opt3 from NFKBIZ__Homo_sapiens__NP_001005474
augggcguggggagacagcaaaggggacccuuccaggguguccggguuaagaacagcgugaaagagcugcuccuucacauccgcucccauaagcagaaagccucuggccaggcuguagacgauuuuaagacccaaggggugaauauugaacaguuccgagagcugaaaaacacagucucauacaguggaaagcguaagggcccugacagcuuguccgaugguccagcaugcaaaagaccggccuuacugcacucucaguuucuaacucccccucagacgccaacccccggggaaucgauggaggacgugcaucucaaugaaccuaagcaagagucaagcgcggaucugcuucagaacauaaucaauauuaaaaacgaguguaguccaguuucccugaauacagugcaggucucuugguugaaccccgugguaguuccucagagcuccccagcugaacaaugccaggacuuccacggaggccagguguuuucaccgccccaaaagugucagccuuuccaggucaggggcagucagcaaaugaucgaucaggccagccucuaucaguacucuccacagaaucaacauguggagcagcagccccacuauacucacaaaccuacccuggaauacuccccauuucccauuccgccucagucacccgcauaugagccaaaccuguucgacgggccugagagccaauuuugccccaaucagagucucgugucuuuacugggagaucagcgggaauccgagaacaucgccaauccaaugcagacaagcucgucuguccaacagcagaacgacgcucaucuucacuccuucucaaugaugcccaguagcgcaugugaagccaugguuggucaugagauggcuuccgauucuagcaauaccucauugccuuuuaguaacaugggcaacccaaugaauacuacacaacuggggaagucccuauuccaguggcaaguggaacaggaggagagcaagcucgccaacauaucucaggaccaguuucugucaaaagaugcggacggagacaccuuccuucacaucgcaguagcccagggccgcagagcucugaguuacguguuggccaggaagaugaaugcacuccacaugcuggauauuaaagaacauaacggucagagcgcuuuccaagucgccguggcggccaaucagcacuuaaucguucaggaccuggugaacauuggggcacaggucaauacgacugauugcuggggacggaccccgcuccaugugugugcugagaagggccacucccaaguacuucaggccauccagaaaggcgcuguugggucuaaccaauuuguggaccuggaagccacaaauuaugauggauugacuccccuacauugcgcagucauagcccacaacgcugugguccacgagcugcagcgcaaucagcagccucauucgccagaagugcaagagcuccugcuuaagaacaaaagccugguugacaccauuaaguguuugauccagaugggugcggcaguggaggccaaggaucgaaaauccggcagaacagcucuccaccuggccgcagaagaggccaauuuagaacugauuaggcuauuccucgagcugcccucaugccuuaguuuuguaaacgcuaaggccuacaaugggaacaccgcauugcaugucgcggcuucucugcaguaccggcucacgcagcuggacgccgugcgucuucugaugcgcaaaggagcagauccuagcacuagaaacuuggaaaaugagcaaccaguucaccucgugcccgacggcccggucggugagcagaucaggcggauccugaaggggaaauccauucagcagcgagccccuccauauuga

SEQ ID NO: 59679 - RNA, 3900 nt, Artificial Sequence
  derived and/or modified sequence opt3 from NFRKB__Homo_sapiens__NP_001137307
auggacagccuggaucacaugcucaccgacccccuugagcugggcccuugcggggauggacaugguacaagaaucauggaagacuguuuguuaggcgggacuagggugucccugccagaggaucuacucgaagacccggagauuuucuuugaugucguuucucugucaacguggcaggaagugcuuagugacagccaacgggagcaccuucagcaguucuugccccaguuuccugaggauuccgccgaacaacagaacgagcucauacuggcucuguucucuggagaaaauuuucgcuucggcaacccacuccauaucgcacagaaguuauuucgagacggucacuucaaucccgagguagugaaauaccgucagcugugcuuuaagucgcaauauaaaagauaccuuaacucacagcagcaguauuuccauagguugcugaagcaaauucuagccagccggagugaucuccuggagauggcgcgcagauccgggccugcccuuccauuuaggcagaaacggcccucuccuagccgcaccccagaagaacgagaauggagaacacagcaaagguaccugaaggucuugcgggaggugaaggaagaguguggagacacugcucucuccucagaugaggaagaccugaguagcugguuaccgucuucccccgcacguucaccuagcccagccguuccccugcgcguggucccuacccucaguacaaccgacaugaaaacugcugauaagguggagcuuggcgacucugaucugaaaaucauguugaagaaacaccacgaaaagagaaagcaucagccagaccaccccgaucuacugacaggcgaccucacccugaaugauauuaugacgaggguaaacgcagggcggaaaggaucccuugccgcucuguaugacuuggccguucucaagaaaaaggugaaagagaaggaagagaaaaagaagaaaaagaucaaaacuauaaagagcgaggcggaagaucuggcagagccguuaucgucuaccgaaggugucgccccucugucccaggcucccucaccacuagccaucccugcaauuaaagaggaaccccucgaggaccugaagccaugccuuggcaucaaugagauuaguagcuccuucuuuucuuugcugcucgaaauccugcuucuggagagccaggcuucauugcccaugcucgaggagcgagugcuggauuggcaaaguuccccugccagcucuuuaaacucaugguucagugcggccccaaauugggcagagcuggugcuaccggcucuccaguaccuggccggggaaagccgcgcuguccccuccucuuucucgccuuuuguugaguucaaggaaaagacacagcaguggaagcuguugggacaaagccaggacaacgagaaagaacuggccgcacucuuucagcugugguuagagacuaaggaccaggccuucuguaaacaagagaaugaagauuccucagacgcuaccacaccagugcccagaguaaggaccgauuaugugguccggccuaguacgggcgaggaaaagcgcguguuucaggagcaggaaagauacagguacucucagccacauaaggcguucacuuuucguaugcacgguuucgagagcguuguggggcccgucaaaggaguguuugacaaggagacaucccugaacaaagcacgggaacacucacuuuugcgaagcgauagaccggccuauguaaccauacucucucugguuagggacgcugccgcacgccuaccuaauggcgagggcacucgggccgaaauuugcgagcugcucaaggauucccaauuccuggcuccagacgugacaaguacccaggucaacacgguggucagcggggcccuugauagauugcauuacgaaaaagaccccugugugaaguaugauaucggaaggaagcuguggauuuacuuacaccgcgaccgaucugaggaggaauuugagcggauccaucaggcacaagcggcugccgcaaaagcccguaaggcucuccagcagaaaccuaagcccccauccaaaguuaagucaaguagcaaagaaucguccaucaaggugcugucuagcgguccuucagagcagagucaaaugucccuuucugauagcuccaugcccccaaccccgguaacaccugucacucccaccacaccagcccugcccgcaauuccuauaucaccacccccugugagcgcuguuaauaagaguggcccgucuacuguguccgagccagccaaaagcucgucaggggucuugcucgugucuagucccaccaugccucaccugggaacaaugcuauccccagcgagcucucagaccgcccccagcucccaggcugcagccagaguagugucacauaguggcagcgcuggucugucucagguuagggucguggcccaaccuucccucccggcagugccccagcagucagggggcccagcgcagacucugccucaaaugcccgccggaccacagauccgcgucccugcuacggccacacagaccaagguugugccccaaacugugauggcaaccguaccagucaaagcucagacaaccgccgcaacugugcagcggccgggcccugggcagacaggacuuacgguuaccaguuugcccgccacugcuagcccaguguccaagcccgcgacaucuucgccugguaccagcgccccaucagcauccacagcugccgucauucaaaacgugacuggccagaacaucauaaaacagguugccauuaccgggcagcugggagugaagccccaaacgggcaauaguaucccuuuaaccgcuacaaacuucagaauccaggguaaggacguacucaggcugccgccaucuagcauuacuaccgacgcaaaagggcagacaguccuucgaaucacucccgauaugauggccacccuggcgaagucccaggugacgacagugaaacuaacccaagaccucuuuggcacuggaggcaauacaaccgggaagggaauuucagcuacucugcacgucaccucuaacccuguucacgccgcagauagccccgccaaagcuaguuccgcaagcgccccaucuucaacaccuacggguaccacugugguaaaggugacacccgacuugaagccaaccgaagcguccaguagcgcuuuccgccugaugccugccuuaggcgucucgguggcagaucagaaagggaagucuacaguugccuccagcgaggcuaaaccggccgcaacuauacggaucgugcagggacucggcgucaugcccccaaaggcuggucagaccauuacgguggccacacaugcgaaacaaggggccucaguugcaaguggcucuggaaccgugcacacuuccgcugucagccugccuucaaugaaugccgcuguaaguaagaccguggcaguugccagcggcgccgcuuccacacccaucucuaucagcacuggggcgccaaccgugagacaggucccuguguccacaacgguagugucaaccucucaggcaggaaaacuucccacuaggauuacagucccgcugaguguuauaucgcaaccaaugaaaggcaagagcguggugaccgccccuaucauuaaagguaacuugggggcuaaucucuccggacugggccguaacaucauucuaacuacaaugcccgccgguaccaagcugaucgcaggcaauaaaccagucucuuuccuuacggcccagcagcuccagcaacugcagcagcaggggcaagcuacucaggugcgcauacagaccguucccgcgucacauuugcagcaaggaacagccagcggcuccaguaaggcaguaucuaccguggucgugacuacagcuccuagcccgaaacaggcccccgaacagcaauga

SEQ ID NO: 59680 - RNA, 1221 nt, Artificial Sequence
  derived and/or modified sequence opt3 from NFS1__Homo_sapiens__NP_001185918
augcugcucagagccgcuuggaggcgggcagccguggcggucaccgcugcccccggcccuaagccagcagccccgacacgcgggcuucgacugcguguuggagacagagcuccccagagcgcagugccugccgauacugcugccgcgccagagguaggucccguguugaggccuuuauacauggacguccaagcaacgaccccacuggauccccgggugcuagacgccaugcucccuuaucugaucaacuacuauggcaauccacacucccgcacacaugcuuacgggugggaaucugaggccgcaauggaaagagcuaggcagcagguugccucacuuauuggagcggauccgcgggagauaaucuucaccaguggcgccaccgaaagcaacaauauugcaaucaaagagcuggaggcugccauucagcccgacacauccuuggugucugucaugaccgugaacaaugaaaucgguguaaagcaaccuauagcugagaucgggcgcauuugcucgucacgaaaaguuuauuuucacacugaugccgcacaggccgugggaaagaucccacucgacgucaacgauaugaaaauugaccugaugagcaucaguggccauaagauauacggccccaagggggugggagcuauuuauaucagaaggcggccucgugugcgcgucgaagcgcugcaguccgguggcgggcaggagagaggaaugaggucuggcacaguuccaacuccccucgugguagguuuaggggcagccugugagguggcucaacaggaaauggaguacgaucacaaacggauuagcaagcuguccgaacgacuuauccagaauaucaugaaaucauugccggacgucgugaugaacggagauccuaagcaucacuaccccggcugcauuaaucugaguuucgccuauguugagggcgaaagccuacucauggcacugaaagacguggcccuuucuuccgggucagcuuguacgagcgccagucuggagccaucuuacgucuugcgcgcaauaggaacugacgaggaucucgcgcacuccagcaucagauuugguauuggcagguucaccacagaagaggaaguggacuauacuguagagaagugcauccagcauguuaagcggcugcgcgaaaugucgccuuuaugggagauggugcaagaugggauagaccugaaaucuauuaaguggacccagcacuga

SEQ ID NO: 59681 - RNA, 765 nt, Artificial Sequence
  derived and/or modified sequence opt3 from NFU1__Homo_sapiens__NP_001002755
auggccgcuaccgcaagaaggggcuggggagccgcggcuguggccgcagggcugcggcgccgauucugccacaugcucaagaaccccuacacaaucaaaaagcagccucuucaucaauuuguccagcguccacuguucccguugcccgccgcuuuuuaucacccuguuagauacauguucauucagacucaggacacgccaaaucccaacagcuuaaaauuuauaccugguaagccagugcuggagaccaggacaauggauuuccccacuccugcagccgcuuuucgguccccacuagcccgccaacucuucagaaucgaaggcguaaaaucuguguuuuucgggccggacuuuauuaccgucacaaaggagaaugaggaacuggauuggaaccuucugaagcccgacaucuaugcgaccauuauggauuucuuugcaucaggauugccucucgugacugaagagacaccaaguggcgaggccgguagcgaagaggacgaugaaguuguggcuaugaucaaagagcugcuggacaccaggauacggcccacgguccaggaggaugggggagacgugaucuacaagggcuucgaagauggcauuguacagcucaaauuacagggguccuguacuucuugcccuucgucaaucauuacccugaagaauggaauccaaaacaugcuucaguucuauauaccagagguugaagguguggagcaggucauggacgaugaaagcgacgagaaagaggccaauagucccuga

SEQ ID NO: 59682 - RNA, 1044 nt, Artificial Sequence
  derived and/or modified sequence opt3 from NFYA__Homo_sapiens__NP_002496
auggagcaguacaccgccaacagcaauuccucuacagaacaaaucgugguccaggcuggccagauucagcaacagcagcaagggggaguuacugcagugcagcugcagacggaggcccagguagcgucagcuaguggucagcaagugcagacccuccaggucgugcaaggccagccccuuaugguucaggugagcgggggacagcugauaacauccacuggccaaccuaucaugguccaggccgugccaggugggcagggacagaccauuaugcaaguaccgguuucuggcacacagggcuugcagcagauccaauuagugcccccugggcagauucagauccagggaggucaagcaguccaggugcagggccaacaggggcagacccagcaaauaaucauucagcagccacagacugccgugacagcuggacaaacccagacgcagcagcaaaucgcaguccagggccagcaaguugcccagacugcugaaggucagaccauuguguaucagcccguaaacgccgacgggacaauccugcaacaggugacugucccugugucgggaaugauaaccauuccagcggcaucacuagccggcgcucagaucguucagacaggcgccaauaccaacacgacuagcagugggcaaggaacagugaccgucacucuccccguggcagguaauguaguuaacuccggcgggauggugaugauggucccuggagcuggcucugugccagccauucagagaaucccgcugcccggugcggagaugcuugaagaggagccucuguacgucaaugccaagcaguaucacaggaucuugaaacggcgccaggcacgagcuaagcucgaagccgaggggaaaauuccaaaggaacguagaaaauaccugcaugagagcaggcaccggcaugcuauggcccgcaagagaggcgagggaggcagguucuuuucccccaaggaaaaagauucaccucacaugcaagacccaaaccaggcagaugaggaagccaugacacagauaauccgggugaguuga

SEQ ID NO: 59683 - RNA, 624 nt, Artificial Sequence
  derived and/or modified sequence opt3 from NFYB__Homo_sapiens__NP_006157
augaccauggacggcgauagcuccacaacugacgccucucagcuggggaucucagcugauuacauuggagguagucacuaugugauacaaccccaugacgauacggaagacagcaugaacgaucacgaagacaccaauggcuccaaggagucuuucagagaacaggauaucuaccucccuauugcaaacgucgccaggaucaugaaaaaugcgauuccacagacagggaagaucgcuaaagacgccaaggagugcguucaggaaugugugucggaguuuauaucauucaucacuagcgaggcaagugaacggugccaucaagagaaacgcaagaccauuaacggagaagauauccuuuuugccauguccacacugggcuucgacucuuauguagagccguugaaguuauaccugcagaaauuucgagaggcuaugaagggugaaaaagggauuggaggcgcagugaccgccacugauggccuaagcgaggaacucacagaggaggcuuucaccaaucagcugcccgccgggcuuaucacgacugacggacagcaacagaacgucaugguguauaccacauccuaccagcagauaucagguguucaacagauucaguuuaguuga

SEQ ID NO: 59684 - RNA, 1284 nt, Artificial Sequence
  derived and/or modified sequence opt3 from NFYC__Homo_sapiens__XP_011539819
augagcaccgagggcggguucggagguacauccucuucagacgcccagcaaagucugcagagcuuuuggcccagagugauggaagagaucaggaaccucacugucaaggauuuccggguucaggaacuuccucuggcucgcauuaaaaagauaaugaaauuggacgaggaugugaagaugaucuccgcagaagccccaguauuauuugcgaaagcugcccagauuuucaucacggagcugacccuacgagcauggauucacacagaggacaauaagcguagaacucuccaaaggaacgauaucgccauggcuauaaccaaguuugaccaguucgauuuucugaucgacauugugccgcgggaugaacuuaaacccccuaagcgccaggaggaagucagacagucugugacaccagcagagcccguucaauacuauuucacccuggcccagcagccuacugcugugcagguccaaggccagcagcaagggcagcagacaaccucgucaacgacuaccauccagccaggacaaauuaucauagcccagccccagcagggccaaacaacuccugugaccaugcagguaggugaggggcagcagguucaaauugugcaggcgcagccacagggacaagcacagcaggcccaaagcggcacaggccagaccaugcaggucaugcagcaaaucauuacgaauacuggggaaauccagcagaucccggugcaguugaacgcuggacaacuccaguacauuaggcuggcccagcccgugagugguacacaggucguucaaggccagauacagacccuggcaacuaaugcucaacaggggcagcggaacgccucccagggaaaaccucgccgaugccucaaggagacauuacaaaucacccagacggaagugcagcagggccaacagcaguuuucucaguucaccgacggucaaagaaauagcguacagcaggcgaggguguccgagcugacaggggaagccgagccacgggaggucaaagcaacuggaaacucaacccccuguacaaguagccuuccuacuacccauccacccucucaccgugcuggcgccuccugcguguguugcucacagccgcaacagagcaguacaucuccucccccauccgaugcuuugcaguggguuguggucgaacaacuguaucagauucaacaggugaccaugccugccggccaggaccuagcacagcccauguuuauccagagcgccaaucagccaucggaugggcaagcuccccagguaacuggagacuga

SEQ ID NO: 59685 - RNA, 456 nt, Artificial Sequence
  derived and/or modified sequence opt3 from NGB__Homo_sapiens__NP_067080
auggagagacccgaaccugagcugaucaggcagagcuggcgggccgugucccgcucuccacucgaacacggcaccguccuuuucgcucgacuguuugcauuggagccggacuuacugccccuauuccaauacaacugccgucaguuuucaaguccugaagauugucucagcuccccagaguuccuggaccauauuagaaagguuaugcuugugauagaugccgcgguaacaaauguggaggaccugucuucguuggaagaguaucucgcuucacuggggaggaaacaccgggccgucggagugaagcugagcaguuuuuccacuguuggugaaucucucuuauacaugcuggagaaaugccuuggccccgcauucacgccugccacccgcgcugcauggagccaguuguauggggccgugguccaggcuauguccagaggaugggauggcgaguga

SEQ ID NO: 59686 - RNA, 948 nt, Artificial Sequence
  derived and/or modified sequence opt3 from NGDN__Homo_sapiens__NP_001036100
auggccgcucugggcgugcucgagagcgaccuucccuccgcagucacccuguugaagaacuuacaggaacaaguuauggccgugacagcgcagguaaaaucucugacucagaaggugcaggcuggggccuacccuacggagaaaggacuaucauuccucgaagucaaggaucaacugcuucugauguauuugauggaccucacccaccugauccuggauaaagcaagugguggcagccuccaggggcaugacgccguguuaagacugguugagauuaggacagugcuugaaaaguugcggccacuggaucagaagcuaaaauaccagauagacaagcucaucaaaacugcugucaccggaucccugucugagaaugauccgcuucgcuuuaagccccacccuucgaacaugaugucaaaacugagcagugaggacgaagaggaagaugaggcagaggacgaucaauccgaagccucuggcaaaaagagcgugaaggguguauccaagaaauauguuccaccccgauuggugccuguccauuacgacgagacagaagcugagcgugaaaagaaaagacucgagagggccaagcggcgcgcgcugucaaguagcgugauuagagaguuaaaagaacaguauucugaugcaccagaggaaaucagggacgcccggcacccccaugugacccgccagucccaggaggaccaacaccgaauuaauuacgaagagucaaugauggucagacugagcguuaguaagagggagaaggggcggcguaaacgcgcuaacgugaugucuucccagcuccacagccuuacucauuucucggauaucucugcccugacaggaggcaccguacacuuggacgaagaucagaauccuauaaagaaaagaaagaaaaucccacaaaagggcaggaagaaaaagggguuucggcgacgcagauga

SEQ ID NO: 59687 - RNA, 1857 nt, Artificial Sequence
  derived and/or modified sequence opt3 from NGEF__Homo_sapiens__NP_001107562
auggagcugcucgccgcugcauucagcgccgcgugcgcuguggaccacgauuccucuaccucagaaagugacgccagagauagcgcagccggccaucuucccggguccgagucuucgucaacaccuggaaacggugcuacuccagaagaguggccggcacuggccgacagccccacgaccuugacagaggcuuuaaggaugauccacccuauuccagccgauaguuggcggaaucugauagagcagaucggccuacucuaccaagaguaucgcgacaaguccacucugcaggaaauugagacccgacgucagcaggaugcggaaaucgaggacaacacaaaugggucucccgcaagcgaggauaccccugaagaggaagaggaagaggaggaagaggaagaaccagccagucccccugaaagaaaaacucuuccacaaauuugucuguugucaaacccgcauaguagguuuaaucucuggcaggaccugcccgagauccggagcucuggaguccuggagauacuccagccugaagagaucaaguuacaggaagcuauguucgagcugguuacauccgaagccucauacuauaaaagccuuaacuugcuggugagucacuuuauggagaaugagcgcauuagaaagauccuacauccaucugaagcacacauucucuucuccaacguacuggaugugcuugcugucagcgagagguuucuguuggaacucgagcaccggauggaggaaaauaucgugauaucggacguuugcgauauuguguaccgcuaugccgcggaccauuucucugucuacaucaccuauguguccaaccaaacguaccaggagcgaacuuacaaacagcuguuacaggaaaaggccgcauuuagagagcugauugcucaacucgaacuugaccccaaguguaggggccugccuuucucauccuuuuugauccuaccauuccagcggaucacccgucugaaacuccugguacagaauauucuuaagcgcguugaggagagaagcgaaagggagugcacagcccuggaugcucacaaagaauuggagaugguggucaaggccuguaacgaaggugugcggaaaaugucccgaacugagcaaaugauaucuauccagaagaagauggaguuuaaaauuaagagcgugcccaucauaucacauagucgcuggcuccugaaacagggggaauuacagcaaauguccggaccgaagaccagcagaacacugaggaccaaaaagcuauuccacgagauuuaucucuuucuguucaaugaccuuuuggucaucugccggcagaucccuggcgauaaauaccagguuuucgacucugcaccccgcggccugcucagaguggaggaacuggaagaucaggggcaaacgcuugccaacguauuuauucugagguugcucgagaaugcugacgaucgugaggcgacuuauaugcugaaggcaucaagucagagcgaaaugaagcgguggaugacauccuuagccccaaaccgaagaaccaaauucgugucuuuuacuucgaggcugcuagacuguccucagguccagugcgugcaccccuacguugcucaacagccagaugagcucacacuggaacuugccgacaucuugaacauucuggauaagaccgacgacggauggauauucggugagcgccuccaugaucaggagcggggcugguuucccagcuccaugacggaagagauccugaauccuaaaauuagaucacagaacuuaaaggaauguuucagggugcacaaaauggacgauccacaacgcagucagaauaaggaccgacggaagcuggggucucguaacagacaguga

SEQ ID NO: 59688 - RNA, 891 nt, Artificial Sequence
  derived and/or modified sequence opt3 from NGF__Homo_sapiens__XP_011539820
auggccagcuccaauggccacuucaaugaggugcuggcuucugggagagcaguccagggagccgguuggcaugcgggccccaagcucucaagugcuagcgggccuaacaauuccuuuaccaaaggagccgcauucuacccaggccacacagaaguucauucugugaugucgaugcuguuuuauacucuuaucacggccuucuugauugguauacaagcugagccgcacucagaaagcaacguacccgcagggcauaccaucccucaggcccacuggacaaaguuacagcacagucuggacacugcucuaaggcgggcccgcuccgcgccagcagccgcuauugccgcacgaguggcuggacagacccguaauaucacagucgaucccagacucuuuaaaaagaggcggcugcgcucuccuagagugcuuuucagcacccaaccacccagggaggccgcggacacucaggaucuggacuuugaaguuggcggcgccgcaccuuucaaccggacacaucgcuccaaacgaucaaguagccacccaauuuuucauagaggggaguucucugugugcgauuccgucucaguguggguaggagacaagaccacggcuacugauaucaaggguaaagagguuaugguguugggcgaagucaauauaaacaauagcguguuuaagcaguacuucuuugagaccaaauguagggacccgaaccccguggauagugggugccggggaaucgacucuaagcacuggaacuccuauuguacaacuacccacacauucgucaaagcccucaccauggauggcaagcaggcugccuggcguuucauucgcaucgacacggcaugcguuugugugcugagcagaaaggccguaaggcgggcuuga

SEQ ID NO: 59689 - RNA, 576 nt, Artificial Sequence
  derived and/or modified sequence opt3 from NGFRAP1__Homo_sapiens__NP_001269603
auggccguggcuggcgggggaaagggugagauccugcuccacuggcccccuaaacuuggcggggaacugggaggcgacgcaagaccaagcagggauccggaguugcaguccgacgccgcguucggugcugucguuacccgggugugguuacccgccccucgcugcccagaacuagggggacuggcauuuggccccggcaagucuggggccgagaaacaaccugaaaagaaaaaccucauuauggcuaauauacaucaggagaacgaggaaauggagcagccaaugcagaauggagaagaggaucgaccccuggguggcggggagggacaccaaccugcaggcaaccguagaggucaggccaggcggcuugcuccaaauuuccgcugggccaucccgaacagacagauuaaugacgggaugggaggcgauggcgacgauauggaaaucuuuauggaggaaaugagggagauucggcgcaagcugcgagaauugcagcucagaaacugucugaggauccugaugggggagcucucaaaucaucacgaccaucacgaugaguucugcuuaaugcccuga

SEQ ID NO: 59690 - RNA, 1284 nt, Artificial Sequence
  derived and/or modified sequence opt3 from NGFR__Homo_sapiens__NP_002498
augggcgccggggcuaccgguagagcaauggacggacccaggcugcuccuucuguuguuacugggcgugagccuagggggagccaaggaggcgugcccuacaggccucuacacucacuccggugaauguugcaaggcuuguaaccugggggagggagucgcccagccaugcggcgcaaaucaaacgguuugugaaccgugccuugauucugugaccuucucagacguagugagugccacagagcccuguaagccuugcacugaaugugucggccugcagagcauguccgcuccaugcguggaggcagaugacgccguuugucggugcgcuuauggguacuaucaggaugagaccacaggacgcugcgaagccugucgagugugcgaggcggguucuggcuuggucuuuucgugucaggacaaacaaaacaccgugugcgaagagugucccgaugggacuuacucagacgaggcaaaucauguagauccuugccucccauguacaguuugcgaagacaccgagcgucagcugagagaauguacgaggugggccgaugcugagugcgaagagauccccggacgguggauuacucgcagcaccccuccagagggcagugacuccacagccccgucuacucaggaacccgaggcaccuccagaacaggaucugauagcuagcaccguggccggugucgugacaaccgugaugggguccucacaacccgucguuacgagaggaacuacagacaaccucaucccuguguauuguaguauuuuagcggccguaguggucggccugguggcauacaucgcuuucaagagguggaauagcugcaaacagaacaagcagggcgccaauucucggccaguuaaccagaccccuccgccugagggggaaaaacuucacuccgacucaggaauuagcguggauagucaaucuuugcaugaccagcagccccacacucaaacagcuuccggucaggcccugaaaggcgaugggggacuauauagcucgcucccacccgcaaagcgcgaggaggucgaaaaacugcuuaauggcucugccggugacaccuggcgacaucuggcuggggaguugggcuaccagcccgaacacaucgauuccuuuacgcacgaggcgugcccagugagagcacuccuggccucaugggcuacccaggacagugccacauuagaugcacugcucgccgcucuuaggcggauacaacgugccgaccugguagagagcuuguguuccgaaucuacugcaaccagccccguuuga

SEQ ID NO: 59691 - RNA, 1911 nt, Artificial Sequence
  derived and/or modified sequence opt3 from NGLY1__Homo_sapiens__NP_001138765
auggccgcugcagcccugggcagcuccucugggucagcgagucccgcuguggccgagcucugccagaacaccccugaaacauuccuugaggcaagcaagcuguuguuaacuuacgccgacaauauccugagaaacccaaaugaugaaaaauauagguccauucggauaggaaacacggcuuuuucuacccgccuacucccgguccgaggugcaguugagugucuguucgaaaugggcuuugaggagggggaaacacaccuuaucuuccccaagaaagccucgguggagcaacugcagaagauucgugacuugaucgcuauugaaagaucaagcaggcucgauggaaguaauaaaucccauaagguaaagucuagccagcagccugccgcguccacucaacugccaaccacacccucaaguaacccuagcggccugaaucagcacacccggaaccgccagggucagucuuccgacccacccucagcaagcacuguggccgcugauagugccauccucgaggucuuacaaucuaauauacagcaugugcugguuuacgagaacccugcacuucaggaaaaggcuuuggccugcaucccagugcaggagcugaagagaaaaucccaagaaaagcuaagcagggcgcggaaacucgacaaggggauuaauaucucggaugaggacuuucugcuucuggaauugcuccacugguucaaggaggaguuuuuccauugggucaacaaugugcuguguucuaaaugcggaggccagacacgcucccgagauagaucauuacugccgagugacgaugaacucaaguggggcgccaaagagguagaagaccacuauugugaugcaugccaguuuagcaacagguucccccgguacaauaacccugagaaacuucuggaaacccguugugggcgcugcggagagugggcuaacuguuuuacguugugcuguagagccguugguuucgaggcuagguaugugugggacuacacugaacuacaacggacccugucccucaaacugacaacucuuaaggagauuggcaaaaccuuucugcgaaucucuaagcgccagaaguugauacaggucguggacgugacauggagauauagcugcaaacacgaagaggucauugccaggcggaccaagguuaaagaagcacuccugcgcgauacgaucaauggguuaaacaagcagagacaacuguuccuaucagagaauaggcguaaagagcuccugcagcggauuaucguggaacuuguagaguucaucaguccaaagacucccaagccuggagaauugggcggucgaauuuccgggagcguggccuggagagucgcuaggggagagaugggccugcagcgcaaagagacacucuuuauaccaugcgaaaacgagaagaucucuaaacagcugcaucuuuguuacaauauugugaaggaccgguacguuagagugucaaacaauaaccaaaccaucaguggcugggaaaauggggucuggaaaauggagagcauauucaggaagguggaaacugauuggcacaugguauaucuggcgcgcaaggagggauccucuuuugcauacauuucguggaaauucgagugcgguagcguuggcuugaagguggacuccaucucaauccgaacaaguucucagaccuuucagacggggaccgucgaauggaaacuccggagcgauacagcccagguggagcugacuggagacaacuccuuacauucauaugcugauuucagcggcgccaccgaagucauucuggaggcagaacuaucucguggugacggggauguggccuggcaacacacacagcucuuuagacagucccugaaugaccacgaggagaacugucuugaaaucauuauaaaguucagugauuuguga

SEQ ID NO: 59692 - RNA, 900 nt, Artificial Sequence
  derived and/or modified sequence opt3 from NHEJ1__Homo_sapiens__NP_079058
auggaggaacuggagcagggccuccuuaugcaacccugggccuggcugcaguuggcugaaaacagcuuacuggcaaagguguucaucaccaaacagggguacgcccuacucgucuccgaccugcagcaaguuuggcacgaacagguggauacaucuguagugucacagagagcgaaggagcuuaauaaaaggcugacugcuccuccagccgcauuuuugugccaucucgacaaccugcugcggccgcucuuaaaggaugccgcucaccccagugaggcaacguucagcugugacugcgucgccgaugcucugauucuucgcgugcgauccgaguugucuggacugccuuuuuauuggaauuuccauuguaugcuagccucgccaucacucguuagccagcaccugauacguccccuuauggguaugagucuggcguugcaaugccaggugagagaacucgcaacccuguuacauaugaaagaccuggagauccaggauuaccaggaauccggcgccacacucauuagggaccggcuuaagacugagccuuuugaggaaaacucuuuccuggagcaauuuaugaucgaaaaguugccagaggcuuguagcauuggggauggaaaacccuucgucaugaaucuacaggaccuguauauggccgugaccacacaggaaguacaaguuggccagaagcaccagggugcaggggauccucacaccuccaacucagcuagucuccagggaaucgacagccaaugcgugaaucagccagagcagcuggucucuuccgccccgacucuuucagcgcccgagaaagaaagcacaggcaccaguggcccucugcagcgcccacaauugucuaaggugaaaagaaagaagcccagggggcucuuuuccuga

SEQ ID NO: 59693 - RNA, 402 nt, Artificial Sequence
  derived and/or modified sequence opt3 from NHLH1__Homo_sapiens__NP_005589
augaugcugaacagcgacaccauggagcucgaucuucccccuacacacuccgaaacugagucuggcuucucagacugcgggggaggugccggcccagauggggcuggaccgggcggucccgggggaggccaggcaagaggcccugaaccaggggagcccggaaggaaggaccugcaacauuugagucgggaggaacgccgacguagaaggcgggccacggcgaaauaccgcaccgcucacgccacaagagagaggauccggguggaagcauuuaauuuagccuucgcugagcugcgcaagcuacucccuacucugccacccgauaaaaagcugagcaaaauugaaauacuucgauuggcaaucuguuauauuuccuaccucaaccauguccuggacguuuga

SEQ ID NO: 59694 - RNA, 1188 nt, Artificial Sequence
  derived and/or modified sequence opt3 from NHLRC1__Homo_sapiens__NP_940988
auggccgcugaggcaagcgaauccggccccgcccugcacgagcucaugagagaagcggagaucucucuucuggaaugcaagguguguuucgagaaauuugggcauaggcagcaacggcgcccucgaaacuugucaugcggacacgucguuuguuuagcuugcguggccgcacuggcccauccacguacccuagcucucgaguguccguucugcagaagggcaugucgggguugcgacacaagugauugucugcccguacuucaccugauugaauugcucggcagcgcccugcgccaguccccugcugcccauagagcggcaccaucugcccccggggcucugacuugccaccacacguuuggaggcugggguacccucgugaauccuacaggguuagcccuguguccaaagacuggaagggucgugguugugcaugacggccggcgccgagucaaaauauucgauucgggcgggggaugcgcacaccaguuuggugagaagggcgacgcugcccaggauaucagauaccccguggacguaaccauuacaaacgauugccauguuguggucaccgacgcgggggauaggucaaucaaaguguucgacuuuuucggacaaauuaaacuugugaucggcggucaguuuagcuugccuuggggagucgaaacuacaccacagaaugggauaguugugaccgaugccgaggcaggcagucugcaccuacucgacguagauuucgcugagggcgugcugcggcguacggaacgccuucaggcccaccuguguaacccgagaggggucgcuguguccugguugacuggagccaucgcaguucucgagcauccccuggccuuagguaccggcgugugcucuacaagggucaagguguuuagcuccucaaugcaacugguagggcagguugacacuuucggacucagucuuuauuuuccuagcaagauuaccgcuucugcggugacauucgaccaccagggcaaugucaucguggcagauaccuccgguccagccauucuguguuuggggaagcccgaagaguucccugucccaaaacccauggugacgcauggccuaucacacccgguugcucugacuuuuacaaaggaaaacagccuccuggugcuugacaccgccagucauucuaucaaaguauacaaggucgauuggggauga

SEQ ID NO: 59695 - RNA, 1044 nt, Artificial Sequence
  derived and/or modified sequence opt3 from NHLRC3__Homo_sapiens__NP_001012772
auggccagauucugggugugcgucgcuggcgcaggguuuuuccuggccuuucucguucuucacagcagguucuguggaucccccgugcugcggaacuuuaccuucgcgguaucuuggcgcacagagaagaucuuguaccgauuagacguggguuggccuaaacauccagaauauuuuacuggcacgaccuucugcgucgcuguggauucacugaaugggcuaguuuacauuggacagcguggcgacaacauaccgaagauccucguguuuacagaggaugguuauuuccugagagccuggaauuacacugucgacacaccccacgggauuuuugcagccaguacccuuuaugaacaaagcguguggaucaccgauguaggauccggcuucuuuggccauacuguuaaaaaguacucuucguucggggaccuggugcaggucuugggaacaccugguaaaaagggcaccucacucaacccacugcaguucgauaaucccgcugagcuguauguggaagacacgggggauauuuacaucguggacggagauggcggucucaacaauagguuaauaaagcugagccaggacuuuaugauccuuugguugcacggggagaacggaacuggcccugcaaaauucaauauuccacauagugucacccuggauuccgccggccggguuuggguggcugaccgcgggaacaagagaauccaaguauuugacaaagauacaggagaguggcuaggugccuggaauaacuguuucacugaagagggccccucuagcgugagguuuaccccugacgggaaguaccucauugucgcgcagcugaaucuuucccggcugucagugguugcagccccaccggugggaaguaucggcgaaugcagcgucauaucuacaauucaguuggcugaucaggugcucccccaccuguuagagguagaccgcaaaaccggugccguuuauguggcagagaucggggcuaagcaaguccagaaguacgugccucugaacuccuaugucccaucauucggcagcuga

SEQ ID NO: 59696 - RNA, 273 nt, Artificial Sequence
  derived and/or modified sequence opt3 from NHP2__Homo_sapiens__NP_001030005
augaccaagaucaaagccgaccccgauggcccugaggcucaggcagaagccugcagcggggagagaacauaccaagaacugcucgugaaccagaauccaauugcgcagccgcuugcuuccaggcggcugacucgcaaguuguauaaauguauaaagaaagccgucaagcagaagcaaauccgacguggaguuaaagaggugcagaaguucguaaacaaaggugaaaagggcacgugggugcagccccaggcaccuucugccccacccgucuga

SEQ ID NO: 59697 - RNA, 387 nt, Artificial Sequence
  derived and/or modified sequence opt3 from NHP2L1__Homo_sapiens__NP_004999
augaccgaggccgacgugaaccccaaggcuuacccucuggcagaugcccaccucacaaagaaacuucuggacuugguccagcaaagcugcaauuauaaacaguuaagaaagggcgcgaacgaagcuacuaaaacgcugaauagggggaucuccgaguucauuguuauggccgcagaugccgaaccacuagagauaauccuccaucugccgcuucugugugaagacaagaacgugcccuacguauuugugcggucuaagcaggcuuugggacgcgcaugcggugucucacgaccugugauugccuguaguguuaccaucaaagagggcagccagcucaagcaacagauucaguccauccagcaaucuauagagcgucugcugguguga

SEQ ID NO: 59698 - RNA, 4425 nt, Artificial Sequence
  derived and/or modified sequence opt3 from NHS__Homo_sapiens__NP_001129496
auggcccuggcuugcuguaugcccaagaacgcagccgugagcaaucucgacaucgaguccaaacuuucugucuacuauagagcgccuuggcaccagcaaaggaacauuuuccugccagcuacccggccgcccugcguugaagaguugcaucgccacgcccgacagucauuacaggcacugcguagagaacauaggagucggagcgaucgcagagagcagagggccgcugcaccucuauccauagccgcuccaccccucccugccuacccacccgcgcacucucaacggcgccgagaauuuaaggacagacauuuccugacauuuaauucgacuaggucaccuagcccaacggaguguugccacaugaccccguggagucggaaaucccaucccccugaggaugaagacacagaugugaugcuuggccagcguccaaagaaccccauccacaauauuccuucuacucuggacaaacagaccaacuggagcaaggcauugccacuccccacaccggaggaaaagaugaaacaggaugcccaaguaaucuccucauguauuaucccuauaaaugugaccggggucggauucgaccgcgaggcuaguaucagaugcagccuggugcacucucaguccguucugcagaggcggcgaaagcuccgcagaaggaaaacuauuucagguaucccccggcgcgugcagcaagagauugauagcgacgaaaguccagucgccagagagaggaacgugaucguacauacaaauccugaucccucuaacaccguuaaucguauauccggcacgcgggacagcgaaugucagacugaggauauuuuaaucgcagcuccaucgcgaagaaggauucgcgcccagcgggggcaaucuaucgcggccucccugucacacagugcaggaaacaucagcgcucuugccgacaagggcgacaccauguuuacacccgcuguguccucuagaacuaggagccgcucauugccucgagaagguaaucgugggggagaugccgagccaaaagucggcgcaaagccgagugccuaugaggaaggcgaguccuucgugggggaccacgaacggacccccaacgauuuuagcgaggcuccuucuucaccaagugcgcaggaccaucagcccacacugggacuagcaugcagccagcaccuccauuccccucaacacaagcugucugaaagagguaggucgcgccuuagccggauggccgcugauuccggcucaugugacauuaguucuaauagcgauaccuucggguccccaauacauugcaucucaacggccggagugcuguugagcucucacauggaccagaaagaugaccaccaguccaguagcggcaacuggucugguuccucaaguacuugucccagccagacaucggagaccauuccgccugcagccuccccaccccucacugggucuagccauugcgauucagagcugaguuuaaacacagcuccucacgccaaugaagacgcauccgucuuuguuaccgagcaauacaacgaccaucuggauaaggugagaggacacagggcuaauucuuucacgagcaccguagcggaccuccuugaugaccccaacaauuccaacacaucagauagcgaauggaauuaucugcaccaucaccaugacgccaguugccgacaggauuuuucuccagagcgcccuaaagcagacuccuugggcugucccagcuucacuucgauggccaccuacgauucauuucuagaaaagucuccaagugacaaagcugauacauccagccacuucucuguggacacugagggcuauuacaccagcaugcauuucgauugcgggcugaagggaaacaaauccuacgucugucacuaugccgcacucgguccggagaauggccagggggugggagcuucaccuggccugcccgacugcgccuggcaggacuaccuugaucacaagcggcaagguagaccaaguaucagcuuuaggaagcccaaagcgaagccuacaccacccaaacguucuuccucacugcgcaagagugacgggaacgccgauauaagcgagaaaaaggagccuaagauuuccucuggccagcauuugccgcacucgagccgggaaaugaaacucccacuggacuucgcuaauacccccucaagaauggagaacgcaaauuuaccuacuaagcaggagccauccuggaucaaccagagugaacaaggaaucaaagagccccagcuggaugccucugacauuccuccguuuaaggaugaaguugcugagagcacgcauuaugccgaccuauggcuccugaaugaucuuaaaacaaacgaccccuacagguccuugucaaacucuagcaccgcaacuggcaccacagugaucgaauguauuaagaguccagaguccagcgagucucagaccucacaauccgaaagucgagcgacuacaccuagccugcccucggucgauaaugaguucaagcucgccucuccagaaaaacuggcugggcuugccuccccuagcucaggauauaguucucaguccgagacgcccaccagcucauuuccaacugcauucuuuagugguccgcugagcccuggcggguccaagcggaaacccaaggugccagaacgcaaaucuagcuugcagcagcccucccucaaggacggaacaauaucacugucuaaggauuuagagcugccuaucauuccacccacccaccuagaccucagugcucugcauaacguacuuaauaaaccuuuccaccacagacauccguugcacguuuuuacacauaacaagcaaaauacugugggcgagacccugaggucgaacccacccccuagccucgccaucacgcccaccauccugaaauccgucaauuuacggucuauuaacaagucagaagaggugaaacagaaggaagagaauaacacagaccugccauaccuugaagagagcacuuugaccacagcagcccucuccccuaguaaaauacgaccccacacugcuaauaagucugucagcagacaguauucaaccgaggauacgauccuguccuuccuagacaguagcgcgguggaaauggguccagauaagcugcaccucgagaaaaacucuacauuugacguuaagaaucgcugcgauccugaaaccauuacuuccgccgggucaagccugcuugacucgaacgugacaaaagaucagguaaggaccgagacugagccgauccccgaaaauaccccaacaaagaacugugcauucccuacggagggcuuucaacgugucucugcugcccggcccaacgacuuggauggaaaaauuauccaguacggcccagggccugacgaaacccuggaacaggugcagaaggcccccagugcuggauuagaagagguugcacaaccggaguccguggaugucauaacuagccagucagacuccccaacaagagccaccgacgugucuaaucaguucaagcaucaauucguaaugagcaggcaccaugauaaagugccugguacaaucaguuacgaauccgagauuacuagcguuaacucuuuucccgaaaagugcucaaaacaggagaauaucgcgaguggcauuuccgcuaagagcgccucugacaacucgaaagcagaagagacccaggggaaugucgaugaggccucacucaaggaaagcuccccaagugacgauucuaucauaagcccccuguccgaggacucacaggcugaagcagagggaguguucgugaguccuaacaagccgcgcacgacagaagaucuuuuugccgucauucaccgaucuaaaagaaagguucugggccggaaagacagcggugauauguccgugaggucaaagagccgcgcgcccuugucuuccaguagcucguccgcuucuucaaucaccagcccaaguuccaaugugacuaccccuaacucucaacguagccccgggcucauuuauagaaaugccaaaaagucaaacacauccaaugaggaguucaagcugcuacugcucaaaaagggcagucggagcgacucuucauacaggauguccgcaacugaaauccugaaaagcccuauacuuccaaagcccccuggagaguugaccgccgaaucuccacagaguacagaugacgcucaucagggcucgcagggggccgaggcacugucccccuuaagcccguguucaccucgcguaaacgcugagggauuuucuagcaaauccuucgccacgagugcgucagcccgagucggcagaucucgggcaccacccgcugccagcuccaguagguauagcgugcgcugcagacucuacaauaccccuaugcaagcuaucuccgaaggugagacugaaaacucugaugggucaccacacgacgacaggagcucgcaguccaguacauga

SEQ ID NO: 59699 - RNA, 4821 nt, Artificial Sequence
  derived and/or modified sequence opt3 from NHSL1__Homo_sapiens__NP_001137532
augguggucuucaucaacgccaagauuaaaagccugauaaagcucuuuaaaaagaaaaccguuuccaaucuugacgaggaaucuagauggacagugcacuacacugcucccuggcaucagcaagagaacguauuccugccuacgaccaggccaccgugcguggaagauuugcaccggcaggcaaaguuaaaucugaagucaguccuacgcgagugugacaaacuccgacaugauggcuaucguaguagccaguacuauucccaggggcccacauuugccgcgaacgcuucuccuuucugcgacgauuaccaagacgaagaugaggagacugaccagaaguguucgcugucaagcagugaagaggaaagauuuaucuccauuaggcggccaaaaacccccgccucuagcgauuucuccgaccuuaauacacagaccaacuggacuaagucacugccuuugccaacacccgaggagaaaaugcgccagcaagcacagaccgugcaggccgauguugugccuaucaauauuacgggagaaaacuuugacagacaggcuagucucaggcggagccugaucuauacugauacccugguccgccgaccaaagaaggugaaaagaaggaagacaauaacugguguaccggacaauauccaaaaagagcucgcaucuggcaccgggcaggacgaugccgacggacacuccguuuacacacccgaucauuauucaaccuuaggccgguucaacagcugccguagugcuggucagcgcucugaaacgagagacuccagcugucaaacugaggaugugaaggucgugccuccaucgaugaggcggauucgagcccagaaagggcagggaaucgcggcacagaugggccacuuuucuggcuccucagggaauaugagugugcugagcgacuccgccggaauugucuuccccucucgccuugauagcgacgcugguuuucacucauugccuagaaguggcgccagggcaaacauccaaucccuggaaccacggcuaggggcucucggacccgccggcgauaugaaugguacauuccuguaccagcgcgggcauccgcaggcggacgagaaccuuggacaccugggcggcgccagcgggaccggaacuuugcucagaccuaagucucaggagcugaggcauuuugaaucagagaauauaaugagucccgcaugcguugugagcccacacgcuacauacuccaccucuauuaucccuaacgccacguuaucgagcuccucagaaguaauugcuauccccaccgcccaaagugcaggucagcgugagucuaaaagcuccggcucaagccacgcccggaucaagucucgagaucaucugauuuccagacacgcugugaagggggacccacagagucccggaaggcauuggaacgaaggccacgcgacaauacucagccaggaccuugauccucauucuccaggugagccggcacuguugucccuaugugacucagccgucccccugaaugcuccugccaaccgcgagaaugggagucaagcaaugccauauaacugccggaauaaccucgccuuccccgcucacccucaggauguggacggcaaaagcgaaucguccuacucuggaggcgggggacacagcucaagugagccaugggaauauaaguccucugguaauggcagagccagcccccugaaaccgcaucuugcaacuccuggguacuccaccccaacaucaaacaugagcaguuguucucuggaucagacuuccaauaaggaggacgcgggcagcuuguauucggaagaucacgacggauacugcgcuucaguucauaccgauucuggucacgggaguggcaaccucuguaauuccagcgacggauucggcaaccccaggcacucugugaucaaugucuuuguggggcgcgcccagaaaaaccaaggagaucgaagcaauuaucaggacaagucccugucacggaacauuaguuuaaagaaagcaaagaaaccuccccugccaccuagccguacagauucucuaagaaggauccccaagaaauccucacagugcaacggucaaguacucaaugagagucugauagccacccuucagcauagcuugcagcugucccucccaggcaagucugggucgagcccgucacaguccccuugcagugaccuggaggaacccuggcuuccacgcucucggagccaauccacuguuucagcuggaucuagcaugacgagugccacaacccccaacguguacucccuguguggcgcaacuccuagccagucugacaccucauccgucaagagugaguacacagauccaugggguuauuacauugacuauaccgggaugcaggaagaucccggcaauccugcuggaggcugcagcacuucgucuggggugccgacaggaaacggcccagucagacacgugcaggaggguuccagggccacgaugccccaaguuccugggggaagcgugaaaccaaagaucaugucacccgagaaaagucaucgaguaaucucuccuuccagcggcuacucaagucagagcaauaccccgacugcguugacacccgucccaguguuccucaaguccguuucuccugccaacgguaaaggcaagcccaagccaaaagugccugaacgcaagagcucccugauuucaucugucaguaucucgagcuccucuaccucauuaagcuccaguacaucuacugaggggagcggaaccaugaaaaagcuggaccccgcugugggcucaccaccggcaccucccccacccccuguaccaucucccccuuuuccguguccagccgaucggagucccuuccuaccucccccaccucccgugacggacugcagccaggggucuccacucccucacuccccgguuuuucccccaccucccccagaagcucugauuccuuucuguucacccccggauuggugccuuagcccaccuagacccgccuugucgccaauacugcccgacucuccugucagucucccgcugcccccaccuuuacugcccuccagcgagccuccacccgcaccuccacuugaucccaaauuuaugaaggacaccaggccgccuuucacaaauucaggacagccagaauccucucguggcagcuugagacccccuaguacuaaagaggagaccucccggccacccaugccgcucaucacaacugaagcgcugcaaauggugcagcuaagaccugugaggaagaacagcggugccgaggcugcccagcugucugaacgaaccgcacaagagcagcggacgcccgucgcuccacaguaucaucucaagccuucagccuuucugaaaagucgcaauuccacaaacgaaauggagagcgagucucagcccgcaucgguuaccucaagccuuccaacucccgccaaguccaguucucaaggggaucacggaagcgcugcggaaagaggcgguccuguguccaggucaccaggcgccccgagugcaggggaggcugaagcccggcccucuccuagcacaaccccauugcccgacuccucaccuagccgaaaaccacccccuauuucuaagaaaccgaagcuguucuuagugguaccacccccucagaaggauuuugccgucgagcccgcugaaaauguguccgaggcacucagagccguuccaaguccuacuaccggagaggaaggcagcgugcacucgcgcgaggcgaaagaauccucugcugcccaggcagggucacaugccacacaccccggaacgagcguccuggagggcggugcugcagggaguauguccccaucuaggguggaggccaacguuccgauggugcagccugacguaagccccgcgccaaagcaagaggaacccgcugaaaauucagccgacaccggaggcgauggugaguccugucuuagucagcaggacggcgcagccggggucccugaaacuaacgcugccggaagcuccucagaggcaugcgauuuccugaaagaggacggcaaugaugaagugaugacaccaucccguccccggaccacagaggacuuguuugcugccauccauagaagcaagaggaaagugcucgggcgccgagauucugacgaugaccacaguagaaaccauucgccuuccccgccagucacucccaccggagcggccccuagccuggcaucaccaaagcagguuggcucuauccaacggagcauuaggaaguccaguacgucaucugauaacuucaaagcucuacugcucaagaaagguagccgcuccgacacaagugcccguaugagcgcugcagaaaugcugaagaauaccgaccccagauuccagcgguccaggucugagccuucacccgaugccccagaaagcccgucguccuguaguccuucuaaaaaccgccgagcccaggaggagugggcuaagaaugaagggcuuaugccccgcagcuugucauuuuccggaccacgguacggcaggucucgcacuccucccagugcggcaagcuccagauauucaaugaggaaccggauacagagcucuccaaugaccgugaucagugagggcgaaggggaggccguagaaccuguggacuccauugcucguggagcccugggugcagccgagggcugcagcuuagaugggcucgcucgcgaggaaauggacgagggaggccugcuuuguggugaagggcccgcggccucacugcaaccgcaggcaccaggaccugucgauggcacagcuucugccgagggccgagagcccuccccacagugcgggggaucgcuaagcgaagagaguuga

SEQ ID NO: 59700 - RNA, 642 nt, Artificial Sequence
  derived and/or modified sequence opt3 from NICN1__Homo_sapiens__NP_115692
augagcagagugcugguccccugccacguuaagggcuccguggcccuccagguaggggacgugaggaccucucaaggacggccugguguccuugugaucgauguuacauucccaucaguggcuccguuugagcugcaggaaauuacuuucaaaaacuacuauacggcauuuuugaguauacgcguccgacaguacaccagcgcccauacacccgcgaagugggugacuuguuuacgugacuauugccugaugccugauccacacuccgaggaaggcgcucaggaguacguaucucuauucaaacaucaaaugcucugugacauggccagaaucucggaacugaggcuuauucugcggcagcccucaccuuuguggcucagcuuuaccguugaggagcugcagaucuaucagcaagggccaaagagucccuccgugacauucccuaaauggcugucucacccagucccgugcgaacagcccgcacucuuacgcgagggacugccugauccaagcagaguguccucagaagugcagcagaugugggcccuuaccgagaugauuagggcuagucauacuagcgcacggaucggccgcuuugacgucgaugguuguuacgacuugaaucugcuaucuuauacauga

SEQ ID NO: 59701 - RNA, 3744 nt, Artificial Sequence
  derived and/or modified sequence opt3 from NID1__Homo_sapiens__NP_002499
augcuggccagcuccucuagaaucagggcugcauggacccgggcccuccuucugcccuuguuacuggcgggcccuguggggugccuaucacgccaggaacucuucccauuuggaccgggucaaggcgaccuggaacuugaggauggggacgauuucgucagucccgcucuggaauugagcggagcccuccgauuuuacgaccguuccgauauugacgcaguuuaugugacaacuaacggcauaaucgccacgucugagccuccagcuaaggaaucgcaccccggucuguucccuccaaccuuuggggcaguagcccccuuccuggcugaucucgacacaacugauggauuaggcaaaguguacuauagagaggaccugucaccuagcauuacccagagggccgcggaguguguccaucggggcuuuccagaaaucaguuuccagccguccucugcagugguugugacaugggagagcgucgcccccuaccaggggccuucccgcgauccagaccaaaagggaaaaagaaauaccuuucaggcugugcuugccucaagugauucuagcuccuaugcaauuuucuuguaccccgaagacggucugcaguuucacacuacauucucaaagaaagagaacaaucagguaccugcuguuguggccuuuagccaaggcagugucggguuccuauggaagucuaacggagcguauaauaucuucgccaacgacagggaguccguggaaaaucucgcaaagagcucgaacucuggccagcagggugugugggucuuugagauaggguccccagcuaccacgaauggaguugugcccgccgauguaauccugggcacugaagacggcgcugaguacgaugacgaagaugaggacuacgaucuugccaccacacggcugggguuggaggacgugggaacuaccccguucucauauaaagcacuccgccgagguggcgccgauacauacagugucccuagcgugcugucccccagaagggcugcgaccgaacggccauuagggccucccacggagcguacucgcucuuuucagcuggcaguugaaacauuccaucaacagcacccacaggugauugacgucgaugagguggaagagaccggaguaguuuuuagcuauaacacugacucaagacaaacaugcgccaauaacaggcaucaguguagugugcacgcugagugccgggacuacgccaccggcuucuguugcuccugugucgcagguuauacggggaauggccgacagugcguggccgaaggaagcccccagcgcgucaacggcaaggugaaagggagaaucuuuguuggaucuucacaagugccuauuguauucgagaauaccgaucuccacaguuacgucgugaugaaccaugguaggagcuauacagcuaucuccacuauaccagaaaccguuggcuacucucuucugccguuggcccccgugggaggaauuaucggcuggauguuugcagucgagcaggacgguuucaagaacggguuuucgauuacaggcggagaguucacucggcaggcggaggugaccuuuguaggccacccugggaaucuagugaucaaacagcgcuucagcggaaucgaugagcauggucaccugacaauugacaccgaacucgagggcagaguuccacaaauacccuucggguccucaguccacaucgaaccuuacacugagcuguaucauuacaguacgucugugauuacaagcuccucaaccagggaguauacugugaccgaaccagagcgugauggagcuagccccucucggaucuacacauaucaguggcgacagaccauaacuuuucaggaauguguccacgacgauuccagaccggcccuuccuaguacacaacagcugagcguugacucuguguucguguuguacaaccaggaggaaaagauucucagguaugcacuguccaauucaaucggcccaguacgcgaggguagucccgaugccuuacagaacccuugcuacaucgggacgcauggcugugacaccaaugcugccugccggcccggaccaagaacucaauuuacaugcgaguguagcauuggcuuccgcggggauggaaggaccugcuacgacaucgaugaauguucggagcagccuuccgucugcggcucucacacaauuuguaacaaucaucccgguacuuuucgaugcgaauguguggagggguaucaguucagcgacgaaggaaccugcguugcaguggucgaccaacggccaauaaacuacugugagacgggccugcacaauugcgauaucccgcagcgugcucaguguauuuauaccgguggcucaaguuacacaugcuccugccuaccuggguuuucuggagacggccaggccugucaagauguggacgagugccagcccagcagaugucacccagaugcguucugcuauaacacucccggguccuuuaccugucagugcaagccuggauaccagggcgacgguuucagguguguuccaggggaaguggagaaaacacgcugccaacaugaacgggagcacauccucggagccgcuggcgcaacugauccccagagaccuaucccgccaggucuguuuguacccgaaugugacgcccauggccacuaugcuccuacccagugccacgggucaacgggauacuguuggugcgucgauagggacggccgagagguggaggggacacgcacccggccaggaaugacucccccuugccuuagcacaguggccccgcccauucaucagggcccagcagucccuaccgcgguuauacccuugccaccugguacucaccuccuguucgcccaaaccgggaagaucgaaagacugccccuugagggaaauacaaugaggaaaacggaagcuaaggccuuucugcaugugccagcaaaaguaauuaucggcuuggcuuucgauuguguggacaagauggucuacuggaccgauauuacugagccgaguaucggucgugccucucuccacggcggggagccuacaaccauaauccgccaggaccugggaucccccgaaggcauugcaguggaccauuuagggcggaacaucuucuggacagauagcaaucuggacagaauugagguugccaaacuagauggaacucagaggcgagugcucuuugaaaccgaccuggucaacccacggggcaucgugacggauucgguucgcgguaaucuuuauuggacagacuggaacagagauaaccccaagauagagaccucauacauggacgggacuaauaggcggauuuuggugcaagaugaccugggacucccuaacggccugaccuucgaugcuuuuucuagucaguuaugcugggucgacgcgggcacaaaucgagccgaaugucugaacccaucccagcccagcagacgcaaggcacuugagggguugcaguauccuuucgcuguaacuucuuacgggaaaaaucucuauuuuaccgacuggaagaugaacagcgugguugcccuggaucuagccaucuccaaagagacagacgcuuuccaaccgcacaagcagacgaggcuguacgguauuaccacugcacucucacagugcccacagggccacaauuauuguagugugaacaaugggggaugcacacaucugugucuugccacccccggcagccguacuugccgguguccugauaacacauugggugucgacugcaucgaacaaaaauga

SEQ ID NO: 59702 - RNA, 4128 nt, Artificial Sequence
  derived and/or modified sequence opt3 from NID2__Homo_sapiens__NP_031387
auggagggcgacagaguggccgggaggcccguccugagcucccucccuguucuucuguuguuaccacugcuaaugcuccgggcugcagcccugcacccggaugaacuuuucccccauggagagucuuggggugaccagcuguugcaagaaggcgaugacgagucaagugcggugguaaagcucgcuaacccucugcacuuuuacgaagcccgcuucagcaaucuguauguggggaccaacggaaucauuuccacacaggauuuuccacgagagacucaguacgucgacuaugauuuccccacggacuuuccugcaauagccccauuccucgcugauaucgacaccucucauggccgugguagaguguuauacagggaggauacaucgcccgcaguucuggggcuugccgcucgguaugugcgcgccggauuuccuagaucagcgagguucacuccaacccacgcauuuuuggccacaugggaacaggucggcgcuuacgaggaagugaaacggggcgcccugccgagcggggagcuaaauaccuuccaagcaguacucgcuagugacggauccgauucuuaugcccuguuucuuuaccccgcgaacggucugcaguucuugggcacucgcccuaaggagagcuacaauguucagcuccagcugccagcccgagugggguuuugcagaggagaagcagacgacuuaaaauccgagggccccuauuucucacugacaaguaccgaacaaagcgucaagaaccucuaccagcuuucuaaucuggguauuccuggggugugggcuuuccauaucggauccacgucaccauuggauaacgugaggcccgccgcugucggcgaccuaagcgccgcacacaguucuguuccgcugggccgguccuuuagccacgccacugcucucgagucggauuauaaugaagacaaccuggauuacuaugacgugaaugaggaggaagcggaguaccuuccuggggaacccgaggaagcacugaacggacauucuuccauugauguaucauuccagaguaaaguggacaccaagccauuggaggagagcuccacacucgauccucacacuaaggaagguaccucucugggcgaggucgggggacccgacuuaaaaggccagguggaaccaugggaugagcgugaaacacgcagccccgccccuccagagguugacagagacucacuggcuccgaguugggagaccccaccuccauaucccgaaaaugguuccauccaaccuuacccagaugggggccccgugccgagcgagauggacgucccuccagcccaucccgaagaggagauagugcuaaggucuuacccugcaucaggacacacgacuccccucagucggggcacauaugaaguagggcuggaggauaacaucggaagcaauaccgaaguuuuuacuuacaacgccgcuaacaaggagacaugugaacacaaucaucgacagugcucccgccacgccuucuguaccgacuaugcaacggguuuuugcugucauugccagucuaaauucuacggcaacgggaagcacugucuuccagagggagcgccucauagagugaauggcaaagucucgggucacuugcacguggggcauacccccguccacuuuacagauguggaccugcaugcuuauauuguuggcaacgauggaagggccuacacugcaaucagccacauuccacaaccggccgcucaggcccuccugccucuuacccccaucggcgggcuguucggaugguuguuugcacucgagaagccagguuccgaaaauggcuucucacuggcuggggccgcguuuacacacgacauggaggugacuuucuaucccggagaagagaccguacggauaacacagaccgccgaaggcuuagauccugagaacuaccugaguauuaagacuaauauccagggucaagucccauacgugucugcuaacuuuacggcacauauuagccccuauaaagagcuauaccacuauuccgacucaacaguuaccagcacuucuucccgcgauuacagucucaccuucggggccaucaaucagacauggagcuauagaauccaucagaacauuaccuaccaggugugcaggcacgcuccucgucauccgucuuucccaacuacacaacagcugaaugucgaccggguguuugcccuuuauaacgaugaagaacgaguauugagauucgcagugacgaaucagauaggccccguuaaggaagacuccgacccuaccccaggaaaccccuguuacgauggcucacacaugugcgacacuacagcgaggugucacccugggaccggagucgauuacacaugcgagugcgccaguggcuaucagggugacgggcgcaauuguguggaugaaaacgagugcgcuacuggauuucaucgguguggcccgaacagcgugugcaucaaucugcccgguucguacagaugugagugcagguccggcuaugaguucgccgacgaucgccacaccuguauucucaucacgcccccugcaaaccccugcgaggacgggucucauaccugugcuccagccggacaagcacgaugcguccaccauggcgggagcacauuuucaugugccugccugccuggauacgcuggcgauggucaccagugcacugacguugaugaauguagugagaaucggugccaccccgcggccaccuguuauaacacaccaggguccuucucuugccguugucagccgggauacuauggcgacgguuuucagugcauaccugauagcacuuccucauuaacccccugugagcaacagcagagacaugcacaagcucaguacgccuacccaggcgccagguuccacauuccccagugcgacgaacaggggaauuuucugccucuucaaugucauggaagcacgggcuucugcugguguguggacccagaugggcacgaggugcccggaacacagaccccuccgggcaguacuccaccccacugcgguccuucucccgaaccaacacagcgcccucccaccaucugcgagcgguggagagaaaacuugcucgagcauuaugggggaacuccaagggacgaucaguacguaccucaaugugacgaucugggccacuuuaucccgcuacagugccaugguaaauccgacuucuguuggugcgucgauaaggacggccgagaggugcaggggacccgcagccagcccggaacaacgccagcuuguauuccuaccguugcacccccaauggugcggccuacucccagaccggaugucacaccaccuucggugggcaccuuucugcucuauacacaagggcagcagaucggauaccugccccuuaauggcacuagguugcaaaaagacgccgcgaagacccuguuaucacuccacgguucuauuauaguugggaucgauuaugacugccgugaacgcaugguguacuggacggacguagcuggacggacaauuaguagagccggccuggagcuuggcgcagaaccagagaccaucgucaacuccgggcugaucagccccgaaggauuggccauugaucauauaaggcgaacuauguauuggaccgacucugugcucgauaaaaucgagagcgcucugcuagacgguuccgagcggaaggugcuguucuacacagaucucgucaauccucgcgcaauugccguugacccgaucagaggcaaccuguacuggacugauuggaauagggaagcgcccaagauugagaccucaagucuugacggggaaaaccggcgaaucuugauaaauacagauaucggacugccaaacggcuuaacguucgacccuuuuagcaaacuccuguguugggcugaugccgguaccaagaaacuugagugcacucugcccgacgggacaggaagacgcgugauucagaauaaccuaaaguauccuuucucuaucguauccuacgcagaucacuuuuaucacaccgacuggaggcgugacggcguggucucagugaacaaacauaguggccaguucacugaugaauaccucccagagcagcggagccaccuguaugggauuacagccguuuaccccuauuguccuaccggaagaaaguga

SEQ ID NO: 59703 - RNA, 1134 nt, Artificial Sequence
  derived and/or modified sequence opt3 from NIF3L1__Homo_sapiens__NP_001129511
augcugagcuccugcgugagacccgucccuaccacaguuagguucguggacucucucaucuguaacucaagucggagcuuuauggaucuuaaggcccuguuguccucuuuaaaugacuucgcuucgcugucauuugcagagagcugggauaacguaggccuacucguggaaccaaguccgccccacacugucaauacgcuguuccuuaccaacgaccugacagaggaagugauggaggaaguuuugcagaaaaaggccgaucucauucuguccuaccauccuccaauauuucgccccaugaaacgaaucacuuggaauaccuggaaggagcgucuggugauuagagcgcucgagaacagggucgggaucuauucuccucacacagcuuacgacgccgcaccacaaggagugaauaacugguuagccaaaggucugggcgcuugcaccagccggcccauucauccuuccaaggcaccaaauuauccgacugaagggaaccaccgcguagaguucaauguuaacuacacacaggaucuugacaaggugaugucagccgucaaaggaaucgauggcgugagugugaccagcuuuucugcuagaacggguaaugaggaacagacuaggauaaacuugaauuguacccagaaggcccugaugcaagucguugacuuccuaucccggaacaaacagcucuaucagaagacagagauccugucacuugaaaaaccccuguugcuccauacugggaugggacgccugugcaccuuagaugagagcgugagucuggcgacaaugauugaccgaaucaagagacaccucaaacuuucucacauuaggcuggcauugggcguaggccggacccuagaaucccaggugaaggucguggcccugugugcugggagcggaucgucuguucuccaagguguggaggccgaucuguaccuuacgggcgaaaugucccaucacgacacucuggacgcagcuucacaggggaucaacgucauauugugcgagcauaguaauacagagcguggauuucucagcgaucugcgcgacauguuagauucccaccuggaaaacaagauuaauaucauucuaucugagaccgacagagauccucuccaggugguauga

SEQ ID NO: 59704 - RNA, 1311 nt, Artificial Sequence
  derived and/or modified sequence opt3 from NIM1K__Homo_sapiens__XP_006714513
augacugccguguacaugaacggcgggggacuggucaauccccacuaugcuagaugggacaggcgggauagcguugaguccgguugccagacagaaucuucaaaggagggcgaagaggggcaaccucgccagcucacuccauucgaaaaacuuacgcaggacaugagucaggaugagaaggugguacgagagaucacccugggaaaacguauuggcuuuuacagaauaaggggugaaaucgggagcggaaacuucucccaagugaaguugggcauucauucuuuaacaaaagagaaggucgcaaucaagauucuggacaaaacuaagcuagaucagaaaacccagcggcuccugucgcgcgaaaucucaagcauggagaaacuucaccauccgaauauaaucagacuguaugaggugguugaaacauugaguaaacuccaccuggugauggaguacgccggcgggggagaacuguuugguaagauuuccaccgagggcaagcucucugaacccgagagcaaauuaaucuucucccagauugucucagcggugaagcauaugcacgagaaccaaaucauacacagggaccugaaagcugaaaauguauuuuauacaaguaacacuuguguuaaggugggggauuucggauuuagcaccgucucuaaaaagggcgagaugcuuaauacguucugcgguuccccuccauacgccgcacccgaauuguuucgggacgagcauuauauugggaucuacguggauauuugggcccugggagugcuacucuacuucauggucacuggcaccaugccuuuucgcgcugaaacaguugcaaaacugaagaagucaauccuugagggcacuuauagcgugccaccccacguaagugagccuugucaucgacugaucagagggguguugcagcagauuccaaccgaaagguacggaauagacugcaucaugaacgaugaguggaugcagggugucccguaucccacaccucucgaaccauuccaacuggaccccaaacacuuaucugagaccuccacgcugaaggaagaggagaaugaagugaaaagcacucucgagcaccuuggcauuacagaggaacauauccggaacaaucaggggcgugaugcccgcucgucuauaaccggaguuuacagaauuauccugcacagggugcagcggaagaaggcuuuggaguccgucccugugaugaugcuaccagaccccaaggaacgagaccugaagaaaggcucacgcguauauagagguaucaggcauaccaguaaguuuuguagcauucucuga

SEQ ID NO: 59705 - RNA, 4134 nt, Artificial Sequence
  derived and/or modified sequence opt3 from NIN__Homo_sapiens__NP_057434
auggacgagguggaacaggaucaacacgaggccagacugaaggaacucuucgacagcuuugauaccacaggcacugggucccuuggacaggaggaacugacggacuugugccauauguuaucucuggaggaggucgcucccguucuacagcagacccuccugcaagauaaccuucuggguagggugcacuucgaccaguuuaaagaagcauugauccucauucugucacggacacugaguaaugaggaacauuuccaggagccugauuguagccucgaggcccagccaaaguacguacgcggcgggaaacgauauggacguagauccuuaccggaauuucaagagucuguggaagaguuccccgaagucacugugauagagccucuggacgaggaagcgaggccaucgcacauccccgcuggcgauugcucagagcauuggaagacccagcggagcgaagaguacgaagccgagggucagcuucgcuuuuggaacccugacgauuugaaugcaagucaguccgggucuagcccaccccaagacuggauugaggaaaaacugcaggagguuugugaagaucuaggaaucacaagagacggccaccucaacaggaagaagcugguguccauuugcgagcaguauggccuucaaaaugucgacggggaaaugcuggaggagguguuccacaacuuggauccugacggaaccaugucaguagaagacuuuuucuacggucucuuuaaaaauggcaagagucugacuccaagcgccucuacaccguaucggcaguuaaaacgccaucuguccaugcagucauucgaugagagcgggcgaagaaccacgaccaguucugcuaugaccuccacaaucggauuuaggguuuucagcugucucgaugacggcaugggucacgcaucgguggaacggauacuugauacuuggcaggaggaggggaucgaaaacucucaagagauucugaaggccuuggacuucucccuagauggaaauaucaaccugaccgaacucacacuggcucuugagaaugaacuguuggucaccaaaaacucaauucaucaggccgcgcucgcaaguuuuaaggccgagauccgucaccuguuagagcgcguggaccagguggucagagaaaaggagaaacugaggagcgaucuagacaaggcugaaaaacucaagucccugauggccucugagguugacgaucaccaugcagcuauagaacggcgaaaugaguacaaccuucgcaaauuggacgaggaauauaaggagagaauugccgcgcugaaaaaugaacucaggaaggagcgggaacagauccugcaacaggccggcaagcagcgccuugagcuggagcaggaaauugagaaagcaaagacggaagagaacuacaucagagauagguuggcucucagccugaaagagaacucacguuuagaaaaugagcugcuagaaaacgccgagaagcucgcugaauacgagaaucugacuaacaaacuucaacggaauuuggagaacgugcuggccgaaaaguucggcgaccucgaucccaguuccgcagaguuuuuccugcaggaagaacgauuaacacagaugagaaaugaauaugagaggcagugccgcguacugcaagaccagguggaugagcuucagagcgaauuggaggaauaccgggcccaagggagaguccucaggcugccucuaaagaacucuccaucagaggaaguggaggcuaauaguggagguaucgagcccgaacacggccuggggagcgaggaauguaacccucucaauauguccauugaggcggagcugguuauagaacagaugaaagagcagcaucaccgcgacaucugcugucuucgauuggaacuggaggauaaggugcggcauuaugaaaaacaguuagacgagaccgucgugucuugcaagaaagcacaagagaacaugaagcagcgucacgaaaaugagacucacacacucgaaaagcagauuucggaucugaaaaacgagaucgccgaacuucagggacaagcugccguacugaaggaggcacaucacgaggccaccuguagacaugaagaggaaaagaagcaguugcagguuaaacucgaggaagagaagacgcaucugcaggagaagcuaaggcugcaacacgaaauggagcucaaagcucgccugacccaggcccaggcgagcuuugaacgggagagagagggccuucaauccucagcauggacagaagagaaggugagggguuugacucaggaacuggagcaguuccaccaggaacaauuaaccagucucgucgagaaacacacacuggagaaggaggagcuucgaaaagaacugcuagagaagcaucagcgcgaacuccaggaggggcgguacgagucugaaaaacugcagcaagagaauagcauauugagaaacgaaauuacuacccugaacgaggaagacuccaucucaaauuuaaagcucggcacacugaacggaagccaggaggagauguggcagaagaccgaaacugugaaacaggagaaugcugccguccaaaagaugguggaaaaccuuaaaaagcagaucucugagcugaaaauuaagaaucagcaguuggaucucgagaacacggaacugucccaaaagaauagucagaaccaggagaaacuacaagaacugaaucagaggcuuacagagaugcucugccagaaggaaaaagagccaggcaacagcgcacuggaggaacgugagcaggaaaaguuuaauuugaaagaggaacuggagcgcugcaagguucaaucuuccaccuuagugucaagucucgaggccgaacugagcgagguaaagauccagacucacauuguccagcaggaaaaccaucuucugaaagacgaguuggaaaagaugaaacaacuccaccggugucccgaccugucggauuuccagcagaagauauccucugugcuaagcuauaaugagaaacugcuuaaggagaaggaagcucucucagaggaacugaacaguugcguugacaaauuggccaaguccucuuuacuggagcacagaaucgcaaccaugaaacaggagcaaaagagcugggaacaucaguccgcuucacucaaaagccagcugguggccagucaagagaagguccagaaucuugaagauacagugcagaacguaaaccugcagaugucuaggaugaaauccgacuugcgagugacccaacaggagaaggaagcgcuaaagcaggagguuaugagccugcacaaacagcuccaaaaugccgggggaaagucgugggcuccggagauugcaacucauccuucaggucugcacaaccagcagaaacggcuuucuugggauaaguuagaccaucugaugaaugaggaacagcaacucuuguggcaggaaaacgagcgccugcagacaaugguccagaauacgaaagccgaacucacccacaguagagagaaggugaggcaacuggaguccaaccuucugcccaagcaccagaaacauuugaauccaagcggcacuaugaacccuacagaacaggagaagcuaucucugaaacgggaaugugaucaauuucagaaggagcagagccccgcuaaucgaaaagugucccagaugaacucacucgaacaagaguuagagaccauccaccuggaaaaugaggggcuuaagaagaaacaggucaagcuggacgaacagcucauggagaugcagcauuugagaaguacagccacuccaagccccucuccucacgcaugggaucugcaacuccugcagcagcaggcgugcccaaugguuccgcgcgagcaauuccuucagcuacagaggcaacuguugcaggccgaacguaucaaccagcacuuacaggaggaacuggagaaucggaccuccgaaacgaacacuccccaaggaaaucaggagcagcucgugacagugauggaggaaagaaugauugagguagaacagaaacugaaacuugucaaaaggcugcuccaagagaaggugaaccaguugaaggaacagguuucacugccuggccaucuauguaguccaacuagccacuccucuuuuaacucgagcuucaccucacuguacugccauuga

SEQ ID NO: 59706 - RNA, 459 nt, Artificial Sequence
  derived and/or modified sequence opt3 from NINJ1__Homo_sapiens__NP_004139
auggacagcggcaccgaggaauacgagcugaacgggggacuucccccugguacaccaggcuccccggaugccucucccgcuagauggggguggaggcacggaccuaucaaugugaaccauuaugcaucaaagaaaagugccgcggaaagcaugcucgacauugcucuguugauggccaaugcaucccaguuaaaggccgucguugagcaaggcccaucuuucgcuuuuuacgugccccugguagugcuaauaucgaucucacucguccugcagauugguguggggguucuucugaucuucuuggugaaauaugaucucaacaauccugcaaagcacgccaaacuggacuuucugaacaaucucgcuacuggauuagucuucauuaucgugguaguuaacauauuuaucacggccuucggcgugcagaagccacugauggauauggcgccccagcaauga

SEQ ID NO: 59707 - RNA, 408 nt, Artificial Sequence
  derived and/or modified sequence opt3 from NINJ2__Homo_sapiens__NP_001281274
augauguacaugcccggcagcuccgacccuagaucucagccaaucaaccugaaucacuaugccaccaagaaaucaguggcugagaguaugcucgaugucgcacuuuucaugagcaacgccaugaggcugaaggcgguuuuggaacaagggccguccucucauuacuauacaacuuuagugacgcugauuucgcuaucacuccugcuucagguagugauaggaguccuguuggugguuaucgcucggcucaaucugaacgagguggaaaaacaguggcgccugaaucagcucaacaaugccgcaaccauuuuagucuuuuucacagugguaaucaacguuuuuauuacugccuucggugcucacaagaccggcuuucuggcagcccgagcuagccguaauccccuuuga

SEQ ID NO: 59708 - RNA, 4149 nt, Artificial Sequence
  derived and/or modified sequence opt3 from NINL__Homo_sapiens__NP_079452
auggacgaggaagagaaccacuacgugagccagcugagagaagucuauuccucuugcgauaccacaggcacuggguuccucgacaggcaagagcuuacgcagcuguguuugaaguuacaucuggaacagcagcuacccguucuccugcaaacccuucugggaaaugaucacuuugcccgggugaacuucgaggaguuuaaagaagguuucguagcuguguugucaaguaaugcaggcguccgcccuagcgacgaggauuccucuucgcucgaaucagccgcgagcagugcuaucccaccgaaguacgugaacggguccaaaugguauggacgacguucuagacccgagcugugcgacgccgcaacagaggccaggcggguuccugaacagcagacucaggcuagccugaagucccaucucuggcgcucagcaaguuuagagagcguggaaucuccaaaauccgaugaggaagccgagucaaccaaggaggcucaaaaugaacuguuugaggcccagggccagcuucagacaugggacagcgaagauuucgguaguccccaaaagucuuguuccccuagcuuugacaccccagagucgcagauuagaggggucugggaagaguugggaguggggucuuccggccaccugucagagcaggaacuagcgguaguuugccaaagugugggccuccagggacuggagaaagaagaacuugaagaucuguucaacaaguuggaccaggauggugacggcaaagucagccucgaggaguuucagcugggguuauucucccaugaacccgcacugcuccuugagucuagcacuagggugaagccuucaaaagccuggagucacuaccaagugccagaagaguccggaugucacacaaccacgacuagcucucuggucucauugugcaguagccuacggcuguuuuccucuauagacgauggcucggguuucgcuuuuccggaccagguucucgccauguggacccaggaggggauccagaauggacgcgaaauucugcaaagccuugauuucuccguggacgagaagguaaaccuguuggaacucacaugggcacuggauaaugaguuaaugacuguggacucagcuguccagcaggccgcgcuggccuguuaucaucaggaacuaaguuaccaacagggccagguggagcagcucgcacgagagagagauaaggcuaggcaagaccuggaacgggccgagaaacguaaccuugaguucguuaaggagauggaugacugccacucuaccuuggaacagcugacagagaaaaagaucaaacaucucgagcagggcuaucgcgaaagacugagccuucugagguccgagguggaagcugagcgggaauuguuuugggagcaagcccaccgacagcgcgcagcccucgagugggaugucgggagacugcaggcugaagaggcgggauuaagggaaaagcugacccuagcacucaaagaaaauucacggcugcagaaggagauuguggaaguaguugagaaacuuagcgacucugaacgcuuggcccugaagcuccaaaaggaccuggaguucguguuaaaagauaagcuggaaccccaguccgcugagcuuuuggcccaggaggaaagauuugcagccguccucaaagaguacgaacugaaguguagggaccuacaggaucguaacgacgagcugcaagcugaacucgagggucugugggcccggcuuccuaagaaucgacacaguccaagcuggucucccgauggcagaaggcgccaguugccugggcugggaccagcaggcaucuccuucuuagguaacucagcgcccgugaguauagagacggaacucaugauggagcaggucaaagaacauuaccaggaccugcggacucaacuugagacaaaggugaauuauuacgaaagagagaucgcugcccugaaaaggaacuuugagaaggaacgcaaagauauggagcaggcacgacggcgugaaguuagcguguuggaggggcagaaggccgaccucgaggaacugcacgagaagucgcaagaaguaauuuggggccuacaggagcagcugcaggauaccgcuagaggaccggaaccugagcaaaugggccucgcccccugcuguacucaggcacugugcgggcuugcuuugaggcaucacucccaucugcagcagauccgccgggaggccgaagcggaguuaucuggagaacucagcggucugggcgcccuuccagcuagaagggaccugacacuagagcucgaggagccuccccaagggccacugccccgaggaucacagcgcagugagcaguuggaacuggagcgggcauuaaaacuccagccuugcgccuccgaaaagagagcucaaaugugugucucucuggcccuugaggaagaggagcuggaauuggcaaggggcaaacguguggaugguccaagccucgaggcggaaaugcaggcccugccgaaggacgggcuaguugcuggcuccggacaggagggcacccgcgggcugcuuccccuccggccuggaugcggugagagaccacuggccugguuggcacccggcgaugggagggaaucagaggaagcugccggagcaggcccucgacggcgccaggcccaagacacggaggcuacccagagcccagcgcccgccccggcuccugcaagucacgguccaucugaaagaugguccaggaugcagcccugugggguggacggcgauauugucccuaaagagcccgagccauucggagccagcgccgcuggccuggaacaaccuggggcacgggaguuaccccuccugggaacagaacgagacgccucgcagacucagccaagaaugugggagccgccucuucgccccgcggcuucaugcaggggccaggccgaacgucugcaagcaauccaggaggagcgggccagaucuuggaguagggguacccaggaacaggcuuccgagcaacaggcacgcgccgaaggggcguuggagccaggaugucacaagcauagcguggaaguagcucgaagaggcucucuccccagccaucugcagcuagccgauccucaggguuccuggcaagagcagcuggcagccccagaggaaggcgagacaaagauagcucuugaacgggagaaagacgauauggagacuaagcuccugcacuuggaagacgugguuagggccuuagagaaacacgucgaucugcgcgaaaacgaccgucucgaguuucacagacugucagaagagaauacccuucugaagaacgauuuggggcgggugaggcaggagcuagaagcagcugagaguacacaugacgcccaacgcaaagaaauugaggugcugaagaaagauaaggaaaaggcgugcagcgagauggagguccucaaucgacagaaccagaauuauaaagaccagcugucucaacuuaacguuagaguguuacagcugggacaggaagccuccacccaccaggcacaaaaugaggaacaucgggugacuauccagaugcucacgcagucauuggaggaaguagucaggaguggccagcaacagagcgaucagauucagaagcugcgcguggagcucgagugucugaaccaagaacaccagucccuucagcugcccuggucugaguugacacaaacccuagaagagucgcaggaccagguucagggggcucaucugagacucaggcaagcccaggcucagcacuuacaggaggugcggcuggucccucaagaccguguggcagaacuucaccgccugcucagcuugcagggagagcaggcccgaagaaggcuggaugcccagcgggaggaacaugaaaaacaacucaaggcuacugaggagcgcguugaagaggcggaaaugauccugaaaaauauggagaugcuucuacaggaaaagguggacaagcugaaagagcaguucgagaagaacaccaaaucagauuuguuacugaaggaacucuacguagagaaugcacaccuggucagagcccuucaagcuacagaagagaaacagaggggcgccgaaaagcagucccggcugcucgaggagaaggugcgagcauugaacaaacuggugaguagaaucgccccggcugcgcuaucugucuga

SEQ ID NO: 59709 - RNA, 765 nt, Artificial Sequence
  derived and/or modified sequence opt3 from NIPA1__Homo_sapiens__NP_001135747
auggccgugggccagaucgggaacuuccuggcuuacaccgcaguccccacaguucucgugacuccucuuggagcccuggguguaccauuuggcagcauuuuggcguccuauuuacugaaggagaaacuaaauauacucgggaagcugggaugccuucugucuugugcuggcucaguggucuugaucauucacaguccgaaaagcgaauccgugacgacccaagccgagcucgaagagaagcugacaaaccccguuuucguggguuaccugugcaucguccucuuaaugcugcuuuugcugaucuuuuggauugccccugcacaugggccaacuaauauaaugguguauaucucuauuuguucgcuacucggaucauucaccguacccagcacaaaaggcaucggccuggcugcacaggacauucuucacaacaauccuaguucccagagagcccugugcuugugucucguucuguuagcugugcuggggugcucuaucauaguccaguuuagguacauuaacaaggcccucgaauguuucgauagcuccguguuuggagcgaucuauuacguggucuucaccacucuuguucuguuggcaucagccauucuauuucgggaguggaguaaugugggucugguagacuuccucggcauggcuugcggguuuacaaccgugagcgucggaaucgugcugauccaaguuuucaaggaguuuaacuucaaucuuggcgaaaugaacaaaucuaauaugaagacggauuga

SEQ ID NO: 59710 - RNA, 1083 nt, Artificial Sequence
  derived and/or modified sequence opt3 from NIPA2__Homo_sapiens__NP_001008892
augagccagggcagagggaaguacgacuucuauaucggacugggucucgccauguccucuucaauuuuuauaggcgggaguuucauccuuaaaaagaaaggacuguugagguuagcucggaagggcagcaugcgcgcaggucaagggggacacgccuaccugaaagaguggcuauggugggcgggccuccuguccaugggcgcuggggaaguggccaacuuugcagccuaugcuuucgcacccgccacccuugucacaccucugggagcuuugucuguucucgugucggccauucugucaagcuacuuucugaaugagcgacucaacuuacaugguaagaucggcugccugcuuaguauuuugggguccacuguaauggugauccacgcgccaaaggaagaggaaauagagacgcugaaugagaugucucauaaacuaggagauccgggcuucgucguguuugcaacccucguugugaucgucgcccugauucuuaucuucgugguagguccccgucacgggcagacaaacauucugguuuauaucacuauauguagcgugauuggagcuuuuuccgucucaugcgugaagggcuugggcaucgccauuaaagaacucuucgcagggaagccugugcugagacauccauuagcuuggauccugcuccuuagucugaucgucuguguuagcacccagauuaauuacuugaacagggcccuagacauauuuaauacaucuaucgugacccccauuuauuacguauucuuuacuacauccgugcugaccugcucagcgauccucuucaaagaguggcaggauaugccugucgacgaugugauaggaacgcugagcgguuucuuuacuauuaucguuggcaucuuccuucugcacgccuuuaaggacgugaguuucucuuuggcaucccucccagucagcuuucggaaggaugaaaaagcuaugaacgggaaucugucgaacauguacgagguguuaaauaacaaugaggaaucucugaccuguggaauugagcaacacacaggcgaaaacguaucccgcagaaaugguaaccuaacugccuucuga

SEQ ID NO: 59711 - RNA, 1179 nt, Artificial Sequence
  derived and/or modified sequence opt3 from NIPAL3__Homo_sapiens__XP_011540110
auggcccccaccggccugacauucgcuagcccuccauccgcagugagagaggaaaaccucaucggggcccuucuggcgauuuuuggacacuuggucguuucuauagcuuuaaaucugcagaaguacugccauaucaggcuagccgguucaaaagacccgcgggcauauuucaagacuaaaacgugguggcucggccuguuucuuaugcuguugggggagcucggaguguucgccaguuacgcuuuugcaccccugagccugauuguaccucucuccgccgugucugucaucgcuucggccauuaucggcauaaucuucauuaaggaaaaauggaagccaaaggauuuucuucgccgauaugugcugucauucguugguugugggcuugcgguggucggaaccuacuugcuggugacauuugcacccaacagccacgagaaaaugacuggcgaaaauguaacccgucaucuaguuaguuggccuuuccuccuguauaugcuuguggagaucauucuguuuugcuugcuccuguacuucuauaaggagaaaaacgccaauaacaucgucgugauauuacugcucguggcuuuacugggcuccaugacagucguuaccgugaaggccguagcagggauguuggugcuaucuauucaaggaaaucugcagcucgacuacccaaucuuuuacgucauguucguguguaugguugcuacugccguguaucaggcggccuuccugagccaggcaucccaaauguacgauucaagucuuauugcuagcgucgguuauauccugucuacaaccaucgccauuacggcuggcgccauauuuuacuuggacuucaucggggaagaugugcuccacauuugcauguuugcacugggauguuuaaucgccuuccugggcguauuucuaauaacuagaaacaggaaaaagcccauuccuuucgagccauauaucuccauggacgcuaugccggguaugcagaauaugcaugauaaggggaugaccguucagcccgaacucaaagcgucauuuagcuacggagcacuggagaacaaugacaacaucagugagauuuaugccccugcuacacuuccagugaugcaggaggaacacggcucucgguccgccagcggcguccccuaccgcguguuggaacacacuaagaaagaguga

SEQ ID NO: 59712 - RNA, 1401 nt, Artificial Sequence
  derived and/or modified sequence opt3 from NIPAL4__Homo_sapiens__NP_001092757
augcccggcgacagcuccccugggacccugccacucugggaugccucucuuucaccgccccugggaccugacccagguggcuucaguagagcuagccacgcaggggauaaguccaggcccccugccccagaguugggaucucccggcgcggugcggccucgcgucgguucgugcgcuccagggccgauggaauuacgaguuucaaacacaagcugugagaauggaagucugcuacaucucuacugcuccucucaggaagugcugugucaaaucguaaacgaccuuagccccgaggugccuuccaaugccacuuuucacucauggcaggaacguauuagacagaacuauggcuucuacauaggccugggguuggcauuucucaguagcuuccugaucggaucuuccgucauucugaaaaagaaaggucucuuaaggcugguggccacgggcgcuacccgggcaguugaugggggauuuggcuaucuuaaggacgccauguggugggcugguuucuugacaauggccgcgggggagguggcaaauuuuggagccuacgcuuucgccccagcaacugucgugacaccccugggcgcucuaucaguacucaucagcgccauucugaguucuuauuuucuucgcgagucccugaacuugcucggcaaacuggggugcguuaucuguguggcgggaagcaccgucauggugauacaugccccugaagaggaaaaggugaccacuaucauggagauggcaucgaagaugaaagauacagguuucauugucuuugcuguuuuacugcucgugucuugccuuauccugauuuucguaaucgccccaagauacggccagaggaauauauugauuuauaucauuaucuguuccgugaucggggcuuuuucagucgccgcagugaagggacuaggcauuaccaucaaaaacuucuuccaaggucugcccguugugcggcacccgcucccuuacauacugagucuuauucuggccuugagccucuccacgcaggucaauuuucugaaccgcgcuuuagacaucuucaauacuucucugguguuucccauauacuauguauucuuuaccacaguuguggucacuagcucaauuauccuauucaaggagugguacaguauguccgcgguggauaucgcagggacccucagcggcuuugucacaauuauccugggaguguucaugcuucaugccuuuaaagacuuggauauuucuugcgcuucacugccacacaugcacaagaacccucccccaagucccgccccugaaccaaccguuauacgacucgaggacaagaaugugcugguagauaacaucgaacuugcaagcacguccucuccggaggaaaaacccaaggucuucauuauccauucguga

SEQ ID NO: 59713 - RNA, 8094 nt, Artificial Sequence
  derived and/or modified sequence opt3 from NIPBL__Homo_sapiens__NP_056199
augaacggcgacaugccccacgugccuaucaccacucuggccgggauugcuagccucacugaucuucugaaucaguugccauuaccgagcccccugccugcaacgaccacaaagucucuacucuucaacgccagaauagcggaagaagucaauugccugcuugcuuguagggacgauaaccugguuucacaauuggugcacagucucaaucagguaagcacugaccacaucgagcugaaggauaaccugggauccgacgauccagaaggugacauucccgugcucuuacaggccguccuggcacggucuccuaauguguuucgcgagaagucgaugcagaaccgauacguucaaucaggcaugaugaugagccaguauaaacuuagucaaaauuccaugcauucuagcccagccuccucaaacuaccagcagaccacaaucagucacagccccucuucccguuucgugccuccacagaccucaagcgggaauagauuuaugccgcagcagaacagucccgucccuucuccauaugcuccccaauccccugcaggauacaugccauauagccaucccucgucuuacacuacacacccgcagaugcagcaagccuccgugucaaguccuauuguagcuggcgguuugaggaauauccacgauaacaagguuagcgggccccuguccggaaauucugccaaccaucacgcggacaacccacggcauggcagcucagaagauuaucuacacauggugcaccgccucaguuccgacgauggcgacagcucuaccaugagaaaugcagccucauucccucugaggaguccccagccagucugcagccccgcuggguccgagggaacgccuaaagguucucggccaccgcuuauacugcagucgcagagcuugcccuguuccucaccucgcgacgugccacccgauauccuccuggacaguccugagcgaaagcaaaagaaacagaagaaaaugaaguuaggcaaagaugaaaaggagcagucugaaaaggccgcaauguacgacauuaucagcuccccaucaaaagauagcacuaagcugacccucagacuuucuagggugcgguccagugacauggaucagcaagaggacaugauuagcggggucgagaacucuaauguuuccgaaaacgauauccccuuuaaugugcaguacccgggacagacaucaaaaacuccuauaaccccacaggacauuaaccguccccugaaugcugcccaaugcuugagucagcaggagcagacagcguuccuaccugccaaccaaguacccgugcugcagcagaauaccagcgucgcagcuaagcaaccacagacgucggugguucagaaccagcaacagaucucccagcagggcccuauuuaugaugaaguggagcucgacgcccuggcugaaaucgagcgcaucgagagagaaucugccauugagagggaacgguuuagcaaagagguccaagacaaggauaaaccccuuaagaagcgaaaacaggacucauacccacaggaagcugguggggccacuggaggcaaucgcccggcuagucaggagacaggcuccaccgggaacggaucuagaccugcgcugauggugagcauagauuugcaucaagcagguaggguagacucccaggccucaaucacucaggauagcgacaguauuaagaaacccgaggaaaucaagcaauguaaugaugcuccaguuucugugcuccaggaggacauagucggcucccugaaaagcacacccgaaaaccacccugagaccccaaagaagaaaucggaucccgaauuaucaaagucugagaugaaacagagugagucccggcuggccgaaagcaagccuaaugagaaccgccuaguggaaacgaaaucuagcgagaacaagcucgagaccaaggucgaaacacagacugaggaacugaaacaaaaugaguccagaaccacagaaugcaagcagaacgagucaacuauuguggagccgaaacagaaugaaaacaggcuuagugacaccaagccaaaugauaacaaacagaauaacgggcguagcgagacaaccaagucucggcccgaaacuccuaagcaaaaaggagagucccgaccagaaacgcccaagcagaaaucagacggccauccugagacaccgaagcagaaaggugaugggagacccgagaccccaaagcagaaaggcgaaaguaggccugagacucccaagcaaaagaaugaaggacgcccagagaccccuaaacaccggcaugacaacagaagggacagcggcaagcccuccacagagaagaagccagagguuucuaaacacaagcaggauaccaagucggacagcccgcgcuugaaaucagagcgagcagaagcccugaagcagcggccugaugggcguuccgugagugagucucucagaagggaccacgauaauaaacaaaaguccgacgaucgcggagaauccgagcggcauagaggugaccaaucaaggguacgacgccccgagacucugcggucuagcaguagaaacgaacacggcaucaaauccgauagcucuaagacagacaaacuugagaggaaacaucgucacgaaucaggggauucccgcgagcggccaaguagcggagaacagaagucgagacccgacucuccuagggucaaacagggcgauuccaauaagagccgaucagacaaacuggguuucaagaguccaacgucuaaggacgauaaacggaccgaggggaacaaguccaaaguggacacuaauaaggcucaccccgauaacaaagccgaguuuccuagcuauuugcucggcggacgcucaggcgcacugaagaacuucguuaucccgaaaauuaagagagacaaggaugggaaugugacacaagaaaccaaaaagauggagaugaaaggagaaccaaaggacaaagucgagaagaucgguuuaguggaagaucugaacaagggcgcgaaacccguagugguucuacagaagcucagucuggacgauguccagaaacuuauuaaggacagggaggauaaaagccgguccucuuugaagccuauaaagaauaaacccagcaaguccaacaaagggucaaucgaccagucugugcugaaggagcucccaccugaacuguuagcugagauugaaaguacaaugccccugugugagcgagugaaaaugaauaagagaaagcgcucgacugucaacgaaaaaccaaaguacgccgagaucagcuccgacgaggauaaugacucugaugaagcauuugagucaagcaggaaacgucauaagaaagacgaugacaaggccugggaauaugaggagcgggauagaagguccaguggagaccaccgccgaucuggccauagccacgaagguagacggucauccgggggcggaagguaccgcaaccguaguccuagcgauucugacauggaggauuauuccccgcccccaucacuuagcgaaguugcuagaaagaugaaaaagaaagagaagcagaagaagcggaaagccuacgaaccuaaguugacccccgaggagaugauggacucgucuacguucaagagguuuaccgcaaguaucgaaaauauucucgauaaccuggaggacauggacuucacagcuuucggcgaugacgaugaaauaccacaggagcuacugcucgggaaacaucagcugaaugaacuuggauccgagagcgccaagaucaaagcgaugggcauuauggacaaguugucaacugauaaaaccgugaaggugcugaacaucuuagagaagaauauucaggacgguuccaaacucucuacacugcuuaaccacaauaacgauacugaagaggaagaacgccuguggcgagacuugaucauggaaagaguaaccaagagcgccgaugcuugccucacgacaauaaacaucaugaccaguccuaauaugcccaaagcagucuacauugaggacgugaucgagcggguuauucaauauacuaaguuucaucugcagaacacacuauacccgcaguaugauccaguguacaggcuggacccucaugggggaggccuccuguccagcaaagccaagcgcgcuaaguguucuacccacaaacagagagucaucgugaugcuuuauaauaagguuugcgauauagugucaaguuuguccgaacuguuagagauucaacuccugacugacaccacaauccuucagguaagcucuauggguauuacgcccuucuuugucgaaaacgugucggagcugcagcuaugugccaucaaacucgugaccgcagucuucucaagguacgagaagcaucggcaacugauauuggaagagaucuuuacuagccuggcgcguuuaccaacauccaaacgcagucuccgaaauuucagacugaacucuagcgacauggauggcgaacccauguauauucagaugguuaccgcccuugugcugcaguugauccagugcguagugcaccucccuuccucagagaaggacaguaaugcugaagaggauucuaacaagaaaauugaccaagaugucgugaucacaaauagcuacgagacugccaugaggaccgcacagaacuuucuguccauauuccuaaagaaaugcgggucaaagcagggagaagaggacuaccggccgcuguuugaaaauuucguucaggaucuucucagcacggugaacaaacccgaguggccagcugccgaacuguugcugucuuuacucggccgccugcuuguccaucaauuuuccaauaagaguacagagauggcacugagaguggccagcuuggacuaucucgggaccguugcugcgaggcugcggaaagaugccgugacuucgaagauggaccagggauccauugagcgaauccuaaagcaggucucuggcggugaagaugagauccagcaacugcagaaagcacuucucgacuaccuggacgaaaacaccgagacagauccuucauugguauucagcagaaaguuuuauauugcucagugguuccgcgacacuaccuuagaaacagagaaagccaugaagagucagaaagaugaggaauccucugaggggacgcaccacgccaaggaaaucgagaccacuggacaaauuaugcauagggcugagaaucggaagaaauuccugcguagcauaaucaagacaacccccucacaguuuuccacucucaaaaugaacagugacacaguggauuacgacgaugcaugucugauuguuagauaucuugccagcaugaggccuuucgcgcagucuuuugacaucuaccugacccaaauuuugcgcgugcuaggcgaaaaugcuaucgccguccggacgaaggcaaugaaaugccugucagaggugguagccguggauccauccauacucgcucgacuggacaugcagagagguguccacggcaggcuuauggauaacagcacuucuguucgcgaagcagccguggaguuacuggggcgguucgugcucuguagaccccaguuggcggaacaguauuacgacaugcugaucgagcguauucucgauaccggaaucagugucaggaagcgggugauuaagauccugcgcgacauaugcauugagcaaccuacauuuccaaaaaucaccgaaauguguguuaagaugauccgaagaguaaacgacgaggaaggcauuaagaaacuugugaaugagacuuuccagaaacugugguuuacacccaccccgcauaacgauaaagaagcuaugacaaggaagauauugaauaucacugacgucguggccgcaugccgggauaccggguacgacugguucgagcagcuacugcagaaccucuuaaaaucggaggaagauuccagcuauaagccuguuaaaaaggccuguacgcaacugguggacaaucuugucgagcacauucugaaauacgaagagucacucgcugauucugacaacaagggagugaauagcggccgcuugguagccugcaucacaacccuguuucucuucuccaaaauuagaccacagcugauggucaagcacgcaaugacuaugcagcccuaucuuaccacaaaguguaguacucagaacgauuuuauggugaucugcaauguugcuaaaauacuagaacugguggucccuuugauggagcauccaucagagaccuucuuagccacgaucgaagaggaccugaugaagcucauuaucaaauacgguaugacagugguucaacacugugugucuugccugggggcggucgugaacaagguaacccagaauuuuaaauucgugugggccugcuucaacagguauuacggagcaauuagcaaacuuaagucccagcaucaagaagaucccaauaacacaagucugcucacaaauaaaccggcuuugcugcgaagccuauuuaccguuggcgcccugugucggcacuucgacuuugaccucgaggauuucaaggguaacuccaaagucaacaucaaggacaaagugcuugagcuguuaauguauuuuacuaagcauucugaugaagaggugcagacaaaggcuauaauuggcuugggguucgcauuuauccagcacccuucacugauguucgaacaggaggucaaaaaucucuacaacaauauccugagcgacaagaacucguccguaaaucuuaaaauucaagugcugaagaaccuccagaccuacuugcaggaagaggauacgcguaugcagcaagccgacagagauuggaaaaagguugccaagcaggaggaccugaaagaaaugggagaugugaguucuggcaugagcucauccaucaugcaguuauaucuaaagcagguccuggaggcauuuuuccacacucaaucuagugugcgccauuuugcgcucaauguuauagcacuuacccugaaccagggguugauucaccccgugcagugcgucccauaccugaucgccaugggaacagacccugaacccgcuaugaggaauaaagccgaucaacagcucguggagauugacaagaaauaugcaggcuucauccauaugaaggccguagcugguaugaagaugagcuaccaggugcagcaagcgauaaacaccugucugaaagauccaguucggggguucagacaggacgaauccucaagcgcccuuugcucucaccucuauaguaugauucgcggaaauaggcagcaccgacgggcauuucugaucuccuugcugaacuuauucgacgauacagcuaagacugacgucaccaugcuacuguacaucgccgauaaucucgcauguuuucccuaucagacgcaagaggagccucuuuucauuaugcaucacaucgacauuacacugagcgugucaggcucuaacuugcugcaguccuuuaaagaaucgauggugaaggauaaaagaaaggagaggaaaagcaguccaucuaaggaaaaugaguccagcgacucagaagaggaggucagucgcccgcguaagucccggaaaagaguugauagcgacucugauucagacagcgaagaugacauaaacuccgugaugaagugccuccccgagaacucugccccucugaucgaguucgcuaauguaagucagggcauucuuuuacugcucauguugaaacagcaucugaagaaccuauguggguuuucggauagcaaaauccaaaaguacuccccaucagagucugccaagguguacgacaaagcgaucaauaggaagacuggaguccacuuccaucccaaacagacccuggacuuucuccgcagcgauauggcaaacaguaagauuacagaggaagugaaacgauccauaguuaagcaguaucuugacuucaagcuguugauggagcaccuggauccugacgaagaggaagaggagggugaagugucagccucuaccaaugcucggaacaaagccaucacuagccuccugggcgggggauccccaaagaauaacaccgcugcagagacagaagaugacgagagugauggcgaagacagaggugggggaacgagcggcgucaggcgcagacggucucagaggauuucacaacguaucacuuga

SEQ ID NO: 59714 - RNA, 855 nt, Artificial Sequence
  derived and/or modified sequence opt3 from NIPSNAP1__Homo_sapiens__NP_003625
auggcccccagacugugcagcaucuccgugaccgcuaggcggcuccuuggcgggccuggaccacgcgccggugacgucgcaucugcggcugccgcacgauucuacucaaaggauaacgagggcaguugguuucguagccuguucguucacaaaguggacccgagaaaggaugcccauuccacauuguuaucuaaaaaggaaacuucgaaucuguauaaaauucaguuucacaacguaaagcccgaguaccuagacgcuuauaauucacucacggaagcagugcugccuaaacuucaucuggaugaggacuacccauguagcuuggucgggaacuggaauaccugguauggagaacaagaucaggccgugcaccucuggagguucaguggcgguuaccccgcucugauggacugcaugaacaagcugaagaauaacaaagaguaucucgaguuucggcgcgaaagaucccagauguuacugucuaggcggaaucagcuuuugcuggaguucagcuuuuggaacgaaccucaaccacgcauggggcccaauauauacgagcuacgaacauacaagcucaaaccuggaacuaugaucgaguggggcaacaauugggccagagcgauuaaguauaggcaggaaaaccaggaggcaguuggcggguucuuuucccagaucggagaacuguacgugguccaucaccuuugggccuauaaggaucugcaaucacgggaggaaacccguaaugcugccuggcgcaaaagagguugggacgagaacguguacuauacaguaccauugguuaggcacauggagagucggauuaugaucccgcucaagauaagcccccugcaguga

SEQ ID NO: 59715 - RNA, 744 nt, Artificial Sequence
  derived and/or modified sequence opt3 from NIPSNAP3B__Homo_sapiens__NP_060846
augcuggugcucagaagcggccuuaccaaggcccuggcuuccaggacauuggcaccccaggucuguucuucauucgccacugggccucggcaauacgacggaacguuuuaugaguuccgcaccuacuauuuaaaaccaaguaacaugaaugcguuuauggaaaaccugaagaaaaauauccaccuacgaacaagcuacuccgagcucguugguuucuggucuguggaauuuggcgggcguacuaacaagguauuccauauuuggaaauaugauaauuuugcucacagagccgaggugaggaaggcacuggccaacugcaaggaauggcaggagcagucgauaaucccgaaucuugcucggauugacaaacaggagaccgaaaucacauaccugauucccuggucaaaguuggagaaaccuccaaaggaaggagucuaugagcucgcaguguuccaaaugaaacccggcgguccugcccuguggggagaugcuuuugagcgcgccaucaacgcgcauguuaaucugggguacaccaagguggucggcguguuccacacugaauacggcgagcucaacagaguacauguuuuaugguggaaugaaagcgcagacaguagggccgcugggcggcacaagucccacgaggauccacgcguggucgccgcagugcgagaaucugugaacuaucuggucagccagcagaauaugcuuuugauacccgcuuccuuuucaccucugaaauga

SEQ ID NO: 59716 - RNA, 1752 nt, Artificial Sequence
  derived and/or modified sequence opt3 from NISCH__Homo_sapiens__NP_001263222
auggccaccgcuagaacauucggccccgagagggaagcagagccugccaaggaagcgcggguggucgggagcgagcugguugacacuuacacgguguauaucauucagguaaccgauggaucccacgaauggacagugaaacaucgcuacucugacuuucacgaucuccaugagaaacuugucgcugagcgaaaaauagacaagaaccuguugccaccgaaaaagaucauugguaaaaauucacguaguuuaguggaaaagagagagaaggaucuggaaguuuaucuacaaaaacuccuggccgcauuccccggcgugacuccuaggguccuugcccacuuucugcauuuccacuuuuacgagaucaacgggauuaccgcugcauuggccgaggaacucuucgagaagggagaacagcugcugggcgcuggugagguguuugccaucgggccacuccaguuauaugcgguaacagaacagcugcaacagggaaaaccuaccugcgcaagcggcgacgccaagacugaucuuggccacauauuggacuucacaugucggcugaaguaccuaaaaguuuccgggaccgagggacccuuugguacgucuaauauccaggagcagcuccugccauucgaucuuucgauuuuuaagucacugcaucaaguggaaaucagccacugcgacgcuaaacauauucgcggcuuggucgccaguaagcccacucucgcaacccuguccgugagauucucugcuacaagcaugaaagagguguuagucccugaagccuccgaguuugaugaaugggagccagaggggacuacccuggaaggaccgguuacagcggugauccccaccuggcaggcccucacgacucuugaccugucacacaacaguauaagcgagauugaugaaucuguaaaguugaucccuaaaauugaguuccuagaccugucccacaauggccuccugguggucgacaaccuucagcaucuguauaauuuggugcaccucgaucugucauacaacaaguuaagcagucuggaaggucuacauacaaagcucgggaauaucaaaacccugaaccuugcaggaaauuugcuggagucucucuccggccugcacaaacuuuacagccugguuaacuuggaccucagggauaaucggaucgagcagauggaagaggugcgcucgauuggcucucugccauguuuagaacaugucucccugcuaaacaauccccucucaauaaucccugacuaucgaacuaaggugcuggcucaauucggggagagagccagugagguaugccuugaugacacaguuaccacggaaaaggaguuggauaccguggaaguccugaaagcuauucagaaggccaaggaggugaaaagcaagcucuccaacccagaaaagaagggaggugaggacucuaggcugagcgcagcccccuguauccggccgucaaguuccccucccacagucgcuccagcgagcgcaucuuuaccucagcccauacugucaaaccaaggcaaucgugugugcauucuuuugcucguugagccacacagucccgccugggcuccuuggcugggguggggauggggccgcggugccagcacuuguuuucagcaggggcagacccaaggcggacagugccuacugcaggcaggcccaagagggggaacacacgguaggggcgccuggccggaugcuuccuguugccuccugggggaagacucucagcuuuuguga

SEQ ID NO: 59717 - RNA, 732 nt, Artificial Sequence
  derived and/or modified sequence opt3 from NIT1__Homo_sapiens__NP_001172021
augcugggcuucaucaccagacccccucacagguuucucagccuucugugcccaggguugcggauuccgcaguuauccgugcugugugcccaaccccgcccucgagcuauggcaauaucuucaaguagcugcgagcuaccacucgucgccguuugucaggugacauccacucccgacaagcagcagaacuucaaaacgugcgcggaacugguacgugaggcugccagacuuggagcaugucuggccuuuuugccugaagcauucgauuuuaucgcaagggacccagccgagacccuccaucugucugaaccccuggguggcaagcucuuagaggaguacacacaacuggcucgggaaugcgggcuuugguugucgcugggaggcuuccacgagcgcggucaggauugggaacagacucagaaaauuuauaauugucaugugcuacucaacucaaagggggccgucguggcgaccuacagaaaaacacaccugugcgacguugagaucccuggacaaggcccaaugugugagagcaauaguaccaugccgggccccucccuugaaucuccugugagcacuccagcagggaagauuggacuggccgucugcuaugauaugagguuucccgaguugucccucgcucuggcccaggcuggugcugaaaucuuaacauacccuucagccuucggcaguauaaccgggccagcgcauugggagcccgugagcucuuga

SEQ ID NO: 59718 - RNA, 831 nt, Artificial Sequence
  derived and/or modified sequence opt3 from NIT2__Homo_sapiens__NP_064587
augaccagcuucagacuggcccucauccagcuucaaauuuccucuauaaagucagacaacgugacaagggcuugcaguuuuauccgggaggcagccacucagggcgcgaaaauugucagccugcccgaauguuucaauuccccuuacggggcuaaguauuuuccagaguacgccgagaaaaucccgggagaaucuacgcagaaguugucggaaguugcaaaagagugcucaauuuauuuaaucgguggcagcauacccgaggaagaugccgggaagcuguacaacaccugugcuguguucggaccugacggcacacuacucgcaaaguaucgcaaaauccaccuguuugauauugacguaccagguaagaucacuuuccaggagaguaaaacccuuucccccggggauucuuuuagcacauucgacaccccuuacugccgagugggacugggcauuuguuaugauaugcguuuugccgaauuggcucaaaucuacgcccagagaggcugccagcuccuggucuacccaggggcguucaaucugacuacaggacccgcacauugggagcucuuacagaggucccgggccguggacaaccaaguuuauguggcuaccgccaguccugcacgcgaugacaaggcuucauacgucgccuggggucacagcacggugguaaauccauggggcgagguucuggcgaaagccgggacugaagaggcaauaguguauucugauauugaccuuaagaaguuggcugaaaucagacagcagauuccggucuuuaggcagaaacgguccgaucuguacgccguggagaugaagaaacccuga

SEQ ID NO: 59719 - RNA, 627 nt, Artificial Sequence
  derived and/or modified sequence opt3 from NKAIN2__Homo_sapiens__NP_001035304
augggcuacugcagcgggagauguacccugaucuucauuugcggaaugcagcucguguguguccuugagaggcaaauauuugacuuccuggguuaucagugggcccccaucuuggcuaacuuuguucacauuaucauugugaucuuaggccuguucgggacaauacaguaccggccucgcuauaucacuggauacgcaguauggcuagugcucugggucacguggaauguguuuguuauuugcuucuaucuggaagccggcgaucuuuccaaggagaccgaccugaucuugacauuuaacauuucuaugcaccgaucaugguggauggaaaaugguccaggguguacugugaccagugucacaccggcgcccgauugggcuccugaggaccaccguuacaucaccgugagcggaugccuccuggaauaucaguacauagagguagcccauuccucucugcaaauuguucucgcauuagccggcuucaucuacgcuuguuauguggucaaaugcauuacugaggaagaggauucguuugacuucaucggcggguuugauucauacggauaucaggguccacagaagacaagccaucugcagcuucaacccauguacaugaguaaauga

SEQ ID NO: 59720 - RNA, 657 nt, Artificial Sequence
  derived and/or modified sequence opt3 from NKAIN3__Homo_sapiens__NP_001291462
augggcugcuguaccgggagaugcagccugaucugucucugcgcccuucagcugguguccgcuuuggagaggcaaauuuucgacuuuuuaggauuccagugggcacccauacuggguaacuuucuacacaucauugucguuauccucggccuguucgggacaauucaguaccggccucgcuauaucaugguguacacuguauggacggcccuuugggugaccuggaaugucuuuauaaucuguuucuaucuggaagugggaggcuugucuaaggauacagaccucaugacuuuuaacauuucaguucaucgaaguugguggcgugagcacgguccagggugcgugagaaggguccugccgcccagcgcgcauggaaugauggaugacuacaccuauguguccguaacaggcuguaucguugauuuccaguaccuggaagugauucacucugcuguccaaauccucuuaucgcuggugggcuuuguguaugccugcuacgucauaucaauuagcauggaggaagaggacaccuucgauuuuaucgggggacuugacacucauaguuacuaucaggaucacguugaguugaaaccugugaagccaguagaaauuuccaaugacaucgagcccgaaaugcggcugcuaaaccucacauga

SEQ ID NO: 59721 - RNA, 1248 nt, Artificial Sequence
  derived and/or modified sequence opt3 from NKAP__Homo_sapiens__NP_078804
auggcccccgugagcggcuccagaucuccugacagggaggcuucagggaguggaggucggcgccgaagcuccucuaagucgccaaaaccgucaaagagcgcacguagucccagaggcaggcggucccgcucucacagcugcuccagaucaggggauaggaacggacugacccaucagcucggcggucuuagucaagggagccggaaucagucuuaccgcucccgaucaagaagcaggagucgggaacguccuucugccccacgcggaauccccuucgcguccgcuagcucgucugucuauuacggcuccuauucaagaccuuacggcagugacaaaccauggcccagccuguuggauaaggagagggaagaguccuuacggcagaaacgacugucugaacgcgagagaauuggggagcuaggagccccugaaguuuggggucucagcccaaagaacccggagcccgacucagaugaacacacaccuguggaggacgaggaaccaaagaaaaguacuacguccgcaagcaccucugaggaagagaagaaaaagaaaucaaguaggagcaaggaacgguccaagaaacgcagaaagaaaaagucuucgaaaaggaagcauaaaaaguauagcgaggauuccgacucagauagugacucugagacagauagcuccgacgaagauaauaagcgucgggccaaaaaggcuaaaaagaaagagaagaagaaaaagcaccgaagcaaaaaguacaaaaagaagagaagcaaaaagucuaggaaagaauccagugacucaucuuccaaggagucacaggaagaguuucuggagaaccccuggaaagaccgcacuaaggcagaagaaccuagugaucuuauaggcccagaagcccccaagacccugacaagccaagacgauaaaccguugaauuaugggcaugcucuccugccuggagagggcgccgcgauggcagaauacguaaaggccgguaaacggauccccagacgcggggagauuggacugaccucggaggaaaucgcuuccuucgaguguucuggcuacgugaugagcggcucaaggcaccgacggauggaagccguccgucucagaaaggagaaccagauuuauagugcagacgagaaaagggcuuuagccuccuuuaaucaggaggagcgccggaagagagaaaacaaaauccuggcgucuuucagggagaugguguaccgaaagacuaaggggaaagaugacaaguga

SEQ ID NO: 59722 - RNA, 1413 nt, Artificial Sequence
  derived and/or modified sequence opt3 from NKD1__Homo_sapiens__NP_149110
augggcaagcugcacagcaaacccgccgcugugugcaagagaagggaguccccugaaggggacucuuucgcagucucagccgcgugggcucggaaaggaaucgaggaauggauuggucgccagcgauguccaggcgggguuaguggaccgcgucaacucagacuugccggcaccauagguaggagcacacgggagcuggugggggauguauugcgcgacacuuuauccgaagaggaggaagaugacuuuagacuggagguggcacuacccccugaaaagacggauggacucggcucuggcgacgagaaaaagauggagagggucucggaaccaugccccgggucaaagaaacagcugaaguucgaggaacuucagugugaugugagcauggaggaagacagucggcaggaguggaccuuuacacuguacgauuucgacaacaauggaaaaguuacucgcgaggauaucaccuccuugcuccauacaauuuaugaaguggucgacucuagcgugaaccacuccccuaccucaaguaagaugcugcgaguaaaacugacuguugccccagaugguagccaaucuaagagauccgugcucgucaaucaggcugacuuacagucagcaaggccccgggccgagacaaagccuaccgaagaccugcguagcugggagaaaaagcagcgcgcuccacuuagauuucaaggcgauaguagguuggaacagucugggugcuaccaucacuguguggacgagaacaucgagcggcgaaaucauuaucuggaucuagccggaauugaaaacuacacgucccaguucggcccggguagccccucgguggcgcagaaaucugagcucccuccacgcacuuccaaucccaccagaucaaggagucacgaaccugaggcaauccacauaccacaucggaagccccaaggggucgacccggccagcuuucacuuccuggauacaccuaucgcuaaaguuuccgaacuucagcagcgccugagaggaacucaagacggcucuaagcauuuugugaggagccccaaagcccagggcaagucaguaggggugggacacgucgcacguggugcucggaacaagccaccuuugggccccgccauuccagcggugagucccuccgcccaccucgcagcuagcccugcccuguuaccaucucuggcuccgcucgggcauaaaaagcacaaacaucgagccaaggagucacagcagggaugcagaggccuucaagcaccccuggccaguggugggccuguuuugggcagggagcaccuacgcgaacugccagcucucguggucuaugagagccaggcgggacagcccgugcagcggcaugaacaccaccaucaccaugagcaccaccaucacuaccaucacuucuaucaaaccuga

SEQ ID NO: 59723 - RNA, 936 nt, Artificial Sequence
  derived and/or modified sequence opt3 from NKD2__Homo_sapiens__NP_001258011
augggcaagcugcagagcaaacacgccgcugcagccagaaagaggcgggagucccccgaaggggacucuuucguggcgucagcuuacgccaguggacgcaaaggugcagaggaagccgagcgacgugcuagagauaagcaagaacucccuaacggcgacccaaaagaggggccguuuagggaggaucagugcccccuucaggucgcacugccugccgaaaaggcugagggacgggaacauccaggccaguuguuaagcgccgacgauggugagcgcgcggcaaauagagaggggcccaggggaccuggcggccaacggcugaacaucgacgcccuacagugugauguuuccguggaagaggacgaucgccaggaauggaccuucacacucuaugacuuugauaauugcgggaagguaacucgagaggacaugucuucgcugaugcacacgauuuacgaaguggucgaugcuucagugaaccauagcaguggauccucuaaaacccuuagaguuaagcugacagugagcccagagcccuccucaaaaaggaaggaggguccuccagccggccaggaccgggaaccgacucguugucgcauggagggggaauuggcagaggaacccagagucgcugacaggcggcucagugcccacgugcgacgcccuagcaccgauccacaacccugcucugagagaggaccuuauuguguagacgagaauacagaaaggcggaaccauuaccuggaucuggcgggcauagagaauuauaccucccgcuucgguccagggucacagcucugcgagaaaagaagcagugcccccaggacucacucuggagacaaggcacguggcguuggcuuaugucgggaacuguggucccaggcugggcacccgcaguggccuggacccuuuccaagcggucuuguggccgucuga

SEQ ID NO: 59724 - RNA, 498 nt, Artificial Sequence
  derived and/or modified sequence opt3 from NKG7__Homo_sapiens__NP_005592
auggagcugugcagaagccucgcccuucugggcggguccuugggauuaauguucugucugaucgcucuaucuaccgacuuuugguucgaagcagugggucccacacacucagcccauaguggccucuggccuacugggcacggagauauuauaagcggcuacauccaugucacgcagaccuuuuccauuauggcgguucugugggcucuugugucuguaucguuccugguguugucaugcuuuccaagccucuucccgcccggucacgggccucuggucaguacaacugccgcauuugccgcugcaaucuccauggugguugccauggcuguguauaccucugagaggugggaccaaccaccccauccucagauucagacauucuuuagcugguccuucuaccugggaugggucucagccauccucuuacuguguaccggcgcgcuuaguuugggcgcacacugcgggggaccacggcccgguuaugaaacucuguga

SEQ ID NO: 59725 - RNA, 579 nt, Artificial Sequence
  derived and/or modified sequence opt3 from NKIRAS1__Homo_sapiens__NP_065078
augggcaaggggugcaaaguggucguuuguggacugcucagcguggguaagaccgccauccuugagcagcuguuguacggcaaccacacaauugggauggaagacugcgagacuauggaagauguauauauggcuuccguggagacggacagaggagucaaagaacaauuacaucuguacgauaccagaggccuacaggaggguguggagcuccccaagcacuauuucucuuuugcagacggguucguucugguguacucagucaauaaccuugaaaguuuucagcggguggagcuguugaaaaaggaaauagauaaguucaaagacaagaaagagguagccaucguugugcucggaaauaagauugaucugagcgagcagcgccaagucgacgcggaaguggcucagcagugggccaaauccgagaaggugcgacugugggaagucacaguuacugaucguaagacccucaucgagccuuuuacauuacuggcaucuaaacuuucgcagccacaaucaaagagcaguuucccguugcccggcaggaaaaacaagggcaauuccaacucugaaaauuga

SEQ ID NO: 59726 - RNA, 408 nt, Artificial Sequence
  derived and/or modified sequence opt3 from NKIRAS2__Homo_sapiens__NP_001138400
augggcaagagcugcaaaguggucguuugugggcaggccuccgugggaaagaccucuauccuggagcaacuccuuuacgguaaccacguagugggcucagaaaugauugagacacaggaagacauauaugucgggaguaucgagacugauagaggagugagggaacagguuacgauugugguccugggcaauaaaugcgacuugcaggagcaacggcgcguggaucccgacguagcucagcauugggcaaagagcgagaaaguuaaguuaugggaaguguccgucgccgaucgacguucucugcuagagccuuucguguaccucgcgucgaagaugacccagccacagucaaaaagcgcuuuuccgcugaguagaaagaacaaagguuccgggucucuugacggauga

SEQ ID NO: 59727 - RNA, 2118 nt, Artificial Sequence
  derived and/or modified sequence opt3 from NKRF__Homo_sapiens__NP_001166958
augggcuucaugcugccccucaucuuuagauacagcccuaggcuuauggagaagauucugcagauggccgaagggauagacaucggagagaugccauccuaugauuugguguuaucuaaaccgucaaagggucaaaaacggcaccugaguaccugcgacggccagaacccaccuaagaaacaggcugggagcaaguuccaugcacgcccacgauuugaacccguccacuucguugccuccucuucgaaggaugagcgucaggaagacccuuacggaccacaaacaaaagaggugaaugagcagacucauuuugcgucaaugcccagagauauuuaucaggacuacacgcaggauagcuucaguauccaagacggcaacucccaguauugugauucuagcgguuuuauucuaaccaaggaccagccuguaacagcuaauauguacuucgauuccgggaacccagccccgucaacuaccagucagcaagcaaauagccagucuacacccgaaccuuccccaucacagaccuuucccgagagcguggucgccgaaaaacaauauuucaucgagaagcucacugcuacaauauggaaaaaccugaguaauccugagaugaccucuggauccgacaagaucaacuacacguacaugcuuacuaggugcauucaggcauguaagaccaauccagaauauaucuacgcaccccugaaagagauuccgccugcugauauccccaagaacaaaaaguugcucacagacggcuaugccugcgaagugcggugucagaauauauaccugacuaccggcuaugcggggagcaaaaacggaucgcgcgacagagcaacagagcuggccguuaagcucuuacagaaaaggauugaagugcgggucgugcgccgaaaguuuaagcacaccuucggugaggaucugguaguuugccaaaucggcaugucuuccuacgaguuucccccugcucuuaaacccccagaagacuuggugguccuggggaaggaugccucaggacagcccauuuucaaugcaagugcuaaacauuggacgaacuucgugaucacugagaaugccaacgacgcgaucggcauucuaaacaauagcgccuccuuuaacaagaugucuauagaauauaaauacgagaugaugccuaauagaacauggaggugucggguguuccuccaggaucacugccuggcagaagguuacgggaccaagaagacuagcaaacacgcugccgcugacgaggcccuuaagauccugcagaaaacacaaccaaccuauccgucagucaagaguucccagugucauacgggaagcucuccccguggcucaggcaaaaagaaggauauuaaagacuugguuguguacgagaacaguagcaauccuguaugcacccucaacgauacagcacaguuuaaucgcaugacuguggaauaugucuacgagagaaugaccgggcugagguggaaguguaaagugaucuuagaauccgagguuauagccgaagcugugggagucaagaaaacagugaaguaugaggcggccggugaggccguaaagacucugaaaaagacccagccaacaguuauuaacaaucucaaaaagggcgcuguggaagacgucaucucucggaacgagauccaagggcgaucggccgaagaggcauacaaacagcagauuaaggaggauaauaucggaaaccagcuucugcgcaaaaugggcuggaccggugggggcuugggaaagagcggcgaagggauuagagagcccauauccgugaaggaacaacacaaaagggagggacuaggucuggacgucgaacgggugaauaagaucgccaaacgcgacauugagcagaucaucagaaacuaugcuaggucagagagucauacugaucucacguucucucgugaacugacaaaugacgagcggaagcagauucaccaaauagcccagaaauacggccuuaagagcaagucccacgggguuggacaugaucgauaccuggugguaggcagaaaaaggcgcaaggaagacuugcucgaucagcugaaacaggagggucaagucgggcacuaugaauuagugaugccucaggcaaacuga

SEQ ID NO: 59728 - RNA, 4389 nt, Artificial Sequence
  derived and/or modified sequence opt3 from NKTR__Homo_sapiens__NP_005376
augggcgcccaggacagaccccaaugccacuucgauaucgagauuaacagggaaccuguggggcggauaauguuucagcuguucagcgacaucuguccaaagaccugcaaaaauuuucucugucuuugcuccggagagaagggucugggcaaaacaacugggaagaaauuguguuacaagggaucuacguuccaucgcgucguuaagaacuuuaugauucagggcggugauuucucagaagggaauggaaaaggcggcgagaguaucuaugggggauacuuuaaggacgaaaacuucauuuuaaaacacgaucgagcuuuucugcuaagcauggcaaaucgugguaagcauaccaacggcucccaguucuuuaucacaacuaaaccggcgccccaccucgacggggugcauguaguguucggacuggucauaucuggcuuugaggugaucgagcaaauugaaaaucuuaagaccgaugccgcuucgagaccuuaugccgacguuagggugaucgauugcgguguccuggcaacaaagucaauuaaagacguguucgagaagaaacggaagaaaccaacccacagcgaagggagugauuccucuagcaacuccucaaguagcucugaguccucaagcgagagugaauuggagcacgaacgcucuagaaggcggaagcauaaacgccgacccaagguaaagagauccaaaaagaggcggaaagaggccagcucgucugaggaaccucguaauaagcacgcuaugaacccaaaaggacauuccgagcgcucagacacuaaugaaaagagaaguguugauagcuccgcaaagagggagaaacccgugguccggccugaagagaucccaccggugcccgaaaaccgauuccuccugcgcagagacaugccuguggucacagccgagccagagcccaagauaccugacguugcuccaauugugucugaucagaaacccagcguaucaaagaguggcaggaaaaucaagggccgggggaccauucgcuaccacacgccgccuagauccaggagcuguucugaaucagacgaugacgauaguagcgagacucccccacacuggaaggaagagaugcagcgucugcgggccuaucgaccucccuccggagaaaaauggucuaagggugacaaacucucggauccaugcagcuccagaugggacgagaggucauuaagucagcgcucucggagcugguccuacaauggcuauuacucagaucugagcaccgcgagacauucugggcaccauaagaaaaggcgcaaggagaagaaagugaagcacaaaaagaaaggaaagaaacaaaagcauugucgacggcacaagcagacaaagaagcguagaauccuuauccccuccgacauugaaaguagcaaaucuuccacuaggcgcaugaagucaaguugcgaucgggagagaagcucgagguccucuagcuugucaagucaccauuccucuaaacgagacuggagcaaguccgacaaggauguccagucaagccugacccacaguucucgcgacuccuaccggagcaaaucgcauucacagucuuauaguagaggcuccagcaggucucguacagcaagcaaguccucaagucacagccgcucucgguccaaaucaagaaguagcuccaagucuggucacaggaaacgagccagcaagagcccucggaagaccgcuucacaacuauccgaaaacaaaccagugaagacggagccgcuccgcgccacuauggcacagaaugagaacguugugguccagcccgugguagcugaaaacauaccuguuaucccacugagugauucucccccuccaagcagauggaaacccgggcaaaagccguggaaaccuuccuacgagaggauucaggaaaugaaggccaagacaacccaucuucugccaauccagucaacuuauucuuuggcgaauauaaaagagacaggcagcaguuccagcuaccacaagcgggagaaaaacucugaaucagaccaguccaccuauaguaaguacagcgaucgaucgucugaguccagccccagaucacgcaguaggucuucccguagccggucauauaguagaagcuacacgaggucccgcucucucgccagcucccauucacgaucuagaaguccuucgagccggucccacucuaggaauaaauacucagaccauagccaauguucccgcaguucuagcuauaccucaauuuccagugaugacggacguagagcaaagcggaggcugcgcagcucuggcaaaaagaacuccgugucacacaagaaacacagcucgucuagugaaaagacauuacauuccaaauacgucaaggggcgagauagaagcucaugcgugcggaaauauuccgagucuaggagcagucuggacuacuccagcgauucugaacagucaaguguccaggcuacucaguccgcccaagagaaggaaaagcagggacagauggagcgcacccacaauaaacaggagaagaacagaggugaagagaaaagcaagucugaaagggagugcccccauucgaaaaagcggacacucaaggaaaaucuuucagaccaucugcguaacggcagcaaaccaaagcgcaaaaauuaugcuggguccaagugggauagugagucuaacagcgagcgagacgugacuaaaaauuccaagaacgacucacacccuaguucugauaaggaagagggagaagccaccagcgacuccgagucagagguuagcgaaauccacaucaaagugaagcccacaaccaaaucuuccacuaauacgaguuugccagaugacaacggcgcauggaaaagcucgaaacaaagaacauccaccucugauucagaggguagcuguaguaauuccgaaaacaacagggggaagccgcagaagcacaaacauggcucuaaggagaaucuaaaacgggaacacacuaagaaaguaaaggagaaacugaagggaaagaaagacaagaaacauaaggccccuaaacgcaagcaggcuuuucacuggcagcccccacucgaguucggcgaagaggaagaggaagagauugaugacaagcaagucacccaggagagcaaagaaaagaaagugucagagaacaaugaaacaaucaaggauaacauucugaaaaccgagaaguccagugaagaggaccuuagcgggaagcacgauacuguuacagugucuucagaccuggaucaguuuacgaaagacgacuccaaguugagcauaucucccaccgcgcucaauacugaggaaaacgucgcaugccugcaaaauauccagcauguggaggaaaguguaccuaacggaguggaggauguuuuacagacagacgauaauauggagauuuguaccccagacagaucgucccccgccaaagucgaagagacaagcccucuggguaacgcuaggcuagauacuccggacaucaauaucgugcucaagcaggauauggccaccgaacacccacaagcagagguggucaaacaggaaucaucuaugagcgaguccaagguucugggcgagguggggaagcaggacaguucaucugccagccuugcuuccgccggagaaaguacgggcaaaaaggagguggcagaaaaaucgcagauuaacuugauagauaagaaauggaagccccugcaagguguagggaaucucgcggcuccuaacgccgcaaccuccucugccgucgaggugaaaguucugacaacugugccagaaaugaagccccagggccuucggaucgagauuaagagcaaaaauaagguccgaccuggaagccuguucgacgaggugagaaaaaccgcucgcuugaacaggcggccgcguaaccaggaaucguccagugaugagcagacacccucuagagacgacgauagccaaucaagguccccaucucgcagucggagcaaguccgaaacuaaaucacgacauagaaccaggagcguuucuuacagucacucccgcagccggucaagaucuuccacgucgagcuaucguaguaggucuuacucccggagccgcucacgaggcugguacaguagagggaggacacggucccgcucaucuucauauagaagcuacaagucccauaggaccucuagucgaucgcggagccguuccucaucuuaugacccucacagcagaagucgcuccuacacuuaugauucauacuauucuaggagccgguccagaagucgcagccagaggucugacucauaccaccgaggacgguccuacaauagaaggagccgcaguugccguucuuauggcuccgauucggagagcgaccggucauacucccaucacagaucucccagugaaagcucaagguauuccuga

SEQ ID NO: 59729 - RNA, 1347 nt, Artificial Sequence
  derived and/or modified sequence opt3 from NKX1-1__Homo_sapiens__NP_001277008
augagcgccuccggccccgaggcuccuggggacaucccagcacugccgcccccuccacagcccggaucugguccugccccacccgcgccugcugccgcagcccaagaagcuauggauggcagagcagagcucccagccuucccgagggcuggggcgcccccucuugccgcaucagacaccgugccagccgcucccgaaggagccggcgcagcucggccugccgcgccacugcgccccacaaguuuuagcgucuuggauauuuuagacccgaacaaguucaauucccgacguagaaggugcguucugcuagguccuguggcccccgcagcuugugccccaugcgcuucugccccuugugcacccgccccagcugcgucggggcggcccccucgcgcagaggaacucgagagaagggcccuggcuggagccggcggcguaggggcagccggagcugagccaccgaacgccggugaucccuuuaaagcaggcgaagcggagacuaaugacacgaacggguacucaagcggaggcggugggcacaguccuuccgcugauucuggagacgaagugccagaugacgaggaugacgaugaggacgaagcccccgagaccgaagcagcccggggcgcugaggaagcccgcggcgggggagguggccuuggggcacgaggaagcggcugccagggugcugccgagacagacgcguccccuggggccacugucgaugaggcugcagccccaggccccagagaaaauucaccgguggcucagggaccuccaggcggggccgcagcgcccggaggugccggcaccacaccucaggggaccgcuacugccgcaaagcccaaaaggaagcggacaggaagugacagcaaaucuggcaagccacgucgcgcuagaaccgccuucacguaugagcaacugguugcauuggaaaacaaguuuaaagccacuagguaccucuccgugugugagcggcugaaucuggcucucucauuaagccugaccgaaacacaggucaagauaugguuccagaaccgacgcacuaaauggaagaaacagaauccuggugcggauaccagugcccccacagggggcggaggcgggccaggaccgggugcaggcccugggaccggacuucccggcgguuugucuccacugucccccagcccuccaaugggggcuccccuaggcaugcauggaccugccggcuauccggcccacgggccaggaggccucgugugcgcugcacaacugcccuuucuuucgucuccugccguacuguccccauucguuuuggguucacagacguacggggcgcccgcuuuuuaugccccucaucucuga

SEQ ID NO: 59730 - RNA, 933 nt, Artificial Sequence
  derived and/or modified sequence opt3 from NKX1-2__Homo_sapiens__NP_001139812
augcuggccuggcaggacggcggggcuaaggcagcccccagccaccauaaaaucuccuucucugugcucgauauucuugacccucaaaaguuuaccagagcggcucugccagccgucaggccggcaccccgggaggcccgcaaaucauuggcugaaguugaggcaggaaaggaugccaguagccgagacccugugcgucaguuagaaacaccagaugcugccggucccggcgcggggcaggcauccccucuggagggaucugaagccgaggaggaagaggacgcugaagauccaagaaggccccggcuacgcgagagagccgcaaggcuccugccuggccuugcucggucgccagacgccccggcgggugcccuggcaucaggggagcccugcgaagauggaggcggcgggccuguacgcagcccacccggaaguccugguuccccacgacccagaaggcggcguuuggagccgaacugugcuaaaccucgcagagccaggacugcuuucacguacgaacagcucguggcccuggagaauaaguuucgggcaacccgauaucugucugucugcgaacgccucaacuuagcccugagccuuuccuugacagagacucaagugaagauaugguuccagaauagaaggaccaaauggaagaaacagaaccccggcgcugacggggcggcacagguuggaggcggugccccacaaccuggggcugccggaggcggcgggggagguggcucagggggaagucccggcccacccgguacaggggcacugcacuuucagaccuucccuagcuacucugccgcuaaugugcuauuuccauccgccgcaucauucccgcucacugcggcugcccccggcagcccuuuugcaccauuccugggacccaguuaucuuacaccuuuuuacgccccacggcuguga

SEQ ID NO: 59731 - RNA, 1206 nt, Artificial Sequence
  derived and/or modified sequence opt3 from NKX2-1__Homo_sapiens__NP_001073136
auguggagcggcggguccggaaaggccagagguugggaggcugcagccggcgggaggucuucacccggacggcugagucgccgacguaucaugagcauguccccuaaacacaccacaccauucucugugucggacauucucucaccgcuugaagagagcuacaagaaagucggcauggaaggugggggacugggcgcgcccuuggcugccuauagacagggccaagcagccccuccaacugcugcaaugcagcagcaugccguugggcaccauggagcugugacggccgcguaccacaugaccgcagccgguguaccccaguuaagucauuccgcugugggcggguauugcaacggaaaucugggcaacaugucugagcuaccuccauaccaagauacaaugaggaauagcgccuccggucccgggugguauggagcaaacccugacccacgguuuccggcuauaucacgcuucaugggccccgccaguggcaugaauaugagcgggaugggaggucucggcucucugggggaugucuccaagaacauggcgccucuuccaucagcccccagaaggaaacggcgcgugcuguuuagccaggcacagguuuacgaauuggagcgaagauucaagcagcaaaaguaucucagugcuccugagagggaacaccuggccucuaugauccaccugacuccaacccaggugaaaauuugguuucagaaucaucgguacaagaugaaacgucaggcuaaggacaaagccgcacaacagcagcuccaacaggauuccggaggcggugggggcggaggcgggacaggauguccccagcagcaacaggcccagcagcaaagcccgcgcagagucgcugugccuguauuaguuaaggacgguaagcccugccaggcgggcgcaccagccccuggggcugccucgcugcagggacacgcacagcaacaggcccagcaucaggcucaagccgcacaggcggcugccgcagccaucucugugggcuccgguggggcuggccuuggagcccaccccggccaccagccagggucagcaggacaaagucccgauuuggcucaucacgccgcgagcccugccgcucugcagggucaggucuccucucuaagccaucucaacucaaguggcuccgacuacgggaccaugagcuguucuacucugcuuuauggaaggacaugguga

SEQ ID NO: 59732 - RNA, 822 nt, Artificial Sequence
  derived and/or modified sequence opt3 from NKX2-2__Homo_sapiens__NP_002500
augagccugaccaacacaaagacuggcuucuccgugaaagacauccucgaucuuccagacacgaaugaugaggaagggucugucgccgagggaccugaagaggaaaacgaggguccagagccggcuaagagagcaggcccccuggggcagggagccuuggacgcgguucaaucauuaccucugaaaaauccauuuuacgauaguagcgacaaccccuauaccagguggcuagcuuccacagaaggccuccaguacucucugcacggucuugccgcaggggccccuccacaggauucgucaagcaagagucccgagccuuccgcugacgaaucuccagauaaugacaaagagacuccgggaggcggcggggaugcaggaaagaagcggaaacgccgagugcuguucagcaaggcccagaccuaugaguuggaacguagauuuaggcaacagcgguaccucuccgcucccgagcgcgaacaucuggccucacugauuagacucacaccuacccagguaaaaauaugguuccagaaccacagguauaagaugaaacgggcgcgcgcagagaaggguauggaagugacuccauuacccaguccucgaagagucgccgugccaguucuggugagggacggcaagcccugccaugcucuuaaagcccaagauuuggcagcugccacauuucaggcggggaucccguucagcgccuacucugcacagucccugcagcacaugcaauauaaugcucaguacucaagcgccaguaccccucaguaccccacggcucauccccuaguccaagcccagcaguggacuugguga

SEQ ID NO: 59733 - RNA, 1095 nt, Artificial Sequence
  derived and/or modified sequence opt3 from NKX2-3__Homo_sapiens__NP_660328
augaugcugcccagcccugugaccuccacaccauucucugucaaggacauccucaaccuugagcagcaacaccagcauuuucacggcgcccaucugcaggcugauuuggaacaccauuuccacucagcaccgugcauguuagccgcggcugaggggacucaguuuagugacggaggugaagaggaugaagaggacgagggcgaaaaacugagcuaccuaaauucccucgccgcagccgaugggcacggagacucuggccuguguccccaagguuauguucauacggugcuuagagauucgugcucagagccuaaggaacacgaggaggaaccagagguagugagggaccggagccagaaaaguugucagcugaagaaauccuuggaaaccgcuggggauugcaaggcagccgaggaaucugagcgccccaagccucgaagccguagaaaaccaaggguccucuucucccaggcucaaguguuugagcuggaacggcgcuucaagcagcagagauaccugucagcccccgagagggaacaucucgcgaguagcuuaaaacugacaucuacucagguuaagauuugguuucaaaaccggcgcuauaaauguaagcgacagagacaggacaagucccuugaguugggagcacacgccccuccaccgcccccuaggcggguggcugucccagugcugguacgugauggcaaacccugcguuaccccuucagcccaagcauacggcgcuccauauagcgugggggccagugcguacucuuauaauuccuuccccgccuacggauacgguaacagcgcagcugccgcugccgcagccgcugcggcagccgcugccgcagccgcuuauucgucuuccuacggcugugccuauccggcagggggaggcggugggggaggcggcacaucagcggcuaccacugccaugcagccugcaugcagugccgcugggggaggucccuuugucaaugugagcaaccuaggcggguucggauccggcgguucugcccagccacuccaccaggggacagcagcuggcgccgcgugugcccaaggaacccugcagggcauacgcgcuugguga

SEQ ID NO: 59734 - RNA, 339 nt, Artificial Sequence
  derived and/or modified sequence opt3 from NKX2-5__Homo_sapiens__NP_001159647
auguuccccagcccugcccugaccccaacaccguuuuccgugaaagacauccucaaccuugagcagcaacagagaucucuggcugcagccggcgaauugucagcgagguuagaggcuacucuggcccccaguagcugcaugcuagcagccuucaaaccugaggcuuacgcagggccagaagccgcugcccccggacucccugaacugcgggcggagcuuggucgcgcaccaucccccgccaagugugcuucugccuuuccugcagcuccagccuucuauccgcgagcguacucggaucccgacccugccaaagauccacgugcagagaagaaggcuuga

SEQ ID NO: 59735 - RNA, 906 nt, Artificial Sequence
  derived and/or modified sequence opt3 from NKX2-6__Homo_sapiens__NP_001129743
augcugcucagccccgugaccuccacaccuuucucugucaaggacauccuuagacuggagagggaacggucaugcccagccgcuaguccgcacccccgcguucgaaaaagcccugagaacuuucaguacuugcguauggaugcagaaccaagaggcuccgaggugcauaaugccgggggagguggcggggacaggaaguuagauggaucugaacccccuggcgguccaugugaggcgguacuggagauggacgcugaacggaugggggagccccaaccuggacuaaacgccgcaucgccacucggcggcgggacucgcgugccggaaagaggagucgguaauucaggcgauagcgugaggggagggcggagugagcagcccaaagcccgccagcgaagaaagccuaggguucuguucucccaggcucaagugcuugcacuggagcggcguuuuaaacagcagcgcuauuugucugccccagaaagagagcaccucgcuagcgcccugcagcugacguccacccaagucaagauuugguuccagaacaggcgguacaagugcaaacgacagcgccaggacaagucacucgaauuagcgggccauccccugacaccuagaaggguggcaguaccaguucuugugcgggaugguaaacccuguuuggggccgggaccuggcgcccccgcuuuuccaaguccuuauagcgccgcagucucucccuacuccugcuauggcggguacucaggagcuccauauggugccggcuacgggacuuguuacgcgggagcccccagcggcccugcaccacacaccccgcuggcuagugccgguuucgggcauggcggacaaaaugcuacaccccagggccaccuagccgcaacccuccagggggugcgcgccugguga

SEQ ID NO: 59736 - RNA, 720 nt, Artificial Sequence
  derived and/or modified sequence opt3 from NKX2-8__Homo_sapiens__NP_055175
auggccaccagcggcagacuguccuucacagugaggucucuccuugaccugcccgagcaggaugcucaacacuugccucggcgcgaaccagagccgcgagcaccccagccugacccaugcgccgcgugguuagauucagaacgugggcauuaccccaguagcgacgaguccucucuggaaacuucgccuccagauucaagccagagacccagugcuaggccugccuccccaggaucugacgcagagaagcggaaaaagcgcagaguccuauuuagcaaagcccagacgcucgagcuggaaaggcgguuccgccaacagcgauaucuuuccgcuccggagagagaacagcuggcaucauugcucaggcugacccccacacagguuaagaucugguuucaaaaccaccgguacaaacugaagcgugcccgcgcuccuggugccgcggagaguccagaucucgcagccagcgcugaguuacaugccgcacccggccugcuuagaagggugguagugccugucuuggugcgggacgggcagccauguggaggcggugggggaggcgaaguuggcacugcugccgcgcaggagaagugcggggcacccccggccgcugccuguccucugcccggauauccagcuuucgguccuggcucugcccuagggcucuuucccgcauaccagcaccuggccuccccagcucuugugucauggaauugguga

SEQ ID NO: 59737 - RNA, 480 nt, Artificial Sequence
  derived and/or modified sequence opt3 from NKX3-1__Homo_sapiens__NP_001243268
augcugagagugcccgagccuaggccaggcgaagccgagacccucgcugaaacagagccggaacggcaccuugggagcuaccuguuggacuccgagaacacuucuggagcauuaccccgccugccucagacgccaaagcaaccccagaaacgaucacgugccgcguucagucauacccaggucaucgagcuagaaagaaaguuuagccaccagaaauaucucuccgcuccugagagggcccaucuggcaaagaaucuuaaacugacagaaacucaaguuaagauuugguuccagaaccggcgcuacaagaccaaaagaaagcaguugucuucggagcucggugaucuggagaaacacucaagccugccagcccucaaggaagaggcuuuuaguagggcauccuuagugucuguauauaauagcuaccccuauuacccuuaucuguacugcgugggcuccuggucaccagccuucugguga

SEQ ID NO: 59738 - RNA, 1104 nt, Artificial Sequence
  derived and/or modified sequence opt3 from NKX6-1__Homo_sapiens__XP_006714293
augcuggccgugggcgcuauggaggggaccagacagagcgcauuccuccuuuccucucccccucuggccgcguugcacucaauggcugaaaugaagacaccauuauacccggccgcauaucccccucugccagccggacccccuaguagcuccucuucgucaagcaguuccucuagcccaucacccccucuagguacucauaacccaggcgggcucaaaccgcccgcuacgggaggccuguccagucuugguagcccuccacaacagcugucugcagccacaccccacgggaucaaugacauuuuguccaggccuucaaugccagucgcuagcggagccgcgcuccccagugcaucuccguccggcagcucgucuuccucaaguagcuccgccucugcuagcucagccagugcagcugccgcggccgcagcugccgcugccgcagccgcuuccagcccugcgggccugcuggcagggcucccccgguuuucuucauuaaguccaccucccccacccccuggacuguacuucagcccauccgccgcugccguugcagccgugggucgcuauccgaagccccuugcugaguugccuggccgaaccccaauauuuuggcccgggguaaugcagucuccuccauggcgugaugccagacuggcaugcacuccccaucagggaucgauccuacucgacaaagauggcaagaggaaacacacccggccgacauucagcggucaacagauuuuugcgcuggaaaagaccuucgagcagacuaaguaccuugcugggccugaacgcgccagacuggcauauuccuugggaaugacagagucacaggugaaagucugguuucaaaacaggcggaccaaguggcgcaaaaagcaugccgcugagauggccacggcuaaaaagaagcaggacagugaaacugagcgacucaaaggcgcaucugaaaaugaggaggaagaugacgauuacaacaagccacuggaccccaauagcgaugacgagaaaaucacccaguuacugaagaaacacaaguccucaagcggcgggggagguggccuccuucugcacgccucugaaccugaguccaguagcuga

SEQ ID NO: 59739 - RNA, 834 nt, Artificial Sequence
  derived and/or modified sequence opt3 from NKX6-2__Homo_sapiens__NP_796374
auggacaccaacagacccggcgccuucgugcugagcuccgcuccucucgcagcccuucacaauauggcggaaaugaagacaucucuguuuccauacgcuuugcaggggccggccggauucaaagcacccgccuuagguggccugggggcucaacuaccucucggaacuccacauggcaucucagauauucuggguaggcccgucggggcagccggaggcggccuucugggaggguugccucggcucaacggucuggcuaguagcgccggcguuuauuuugggccagcggcagccguggcucgcggauaccccaagccucuggccgaacucccaggccgaccgcccauauucuggccugguguagugcagggggcaccauggcgugaccccagauuagcuggaccugccccagcgggcggcguccuggauaaagacgggaagaaaaagcacuccaggcccacguuuucuggacagcagaucuucgcccuugagaagaccuuugaacaaacaaaauauuuggcagguccggagcgggcucgccuggccuacucgcuaggcaugacugaaucacaggugaagguuugguuccagaauagaaggaccaaauggcggaagcgccaugcugccgagauggcaagcgccaaaaagaagcaggauagugacgcugagaaacucaaggucgggggauccgaugcggaagacgaugacgaguauaaccgaccucuggaucccaauucugacgaugagaaaauuacaagacuucugaagaaacacaagccaagcaacuuggcacucguguccccuugcggcgguggggccggcgacgcucuguga

SEQ ID NO: 59740 - RNA, 582 nt, Artificial Sequence
  derived and/or modified sequence opt3 from NLE1__Homo_sapiens__NP_001014445
auggcccugagcaccgacuacgcucucagaacaggcgcauucgagcccgccgaagcguccgugaacccucaggaucuucaagggucucugcaggaguugaaggaaagggcuuuaucacgguauaaucugguccgcggacaggguccagagcgucuaguuaguggcagcgacgauuuuacucucuuccugugguccccggccgaagacaaaaagccccuuacgcgaaugaccgggcaccaggcacugaucaaccaaguguuguuuucuccugauucgagaauuguagccucagcuagcuucgacaaaaguauaaagcucugggauggaaggacaggcaaauaccuggcaucccugcggggucauguggccgcugucuaucagaucgccuggucugcggacagccgccucuuaguguccgggucaagugauagcacucugaagguuugggacgugaaggcacagaaacuugccauggauuugccaggacacgcugacgaggucuacgccguggauuggucucccgacggccagagaguagcauccggcgggaaggacaaaugccugaggauuuggcggcgcuga

SEQ ID NO: 59741 - RNA, 2472 nt, Artificial Sequence
  derived and/or modified sequence opt3 from NLGN1__Homo_sapiens__NP_055747
auggcccugcccagaugcaccuggccuaacuacguguggagggcugucauggcaugccucguucaccggggccuuggggccccacugacauugugcauguuaggaugucugcuacaggcgggucaugugcucagccaaaagcuggacgauguagacccgcuuguggcuacuaauuucggcaaaauccgcgggauuaagaaagagcugaacaaugaaauauugggacccgucauccaguuucucggcgugccuuaugccgcaccacccacgggugagcgacguuuccagccuccagaacccccuuccccauggucugauauuagaaacgccacccaguuugcuccgguuugcccccaaaauaucauugacgggaggcugccugaggugaugcugccagucugguucacaaacaaucucgaugugguaucaaguuacguucaggaccagagcgaagauuguuuauaucugaacaucuacgugcccacugaggacgauauacgggacuccggaggcccuaagccagucaugguguauauccacggcgggucuuacauggagggaaccgguaaucuuuaugauggcucgguguuggcaucauacgggaacgucauuguuaucacagugaauuaccgccugggaguacuaggcuuucucagcaccggugaccaggccgcuaaagggaacuauggacugcuugaucugauucaagccuugagauggacaagugaaaauaucggcuucuuuggcggggacccccucaggauaacuguguucggauccggugcgggcgggucuugcgucaaccuguuaacccugagccauuacuccgagggaaaucgguggucaaacaguacgaagggccucuuucagcgcgcaauugcccagagcgguacugcucuuucuuccugggccgugucauuccagccggcaaaguaugcucgaaugcuggccaccaaaguuggguguaacgugagcgacacagucgaauugguggagugccuacaaaagaaaccuuacaaggagcugguagaucaggacauccagcccgcgagauaucacauugccuuuggcccaguuaucgauggagacgugaucccugaugacccccaaauucucauggaacagggcgaguuccugaauuacgauauaaugcuuggggucaaccagggagaaggucugaaauuuguggagaauaucgucgacagugaugacggcauuucugcauccgauuucgacuucgcugugagcaacuuuguugacaauuuguauggguacccagaaggaaaggaugugcucagggagacuaucaaguucauguacaccgacugggccgaucggcauaaccccgagacacgucgcaaaacccuguuagcucuguuuacggaccaccaguggguagccccugcagucgccacugcugaucuacacucgaauuucggcucuccaacauauuuuuacgcguucuaucaucacugucaaaccgaccaggugccggcaugggccgaugcugcccauggugacgaaguucccuacgugcucgggauaccuaugauuggcccaacugagcuguuucccugcaacuucuccaagaaugaugucaugcuuucagcagugguaaugacauauuggaccaacuuugccaaaacgggagacccuaaucagccagugccccaggauaccaaguucauccacacaaaaccgaacagauuugaagagguugcuuggacuagguacagucaaaaggaccaguuguaucugcacaucggccucaaaccucgggucaaggaacauuaccgagccaauaaggugaaccuguggcuugagcuggugccacacuugcauaaucucaacgauauuagccaguacaccuccacaacuaccaaaguccccucuacagacaucaccuuccgcccuacuagaaagaacagcguucccgugacgucagcauuuccaacagcgaaacaggacgauccuaagcaacagcccaguccauucuccguggaccagagggauuauagcaccgagcugucuguaacuauugcugucggggccucauuacuguuccuaaauauacucgcauuugccgcucuguacuauaaaaaggacaagcggcgccacgaugugcauagaagguguaguccgcagcguaccacaaccaacgaccuuacucacgcccaagaagaggaaaucaugagcuugcagaugaaacacacagaucuggaccaugagugcgaauccauucacccucaugagguugugcuccggacggcaugucccccagauuacacccuggcuaugcgaagaucucccgacgaugucccuuuaaugacuccaaauacaaucaccaugauccccaacacaauuccuggaauacagccgcugcacacuuucaauaccuuuacggguggccaaaacaauacccuuccacacccccauccucacccacauucgcacagcacaacuaggguguga

SEQ ID NO: 59742 - RNA, 2508 nt, Artificial Sequence
  derived and/or modified sequence opt3 from NLGN2__Homo_sapiens__NP_065846
auguggcugcucgcccuuugccuggugggcuuggcuggggcacagagaggagguggcgggcccggaggcggugccccugggggaccaggcuuaggccuggggagccuaggagaggaaagguucccggucguuaacaccgcguacggucgggugcgcggcguacgacgugagcucaauaacgaaauccuggggcccgugguccaauuucuuggagugccuuaugcuacaccaccccugggcgccagaagguuccagccuccagaggcacccgccuccuggccugguguucggaaugcuacuacguugccaccggcauguccccagaaccuccacggggcccugccugcuauuaugcugccagugugguuuaccgacaaucucgaagccgcggcaacauacguccagaaccaaucugaggauugcuuauaucugaaucuuuacgugcccacugaggacggaccuuugaccaagaaacgcgaugaagccacacugaacccacccgacaccgauauaagagacccgggcaagaaaccuguaaugcuauuccuccauggcgggucauauauggagggaacugguaauauguuugauggcaguguucuggcugccuacgggaacgugaucgucgcaacacuuaauuauaggcugggaguguugggcuuccucagcaccggugaccaggcugccaaggggaacuacggccuguuagaucagauucaggcgcugcgguggcucuccgaaaauaucgcccacuuuggaggcgaccccgagcgcauuacgaucuucgggucuggagcuggugcaucgugugugaaccuucugauauugucacaucacagcgagggccuauuucaaaaagccaucgcucagagugggacugccauuuccucuuggagcgucaauuaccagccacugaaguauacccgacuccuggcagccaagguuggaugcgauagagaagacuccgcugaggcgguggaaugucuuaggcggaaaccuucacgugagcugguagaucaggacgugcaacccgcacgcuaccauaucgccuucggcccagucguggacggugauguugugcccgacgauccugaaauuuugaugcagcagggggaguuucucaacuaugacaugcugaucggcgucaaccaaggagagggcuuaaaguucguggaagauagugcugagagcgaagacgggguaucugccuccgcauuugauuucacaguuucaaauuucguggacaaccuguacggauauccagaggguaaagauguccuaagagaaacuauaaaguuuauguacaccgacugggccgauagggacaauggcgagaugcggcgaaaaacacuccuggcucuuuucaccgaccaccaguggguggccccggcagucgcgacggcuaaguugcacgccgauuaucagagccccguguacuuuuacacuuucuaucaucacugccaggcagaggggcgcccugaaugggccgacgcugcccauggagaugagcugccauacguuuuuggcgugcccaugguaggugcaacagaccucuucccuuguaacuuuaguaagaaugaugucaugcugucugcugugguuaugaccuauuggacuaacuucgccaaaacaggggacccaaaucaacccgugccgcaggauaccaaguuuauucacacgaaaccuaacagauucgaagaggucgugugguccaaguuuaauagcaaagaaaagcaguaccuucacaucggccugaaaccaaggguacgggacaacuaucgcgcgaauaagguggccuucugguuggagcucguuccccaucugcacaacuuacauaccgagcuguuuacaacuaccacaagacuaccucccuacgcuacuagguggccaccucgucccccagcaggagccccgggcacccggcgaccucccccacccgcuacacucccuccagaacccgagccugaaccggggccaagagccuaugauagguuccccggagacucgcgcgauuacucuaccgagcuguccgucacuguggcagugggcgcgucacuuuuguuccugaauauucucgccuuugcugcccuguacuauaagcgggacagaaggcaggaguuacgcugccgacggcugaguccuccaggugggagcggauccggcguccccgguggcgggccucuuuugccggcagcuggacgugaacugcccccagaggaggaacucguuucucuacaacugaaaagaggcgggggagugggcgccgauccugcagaagcccucaggcccgcuuguccaccugacuacacgcuggcgcuucgccgggcccccgacgaugugccauugcuggcaccgggugcuuuaacacuccugccuagcgggcuuggacccccacccccuccacccccuccgucacugcacccauucggccccuuuccucccccaccucccaccgccaccagucauaacaauacuuugccacacccucacuccacaaccagaguauga

SEQ ID NO: 59743 - RNA, 2427 nt, Artificial Sequence
  derived and/or modified sequence opt3 from NLGN3__Homo_sapiens__NP_001160132
auguggcugagacucgggcccccuagccuuucccugucuccaaagccgaccgugggcaggucauugugcuuaacacugugguuccuaagucucgcccugcgggcuagcacucaggcacccgccccuacggucaacacccacuuuggaaaacuucgcggugcgcgaguuccacugcccuccgagaucuugggcccuguggaccaauaccucgggguaccauaugcugcacccccuauuggagaaaagcguuuccugccaccggagcccccuccaucuuggucgggcauaagaaaugccacacauuuucccccuguguguccacagaacauccacacugccguccccgaagugaugcugccgguuugguucaccgcuaaucucgauauuguggcaacauacauccaggagccuaacgaagacugcuuauaucugaaugucuacgugcccaccgaggaugacauuagggauucaggugccaaaccaguaaugguuuauauccaugggggaagcuacauggagggcacuggcaacaugauagacgggaguauccuugcuuccuauggaaaugugauugucaucacauugaacuaccgggugggugugcugggcuuucuaucuaccggggaucaggccgcgaagggaaauuacggccuccuggaccaaauucaggcacuucgcugggucagcgaaaacaucgccuucuuugguggggauccuagaaggauaacgguuuucggauccggcauuggcgcuucaugugugagucuguugacucucagccaccauucugaggggcuguuucagcgggccaucauucaguccggaucagcauuaagcaguugggcuguaaauuaucaacccgugaaauacaccucucugcucgccgacaaggucgguugcaacgugcuugauacaguugacaugguggauugucugcgccagaaguccgcgaaagaauuggucgagcaggacauccagccagcccgauaucacguggcauucggccccguaaucgacggggauguuauuccugacgauccagagauacuaauggaacaaggagaguuucugaauuacgacaucaugcucggcgugaaccagggugaagggcugaaguucgucgagggcguggucgauccggaagacggagugagcggcacugauuuugacuauucgguuucuaauuucguggauaaccuuuacggguaucccgagggaaaagacacccugagagagacaauuaaguucauguacaccgauugggcugacagggacaacccugaaacgcggcguaaaacuuugguagcccucuuuacagaucaccagugggucgagccauccgugguuaccgcugaccugcaugcccgcuacgguucacccacuuauuucuacgcauuuuaucaccauugccaaaguuuaaugaagccugccuggagcgaugcugcgcacggcgacgaagugccauacgucuucggggugcccaugguaggaccgacagaucuguuuccuuguaauuucuccaagaacgacgugaugcuaucugcaguugucaugaccuauuggacgaauuuugccaaaaccggcgauccaaacaagcccgugccucaggacacaaaauucauccacacuaaggcuaauagauuugaggaaguggccuggagcaaauacaaccccagggaucagcucuaucugcauauaggucuuaagccacggguccgagaccacuaccgcgcaaccaaaguugccuucuggaagcauuuggugccucaccuguacaaucuccaugauauguuucacuauacaucaacuaccacaaaggugcccccaccggacaccacucacaguucccauauuacgagaaggccuaacgggaaaacauggagcaccaagcggcccgcuaucucuccagccuacucaaaugagaacgcacagggcaguuggaauggagaucaagacgcgggcccccugcuuguagagaacccucgcgacuauagcacugaacuguccgucaccaucgcugugggggccucucucuuguuccugaauguuuuagcauuugccgcucuguacuauagaaaagauaagaggcgucaggagccacuacggcagcccucgccucagcgaggagccggugcaccggaacucggcgcugccccagaggaggaacuggcggcccuucaauuggggcccacacaccaugagugcgaagcuggaccuccacacgacacccugagacucacugcacugcccgauuacacauuaacgcugaggcgcagcccugacgauauuccgcuuaugacccccaacacuaucacaaugauuccaaauuccuuggugggccuccagacccugcacccuuauaacacauucgccgcugguuucaacucaacugggcuaccccauagucacucuaccacgcgggucuga

SEQ ID NO: 59744 - RNA, 2451 nt, Artificial Sequence
  derived and/or modified sequence opt3 from NLGN4X__Homo_sapiens__NP_001269075
augagcagaccccagggccugcucuggcuuccucuguuguucaccccagugugcgucauguuaaacuccaauguucugcuauggcucacagcccuggcuaucaaguuuacucuuauugacucucaagcacaguacccggugguaaacacgaauuaugggaaaauaaggggacugcggacccccuugccuaacgaaauccucgguccaguggaacaguaccugggcguccccuaugccucaccuccaacaggggagcgccgauuccagcccccugaaccaccgaguagcuggacuggcauucguaauaccacacaauuugcggcuguguguccccagcaccuggaugagagaucccucuuacaugacaugcugccuaucugguucaccgccaaccuugauacuuugaugacauacguucaggaccagaaugaagauugccuguaucuaaacauuuacgugccaaccgaggacgauauccacgaccaaaauucuaagaaacccgucaugguguauauacauggagguucguacauggaggggacgggaaacaugaucgauggcucaauucucgcaagcuacggcaauguaaucguuauuacuaucaacuauaggcuggggauacuuggauuucugaguaccggugaccaggccgcuaagggcaauuacggguugcucgaucagauucaggcacugcgguggaucgaagagaacgugggagccuucggcggugacccuaaacgcgucacaauuuuuggguccggagcuggcgccucuugugugagcuuacugacucucucccacuauucagaaggccuuuuccaaaaggcgaucauccagagugggaccgcacugagcucuugggccgugaauuaccagccagcuaaguauacaagaauuuuggccgauaaagucggaugcaacaugcuagacaccacggacaugguugagugucugaggaacaagaauuacaaagagcucauacaacagacuaucacacccgcaaccuaucauauugcuuuugguccggugaucgauggcgacguaauaccugaugacccccagauucugauggaacagggggaguuccuuaacuacgauaucaugcugggagugaaucaaggcgaagguuugaaguuugucgacgggaucguggauaacgaggacggcguuacuccaaaugauuucgacuuuuccgugucaaacuucgucgauaaucucuacggauauccugaaggcaaagacacacugcgggagaccauuaaguucauguacacggacugggccgauaaggagaaccccgaaacccgccgaaaaacauuaguggcgcuguuuacugaccaccaguggguagccccagcaguugcuaccgccgaucuacacgcucaguaugggagccccacauacuucuaugccuuuuaccaucacugccagagugagaugaagccuucuugggcagacuccgcccauggagaugaagugccauaugucuucgguaucccgaugauuggccccacugagcucuuuagcuguaauuucucgaaaaacgacgugaugcugucugcugucgugaugaccuacuggacaaauuuugcgaagaccggggauccuaaccaaccaguuccccaggacacuaaauucauacacacgaagccuaauagauuugaagagguggcaugguccaaauacaacccaaaggaucagcuuuauuugcacaucggacugaagcccaggguacgggaccauuaccgugccacaaaagucgcuuucuggcucgagcuggugccgcaccuucauaaucugaacgaaauuuuucaguauguuucaaccacuaccaaggugccuccacccgauaugacaaguuucccuuacggcacccgcagaagccccgccaaaaucuggccaacuacaaagaggccugcaaucacgcccgccaacaauccaaaacacuccaaggacccgcauaagaccgguccugaggauacuacagucuugauugaaaccaaacgggacuauucuacagagcucagcgugacuauagcuguaggggccucacuguuauuucugaacauccuagcauucgcggcucucuacuauaagaaagacaagcgacgccacgaaacccacagaaggcccaguccacaacggaauacgaccaacgauauugcccauauccagaaugaggagauuaugucccugcagaugaaacagcuugaacacgaccaugagugcgagagcuugcaagcacacgauacacugcgccucacuugucccccugacuacacccugacauuaagaaggucuccagaugacaucccccugaugacuccuaacaccauaacgaugaucccgaauacacuuaccggcaugcagccauugcacacuuucaacacauuuucaggaggccagaauaguaccaaccucccccaugggcacagcacuacccguguguga

SEQ ID NO: 59745 - RNA, 1947 nt, Artificial Sequence
  derived and/or modified sequence opt3 from NLGN4Y__Homo_sapiens__NP_001193779
augguguacauccacggcgggagcuauauggagggaaccgguaacaugauugacggcuccauacuggccucuuacgggaaugucaucguuauuacaaucaacuauagacucggcauucuuggauuccugucaacuggugaucaggcugcaaaggggaauuacggauuguuagaccaaauccaggcccugagguggauagaagagaacgugggcgcguuuggcggggaucccaaacggguaacgaucuucggaaguggugcuggcgccagcugcgugucccuacucacccugucucauuauucggaagggcuuuuucagaaggcaauuauccagucaggaacagcccugagcaguugggcugucaauuaccaaccugcaaaauauacucgcauuuuggccgacaaggugggcugcaacaugcucgauaccacagacaugguugagugccugaaaaauaagaacuacaaggaacugauccagcagaccauaacuccagcuacauaccacauugccuucgguccggugaucgauggggacgucauucccgaugacccucagauccucauggagcaaggagaguuuuuaaauuaugauaucaugcugggcgugaaccagggcgaagggcuuaaauucguagacggaauuguugauaaugaggacggugugaccccaaacgacuuugauuucuccgucucuaauuuuguggacaacuuguacggcuaucccgaagggaaggauacgcugcgagagacuauaaaauucauguacaccgacugggcggauaaggagaauccugaaacacguagaaaaacucuaguggcacucuuuaccgaccaucagugggucgccccagcuguugccacagcagaucugcacgcucaguauggaagccccaccuacuucuaugccuuuuaccaucacugucaauccgagaugaagccuucaugggcggacagugcccacggcgaugaagugccauacguauucgguaucccgaugauugggcccacggagcuuuucagcugcaacuuuucuaagaacgacgugaugcuguccgcagucgugaugacuuauuggacaaauuucgcuaaaaccggcgauccuaaccagccaguuccccaggacacuaaguuuauccauacaaaaccuaauagguucgaagagguggccuggucaaaguacaacccaaaagaccaauuguaucuccacauaggacugaagccccggguccgcgaucauuacagagcuaccaaaguggccuuuugguuagagcugguaccgcaccuccacaaucuuaacgaaauuuuccaguauguuagcacgaccacaaaggugccucccccagacaugaccaguuuuccuuacggcacuaggcggucucccgcaaagaucuggccaacaacuaaacgccccgccaucaccccugcuaauaacccaaagcauuccaaagauccgcacaagacagggcccgaggacaccacuguccugauugaaacgaaacgagauuauagcacagaguugucggugaccaucgcggucggagcaucucuacuguuccucaauauucuggccuuugcugcccuuuacuacaagaaggacaaaagaaggcaugaaacucaccggcauccuuccccacagcguaacaccacaaaugauauaacccacauccagaacgaggagauuaugucacugcaaaugaagcaguuggaacacgaccaugagugugaaagucuccaggcacacgauacucugcgcuuaacaugucccccugacuauacgcugacccuaagaaggagcccagaugacauccccuucaugacuccgaauacaaucaccaugauuccuaacacacucauggguaugcagccacugcauacuuuuaaaaccuucuccggcgggcaaaauucuacgaaccuuccccacggacacagcaccacacggguguga

SEQ ID NO: 59746 - RNA, 1584 nt, Artificial Sequence
  derived and/or modified sequence opt3 from NLK__Homo_sapiens__NP_057315
augagccugugcggcgccagagcuaacgcaaagaugauggccgcguacaaugggggaaccuccgcugccgcagccggucaccaucaccaucaccaucaccaccucccccaucuuccuccaccgcaccuacaucaccaccaucacccccagcaucacuugcauccuggcucugcugcagccgugcacccaguccaacagcacacaucaagugcugccgcggcagccgcugccgcagcugccgcggccgcaauguuaaaccccgggcagcagcaaccuuauuucccaagccccgcuccuggacaggccccaggcccggcugccgcagcccccgcucagguucaggcggcagccgcugccacugugaaagcacaucaccaucaacacucccaccauccucagcagcagcuggacaucgagccagauaggcccauugguuacggggccuuuggaguaguguggucugucacggacccucgggauggcaagcgcguggcucugaaaaagaugccaaauguuuuccaaaaccucgugucguguaaacgagucuuucgugaacugaagaugcuuugcuucuuuaagcacgacaaugugcugucagccuuggauauacuccagcccccgcauaucgacuauuucgaggaaauuuacguaguuaccgagcugaugcagagcgaucugcacaaaaucauugugaguccucaaccccucuccucugaccaugucaagguguuuuuauaucagauccugagaggccuuaaauacuugcacagcgcagggauacugcacagggauaucaagccaggaaaccuacucgucaauuccaacugugugcugaaaauuugcgacuucggucuugcgcggguugaggaacuggaugagucacgccauaugacacaggaagugguaacucaguauuacagagcuccugagaucuugaugggcaguaggcacuacagcaaugccauugacaucuggucugugggguguauauuugcagaacuccugggacggcgcauuuuauuccaagcccagucccccauccagcagcuggaucucauuaccgaccuucugggcacaccaucauuggaggcuaugcgaaccgccugcgagggugcaaaggcucauauccuaagagggccccacaagcaaccuagccugccaguccucuauacucugaguucucaggccacacaugaagcggugcaccuucuguguaggauguugguuuuugacccguccaaacggaucagcgccaaggaugcucucgcacaccccuaccuggacgagggacguuuacgcuaucauaccugcauguguaaaugcuguuucucgacgucuacuggcagaguguacaccuccgauuuugaaccugucacaaacccaaaguucgacgauacuuucgagaaaaaucugucaagugugaggcagguaaaggaaauuauacaccaguuuauccuagagcaacagaaaggcaaccggguuccccucugcauuaauccucagagcgccgcuuucaaguccuuuaucucuagcaccguggcccagccaucagagaugcccccgaguccucuggucugggaauga

SEQ ID NO: 59747 - RNA, 2115 nt, Artificial Sequence
  derived and/or modified sequence opt3 from NLN__Homo_sapiens__NP_065777
augaucgccagaugccugcucgcugugaggagccuucggcgcgucggcgggucccguauucuguugcgaaugaccuuaggaagagagguuaugucuccccugcaggcaaugucaaguuacacaguggccgguaggaacguacuacggugggaccucagcccugaacaaauaaagacucgcacggaggaacugaucgugcagaccaaacaggucuaugaugcggugggcaugcuugggauugaggaaguuacauacgagaauugucugcaggcuuuggccgacguggaggucaaguauaucguggaaagaacuaugcucgauuucccacaacacguauccucugacaaagagguuagggcagccucgaccgaagcugauaagcggcugucacgcuuugacauugagaugagcaugcgaggagauaucuucgagagaauagugcaucugcaggaaacaugcgaccucggcaaaaucaagccggaggcaaggcgguacuuagaaaagaguauuaaaauggguaagcguaacgggcugcaccuucccgagcagguccagaaugaaaucaaauccaugaagaaacgcaugucugaguuguguauugauuuuaacaagaaucugaacgaggacgauaccuuccuaguguuuagcaaggccgaacucggagcucugccugacgauuucaucgacucccuugagaaaacugacgaugacaaguauaaaauaacacugaaguacccacauuauuuucccgugaugaaaaagugcuguauuccugaaaccagaaggcggauggagauggccuucaauacgcgaugcaaagaagagaacacuaucauuuugcaacagcuccugccauuacgcaccaaggucgcgaagcugcucggcuacucaacacacgcagauuuuguucuugagaugaauacugccaaaaguaccagcagagugacagcuuuccuggacgauuugucucagaagcuaaaaccccugggcgaagccgagagggaauuuauccucaaccugaagaaaaaggaguguaaggaccggggguucgaauacgauggaaaaaucaaugcaugggaccuuuauuacuauaugacccagacggaggagcugaaguacuccauugaucaagaauuuuugaaagaguauuucccuauagaaguagugacugagggucuccugaacacauaccaggaguuacugggccuaucauucgaacagaugaccgacgcucaugucuggaauaagagcgugacucucuauacaguuaaagauaaggccaccggggaggugcugggacaauuuuaccuugacuuguacccacgcgaaggcaaguauaaccacgcggccugcuucggucugcagccggggugucuccugcccgacggaaguagaaugauggcagucgcugcccuugugguaaauuuuucucagccuguugcuggcaggccaucccuguugcgucacgaugaggugcggacguacuuccaugaauuuggccacgucaugcaucagaucugcgcccaaaccgacuucgcacgauuuagcgggacaaacguggagacugauuucgucgaggugcccucgcagaugcucgaaaacuggguuugggacguggauucucugagaagguuauccaaacacuauaaggacggaucaccuauugccgaugaccugcuagagaaacucguagcuagucgccuggucaauaccggucuuuugacacugcggcagaucgugcucagcaagguugaucagucccugcacacuaacaccucuuuagacgcggcaagcgaauacgccaaauauuguucagagauacugggcguggcugccacaccagggaccaauaugcccgcaacuuuuggacaucuugccggcgguuacgaugggcaauauuacggcuacuuguggagugaagucuucuccauggacauguuuuauagcugcuucaagaaggagggaauuaugaacccggaggugggcaugaaauacagaaaucucauccugaagccugggggaucucuagaugguauggacaugcugcacaacuuucucaaaagggaacccaaucagaaggcuuuccugaugucacgcggccuucaugccccauga

SEQ ID NO: 59748 - RNA, 3198 nt, Artificial Sequence
  derived and/or modified sequence opt3 from NLRC3__Homo_sapiens__NP_849172
augagaaagcaggaggugaggaccggccgggaagccgggcaaggacacgguacaggcagccccgcugagcaggucaaagcacugauggaccuccuugccgggaagggaucccagggcucucaggcgccucaagcucuggaucgcacuccagacgccccguugggucccugcucaaacgauagucgaauccagcgucauagaaaagcauuacugagcaagguugggggaggcccugaacuaggcgggccauggcacaggcucgccucccugcuucugguggagggauugacggaccuccagcugcgggaacaugauuucacccagguagaggcuacacgcgguggcgggcaccccgcaagaacuguggcccuggacaggcucuuuuuaccucugucucgggucucggugccaccccgcguuucaauuaccauaggaguggcuggcauggguaaaacaacccuuguccgacauuucgugagauugugggcccacgggcaaguaggaaaggauuuuagccugguucuaccucucacuuucagggaccugaauacacacgagaaacuuugugcggaucggcugaucugcaguguguuuccacaugucggcgaaccguccuuggcaguggccgugcccgcucgugcccuccugauuuuagacggccuggaugagugucgcaccccucucgacuucucuaacacggucgcaugcacugaucccaaaaaggaaaucccaguugaccaccuuauuaccaauaucauaagagggaaccuguuuccugaggugagcaucuggauuacauccaggccaucagcuaguggacagauccccgguggcuugguagaccggaugacugagauucgaggguucaaugaagaggaaaucaaagugugucuagagcagauguuuccggaagaucaggcccugcucggauggaugcugagccaaguccaggcggaccgcgcccuuuaccugaugugcaccgugccugcauucuguagauugacaggcauggcucucggucaucuguggaggucucggaccgggccccaggaugccgaguuauggccaccucgcacgcugugcgagcuauauuccugguacuuuagaauggcucucucaggcgaaggacaagagaagggcaaagccagccccaggauagaacagguugcacacgggggacguaagaugguggguacucugggccggcuugccuuccacggguugcugaagaaaaaguaugucuuuuacgagcaggacaugaaggcuuucggaguggaucucgcgcugcuucagggcgcaccauguaguugcuuccugcaacgagaagagacauuggccucuuccguagcuuauuguuuuacccaucucagccugcaggaguucguugccgcagccuacuauuacggugcuucgagaagggccauuuuugacuuauucacugaaucugggguguccuggccccgccugggcuuucuaacacacuuccggucagcagcgcagagagcuaugcaggccgaggauggaaggcucgacgucuuucugcgcuuccuuaguggcuugcugagcccucgagugaacgcacuccuggccggguccuuacuggcucaaggagaacaucaggccuaccggacccaggucgcagagcuuuugcaggguugccuccguccagaugcugccgugugcgcgagagccaucaauguucugcacugucuacaugaacugcaacacacggagcucgcuaggucuguggaggaagcaauggagagcggcgcccuggcucgccuuaccgggccggcccaccgggcagcguuggccuaucuguuacagguaucagacgcuugcgcccaggaagcaaaccucagucugucccuuagccagggaguccugcaaucuuugcucccccagcugcuauacuguagaaagcugaggcucgauacaaaucaguuucaagacccugugauggagcugcuuggcucaguuuugagugguaaagacugccgcauucagaagaucagccuggcugagaaccagaucuccaauaaaggggccaaggcauuagcccgaucucuccuggugaaccggucgcuuacuagccuggaucuaagaggcaauuccauuggaccacagggcgcuaaggcgcucgccgacgcacugaaaauaaacaggaccuugacaucacugaguuuacaagggaauacuguccgugaugacggagcucgcucuauggccgaagcccucgcuagcaaccggacccuguccaugcuucaucugcagaagaacucaaucggccccaugggugcacagagaauggccgaugcguugaaacagaauaggagccucaaggagcugauguucucuuccaacaguauuggggacggaggcgcuaaagcccuagcagaagcccugaaggugaaucaaggucuugagagccucgaucugcagucuaacuccaucucagacgcuggcguagcagccuugaugggggcgcuguguacaaaucagaccuuacucagucugagccuucgagaaaacucgauauccccugagggagcucaggccauugcacacgcccugugcgcuaauucuacuuugaagaaccucgaucugacggccaaucuacugcaugaccaaggcgcacgggcuaucgccguggcgguucgcgagaacagaacacuuaccagccuccaucugcaguggaauuuuauccaggccggggcagcucaagccuugggacaggcuuuacagcugaacaggucacucacuucacuggaucuucaggaaaaugcaauuggcgacgauggugccugugccgucgcucgggcgcugaaagugaacaccgcauugacagcccuauaucugcaaguggcuuccaucggggccucuggagcacagguccucggcgaggcccuggcuguuaaucgaacccuugaaauuuuagaccugagagguaacgcgauaggcguggccggggcaaaggcucucgccaacgcauugaaagugaauagcucccugcgcaggcucaaccugcaggagaauagucuuggaauggacggcgccaucugcauugcuacugcccugagcgggaaccaccguuugcagcacaucaaucuacaaggaaaccacaucggcgauaguggugcgcggaugauuucugaagcaauaaagacaaaugccccaacguguaccguagagauguga

SEQ ID NO: 59749 - RNA, 3075 nt, Artificial Sequence
  derived and/or modified sequence opt3 from NLRC4__Homo_sapiens__NP_001186068
augaacuucaucaaggacaauagcagagcccugauucagaggaugggcaugaccgugauaaaacaaaucacagaugaccucuuugucuggaacguucuuaaucgggaggaagugaacauuaucugcugugagaagguagaacaggaugcugcacgcgggauuauccacaugauacugaaaaagggauccgagucuugcaauuuguucuuaaaaucacugaaggaauggaacuacccccuauuucaggaccucaauggucagagucuguuccaucaaacuagcgagggcgaucuugacgaucuggcccaggacuugaaggaucucuaucacacgccuuccuuucugaacuucuacccacugggggaggacaucgauauuaucuuuaaucucaaaucuaccuucacagaaccgguguuauggcgaaaggaccagcaucaccaucgugucgagcagcugacucuuaacggauugcugcaagcgcuacagucgcccuguauuaucgaaggcgagucagguaaaggaaagagcacccuccugcagagaauagcuaugcuuuggggaaguggcaaaugcaaggcccugacaaaguuuaaauucguguuuuucuugaggcucucccgggcacagggcgggcuguuugagaccuuaugugaucaacugcucgacauuccuggaacuauccgcaagcagacauucauggccaugcuucugaaauugagacagaggguucuauuccugcucgacgguuauaaugaauuuaagccacaaaacugccccgagauugaagcucugaucaaagagaaucaccgguucaagaacauggugaucgucaccacgacuaccgaaugucuucgccacauucgacaguuuggcgcacugacagccgaggugggggauaugacugaggacucugcucaggccuugauaagagaaguacucaucaaagagcuggcggaaggauuacugcuacagauucaaaaguccaggugccuccggaaucugaugaagaccccucuuuucguugugaucacaugugcaauacagaugggcgagagcgaauuucauucacacacccagacgacuuuguuccauacauuuuacgaucugcucauucagaaaaacaagcacaaacacaagggugucgccgcuagugacuucauccguagccuggaucauugcggggaccuugcccuggagggaguguuuucucacaaauucgauuuugaguugcaagacguguccucagucaacgaagauguucuccugaccacuggcuuacuguguaaguauacagcacagcgcuucaagccaaaauacaaguuuuuccauaagagcuuccaggaguauaccgcuggcagaaggcuaaguucucuccugacgucccacgaacccgaggaagugaccaaagggaauggauaccuucagaaaaugguaagcaucucggacauuacaucuacuuacuccucauugcugcgguauaccugcgguaguagcguggaggccacacgagcggucaugaagcaucucgccgcaguguaccaacacggcugccuguuagggcuguccaucgcuaagcgcccucuuuggagacaggagucuuugcagagcguuaaaaacacuaccgaacaggagauucucaaggccauaaauaucaacucauuuguggaaugugggauucaccuguaucaagagaguacauccaaaagcgcucuaucucaggaguucgaagccuuuuuccagggcaagucacuguacaucaauagugguaacaucccagauuaucucuuugacuucuuugagcaucugccgaauugcgcaagcgcccuugacuucauuaaauuggauuuuuacgggggcgcuauggcguccugggaaaaggcagccgaggacaccggaggcauacacauggaagaggcucccgagacuuauaucccuucuagggccgucucgcuguucuuuaacuggaagcaagaguuccggacguuagaagugacacuccgcgauuuuagcaaacugaauaagcaggacauuagauaccuugggaaaaucuucuccucagcaaccagucugagguugcagauuaagcguugugccggaguagcugguucucucagccugguucuauccacuugcaaaaacaucuacucacugaugguggaagccagcccacucaccauagaggaugaacggcauaucacaucugucaccaaucugaagacucuuuccauucacgacuugcagaaccaacgacugcccggcggguuaacagauagucucggaaaucugaaaaaccuuacgaagcugaucauggacaauauuaagaugaacgaggaggaugcaaucaaacuagcggaaggccucaagaaccugaaaaagauguguuuguuccaccugacccauuuaagcgacauaggugaggggauggauuauauugugaaaucucucuccucagaaccuugcgaccuggaggaaauccagcuugucaguuguugccugagcgcuaaugccgugaagauuuuggcacagaaccuccacaaucugguuaagcuaucgauccuggaucuuuccgagaacuaccucgagaaagacggcaaugaagcccugcaugaguugauagacagaaugaacgugcuggaacaguuaacugcucucaugcugccauggggaugugauguacaaggcucucuuagcucacuguugaagcaccucgaggaggucccccagcuggugaaacuagggcugaagaauuggaggcuuacagacaccgaaauccgcauucucggagccuuuuucgguaaaaacccgcugaagaauuuucagcaguugaacuuagcaggcaaucggguuaguuccgauggguggcuggcuuucaugggaguguuugagaaccucaagcaacuggucuucuuugacuucucuacaaaagaauuucuuccugaucccgcccuggugagaaaguugagccagguacuauccaaacugacuuuccuccaggaggcgaggcuggugggcuggcaauuugacgaugacgaucuuucaguuaucaccggugccuucaaguuagucacggcuuga

SEQ ID NO: 59750 - RNA, 5601 nt, Artificial Sequence
  derived and/or modified sequence opt3 from NLRC5__Homo_sapiens__XP_005256251
auggaccccgugggccugcagcucgggaacaagaaucuuuggagcugccuggucagauuguuaaccaaagauccugaguggcugaacgcaaagaugaaauucuuucugccaaauacugaccucgauuccaggaacgaaacucuggacccggagcaacggguuauccuucagcugaauaaguugcacgugcagggaucugauacguggcagucauucauucacuguguaugcaugcaacucgaagugccccuggaccuggagguccucuuacugaguaccuuugguuacgaugacggcuucacaagccagcuuggggcugaaggaaaaucccagccugagucucaguugcaccauggccugaagcgcccacaccaaucgugugguucaagcccccgacguaagcagugcaaaaagcagcagcuagagcucgccaaaaaguaucugcaacuucugagaacaagugcccagcagagguaccggucccaaauaccugggucuggacagccacaugcguuucaccagguguauguucccccuaucuugcgcagagcuaccgccagccucgauacaccagaaggcgcaauuaugggcgacgugaaagucgaggauggggccgacguguccaucucagaucuguucaacaccaggguaaauaagggaccgcggguuacuguguuacuggguaaggcuggcauggggaaaacaacccucgcacaccgccuuugucagaagugggccgaaggacaucugaacugcuuucaggcuuuguuccuauuugaguuccgacagcugaaucucauuacgagauuucugacucccagugagcuucuguucgacuuguaccucagcccugaaucugaccacgauaccgucuuucaguaucuggagaaaaacgccgaccagguguuacugaucuucgauggccuagacgaagcgcuccaaccaaugggucccgaugggccuggaccagugcugacacuuuucucccauuuguguaauggcacucugcuccccggcugcagggucauggcaaccucacggccggggaagcugccugccugucuucccgcugaggccgcaaugguucacaugcugggauuugacgguccacguguggaagaguacguaaaccacuucuuuagcgcucagccuagucgcgagggcgccuugguggaacuccagacaaaugggagacugaggucuuuaugcgcgguccccgcccugugucagguggcaugccuaugccuccaucaucugcuuccagaucaugcucccggacaauccguugccuugcugccuaacaugacccagcucuauaugcagauggugcuggcuuuaagcccaccgggccaucugcccacgucgucucuuuuggaccucggugaggucgcccugcgggggcuagaaacuggcaaagugauauucuacgcaaaggauaucgccccuccacugauugcuuuuggagcgacacacucccuccugaccucauucuguguaugcacuggccccgggcaccagcaaacaggauacgcauuuacccaccuuaguuugcaggaguuccuggccgcuuuacaucucauggccagcccuaaaguuaauaaggacacgcugacccaguaugugacacuucacucccgauggguccaacgcacuaaggcaagacuggguuugucugaucaucucccaaccuuucuggccggccuagcuagcuguacaugcaggcccuuccugucacaccucgcccaggggaacgaagacugugugggagcaaaacaggcggcugucgugcagguucugaagaaacuugccacucggaaguugaccggcccgaaagugguagagcugugccacugugucgacgagacacaagaaccugaguuagcaagucucaccgcccagucccugccauaccagcuucccuuucauaacuucccucugacuugcacggaucuagcuacacucaccaauauccuggaacaccgcgaggcccccauucauuuggacuuugaugguuguccacuggaaccucacugccccgaggcauuagugggguguggccagaucgagaaccucagcuucaagucuagaaagugcggagacgcuuucgccgaagcgcugucaaggagucuuccaacuaugggccgucugcaaauguuggggcucgccggaagcaaaauaaccgcucgggguauuucccaucugguuaaggcacuaccgcugugcccucagcuuaaagaggugucuuuucgagauaaucagcucucggaccaggucgugcugaacaucguagaaguguugccccaucugccaagauuaaggaagcucgaucugagcuccaauucaauuuguguuaguacacuucugugcuuggcccgcgucgcugugaccugucccacugugcggaugcuccaagccagagaggcagaccugaucuuccuacugucuccuccaacagagacgaccgcggaacuucagagggcccccgaucuccaggagagcgacggccaacgcaaaggggcucagucccgaucacugacuuugcgguuacagaagugccagcugcaaguccacgaugccgaagcacucaucgcucugcuucaggagggaccucaucuggaagagguugacuugagcggcaaccagcuagaggaugaagguugucgucugauggccgaggcagccucucagcuccacauugcuagaaagcuggaccuuuccaauaacggguuaaguguggcgggcgugcauugcguacugagggccgucagcgcauguuggacacucgcugaauugcacauaucucugcaacauaaaaccgugaucuuuauguucgcccaggagccggaagaacaaaagggaccacaggagcgcgccgcuuuucucgacucccugaugcuucaaaugcccucagaacugccuuugaguagccggagaaugaggcuaacacacugcggccugcaggagaaacaccucgaacaguuauguaaggcacuagggggaucgugccaucuuggccaucugcaccucgauuucuccgguaaugccuugggggacgagggagcggcucgacuggcccagcuccugccaggccuuggugcacuacaaucucugaacuugagcgaaaauggcuuaucacuggaugccguucucgggcuggugcgcuguuuuaguacucuucaguggcuguuccggcucgacauuuccuuugagucucagcacaucuugcugagaggagauaaaaccagcagggacaugugggcuacgggcucccuacccgauuucccugcagccgcgaaguuucugggguuccgucaacgcugcauaccgcggucacucugccuuagcgaguguccccuggaaccaccuaguuuaaccagauugugcgcuacacugaaggacugucccggaccacucgagcugcagcuuucuugcgaauuucuguccgaucagagccucgagacuuugcuggacuguuuaccucagcuaccccaacugucgcuccuucagcugucacagaccggcuugucuccaaaaaguccguuccugcucgccaacacacugucccuuugcccuagggucaagaaaguggaucuccgaagccugcaccacgcaacuuugcacuuccggucuaaugaggaagaggaagguguuuguugcgggcgcuuuaccggauguagccugucccaggagcauguggaaucauuaugcuggcuacugaguaaguguaaagaccucagccaaguagaucuuucugccaaccuguugggcgacuccggucugagaugccuccuggagugccuuccccaggucccaauuucaggcuuacuggaccucagucacaauagcaucucccaggagucugcuuuguaucugcuagaaacgcugcccucguguccuagggugcgggaggccagcgugaaccucgggucagaacaguccuuccgaauccauuuuaguagagaggaucaagcaggaaagacacuucgccugucugaaugcagcuucaggccagagcacgucucccguuuggcuaccggccugucaaaaucucuccagcugacugaguuaacacuuacccaguguugccuggggcaaaagcagcucgccauucuacugagcuugguuggacggcccgcgggccuguuuagucucagagugcaggaaccuugggccgacagggcacgcguacuuucccuguuggaggugugugcucaggccagcgguucugucacugaaaucucaauuuccgagacccaacagcagcugugcgugcagcucgaguucccgcgacaagaggagaacccagaagcuguugcauuaagacuggcccacugugaucuuggggcccaucacagucugcuagugggacagcucauggagacaugcgcucggcugcagcaguugagccugucgcaagucaaucucugugaagacgaugacgcgucuucccuucuguuacagagccuguugcucucacugagugagcuaaagacguuuaggcuuaccucuuccugcgugagcacugagggccuggcacaucucgccucaggucugggccacugucaccauuuggaagaacuggaucucaguaacaaucaguucgacgaagaggggacaaaagcucuuaugcgcgcccuggaaggaaaguggauguuaaaacgucuggauuugagccaccuccugcuaaacuccucuacccuugcacugcucacacauagacugagccagaugacuugcuugcaauccuuacggcugaauaggaacucaauaggcgacguugggugcugucaccucucugaggcccuucgcgcugcgaccagucuggaggaacuagaucugucgcauaaucagaucggagacgccggcgugcagcaccucgcaacgauuuugcccggucugccugagcuucgaaagaucgaccugagcgggaacuccaucucuucagcuggaggcguccaacucgccgagagcuuaguacugugcagacgguuggaggaacugaugcucggcuguaaugcacuuggggaucccacagcccugggacuagcucaggagcugccacagcaccucaggguguugcaucugccuuuuucccaccuuggucccggcggggcccugaguuuagcgcaggcacucgacggaucuccacaucuggaggaaauuagcuuggccgagaacaaucuggcuggcgguguucuccgcuucugcauggaacuuccucugcuaagacaaauagaucuggugucauguaaaaucgacaaccagaccgccaagcucuugacuuccaguuuuaccagcugcccggcucuggaggucauuuuacuuucuuggaaucugcucggggaugaagcagccgcugagcuggcccagguguugccccagaugggaaggcugaagcggguagaccucgagaaaaaccaaaucacagcacuuggcgcguggcugcuagccgaaggccuggcucagggguccucaauucaggugauccguuuauggaauaacccaauaccuugugauauggcccagcaccucaagagccaagagccccgccuggacuucgcauucuuugauaaccagccacaggcuccuuggggaacuuga

SEQ ID NO: 59751 - RNA, 1968 nt, Artificial Sequence
  derived and/or modified sequence opt3 from NLRP10__Homo_sapiens__XP_011518345
auggccauggcuaaggcaagaaaacccagggaggcccugcucugggcgcuuagcgaccuggaagagaacgauuucaagaaauugaaguuuuacuuacgggacaugacccuguccgaaggccagccuccacuagcucgcggggagcucgaaggacugaucccgguggaucuugccgagcuguugauuucuaaauauggugagaaggaagcagucaagguugugcucaaaggccugaagguaaugaaucugcucgaguuaguggaccaacugucacacauaugccuucaugauuaccgagaagucuaucgugagcacgugagauguuuggaggaauggcaggaggccgggguuaacggaagguacaaucaggugcugcuagucgcuaaacccaguagcgaauccccugagucucucgcaugcccauuccccgaacaggagcuggagucggugacaguagaagcccuuuuugacucaggcgagaagccuagccuggcuccaaguuugguugugcuccaagguuccgccgggacuggaaaaacgacccuggcgcggaagauggucuuagauugggcaacaggcacucuguaucccggccgcuucgacuacguguuuuaugugucuuguaaggaagucguucuccuucuggagagcaaauuggaacagcuacuguucuggugcuguggggauaaccaggccccugugaccgagauccucagacagccagagaggcugcuuuuuauucuggacggauucgaugaauugcaacggccguuugaggaaaagcucaaaaagcgcggucugucccccaaagagucauuacugcaucuacucauccgaagacacacacugccuaccugcagucuuuugauuacuacaaggccacuggcucuccggaaucuggaaccccuucugaagcaggcccgucauguacacaucuugggcuucagcgaggaggaacgcgcaagauacuuuucuuccuacuucaccgacgagaaacaggcugauagggccuuugacauagugcagaagaacgacauccucuauaaggcgugucaagucccugggauuugcugggugguuuguucauggcugcagggacagauggaacggggcaaaguggucuuagagacgccacgaaauagcacugauaucuucauggccuacgugaguaccuuccugcccccggacgaugacggugggugcucugagcuaucccgccacagaguacucaggagccuguguucgcuugcagcugaaggcauucaacaucagcgguuuuuguucgaggaagccgagcugcgcaagcacaaccucgauggaccuagacuggcugccuuuuuaucuuccaaugacuaucagcugggccuugcaaucaaaaaguucuacucauuuaggcauauaaguuuccaggauuucuuccacgccaugagcuauuugguuaaagaagaccaaucccgucucgggaaggagucucggcgagaggugcagagacugcuagaagucaaggagcaggaaggaaacgaugagaugacacugacuaugcaguuucuccuggacauuagcaaaaaggauucauucaguaaucuugaauugaaauuuugcuucaggaucucccccugccuggcucaagacuuaaagcacuuuaaagagcagauggagagcaugaagcauaaccgcaccugggaccucgaauuuucucuguacgaggcgaagauuaaaaaucuugugaaggguauccagaugaacaaugucucauucaaaaucaagcacaguaacgagaaaaagagccagucccaaaaccuguuuucugugaagucgagcuugucccauggcccaaaagaagaacagaaguguccuucaguucacgggcagaaagagggaaaggauaauauugcaggcacacagaaagaggccaguaccgguaaggggcggggcacggaagagacucccaaaaacacauauauauga

SEQ ID NO: 59752 - RNA, 3102 nt, Artificial Sequence
  derived and/or modified sequence opt3 from NLRP11__Homo_sapiens__NP_659444
auggccgagagcgacuccaccgauuucgaccugcucugguaccuugaaaaccugucugauaaggaguuucagucauucaaaaaguauuuggcuagaaaaaucuuagacuuuaagcugccccaauucccucuaauucagaugacaaaagaagaacucgcaaaugugcugccaauaaguuacgaaggccaguauaucuggaacaugcuuuuuagcauuuucuccaugaugaggaaggaggaucugugccggaagaucauugggcgccgaaaucguaaccaggaggccuguaaagcggucaugagaaggaaguuuauguugcaaugggaaucucacacuuucggaaaauuucauuacaaguucuuucgggacguuucgucagauguguucuauauccuccagcuggcuuacgacagcacgaguuauuacuccgccaauaaccugaauguauuucucaugggugagcgcgcaucuggcaaaaccauagugaucaacuuagccguccugagauggauuaagggggaaauguggcagaauaugaucagcuacgugguucaccuuacagcucaugagauuaaccagaugacuaauuccucauuggcagagcugaucgccaaggauuggccggacggacaagcucccauagccgauauucuaagugacccuaaaaagcuccuguucauccuugaagaucuggacaacauuagguucgaguugaaugugaacgaaagcgcgcucugcucuaauuccacccagaaagucccaauccccgugcuguuaguaucacugcucaagcggaaaauggcaccuggcuguugguuucuuaucagcagucgcccaacacgagguaacaacguuaagaccuuccugaaagagguggacugcuguacuacauugcagcuaucuaaugggaagagagaaauuuauuuuaacuccuucuuuaaggauaggcagcgggccagcgcugcccugcaacucguccacgaggacgagauacuggugggacuuugccguguggcaauccuguguuggauuaccugcacggucuugaaacgccagauggauaagggcagagacuuccagcucuguugccaaacucccaccgaucugcaugcucacuuuuuagccgacgcgcugacaucggaagccggccuaacugcaaaucaguaccaccucgggcugcuuaaaagguugugucugcucgcugccggaggucuguuccuuucuacccugaacuuuuccggcgaggauuugcggugcguuggguucacagaagcugacgugucaguacuccaggccgcaaauauccuguuaccuaguaacacccauaaggaucgauauaaauuuauacaccugaaugugcaggaguucugcacggccauugcuuuucuaauggcggucccaaacuaccucaucccgagcggaucccgcgaauauaaggagaagagagagcaauacucugacuucaaucagguguucacuuuuaucuucggccugcuuaacgcaaauaggcggaaaauuuuggaaaccagcuuugguuaucagcugcccaugguugauucauucaagugguacagugugggguacaugaaacaucucgaccgcgacccugagaagcugacacaccacaugccauuauuuuauugucuguacgaaaacagagaggaagaguucgucaaaacuaucguggaugcccuuauggagguaacaguuuauuugcaguccgacaaggauaugauggugagccucuacugccuggacuauuguugccaucuaaggacccugaagcucucuguccaacguauuuuucagaauaaagaaccccugauacggccuacggcuucacagaugaagagucuuguguacuggcgagagaucuguagcuuguucuauaccauggaaucccugagagaguuacacauuuuugauaacgaccucaauggaaucucugagaggauccugucgaaagcccuugaacauagcuccugcaagcugcgcacauugaaacucucauacgucaguacugcaucuggcuucgaggaucugcuaaaggcccuggcucggaacagaagccucaccuaccuguccauuaacuguacaucaauaagccuuaauauguuuucuuugcugcacgacaucuuacaugaaccaacuugccagauuucccaccucagucugaugaagugugaucuuagggccagcgagugcgaagagaucgcaucucugcuaauuuccggcgggucacuccgcaaacugaccuugaguagcaacccccugcgaucggacggaaugaauaucuuaugugaugcgcuccugcacccgaacugcacacuuauaucccugguguugguuuucugcugucucaccgagaauugcuguucugcucugggucgggugcuacuguuuagcccuacucuucgucaacucgaccugugcguaaacagauugaagaauuauggcguccugcaugugacguuccccuuacucuucccaacaugucagcuggaggagcuucaccugucagggugcuuuuucaguuccgauaucugucaguacauugccaucguuauugcaaccaacgaaaaauugaggucucucgagaucggaagcaauaagauagaagacgccggcaugcagcugcuaugcggugggcugcgccauccuaacuguaugcuugugaauauuggccucgaggagugcaugcugacuuccgcuuguugccggucauuggccagcgucuuaaccacaaacaaaacccuggaaagacucaaucugcuucaaaaccaccugggaaaugacggcguggcaaaguugcuagagagucugaucucucccgauugcguacucaaagugguugggcugccacuuacuggauuaaacacacagacgcagcaacugcucaugaccgucaaggaaaggaagcccuccuugauuuuucugagcgagacuuggucgcucaaagaaggucgagagaucggcgugaccccugcuucacagccagggucuauaaucccgaacaguaaucuggacuauauguucuuuaaguucccccgcauguccgccgcgaugcggacaagcaacacagccucuagacagccucuuuga

SEQ ID NO: 59753 - RNA, 3189 nt, Artificial Sequence
  derived and/or modified sequence opt3 from NLRP12__Homo_sapiens__NP_001264055
augcugagaaccgccggcagggacgggcucugccggcuuagcacauaccuggaggaauuggaggcuguggaauuaaagaaauucaagcuguaucuaggaacugcaacggagcucggugaaggcaaaauccccuggggguccauggagaaggccggaccucuggagauggcgcagcuucugauuacccacuuuggcccagaagaggcuuggcgcuuggcccucucuacauucgaacgaauaaaccguaaagaucugugggagagaggucaaagggaggaccugguccgggauacuccgcccgggggaccuucaagucucggcaaucagagcaccuguuuacuggaaguuucccuugugacaccacgcaaggacccccaggagaccuacagagauuauguaaggcggaaguuucgcuugauggaagaccgaaacgcaagacugggcgagugcgugaaucuaucucauagguacacucggcuccugcuugucaaagaacacucgaacccuaugcaagugcaacagcagcuguuggauacagggcguggacaugcccgcaccguuggucaccaggcuucaccaaucaagauugagacguuguucgagcccgacgaagagagaccugaaccaccgaggacuguggucaugcaaggcgcagccgggaucggaaaaagcaugcuggcucauaaggugauguuagauugggccgacggcaaacuguuucagggucgguucgauuaucucuuuuacauuaauugucgagagaugaaccagagugcgaccgaaugcuccaugcaggaccuuaucuucucuuguuggcccgagccuagcgcaccacugcaagaguugauacgcguacccgaaagacuacuguuuaucauugauggguucgacgagcucaagccuuccuuucacgacccacagggacccuggugccuguguugggaagagaagaggccgacagaacuucugcucaauucacucauccggaaaaagcuguuaccugagcugagucuacucauuacuacccgccccacagcccuggagaaacuucacagauugcuggaacauccaaggcacguugagauccucggcuucagcgaagcugagcguaaggaguauuuuuacaaauacuuccauaacgccgaacaggcaggccaaguguucaauuauguccgggauaacgagccucuguuuaccaugugcuucgugccccuuguguguugggucguuugcacgugucugcagcagcaguuggaagggggaggucuccugcgacaaacuucuagaacaaccacugcuguguacauguuauaucugcuaucccucaugcagccaaagcccggcgccccuaggcugcagccaccgcccaaucagcgcgggcuuugcucauuggcggccgacggacuguggaaccagaaaauacucuuugaggaacaggaucugcggaagcacggcuuagacggugaggauguaagcgcauuccugaauaugaacauuuuucagaaggacaucaauugcgagagauacuauaguuucauucaccuuucuuuucaggaguucuuugcugccauguacuauaucuuggaugaaggggaaggcggagcuggcccugaccaagaugugacaaggcuccugaccgaguacgccuucuccgaacgcagcuuucuagcacugacgucgcgauuccucuuugggcugcuuaacgaggagacccggucucauuuggaaaaaucccuguguuggaaggucucaccacacaucaaaauggacuuacuccaguggauucagaguaaggcccagagcgauggauccacacugcaacaggguucucuugaguucuucagcugccuguacgaaauacaggaggaagaguuuauccaacaggcuuugucacauuuccaggugauuguugugaguaacaucgcguccaaaauggagcacauggucagcucuuuuugucucaagcguugcagaucagcacaggugcugcaucuauauggcgccacuuacagugcugacggggaagacagggcccgcuguagcgcaggagcccacacccugcucguacaacugcggcccgagagaacaguucuuuuggaugcuuauuccgaacaccuggccgcagcguuaugcacuaauccuaaccucauagagcugucucuuuacaggaaugcucugggcucgcgaggugugaagcuacucugucaggggcugcgccauccaaacugcaaauugcagaaucugcgguuaaagagauguaggauuagcuccucagccugcgaggaccucagugcagcccugaucgcuaacaaaaaucuuacccguauggaucugucuggcaacggagucggcuuccccgggaugauguugcucugugaaggacugcgccacccgcagugccggcuacaaaugauccagcugagaaagugccagcuugagagcggugccugucaggaaauggcauccgugcucggcacaaauccucaucuggucgaguuggaccugaccgggaacgcuuuagaagaucucggacugaggcuucugugccaaggcuugcgacacccagugugucggcuccgcacucuguggcuaaaaauuugcagacugacggccgcggccugugacgagcuugcuucaacacucagcguuaaucagucucugagggaguuggauuuaucccugaacgaacucggugaccugggggugcuucuguugugcgagggccuacggcaccccaccuguaagcugcagacucuccgacugggaaucugcagacuuggcagugcagccugugaaggguuaagcguaguccugcaagcuaaucauaaccuccgcgaguuggaucugucuuuuaaugaccucggagauuggggccuguggcuucuggccgaagguuugcagcacccugcaugcaggcuacagaagcuguggcucgacuccuguggguuaaccgcgaaagccugcgagaaccuguauuucacacuuggaauuaaccagacccugacugaucucuacuugacaaauaacgcucugggcgacacgggugugcgucuccugugcaagcggcuuucacaucccggcuguaaacuaagaguucugugguuguuugggauggacuuaaauaagaugacccacaguaggcuggccgcacuccgcgugacuaaaccauaucuggauauaggaugcuga

SEQ ID NO: 59754 - RNA, 3132 nt, Artificial Sequence
  derived and/or modified sequence opt3 from NLRP13__Homo_sapiens__NP_789780
augaacuucagcgugauuaccugccccaauggcgggacaaaccagggacugcucccuuaccuuauggcccuggaccaauaucaguuggaggaauuuaaguuaugucuggagccacagcagcuaauggauuucugguccgcuccgcaaggucacuuucccagaaucccuugggcaaaucucagggccgcggacccacugaaccuuucuuuccuguuggaugaacauuuucccaaaggccaggcuuggaaggucguucucgggauauuccagacuaugaaucugacgucacugugcgagaaagugcgggccgaaaugaaggagaacguacagacccaagagcuccaggacccuacacaggaagauuuagagaugcuggaagcagccgcuggaaauaugcagacucaaggcugucaggacccaaaccaggaggagcuugaugaauuggaggaagagaccgguaaugugcaagcacaggggugccaggaccccaaccaggaagaaccugagaugcuggaagaggccgaucaccgccgaaaauaccgugaaaauaugaaggcugagcuacucgaaacaugggacaacaucaguuggccaaaggaucaugucuauauuagaaauaccagcaaagacgagcacgaggaacugcaaaggcuucuggauccgaaccggacucgcgcccaggcgcagacaaucguguugguuggcagagcaggagugggcaagaccacgcucgccaugcaggcuaugcugcauugggccaauggggucuuauuucaacagagguucuccuacguguuuuaucugucuugucacaaaauucgguacaugaaggagacuaccuucgcagaacucaucucgcuugacuggcccgacuuugaugcuccuauagaggaguucaugucacagccagagaaacuguuguuuaucauugacggauucgaggaaaucauuaucagcgagagucgcuccgaaucucuagaugacgguagccccugcacagauugguaucaggagcugccuguaacuaagauacuccacucccugcuuaagaaagagcugguuccauuggccacccuccugauuacaaucaagaccugguucgugcgagacuuaaaagcgucacuggucaaccccuguuuugugcaaauuacgggcuucacuggggaugaccuaagaguguacuuuaugaggcauuucgaugacaguagcgaagucgagaagauccuccagcagcugcggaaaaacgaaacacuuuuucacucuugcuccgccccgaugguuuguuggaccgugugcucauguuugaagcagccuaaaguacguuacuaugaucugcaaagcaucacucagacaaccacgagucucuacgcauauuucuuuucuaaucuguucuccaccgcugagguggaccuugccgacgauagcuggcccggacaguggcgcgcucugugcucguuggccauugaaggccucuggucuaugaacuuuacauucaauaaggaggacacugagauagaaggucuggaggucccauuuaucgauuccuuauacgaguucaacauucugcaaaagaucaaugacugcgggggauguaccacauuuacucaucuaucauuccaggaguucuuugcagccaugaguuucgugcucgaagaaccuagagaguuucccccacacagcaccaaaccccaggaaaugaagaugcugcuucagcacguuuugcuggauaaagaggcuuauuggacaccugugguccucuucuuuuucggccuguuaaacaagaauauagcgagggaacuggaggacacccuucauugcaaaauuuccccacgggugauggaagaguugcucaaguggggcgaggaacuggggaaggcagagucugccagccuacaauuucacauccugcgacucuuccauugucugcacgaaucacaggaggaggauuuuacuaaaaagaugcuuggacgcaucuucgaaguagacuugaacauucuggaggaugaagaguuacaggcuaguuccuuuugccucaaacauuguaagagacugaauaaacuuaggcugagcguuucuucacacaucuuggaacgggaccucgagauucuggagacgaguaaguucgauagccgcaugcacgccuggaacuccauaugcucuacacuugugaccaaugaaaaccugcaugagcucgaccugucgaauagcaagcuacacgcauccucagucaaagguuugugucuggccuuaaagaacccgagaugcaaagugcagaagcucacuuguaaaagugucacccccgaaugggugcugcaagaucuuaucauugcucugcagggcaauucuaagcuaacacaucucaacuuuagcuccaacaagcuggggaugaccguuccuuugauccugaaagccuuaaggcacucagcaugcaaucucaaguaccugugucuugagaaaugcaaccugagcgcggcuucuugccaggacuuggcccucuuccugacuuccauccagcacgugacacgucuaugucugggauucaaucggcuucaagacgauggcauuaagcuccugugcgcagccuugacgcauccaaaaugugcucuggaacgauuagagcucugguuuugccagcuggccgcacccgcuuguaagcaccuuagugacgcccuguugcagaacagaagccucacccaucugaaucuaucuaaaaacucccugagggaugaggguguaaaguuccuuugcgaagcgcucgggcgcccugacggcaaucugcaaucauugaacuuaaguggauguagcuuuacucgggagggcugcggggaacuggccaaugcucucucgcacaaccauaaugucaagauacuggaucuuggagagaacgaccugcaggaugacggugugaaauugcuaugugaagcacugaagccacacagagcccuccacacacugggccuugcuaaaugcaauuuaaccacagccuguugccagcaucuguucuccguucucucuagcucaaagaguuuggugaaccugaaucuccuggggaacgagcuugauacugacggagucaaaaugcugugcaaggcauugaagaaauccaccuguaggcuacagaagcugggcuga

SEQ ID NO: 59755 - RNA, 3282 nt, Artificial Sequence
  derived and/or modified sequence opt3 from NLRP14__Homo_sapiens__NP_789792
auggccgacagcuccucuucaaguuucuuucccgauuucggccugcuccuuuaccuggaggaauugaacaaggaggaauuaaauaccuuuaaacuguuccuaaaggagacaauggaaccugagcacgggcucacuccauggaacgaggugaaaaaggcuagaagggaagaccuggcaaaucuuaugaaaaaguauuacccgggagagaaggccuggagcgucucccugaaaaucuuugguaagaugaacuugaaagaucucugcgaacgggcgaaggaggagauuaauuggucugcucagacgauaggccccgacgaugccaaagcaggggaaacccaagaggaccaggaagccguucugggagauggcacagaguaucgcaaccgaaucaaggaaaaguucuguauuacuugggacaaaaagucgcuggcugguaaaccugaggauuuucaucacgggaucgcagagaaggaccguaaacucuuagaacaucuguucgauguggacguaaagaccggagcccagccacagauugugguccuucaaggcgcugccggcguggggaaaacaaccuugguuagaaaggcgaugcuggauugggcagagggaucacuauaccagcagagguuuaaguauguguucuaccucaauggucgggaaaucaaccagcugaaagagcgcagcuuugcccaacuuauaaguaaggacuggcccuccacugaaggcccuaucgaggagauuauguaucagccaucuagccuguuguucaucauugacuccuuugaugaacucaauuucgcuuucgaggaacccgaguuugcccugugcgaagacuggacacaggagcacccugucucauucuuaaugaguagccugcucagaaaagugaugcuuccagaggcaucucuguugguaaccacgaggcuaacuaccuccaagcggcugaaacagcuccugaagaaccaucacuacguugaacuucuggggaugucagaggaugcucgcgaagaguacaucuaucaauuuuucgaggacaagcgaugggccaugaaaguguuuagcaguuugaagucuaaugaaaugcuguucuccaugugucaggucccgcucgugugcugggcggccuguacaugcuuaaaacagcaaauggagaagggaggcgaugugacucugaccugucagacaaccacggcacuauuuacuugcuacauaagcucucucuucacacccgucgacggugggucgccuucccugccaaaccaggcucagcuuagaagguugugucaaguugccgcuaaaggaauuuggaccaugacuuauguguuuuaccgggaaaaucugcgucgccucggccugacacagucagauguaaguagcuucauggacuccaacaucauucagaaggaugccgaguaugaaaauugcuacguguuuacccaccuucauguccaggaguucuuugcagccauguucuauaugcugaagggcucuugggaggcugggaaccccagcugucaaccuuucgaagacuugaaaucacuccugcagaguacguccuacaaggauccacacuuaacccagaugaaaugcuuucuguucggacuacucaacgaggacagagugaagcagcuggaaaggacauuuaauugcaaaaugagccuuaagaucaagucuaaauugcugcaauguauggagguucucgguaacucagacuacagucccagccagcugggcuucuuagaacuguuucauugccuuuaugagacucaggauaaggcguucaucucccaggcaaugcgguguuuuccgaaaguggccauuaauauaugcgagaagauccacuugcucgucucuucguucugucugaaacacugccgaugucuacgcaccauuagacugagcgugacaguaguuuuugaaaagaaaauccucaagacuucccugccuaccaacacaugggacggggauaggauaacccauugcuggcaagaccuuuguucaguguugcacacuaaugagcaucugcgggaauuagaucucuaccacaguaaccuggacaagucugcuaugaauauucuucaucacgagcugcgccaccccaacugcaaauugcagaagcuccugcuaaaauucaucacguuuccagauggaugucaggacaucagcacaucccugauucauaauaagaaccucaugcaccuggaucuuaaaggcucagacaucggugauaauggggucaagagcuugugcgaagcccugaagcauccugagugcaaauuacaaacccucagacuggagucuuguaaccuuacuguguucugcugucugaauauuuccaacgcacuaauaaggagucagagccucaucuuucugaauuugucuaccaacaaccuguuagacgauggcguccagcuccugugcgaagcccuucgucaccccaaguguuaucuggagcgguugucccucgaaucaugcggacugacagaggcuggcugugaguaccuaagucuggcccuuauuagcaauaaacgacucacccaccugugcuuggcagacaacgugcugggggacggagguguuaaguuaaugucggaugcgcuccagcaugcucaauguacucugaaaucccuugugcugagaaggugccacuucacaucuuugagcucagaauaucucaguacgucccugcuacauaauaagucucugacccaccuugaccucggcagcaacuggcugcaggauaaugggguaaaguuguuaugugacgucuuccgccauccauccugcaaccugcaggaucucgagcugaugggaugcgugcuuacuaaugccuguugccuggacuuggcaucaguuauccuaaacaaucccaaccugcggagccucgaucugggcaauaacgaccuucaggaugacggugugaaaaucuuaugugaugcccugagauacccuaauugcaacauucaaaggcucggguuggaauauuguggccugacaagucucugcugucaggaccugucuuccgcucuuauaugcaauaagcgccugaucaaaaugaacuugacccagaacacacuaggauacgagggcauugucaagcuguacaaagugcucaagagcccaaaguguaaauuacagguacuggggcuuugcaaggaagccuuugaugaggaggcacaaaaacugcucgaagcugugggaguuucgaauccgcacuugaucauuaagcccgacuguaacuaucacaaugaggaagacgucucauggugguggugcuucuga

SEQ ID NO: 59756 - RNA, 4128 nt, Artificial Sequence
  derived and/or modified sequence opt3 from NLRP1__Homo_sapiens__NP_001028225
auggccggcggggcuuggggaagacuggcaugcuaccucgaguuccuuaagaaagaagaacugaaggaauuucaguuguuacuggccaacaaagcgcacagcagguccucuucaggugagacccccgcucaaccugaaaagacaaguggcauggagguggccagcuaucuagucgcacaguacggggagcagcgggccugggaccucgcucugcauacuugggaacagaugggacuucgcucccugugugcacaagcccaggagggcgcuggucacucuccaucguucccguauucacccagcgaaccucauuuggggaguccaucccagcccacgucuaccgccguucucaugccuuggauccacgagcugccagcgggaugcacacagggcagcgagcgacgugugcugagacaacuccccgauacuuccggcaggcgguggcgcgaaauuucagcaaguuuacuguaccaggcccuuccuagcucuccagaccaugaguccccgucacaggaaagccccaaugcuccuaccaguacagccguauuggggucuuggggauccccaccccagccuagccuggcaccaagagagcaagaagcucccgguacccaguggccgcuagaugagacuucgggcauauauuacacagagaucagggaacgggagcgcgaaaaaucugagaaggggcgaccucccugggccgcgguggucggaaccccaccucaggcccacacgucccuccaaccccaccaucacccaugggaacccucagugagagagagucuguguagcacuuggccuuggaagaacgaggacuuuaaucagaaauucacccagcuucuguugcuccagaggccacauccgcggucccaagauccccugguuaagcguucuuggccugacuauguggaagagaaccgcggccacuuaauugaaaucagagaucuguuugguccagggcucgacacacaggagcccaggauugucauccuucagggagcagcuggcauaggcaaaagcacucuggcccgacaggugaaggaggcuugggggcggggacaauuguacggugaucgcuuccagcacguauuuuacuucucaugcagagagcuagcccagaguaaaguugugucccuggcagagcucaucggcaaggacgggaccgccacuccugcuccaauuaggcagauccugagccggcccgaacgccuucuguuuauuuuggauggagucgacgagccgggcugggugcuccaagaaccuucuucagagcuguguuuacauuggagucagccacagcccgcggaugcacugcuagguagccuccuggggaagaccauccuuccugaggccuccuucuugauaacggcuagaacuacagcccugcagaaucucauucccucucuggaacaagcaagguggguggagguccuuggcuuuucggaaagcucccguaaagaguauuucuaccgguauuuuaccgacgaacgacaggccaucagagcuuucaggcugguuaagucaaacaaagaguugugggcccucugccuggugccauggguaaguugguuagcauguacuugccugaugcagcaaaugaagcgcaaagagaagcuaacacucaccucuaaaacgaccacaacucugugucuucacuacuuggcgcaggcucugcaggcccagccucucggaccccaacugcgggacuuaugcagccuggcagccgaaggcauuuggcagaagaagacccuuuucuccccagaugacuugagaaaacaugggcucgauggagcuaucaucucaacauuucugaagauggguauucuacaggagcacccgauaccucugagcuauucuuucauccaucucuguuuucaggaguucuuugccgcaauguccuacgugcuggaagacgaaaaaggcagggggaagcacaguaauugcauuaucgaucuugagaaaacuuuggaggcuuauggaauacacggccuguucggugccagcaccacacgcuuuuuacucgggcugcuuucugacgaaggcgagcgagaaauggagaacauuuuccauugccggcugucccaaggacguaauuugaugcaguggguccccucacuccagcugcuacugcagccacacagucucgaaagccugcauugucuuuacgagaccagaaacaagacauuuuugacgcaagugauggcgcacuucgaggaaaugggcaugugcguugagacagauauggaacuguuaguguguaccuuuugcaucaaguucucgaggcacgucaaaaagcuccagcugaucgaggggcgccagcaucgguccacuuggucucccaccauggugguacuuuuuagauggguuccugugacagacgccuacuggcaaauucuguucagcguccuaaaagugaccaggaaucucaaggagcuggauuugucaggaaacagucugucccacucugcugucaaaagccuguguaagacucuccgacgcccacggugccugcuugaaacacugagauuggcagguuguggccucacggccgaggacugcaaggaucuggcuuucgggcuaagggccaaucagacccugacugaacuugaccucuccuuuaacgugcugacagacgcaggagcgaaacauuugugucagcgucugcgccagcccucaugcaaguuacaacggcuccagcugguuagcuguggccuuaccagugauugcugccaggaccuggccucuguguuguccgcuagcccuucgcucaaagagcuggaucuacagcaaaauaaccuggacgauguaggugucagacuucucugugaagggcugaggcacccggccugcaaguugauccgauuaggccuggaccagacaacucucucagaugagaugcggcaggagcugcgcgcacuugaacaggagaaaccacaacuguugauuuucucuagaaggaagcccagugugaugaccccuacggaaggacuagacaccggcgagauguccaacagcacaucuagccugaagcggcagcgacucggguccgaaagagcugccucacauguugcacaggccaaucugaaacuuuuagaugugaguaagauauuuccaaucgcugagauugcgggaaaaagccacgaggaaucuucccccgaggucgugccuguagaacugcucugugugccgucacccgccagucagggcgacuugcacacuaagccacuggguaccgaugacgauuucugggggccuacaggacccguugcaacugaggucguggacaaagaaaagaaccucuaucgcgugcauuuuccagucgcuggcagcuacagguggccuaauaccggucugugcuucguuaugcgugaggccgugacgguggagaucgaauuuuguguaugggaccaauuccuuggcgagaucaacccccagcacuccuggauggucgccgggccacuguuggauauuaaagcugaaccgggagcaguggaggccguucaucuaccucacuuuguggcgcugcagggcgggcaugucgacacaucucucuuccaaauggcucacuuuaaggaggaaggaauguuacuggagaagcccgcccggguggaacuucaccauauaguucuggagaauccaucguucagcccccucggcguguugcugaaaaugauccacaacgcacucagauuuauuccuguaaccucagucgugcugcuuuaucauagggugcacccagaagaggucacuuuccaccuauaccugauccccuccgauugcaguauucgcaaggccaucgacgauuuggagaugaaauuccaguuuguucgaauacauaagccuccgccauuaacaccccuguauauggguuguagauacaccgugucugggagcggauccggcaugcucgaaauccugccuaaagagcuugaacugugcuaucggucacccggugaggaccaacucuucucugaauuuuacguaggccacuuggggagcggaauuagguuacaggugaaggauaagaaagacgagacucuagucugggaggcucuggugaagccaggccgcaauaccagucagccuuggaaccuccguuguaauagagaugcacggagguacuga

SEQ ID NO: 59757 - RNA, 3189 nt, Artificial Sequence
  derived and/or modified sequence opt3 from NLRP2__Homo_sapiens__NP_001167552
auggugagcuccgcccagaugggcuucaaccugcaagcucuccuugagcagcugucucaggacgaauugucaaaguuuaaauacuuaaucaccacauucagucuggcacacgagcuacagaagauuccccauaaagaagucgauaaggccgacgggaaacaacucguugagauacugacuacgcacugcgauagcuauuggguggaaauggcgucccuucagguauuugagaagaugcauagaauggaccugucugagagggcuaaggaugaagugcgggaggccgcauugaaaucguucaauaagcgcaaaccucucucacugggaaucacccgaaaggaacguccaccgcuggacgucgaugagaugcucgagagauuuaaaacagaagcccaggcuuucacugagaccaaggguaacgugauuuguuuaggcaaggaaguuuuuaaagggaagaaacccgacaaggauaauaggugccgguacauccugaaaacaaaguuccgcgagauguggaaaagcuggccuggagacaguaaggaagugcaggucauggcagagagauauaagaugcuuauuccauuuuccaaccccaggguguugccuggcccauucucuuacaccguaguucuguauggucccgccgggcuaggaaaaacuacacucgcucaaaagcugaugcuugauugggccgaggacaaucugauccacaaauuuaaguacgcguucuauuugagcugucgggaacucucccgccugggcccuugcucauuugcagaguuaguguuccgagauuggccagaacugcaggacgacauaccgcauauccucgcccaggcuagaaaaauucuuuucgucaucgauggcuuugacgagcugggggccgcacccggagcuuugauugaagauaucuguggugacugggagaagaagaaaccugugccagugcuacugggcagucuccugaacagggucaugcuucccaaggccgcgcuguugguuaccacgcggccucgugcccuccgcgaucugagaauauuagcagaggaaccaauuuacaucaggguggagggguuccuggaagaggaccggcgagcuuacuuucuacgccacuucggagaugaagaccaggccaugagagcuuuugagcucaugaggagcaaugccgcacuguuccaacuuggcucugcccccgcuguaugcuggauuguguguacuaccuugaaacugcagauggagaagggugaagauccggucccuacaugccucacucggaccgggcuguuucuucgcuuccuguguuccagauuuccccagggagcgcaauugaggggcgcacuccguacacugucauuacuggccgcucagggccuaugggcccagaccagcgugcuccaccgggaggaccuggaacgacuugggguucaggagagugauuugagacuguuccucgacggagacauccugaggcaagaucgcgugucuaaagguugcuauuccuuuauccaucugagcuuccagcaguuuuuaacggcacuuuucuacacuuuggagaaggaagaggaagaggaccgggauggccacacaugggacauuggggauguccagaagcuccugucgggaguggaaagacuaaggaacccagaccugauacaagccggcuauuacucuuucggucucgcuaaugagaaacgcgccaaggagcuggaagcaaccuuugggugucgaauguccccugauaucaaacaggagcuuuugcggugcgacauuucaugcaagggcggacauaguacuguaacagaucugcaggaauuacucggcugucuguaugagagccaggaagaggagcuuguuaaagaagugauggcgcaauucaaggagaucucccugcacuugaacgcugucgacgugguccccucuagcuuuugcgugaagcacugucguaaucuccagaaaaugucacugcagguuauaaaggaaaaccuaccagagaaugugaccgccagugaauccgaugcagagguagagagaagccaggacgaucaacauaugcugcccuucuggacggaccucugcucuauuuuugggucaaacaaagaccugaugggacuugccaucaaugauaguuucuugagcgcuucccuggucaggaucuuaugugaacagauugccucugauaccugccaccuccagcgcgugguuuuuaagaacaucucgccugcagacgcucaucggaaccugugucuugcccugagaggucacaaaacagugacuuaccuaacccuccaaggcaaugaccaggaugacauguucccagcgcugugcgaggucuugaggcauccggaauguaaccugcgauauuuagggcucgugagcugcuccgccacaacucagcagugggcugaucugucacuugcacuggagguaaaucaaaguuugaccugugugaaccucucugacaaugagcugcuagaugaaggagccaagcugcuuuacacaacccuccgccaccccaaaugcuuucugcagcgguugagccuggagaacugccacuuaacugaagcuaauuguaaggaccucgccgcaguucuggucguguccagagagcuuacgcaucugugcuuggcgaagaacccuauuggcaauacaggugugaaauuccucugugaagggcugagguacccagagugcaagcuacagacccugguccuuuggaacugugauauaacuucagacggcugcugugaucucaccaaacuguugcaggaaaagagcucuuuacugugccucgaccugggacuuaaucacaucggcguuaaagggaugaaguuucugugugaggccuugcguaagccccuaugcaaccugcgcugucucuggcuguggggaugcuccauuccuccauucaguugcgaggaccuuuguagcgcuuuaucuugcaaucaaucccuggugacacucgauuugggucagaacccccugggcucaaguggggugaaaaugcucuuugaaacccugacuuguagcucgggaacacuucggacgcugagauugaagaucgacgauuucaaugacgagcuaaacaaacugcucgaagagaucgaggaaaagaacccgcaguuaauuauagauaccgagaaacaucacccuugggccgaaaggccauccucucacgacuucaugaucuga

SEQ ID NO: 59758 - RNA, 2940 nt, Artificial Sequence
  derived and/or modified sequence opt3 from NLRP3__Homo_sapiens__NP_001120933
augaagauggccagcaccagaugcaaacuggcuagguaccucgaggaccuugaagauguggaccugaagaaauucaagaugcacuuggaggauuaucccccucagaaaggcuguaucccauuaccgcgggggcaaacagaaaaggcagaccaugucgaucuggccacucuaaugauugacuuuaacggagaggaaaaggcgugggcuauggccguuuggauauucgcagccaucaaucgccgagaucucuacgagaaagcuaagcgugacgagcccaaaugggguuccgauaacgcaagagugucuaauccuacgguaauuugccaggaagacucaaucgaggaagaguggaugggccugcuugaguaucugaguaggauuagcaucuguaagaugaaaaaggauuaccggaagaaauaucgcaaguacgugagauccagguuucagugcauagaagaccggaacgcccgcuugggggagucugucucgcucaauaaacgauauaccagacugaggcugaucaaggaacaccggucacagcaagagcgugaacaggagcucuuagcuauuggaaaaacaaagacuugugagagcccagugagucccaucaaaauggaacugcuuuucgauccugacgacgagcauuccgaaccaguucacaccguggucuuucagggcgccgcggguauugggaagacaaucuuggcacgcaagaugaugcuggauugggccucuggaacccuauaccaggacagauucgauuaccucuuuuauauacauugcagggaggugagccugguaacucaacggucccuuggcgaccugauuaugucauguugccccgauccuaacccaccgauccacaaaauuguucgaaagcccagucgcaucuuguuccucauggacggcuuugaugaacugcagggggcuuucgacgagcacaucggaccuuuauguacagauuggcagaaagccgagagaggugacauucugcucagcucucuuauaaggaagaaacuguugccagaagcaucccuacugaucaccacgcggcccguggcucucgagaagcugcagcaucuucuggaucacccucgccaugucgaaauuuugggcuuuucagaggccaagagaaaagaauacuucuuuaaguauuucagcgacgaggcgcaagccagggcagcuuucagucucauccaggagaaugaagugcuguuuacuaugugcuucauaccauuaguguguuggauugucugcaccgggcugaaacagcaaauggagucuggaaagucccuagcccagacaagcaaaacuaccacagcuguuuacguguuuuuccucucgucucugcuucagccccguggcgguucccaggaacacggguugugcgcccaccuguggggacucuguucacuggcagccgacggcaucuggaaccaaaagauccuuuuugaggagagugaucugcggaaucauggcuugcagaaggcugacguaagcgcguuccuccgaaugaaccuguuucagaaagaaguggauugcgagaaguucuauuccuuuauucacaugaccuuccaggaauuuuucgcagccauguacuauuuacuggaggaagagaaagaggggagaacgaaugucccgggaucuaggcuaaagcucccuagccgcgacgugacuguucugcuugaaaacuacgguaaauuugagaagggcuacuugaucuucgugguccgguuccuguuugggcucgugaaucaagaaagaacaucauaucuggagaagaaauuaaguuguaagauuucccagcagauaaggcuggaacuuuugaaauggaucgagguaaaggcuaaagccaagaaacuccagauucaacccagccagcuggagcuauucuacugccuguaugaaaugcaggaggaagauuuuguucagcgcgcaauggacuacuucccaaagaucgagaucaaccucucuacccgaauggaucauauggugucaaguuuuuguauugaaaauugccaccgggucgagagccugucccuuggauucuugcauaacaugccuaaggaggaagaggaagaggagaaagaaggccgucaccuggacauggugcaaugugucuuacccucuucgagccacgccgcuugcucccauggucucgugaacucacaccugacaaguucuuuuuguagagggcuuuucagcguucuguccacuucacagagcuugaccgagcucgaucugucugacaauucccuaggcgauccaggaaugagggugcugugcgaaacgcuccagcaucccggcuguaacauacgccggcuguggcuugggagaugcggauugagucacgagugcuguuuugacaucagccugguauuaucuuccaaucaaaagcucgucgaacuggaucuuucagacaacgcccugggugacuucggcauuaggcuacucugcguggggcugaaacacuugcuguguaauuuaaagaaacucuggcugguuaacaguggacuuaccagcgugugcuguucggcacuguccucugucuugagcacaaaucagaaccucacucaucuguaucuacgaggcaauacccugggugauaaggggaucaagcugcucugcgagggccuguugcacccugacuguaaacuucagguguuagagcucgauaacugcaaucugacaucacauuguugcugggaccuuaguacucuguugaccuccucucagagccuccgcaagcugucccuaggaaacaaugaucugggcgaccuugggguaaugauguuuugugaagugcucaaacaacagucaugccuguugcagaacuuaggacugagcgagauguacuucaauuaugaaacaaagagugcgcucgagacccugcaggaagagaaaccagagcuuacuguugucuuugaaccgucuugguga

SEQ ID NO: 59759 - RNA, 3087 nt, Artificial Sequence
  derived and/or modified sequence opt3 from NLRP4__Homo_sapiens__XP_006723105
augagcagagccaucaacggcauggacgaggaauuuggguuuauuuaccugcuguuccuugugaccgucucccugaggauaggaaucucugcucccgagaagauggcagccucauuuuucagugauuuugguuugaugugguauuuagaagaacugaaaaaggaagaguuccggaaauuuaaggagcaccuaaaacagaugacacuccaacuggaacuuaagcagauuccuuggacugagguuaagaaagcgagccgcgaggagcuggcuaauuugcucaucaagcauuacgaggaacagcaggccuggaacauuacgcugcgaaucuuccagaaaauggaccguaaggaucugugcaugaaagugaugagagagaggaccggcuauacaaagacuuaccaagcacacgccaagcagaaauuuucccggcucuggucuucgaagucaguaaccgaaauacauuuauauuucgaggaagaggugaaacaggaggaaugugaccaccuggaucgccuuuuugcuccaaaggaggcagggaaacaaccgagaacagucaucauucagggaccccagggcaucgguaagaccacuuugcugaugaaacuaaugauggccuggagcgacaauaagauuuucagggaucgguuucucuacacauucuauuucugcugucgcgaacugcgagagcuuccuccaaccagucuggcugacuugaucuccagagaauggcccgauccugccgcgccaauaacggagauugugucucagcccgagaggcuccuguuuguuaucgacagcuucgaagaguuacaagggggacugaacgaaccugauuccgaccucugcggcgaucuuauggagaagcggccagugcagguccuguugucaagucuacugcguaaaaagaugcucccggaagcaagccugcuuauugccaucaaacccguguguccuaaggagcugcgcgaccagguaacuaucucugagauuuaccaaccaagaggcuuuaaugaauccgacagguugguuuacuucugcuguuucuucaaagaucccaagcgggcuauggaggccuuuaaccucgugcgagaaucagagcagcuguucagcauaugccagaucccuuuacuguguuggauucuaugcaccagucucaagcaggagaugcaaaaagggaaggaccuggcacuuacaugucagucuacuaccuccgucuauagcucguuuguguucaauuuguuuacaccagaaggagcugagggucccaccccgcagacgcagcaucaacugaaagcccucugcucucuggcggccgaaggcauguggacugauacauucgaguuuugcgaagacgaucuucgcagaaacgggguggucgacgcagauaucccugcucuguugggaaccaagauacuccugaaauacggcgagagggaguccucauauguuuucuuacacguguguauucaggaguucugcgccgcucuguuuuaccuacucaagagucaccuggaccauccccacccagccguacggugugugcaggaacuuuuggucgcaaauuucgaaaaggcccgcagagcucauuggaucuuucuggguugcuuccucacugggcuguuaaacaaaaaggagcaggaaaaacuggaugcguuuuucggauuucaacuuagccaggagaucaagcagcagauucaccaauguuugaaaucccucggcgagaggggcaauccucagggacagguggacucucuggcaaucuucuauugccuauuugaaaugcaagaucccgccuucguuaagcaggcugugaaccugcuccaggaggccaauuuucacauuauagacaacgucgaccuggugguaagcgcauacugucuuaaguauugcucaaguuugcguaaacuguguuucuccguucagaauguguuuaagaaagaagaugagcauagcucuacaucagacuacaguuuaaucugcuggcaccauauuuguagcguccucaccacguccgggcaucugcgggaacuucaagugcaggauucuacccugucggagagcacauucgucacuuggugcaaccaguugcgacacccauccugcagacuccagaagcuggguaucaacaaugugucauucaguggccaaucuguucuacuguuugagguacucuucuaccagcccgaccugaaauaucuuagcuuuaccuugacaaagcuguccagggaugacauccgcucauuaugugaugcccucaacuacccugcugggaaugugaaagaacuggcccuugucaacugccaccugagcccaauugacugugaggugcuagcaggacuccugacuaauaacaagaaguugaccuaucugaauguuucuugcaaccaguuagauacaggcgugccgcuccugugugaagcgcuuugcucccccgacaccguccugguguacuugaugcucgcuuucugucaccugagugagcagugcugugaguauauaagcgaaaugcuacugcggaauaaaucuguaagauaccuugaucucuccgccaacgugcugaaggacgaggguuugaaaacucugugcgaagcauuaaagcauccugauuguugccucgacucacugugccuuguuaaauguuuuaucacggccgcugggugcgaggaccuggccagugcauugauuagcaaucaaaaccucaagauccugcagauuggcuguaaugaaaucggagaugucggcgugcagcuacugugcagggcucuuacacacaccgacugucgccucgagauacugggguuggaggaaugcggauuaacuucgaccuguugcaaggaucuggccuccgugcucacauguucuaaaacccugcaacagcuuaaccugacuuugaauacacuagaccauacgggugucguugugcugugcgaggcgcuccgacacccagaaugugcccuccaggugcuuggcuuacggaagaccgauuucgacgaggaaacucaggcucugcucacagcagaggaggaacguaaccccaacuugaccaucacagaugacugcgauacuauuaccagaguagagaucuga

SEQ ID NO: 59760 - RNA, 3603 nt, Artificial Sequence
  derived and/or modified sequence opt3 from NLRP5__Homo_sapiens__NP_703148
augaagguggccggcgggcuggagcucggagcugcagcccuucugagcgcgucccccagagcuuuggucaccuuaucuacagguccuacuugcucaauccugcccaaaaacccgcuauucccccagaaucucaguagccaaccuuguauuaagauggaaggcgacaaaucccugacguuuucuucguacgggcuucaguggugccuguaugaguuggauaaggaagaguuccagaccuuuaaagaacuccugaagaagaaaucaagcgagaguacaacuuguuccauaccacaguucgagaucgaaaacgccaauguugagugccuggcacucuuacugcacgaauacuauggagccucucuugcuugggcaaccagcauuuccaucuuugagaacaugaauuugaggacacugucagagaaggcccgggacgauaugaaacgccauagucccgaagacccugaggcuaccaugacugaucaaggcccaagcaaggaaaaagugcccgguauuucucaggccguacagcaggacuccgcgacagcagccgagaccaaggaacaagagaucucacaggcuauggagcaggaaggggccacggcagcugagacugaagaacaggaaauaagccaagccauggagcaggagggagcgaccgccgcagaaacagaggaacagggccacggcggggauacuugggacuacaagagucaugugaugaccaaauucgcugaggaagaggauguccgacguucuuuugagaacacagccgcugacuggccugaaaugcaaacccuagccggagcauucgauuccgacagaugggguuuuaggccacggacggugguucuccacggcaagagcgggaucggaaaaucggcccuggcucgcagaauugugcuuuguugggcgcagggcggucuguaucaggggauguucucuuacgucuuuuucuugccggugagggagaugcagcggaagaaagaauccucaguaacugaguuuaucagucgcgaguggcccgauagccaagcaccuguuacagaaauuaugucccgaccagagagacuccuguucaucauagacggauucgacgauuuaggcucugugcugaauaacgacaccaagcucugcaaagauugggccgaaaagcagcccccuuuuacucuuauuaggagccuguugcggaagguccuacugccagagucauuccucaucgugacagugcgugacgucggcaccgaaaaacugaagagugagguuguguccccacgcuaucuucugguaagagggauuagcggagagcagaggauccauuugcuccuggaacgggguaucggcgagcaccagaaaacgcaaggguuacgagcuauuaugaauaaccgcgaacugcuagaucagugucaggugccggccgucggaucucucauaugcguggcacugcagcuucaagacguugugggcgagucagucgccccuuuuaaucagaccuugacaggucugcacgcugccuucguguuucaucagcucacucccagagggguaguuaggcggugucugaaccuugaagaacgcgugguccugaagagauucugcaggauggcaguggagggcgucuggaaucguaaaaguguguuugauggagacgauuugaugguucagggccucggggaaagcgagcugcgggcguuauuccacaugaacauccugcuaccagacucccauugugaagaguacuacaccuuuuuccaccucucucugcaagauuuuugcgcugcccuuuauuacguguuggaaggacuggagauugagccugcacucugcccccuguauguagaaaagacaaagcgaucgauggaguuaaaacaggccgguuuccacauccauagccuguggaugaagagauuucuuuucggcuuggucuccgaagacgugaggcgcccacucgagguucugcuagggugucccgugccucugggagucaaacagaagcuccugcacugggugucacuuuugggccaacagccaaaugcuacuaccccgggugacacacuggaugccuuccauugcuuauuugagacccaggacaaagaguucguacggcucgcacugaacaguuuucaggagguguggcuucccauaaaccaaaaucuggauuugauugcuucuagcuucugucuccagcacugcccuuaccugagaaagaucaggguugacgucaaggggaucuuuccacgcgaugaauccgccgaggcgugucccguggugccucuauggaugcgagacaaaacucugauugaggagcagugggaggauuucugcucaaugcucggcacgcauccacaucugcggcagcuugacuugggaagcucuauccugacagaacgugccaugaagaccuuaugugcuaaacucagacaccccacuugcaagauucaaacccugauguuuaggaacgcacagauaacaccgggcguccagcaccuuuggcgcaucguuauggccaaucggaaccugagaucccuaaaucucgggggaacccaccugaaagaggaagaugugaggauggcuugugaggccuugaagcauccuaagugccuguuagaaagucuccgacuggacuguugcggucuuacucacgcaugcuaucugaaaauuagccagaucuugacaacgucuccaucccucaagucacugagucuagcgggcaacaaagugaccgaucaagggguaaugccccugagcgacgcccuucgcgucucgcagugugcucuccagaagcugaucuuggaggauugcggaauuacugccacaggcugucaaucccuggcaucugcuuuagugagcaaucggucacucacccaccugugccuuaguaacaauucccuggguaacgaggggguuaauuugcucuguagaucuaugaggcugccucauugcagccuacagcgucugaugcuuaaccagugucaccucgacacagccggcugcggauuccuggcauuggccuuaaugggcaauuccuggcugacucaucucucacugagcaugaaccccguggaagacaauggggucaaacuucugugugaggugaugcgcgaaccaaguugccacuugcaggaucuagagcugguuaagugucaucucaccgcugcgugcugcgaaucucuguccugugugauaagccggucgagacaccuuaaaucauuagaccugacggauaacgcccucggagacggcgguguagcagcuuugugcgaggggcugaagcaaaagaacucuguccucgccaggcugggacuuaaagccuguggccugaccagugauugcugugaggcuuugucccuagcacugagcugcaaucgacaccucacaucuuuaaaccuggugcagaauaacuuuagcccuaaggguaugaugaaacuuuguuccgccuucgcgugccccacuucaaaucugcagaucauuggccucuggaaguggcaguacccagugcaaauccggaaauugcuggaagagguccagcuccugaagccgcgcguugugauugacgggaguuggcauagcuuugaugaagacgauagauauugguggaagaacuga

SEQ ID NO: 59761 - RNA, 2676 nt, Artificial Sequence
  derived and/or modified sequence opt3 from NLRP6__Homo_sapiens__NP_001263629
auggaccagcccgaggccccuugcagcuccaccggcccaagacuggcuguggcaagggaacuccuucuggccgcguuggaggaauuaucucaagagcagcugaagcgguuccgccacaaacuacgagaugucgggccggacggacguucaauccccugggguagacucgaaagggcugaugccguugaccuggcagagcagcuugcccaguuuuacggcccugagccagcucuggaaguggcacggaagacauugaaacgcgccgaugcuagagacguagccgcgcaacuccaggagaggcggcugcagcgccuggggcucggaaguggcacuuuacugagcguguccgaauauaagaaaaaguaccgagagcauguccuucaguugcacgcaagagugaaggagaggaacgcccggucuguuaaaauuacgaagcguuucaccaaacugcuaauagcucccgaaucggccgcaccugaggaagcuauggguccagccgaggaacccgagccugggcgcgcgagaaggucagauacacauacuuuuaaucgguuguuccgacgcgacgaggaaggaagaaggccacugaccgugguccuucaaggcccggccggcaucgggaagacaauggcagcuaaaaagauucuguaugauugggccgcuggaaaguuguaccagggucagguggacuuugccuucuuuaugcccuguggcgagcuccuggaacggccugggacccgcagcuuagcagaucugauccucgaccagugcccagauagaggagcccccguaccucaaaugcuugcucagccacagaggcuguuguucauucuagacggcgcggacgagcugcccgcacucggugggccggaagccgcuccuuguacugaucccuuugaggccgcaaguggagcccguguucugggcggccuucuguccaaagcucuccucccaacagcccuguuacuggugaccacgcgggcagcggcuccugggcgacuacaaggaagacucugcucuccccagugugccgaggucagggguuucagcgacaaggauaaaaagaaauauuuuuacaaguauuuccgcgacgaacggagagcagagagggccuaccgcuuugugaaagaaaacgagacucuguucgcucuuugcuucgugccauuugucuguuggaucguuugcaccguguugcgacagcagcuggaacucggccgggaucugucccguacaucaaagacuaccacaaguguauaccuucuguucauaaccagcguguugucuuccgcccccgucgcagacgggccuagacuccaaggagaucugaggaauuuaugucgccuggcucgggagggcgugcuagguagaagggcccaguuugcggagaaggaacucgagcagcuggaacuucgagggucaaaaguucagacguuguuccugagcaagaaagagcucccaggcgugcuggagacugaagucacauaucaauuuaucgaccagaguuuccaggaguuuuuagccgcucugucuuaccuuuuggaagauggaggcgugccgcgcaccgcagccgggggaguagguacucuccugcggggcgacgcucagccccacucccaucuaguucugacaaccagauuccucuuugggcugcuuagcgccgagaggaugcgugauauugaacgccacuucggaugcauggugucggagcgggucaagcaagaggcauugagaugggugcagggccagggucagggguguccuggcgucgcgccagaagugacggagggagccaaaggccuggaagacaccgaggaacccgaggaggaagaggaaggggaggaaccuaacuauccauuagagcuccuguacugccuuuaugagacacaagaagacgcuuuuguuaggcaggcccugugccgauuccccgaguuggcacuccagcgggugcgcuuuuguagaauggauguagcuguccugucuuacugcgugagguguugcccggccggacaagcacuacggcugaucuccugucgacucguugccgcucaggaaaagaagaaaaagucacuggguaaaagacuucaggcgaguuugggcgggggaagcucccagggcacuaccaagcaacugccugccucuuuacuccacccacuguuccaggcaaugacagacccccuuugccaucugagcucacuaacucucagucacuguaaacugccugaugcugugugccgcgacuuguccgaggcccugagggccgcucccgcauuaaccgagcucggucugcuucauaaucgucugagcgaagccggguugcggaugcucucugagggccuggcguggccacaguguagaguccagacagugaggguacaacuaccugauccccagcgcggacugcaguaucuugugggcaugcuccgacagucaccagcucugaccacuuuggaccugagugggugccaauuaccggccccuaugguuacguaccucugugcaguccugcagcaccagggaugcggccuucaaacacugagcuuggccuccguggaacucucugagcagucgcugcaggaacuacaggcugugaagagagcaaagcccgaucuggucauuacccacccagcccuugacggucauccccaaccuccaaaagagcucaucagcacuuucuga

SEQ ID NO: 59762 - RNA, 3030 nt, Artificial Sequence
  derived and/or modified sequence opt3 from NLRP7__Homo_sapiens__NP_631915
augaccagcccccagcuggaguggacacuccaaacucuucuggaacaguugaacgaggacgaauuaaaguccuucaaaucucugcuaugggccuuuccucucgaggaugugcugcagaagacgccauggucagaagucgaggaggcugacggcaaaaagcuggcagaaauccuuguuaauaccaguagcgagaacuggauuagaaaugccacagugaacauauuggaagagaugaaucucacugagcugugcaaaauggcgaaggcugaaaugauggaggaugggcagguacaagaaaucgacaacccggagcugggagaugccgaagaggacuccgagcucgcaaagcccggugaaaaagagggcuggcguaauucuauggaaaagcagucguuaguguggaaaaacaccuucuggcagggggauauugacaauuuucacgaugacgucacacugcggaaccagcgcuucaucccuuuucuuaauccacgaacccccaggaaguugacuccuuacacagugguucugcauggaccagccggcguggguaaaaccacgcuagcuaagaaguguaugcucgauuggacugacugcaaccugucacccacccuuagauaugcauucuaccugagcuguaaagaguugaguaggauggggccuugcuccuuugccgaacucauuucuaaggauuggccagagcugcaagacgacaucccgagcauauuagcucaggcccagcggauccuguucgucguggauggacucgacgagcuuaaaguacccccuggcgcgcugauucaggauaucuguggcgacugggaaaagaaaaagccaguucccguguugcuagggucccugcucaaacgcaagaugcugccuagagcagcccuucuggucacaacuaggccacgggcuuugcgcgaucuccaacuguuagcccagcagcccauuuaugugcgaguggagggauuucuggaagaggacagaagggcauacuuccuacggcacuuuggugaugaagaccaagcuaugcgugccuucgagcucaugcgcucaaaugcggcccuguuucagcuuggcagugcaccggcugucugcuggaucguuuguaccacauugaagcugcagauggagaaaggggaagauccugugccaaccugccucacgagaacuggacuguuccuuagguuccuguguagccgguuuccccagggcgcccaauugcgaggugcucuccgcacacugucuuuacuggccgcacaggggcuaugggcccagauguccguauuccauagagaggaccucgaaaggcugggagugcaggagucagaucuucgguuguuucuggacggcgacauacuccgccaagauagagucagcaagggcugcuauaguuucauucaccugucuuuucagcaguucuuaaccgcucuguuuuacgcgcuugagaaagaagagggggaagacagggauggacaugcaugggacaucggugaugugcagaaguugcucuccggcgaggaacgucugaaaaacccugaccuaauucaaguugggcacuuccuguuuggacucgccaaugagaagcgggcuaaggagcuggaagccacuuucggcugucgaaugagccccgauaucaaacaggagcuuuugcagugcaaggcacaucugcacgccaacaaaccauuaucggugacagaccucaaggaaguccuggguugccuuuaugagucucaggaagaggagcuggcuaaagugguaguugcccccuuuaaggaaaucuccauucacuugaccaacacgucagaggugaugcauuguaguuucagccucaagcacugccaagaucugcagaaacuaucccugcaggucgcaaaggggguguuucucgaaaauuacauggacuucgagcuggauauagaauuugagucuagcaacucaaaucuuaaauuuuuggaggucaagcaaaguuuccuguccgacagcucugugagaaucuuaugugaucacguuaccaggucaacaugccaucuccagaaaguggaaauuaagaacguaacuccugacaccgcguaccgcgacuuuugucuggcuuucaucggcaagaaaacacuuacucaccugacccuagccggacauauagagugggaacggacaaugaugcucaugcugugcgauuugcugagaaaucacaaguguaacuuacaguaucucaggcugggcgggcauugcgcaaccccagagcagugggccgaguuuuucuacguccuuaaagcuaaucaaagucugaagcacuugcgccucagcgccaacgugcugcuagacgaaggagcaaugcugcuuuauaaaacuaugacgcgaccgaagcacuuucuccagaugcuguccuuggagaauugucggcugacagaggcuucuugcaaagauuuagccgcgguucucguggucucgaagaagcugacccaucuuugucuggccaaaaaccccauuggugacacuggcgugaaguucuugugcgaagggcucagcuacccugauugcaaacugcagacccuaguacugcagcaauguuccaucacaaaacuuggaugccguuaucucucagaagcucugcaggaggcauguaguuugaccaauuuagaccugucuaucaaccagauugccagaggccucuggauccugugccaggcucuugagaauccaaacuguaaucugaagcacuugaggcuauggagcugcucccugaugcccuuuuacugucaacaucucgguucagcccugcuuagcaaccagaaguuagaaacucuggaucucgggcagaaccacuuguggaagucuggcauuauaaaacuguucggagugcuccgccaacggacaggcucccugaagauccuuagacugaaaacguaugagaccaauuuggaaauuaagaaacuacuggaggaaguuaaggagaagaacccuaaacucacuaucgacugcaaugcaaguggggcgacagccccacccuguugcgauuucuucuguuga

SEQ ID NO: 59763 - RNA, 3147 nt, Artificial Sequence
  derived and/or modified sequence opt3 from NLRP8__Homo_sapiens__NP_789781
augagcgacgugaaucccccuuccgauaccccaaucccguucucuucaaguagcacacacuccucucauauucccccuuggacuuuuucgugcuacccaggcucacccugugagaacggggucaugcuguauaugagaaacguuagccacgaggaacuccagagguucaagcaacuucuguugacggaauuaaguaccggaacaaugccuauaacuugggaccagguggagaccgccuccugggcugaaguagugcaucugcuaaucgagcgguuuccaggucgccgagcaugggaugucacaucuaauauuuucgccaucaugaacugcgacaaaaugugugugguugugcguagagagauuaaugcgauccuccccacccuggaaccugaggaucuuaacgucggcgaaacucaggugaaucuggaggagggggaaagcggaaagauaaggcgguacaaauccaacguaauggagaaguuuuucccaaucugggacauuacaaccuggccgggcaaucagcgcgacuuuuucuaucaagguguucacagacaugaagaguacuugcccugccuccugcugccuaaaaggccacaggggcggcagcccaagacgguggcuauccagggagccccuggcauuggcaagacuauccucgcaaagaaggucauguuugaaugggcccgcaacaaauucuaugcucacaagcgauggugugcauuuuacuuccacugccaagaggugaaucagaccacagaucagucauuuagugaguuaauagaacagaaauggccagggagccaagaucuggugucuaagauuauguccaagcccgaccagcuuuugcugcuacucgauggauucgaggaacugacuucaacccuuaucgacagacuggaggauuugagcgaagacuggaggcagaaacucccggguaguguccuguuaucuucccugcucagcaagacaaugcuuccugaggccacccuguugauuaugauccgguucacgucguggcaaacuuguaaaccccuacugaagugcccaucucucguuacacugccuggcuuuaacaccauggagaaaaucaaguauuuccagauguacuuugggcauacugaagagggagaccaggugcuuuccuucgcuauggaaaauacaauucuguuuucaaugugucguguacccguggucugcuggaugguguguaguggcuugaaacagcaaauggagcgcgguaacaaucucacccagagcugcccaaacgccacguccguuuucgugagauacauaucuagccuguuucccaccagggcggaaaacuucucacggaagauccaccaggcacaguuagaggggcugugccaucuagccgcugauaguauguggcaccgaaaguggguccucggaaaagaggaccuggaagaggccaaacuugaucaaacaggcgugacugcauuuuugggcauguccauucugcgcagaaucgcuggggaagaggaccacuauguauucacccucguuacauuucaggaguucuuugccgcgcuguucuacgugcuuuguuucccucagaggcugaaaaauuuucaugucuugagccacgugaacauacagcggcucauugccucuccacgcggaucaaagaguuaucugagccauauggguuuauuccuguuuggcuuccuaaaugaagcaugcgcuuccgccgucgagcaaucuuuucaguguaaagugucguucgggaacaagagaaagcuccugaaaguuaucccgcuuuugcacaagugcgaucccccuagcccaggauccggcgugccccagcuguuuuacugucuccaugaaaucagggaggaggcuuucguaucacaggcccugaaugacuaucacaaagucguguuacguauugguaacaauaaggaaguucaagugagugcauuuugccugaaacggugucaguaccuucacgaggucgaauugacugugacccucaacuucaugaauguauggaagcugucuagcuccucacauccugggagcgaggccccagaaucuaacggccuacaccgaugguggcaggaucugugcuccguguuugcuacaaaugacaagcucgagguucugaccaugacuaacaguguccuuggacccccguucuugaaagcgcuggcagccgcuuuaagacauccucaauguaagcuccagaaacugcuucugaggcgcgugaauagcacgauguugaaccaggaucucaucggcgugcugacagggaaucagcaccuacgguaucuggaaauucaacacgucgagguugagucuaaggccgugaaacuccugugcagagugcuuagguccccacgcugucgauugcagugccugcgguuagaagacugccucgcaacuccccguauauggaccgaucugggaaacaaccuucaggguaauggccaucugaagacccuaauccucagaaagaacucacuggagaauuguggggccuacuacuugaguguagcucagcuggaaagguuaagcauugagaacugcaaucucacacaacugaccugugaaucgcuugccuccugccugcgccagucuaaaauguugacucaccucagccuggcagagaacgcgcuaaaggacgagggagcuaaacauaucuggaaugcccugccucaccuucgguguccccuccagagacuggucuugaggaagugcgaccugacauuuaacuguugccaggauaugaucucagcauuauguaaaaauaagacgcucaaaagucuggaccuuuccuucaacucucugaaggaugacggcgugauuuugcucugcgaagcccugaagaauccagauuguacccuacaaauacuggagcuugaaaacugccucuucacuagcaucugcugucaggcuauggccuccaugcugcgcaaaaaucagcauuugcgacacuuagaccugucaaagaacgcaauugguguuuaugggauccucacacugugcgaggcuuuuagcagucagaaaaagcgggaggaagugauuuucuguaucccugccuggaccagaauaacaucuuuuucccccacuccacacccgccugauuucaccggcaaaagcgacugccuuucgcaaaucaaucccuga

SEQ ID NO: 59764 - RNA, 2976 nt, Artificial Sequence
  derived and/or modified sequence opt3 from NLRP9__Homo_sapiens__XP_011525195
auggccgagagcuucuuuuccgacuucggccugcucugguaccuuaaggaacugagaaaagaggaauuuuggaaguucaaagaguuguuaaagcagccccuggaaaaauuugagcuaaagccuaucccaugggcugagcucaagaaagcaucuaaggaagauguggccaaacugcuugacaagcacuauccggggaaacaagcgugggaggucacccugaacuuguuccuccagauuaauaggaaggaucuguggacaaaggcucaggaagagaugcggaacaaacugaaucccuaccgcaagcauaugaaagagacuuuucagcucauaugggaaaaggagacgugcuuacacguuccugaacauuucuauaaagagaccaugaagaacgaauacaaagagcugaaugacgccuauacagcagccgcucgacgucacacugugguacuugagggaccagaugguaucggcaagaccacauugcugagaaaggugaugcuagacugggcagaagggaaccucuggaaagauagguuuaccuucgucuuuuuccugaaugugugugagaugaacggaauugccgaaacuucacuucuggaguugcucagucgggacuggcccgaaagcuccgagaagaucgaggauauuuuuagccaaccugaacgcauccuguucauaauggacggcuucgagcaguuaaaauuuaaucugcagcucaaggcugaucuuucggacgauuggagacagaggcaaccaaugcccaucauucugucaucuuugcuacagaaaaagaugcugccugaaaguucccuccugaucgcccuugguaagcuggcgaugcagaaacauuacuucauguugcggcacccaaagcucauuaaacuguuaggguuuucugagagcgaaaagaaauccuauuucucauacuuuuucggagagaagaguaaggcacugaaaguuuuuaacuucgugcgcgacaauggcccgcuauuuauccucugccacaaccccuucacauguuggcuggucugcaccugugugaagcagcgacuugagagaggcgaagacuuggagauaaauagccaaaacacgacuuaccuguaugccucuuuucucaccacaguauucaaagcugggucccagucauuuccuccaaagguuaauagggcccggcugaaaagccuuugcgcacuggcugccgaaggaauuuggacuuacaccuucguguucagucauggugauuugcgucgcaacggccucucugaguccgagggggucaugugggugggaaugagacuguuacagaggcggggcgacuguuuugcguucaugcaccugugcauccaagaauuuugugccgcaauguucuaucuacucaagcgacccaaggaugacccuaacccagcuauugguagcaucacacagcuggugcgcgccucggucguucagccccagacccuuuugacgcaaguggggaucuuuauguucggaauuucuacugaggaaauaguauccaugcuggagacaucauuuggcuucccgcucaguaaagaucugaagcaggaaaucacccagugcuuagagagccugucccagugugaggcugacagagaagccauugcauuucaagagcuuuucaucggcuuguuugaaacucaggagaaagaauuugugacaaaggucaugaauuucuucgaggagguguucauauacauugggaacaucgaacaucucguuaucgccucuuuuugccugaaacacugccagcaccuaaccacgcugaggauguguguggagaauauuuucccugaugacagcggaugcaucucagauuauaacgaaaagcucgucuacuggcgggagcuguguaguauguuuauuaccaauaaaaacuuccagauacuugacauggaaaauacauccuuggaugaccccagccuggcuaucuuaugcaaggcgcucgcacaaccaguguguaagcugcgcaaacuuauuuuuacuucuguauauuucggucaugacucagagcuguuuaaggccguuuugcacaacccucaucucaaacugcuaagucuguacggcaccagccucucccagucugauaucagacaccugugcgagacacuuaagcaucccauguguaaaaucgaagaguugauucuggggaagugcgacauaucgagcgaagugugugaggauaucgcuuccgucuuagccugcaauucaaagcucaaacaccugagucuuguggagaacccacugagggacgaaggaaugacucuacucugugaggcacugaagcacucucauugcgccuuggaacgucugauguuaauguacugcugucucaccagcgucuccugcgauucaauuagcgaggugcugcuuuguucuaaaucccugaguuugcucgaccugggcagcaaugcucuagaagauaacgguguugccucucugugcgcagcgcuuaagcaccccggguguuccauccgggagcucuggcugaugggcugcuucuugacaucagacaguuguaaagauauugcugccgugcugaucugcaauggaaaguuaaagacccucaaacugggccauaacgagauaggggacacuggaguacgacagcuuugugcagcccugcagcacccucacugcaaguuggaaugucucggucugcaaacgugcccaaucacaagagcuugcugugaugacauugccgcagcucuaaucgccugcaaaacccugaggagccuuaaucucgauuggauugcgcuggacgccgacgcugucgugguuuugugugaggcauuaucgcauccggauugcgcccugcagaugcucggccugcacaaguccggguuugacgaagagacucagaaaauccuuaugucuguggaagagaagauaccccaucugaccauuagccacggaccuuggaucgaugaggaauauaagauucgcggcgucuugcuauga

SEQ ID NO: 59765 - RNA, 366 nt, Artificial Sequence
  derived and/or modified sequence opt3 from NMB__Homo_sapiens__NP_066563
auggccagaagggcuggcggggcacggauguucggaagccugcuccuuuuugcccuguuggcggcugguguggcccccuuauccugggaccugccugagccacgcucucgagcaucaaagauccguguccacaguagaggcaaccuaugggccaccgggcauuucaugggcaaaaagagccucgaaccguccucucccucgccucugggaacagcuccacacacuucacuuagggaucagcggcugcaauugagccaugaccuccuggguauucugcuccugaaaaaggcauuagggguuagucuuucccgccccgccccucagauacaguacagaagguugcuggugcagauccuacaaaaauga

SEQ ID NO: 59766 - RNA, 1173 nt, Artificial Sequence
  derived and/or modified sequence opt3 from NMBR__Homo_sapiens__NP_002502
augcccagcaagucccugucuaaccucucagugaccacaggcgccaaugagagugggagcgucccugaaggaugggagagagacuuccuuccagcuuccgaugguacuacgaccgaacugguuaucaggugcgugauuccgucuuuguacuuacugauaaucacaguaggccuacucgggaacauuaugcuggugaaaaucuuuauuacuaauucggcaaugcggucaguccccaacaucuucauaagcaaucuugccgcgggagaccuguugcuccugcugaccugugugccuguugaugcuagucgcuacuuuuucgacgaguggauguuuggcaagguggguugcaaacucaucccagucauucaguuaacauccguggggguaucuguuuucacccugacugcccuuagcgcagaucgauaucgugccaucgugaaccccauggacaugcaaacauccggagcuuugcugagaaccugugucaaggcaaugggcauuuggguggugucaguccuacucgccguuccugaagcuguguuuagugagguagccaggaucagcucucuggauaauuccucauucacggcgugcauaccauauccccagacugacgagcuucacccuaaaauucauagcgugcugaucuuuuuggucuacuuccucauuccacuggcaaucaucaguauuuauuacuaucacauagccaagaccuuaaucaagucugcucauaaccugccgggcgaauacaaugagcacacuaaaaagcagauggaaacacggaaacgccucgccaagauugugcuuguuuuugugggguguuucaucuuuugcugguuccccaaccauauacuguacauguauagauccuucaauuacaacgagauugauccuagcuugggacacaugaucgucacccuaguggcaaggguacugucguuugguaauucuuguguuaacccauucgcucucuaucugcuuuccgagucauuucggcgccacuucaauagucagcugugcuguggccgaaaaagcuaccaagaaagagggacauccuauuugcucucuagcucagccgugaggaugaccagucugaaguccaacgcgaagaacauggucacgaauagcguguuacugaacggacauucuaugaaacaggagauggcccuauga

SEQ ID NO: 59767 - RNA, 459 nt, Artificial Sequence
  derived and/or modified sequence opt3 from NME1__Homo_sapiens__NP_000260
auggccaacugcgagagaaccuucaucgcuauuaagcccgacggcgugcagagggggcuggucggagaaauaaucaaacgguuugagcaaaaggguuuccgccucguuggccuuaaauuuaugcaggcaagcgaagaucuguugaaggagcacuacguggacuuaaaagaucgaccuuucuuugccgggcugguaaaguauaugcauuccggaccaguggucgcgauggugugggaaggccuaaauguugugaagacaggucgugucaugcucggggagacuaacccggcugacucuaaacccggaacgauuagaggcgauuucuguauccaggugggcaggaauauuauccacgggucagacaguguagagagcgccgaaaaggagauaggacugugguuucauccugaggaacuuguugauuacaccuccugcgcacagaacuggaucuaugaguga

SEQ ID NO: 59768 - RNA, 804 nt, Artificial Sequence
  derived and/or modified sequence opt3 from NME1-NME2__Homo_sapiens__NP_001018146
auggccaacugcgagagaaccuucaucgcuauuaagcccgacggcgugcagagggggcuggucggagaaauaaucaaacgguuugagcaaaaggguuuccgccucguuggccuuaaauuuaugcaggcaagcgaagaucuguugaaggagcacuacguggacuuaaaagaucgaccuuucuuugccgggcugguaaaguauaugcauuccggaccaguggucgcgauggugugggaaggccuaaauguugugaagacaggucgugucaugcucggggagacuaacccggcugacucuaaacccggaacgauuagaggcgauuucuguauccaggugggcaggaccauggccaaucuggagcggacauuuauugcaaucaagccugacgggguacagcgcggacuuguuggugaaauaaucaaaagauucgagcaaaagggcuuuaggcugguggccaugaaauucuugcgggcuucagaggaacaccucaagcagcauuacauugaucugaaggaccgcccauuuuuccccgggcuggucaaauauaugaacaguggaccugugguggcaauggucugggagggccucaauguugugaagacuggucgaguaauguuaggggaaaccaacccagccgauagcaaacccggaacaaucagaggcgacuuuugcauucaggugggcaggaauaucauacacggguccgauucugucaagucggcugagaaagaaauuucacugugguucaagccugaggaacuuguggacuacaaaagcugugcccaugauuggguuuaugaguga

SEQ ID NO: 59769 - RNA, 459 nt, Artificial Sequence
  derived and/or modified sequence opt3 from NME2__Homo_sapiens__NP_001018148
auggccaaccuggagagaaccuucaucgcuauuaagcccgacggcgugcagagggggcucgucggagaaauaaucaaacgguuugagcaaaaggguuuccgccuuguugcaaugaaauuucugcgagccagcgaggaacacuugaagcagcauuacauugauuuaaaagaccguccuuucuuuccaggccuggugaaguauaugaauagcgggccgguaguggcgauggucugggaaggacuaaacgugguuaagacaggcagagugaugcucggugagacuaaucccgcugauucuaaaccugggacgaucaggggagacuucugcauucaggucggccggaacaucauacacggcucagauagugugaaguccgccgagaaagaaaucucccugugguuuaagccagaggaacuuguagacuacaaaucuugugcacaugauuggguuuaugaguga

SEQ ID NO: 59770 - RNA, 510 nt, Artificial Sequence
  derived and/or modified sequence opt3 from NME3__Homo_sapiens__NP_002504
augaucugccuggugcucaccauuuucgccaaccuuuuucccgcugcauguacaggcgcccacgagagaacuuuccuggcggucaagccugacgggguucagaggcgguuggugggagaaauaguacgccgauuugagcguaaagguuucaaguuaguggcucugaagcuaguccaagccagcgaggaacuccugagagaacauuacgcagagcuuagggagcggccauuuuauggccgccuggugaaauacauggccuccgggccgguuguggcuauggucuggcagggauuggaugugguaagaacgucuagggcacucaucggcgccaccaaucccgcugacgccccuccagguacaauucggggagauuucugcaucgaaguugggaaaaaccugauucacggcucagacaguguggagagcgcgcgccgagaaaucgcacugugguuuagagccgaugagcucuuauguugggaggacuccgcuggccauuggcuguaugaauga

SEQ ID NO: 59771 - RNA, 522 nt, Artificial Sequence
  derived and/or modified sequence opt3 from NME4__Homo_sapiens__NP_001273364
augggcgggcuguucuggagaagcgcccucaggggacuucggugcgguccccgcgcuccuggcccaucccuguuggugcgacacgggucuggaggcccgucauggacccgugagagaacauuagucgcaguuaagcccgacggugugcagaggcggcugguaggggaugugauccaacgcuuugaaagaaggggauucacucuagucggcaugaaaaugcuccaggccccugagagugugcuggcggaacauuaccaggaccuucggcgcaagccauuuuaucccgcucugauucgauacaugagcuccggcccuguuguggccauggucugggagggguauaacgugguaagagcaucuagggccaugauaggacacacggauucggcugaagcagccccagguaccauccggggcgacuucucaguucauauuagcagucaccguuuggcuccccucgaucgcgggcagagagagcaacagauggugccuggaaucccacagggcgcccaugaggcguga

SEQ ID NO: 59772 - RNA, 639 nt, Artificial Sequence
  derived and/or modified sequence opt3 from NME5__Homo_sapiens__NP_003542
auggagaucagcaugcccccuccacagauuuacguggaaaagacccuggccauaaucaaaccggacauugucgauaaggaggaagagauccaagacauuauccucagauccggcuucacaauaguucagaggcggaaacuucgccugucucccgaacagugcucaaacuuuuauguggagaaguacgggaaaauguucuuuccuaauuugacugcuuauaugaguagcggaccauuaguagcaaugauccuggcccgacacaaggcgauuuccuacuggcuagagcuccugggucccaacaauucucuuguggcuaaggaaacgcauccugauucgcugcgugccaucuauggcaccgacgauuugagaaacgcacuccacgggucaaaugacuucgccgcugcagagagggaaauucgguuuauguucccagaggucaucguggagcccauaccuauuggacaggccgcuaaagauuaccugaaccugcauaucaugccaacacucuuagaaggccugacugagcuuuguaagcaaaaaccggccgaccccuugauuuggcuggcggauuggcuacucaagaauaacccuaauaaaccaaagcugugccaccaucccaucguugaggaaccuuauuga

SEQ ID NO: 59773 - RNA, 585 nt, Artificial Sequence
  derived and/or modified sequence opt3 from NME6__Homo_sapiens__NP_005784
augacccagaaccugggcagcgagauggccuccauccucagaucuccccaagcacuucagcugacauuggcuuuaauuaagccugacgccguggcgcacccacugauacuagaagcuguccaucagcagauccucucaaauaaauuccugauuguuaggaugcgggagcuucuguggcgcaaggaagauugccaacgauuuuaccgugagcacgaagggagauucuuuuaucagagguugguggaguucauggccaguggaccgauccgggcauacauucucgcccauaaagacgcuauccagcuguggcgcacucugaugggucccacgagaguauuuagggcacggcacguggccccugauagcauacgcggcuccuucgggcucaccgacacacgaaacacuacccauggaucugauucggucgugucagcuagcagagagaucgccgcguuuuucccagacuuuagugaacagaggugguaugaggaagaggagccccaauuacgguguggcccuguuugcuacuccccagaagguggggugcacuaugucgcaggaacaggcggccuggggcccgccuga

SEQ ID NO: 59774 - RNA, 1131 nt, Artificial Sequence
  derived and/or modified sequence opt3 from NME7__Homo_sapiens__NP_037462
augaaccacagcgagagauucguguuuaucgccgaaugguaugaccccaaugcuucccugcucaggcgguaugagcuucuguucuacccuggcgaugggucugucgaaaugcaugacguuaagaaccaccgcaccuuuuugaaacgaacaaaguaugauaauuuacaucuggaggaccuauucauuggaaacaaagugaauguauuuucacgucagcucgugcugauagauuacggugaccaauauacugcaagacagcuuggcaguaggaaggagaaaacgcuggccuugaucaagccagaugcgauuagcaaggcuggggaaaucauugagaucauaaacaaagccggauucaccaucacaaagcucaaaaugaugaugcugucccggaaggaagcacuggacuuucacgucgaucaucagucucgcccguucuuuaaugagcucauucaguucaucacuaccggccccauuaucgccauggaaauauuaagagacgaugcuauuugcgaguggaaaaggcugcuugguccugcaaacucggggguggcccggacagacgcuucagagagcauccgcgccuuguuuggaaccgauggcauucgaaaugcggcacacggcccagacaguuucgccuccgcugccagagaaauggagcuguuuuuccccucuagcgggggaugugguccugcaaacacugcuaaguucacaaauugcaccuguugcaucguuaagccacacgccguguccgaaggccuacucgggaaaauccugauggcgauuagggacgccggauuugagauaucagcaaugcaaauguucaacauggaucgggucaauguggaagaguuuuacgagguauauaagggcguugugacggaauaccaugacauggucacugagauguacaguggucccuguguggcuauggaaauccagcagaacaaugccaccaaaacauuccgugaguuuugcgggccugcugauccagaaauugcccgccaccuuagaccgggaacucugagggcaaucuucggcaagaccaaaauacagaacgccgugcauuguacagacuugcccgaggauggccuccuggagguccaauacuuuuucaagauuuuagacaacuga

SEQ ID NO: 59775 - RNA, 1767 nt, Artificial Sequence
  derived and/or modified sequence opt3 from NME8__Homo_sapiens__NP_057700
auggccagcaagaaaagagaggugcagcugcaaaccgucaucaacaaucagucccucugggacgaaaugcuucagaacaagggccugacaguuauugauguguaccaggcuuggugcgggcccuguagggcaaugcaaccuuuguuccggaaauuaaagaaugagcugaacgaagacgagauacuacacuuugccguagcggaagcugauaauaucgugacucuccagccauuccgcgacaaaugcgagccggucuuucuguucucugugaacggaaagauuaucgagaagauucagggugccaaugcaccccuuguuaacaaaaaggugaucaaucugauagaugaggagcgaaaaaucgccgcuggcgaaauggcacguccucaguauccagagauucccuuggucgacucagauagugaggugagcgaagaguccccuugugaaucuguacaagagcucuacucgaucgccauuaucaagccagacgcuguuauaagcaaaaaggugcuggaaauuaagagaaaaaucacgaaggccggguuuauuaucgaggcggagcauaaaaccguccugacagaagaacagguggugaacuucuauucaaggaucgcagaucagugcgacuuugaagaguucgucaguuuuaugacuuccggacucucuuacauuuuaguugugagccagggcuccaagcacaaucccccuucagaagagaccgagccacaaacagauaccgaaccgaacgagcggagugaagaccagcccgagguagaagcccaggugacuccugguaugaugaaaaauaagcaagauagccugcaggaguaucuugagcgccagcauuuggcucagcugugugacauagaagaggacgccgcaaacgucgcuaaauucauggaugccuuuuucccagacuuuaagaagaugaaaucuaugaagcuagagaaaacacucgcgcugcuuagacccaaucuguuccacgaaaggaaggaugacguguugcggaucauuaaagaugaggacuucaagauccucgaacaacgccagguugugcuguccgagaaggaagcccaggcauuaugcaaagaguacgaaaacgaggauuauuuuaacaagcugauagagaauaugaccucagggccuagccucgcucuuguccuguugcgagacaacggacuacaguacuggaaacaacugcucggcccaagaacgguggaagaggccauugaauacuuccccgagagucugugugcucaguuugccauggauucucuuccgguaaaucagcuguauggcuccgacagcuuggaaacugcagagagggagauccagcauuucuuuccucuccaaucgacccugggguuaaucaagccccacgccacaucugaacagcgggagcagauucugaaaaucguuaaggaagcuggauucgaucuaacucaggugaagaaaauguuucucaccccagagcaaauugaaaagauauacccuaaagucacagguaaggacuucuauaaagaccugcuugagauguuguccgugggccccucaauggucaugauccugaccaaguggaacgcgguggcagaguggcgucgccucauggggccaacggaucccgaagaggccaagcugcuuaguccugacagcauuagagcucaguuuggaaucuccaaacugaagaauaucguucacggcgccucuaacgcauacgaagccaaagaggugguaaauagguuguucgaggauccagaagagaacuga

SEQ ID NO: 59776 - RNA, 792 nt, Artificial Sequence
  derived and/or modified sequence opt3 from NME9__Homo_sapiens__NP_835231
augcugagcuccaagggccucaccguggucgacguuuaccagggguggugcggacccuguaaaccugugguaucucuuuuccaaaagaugagaaucgaggugggucuggauuuguuacacuuugcccuggcugaagcagacaggcuagauguccucgagaaauaucggggcaagugcgaaccaacauuccuguuuuacgccauuaaagacgaggcgcuuucagaugaagacgagugugugagucacgggaagaacaauggagaggaugaagacaugguuagcuccgagcgcacuugcacgcuggcuauaaucaagccggaugccguggcacacggcaaaaccgacgaaauuaucaugaagauucaggaggccgguuucgagaucuugacaaacgaggaacgaacuaugaccgaagcugagguccgucucuuuuaucagcauaaagcaggggaagaggccuucgagaagcuggugcaccauauguguucuggacccucgcaucugcucauauuaacaagaaccgaaggcuuugaggauguaguuacuacauggaggaccgugaugggcccucgggacccaaaugucgcucgcagagaacagcccgagucacugagggcccaauacgggacggaaaugccuuucaacgcggugcacggaagccgggaucgcgaggacgcagaccgagagcuugccuugcuguuuccaagucuaaaauucuccgauaaggacacugaagcuccccagggugagucuagcacccagccuagacucaagaucacagaucuggacuga

SEQ ID NO: 59777 - RNA, 924 nt, Artificial Sequence
  derived and/or modified sequence opt3 from NMI__Homo_sapiens__NP_004679
auggaggccgacaaggaugacacccagcaaauccugaaagaacacagccccgaugaguucauuaaggacgaacagaacaaaggccucauagaugagaucacaaagaaaaauauucagcuuaagaaggaaauccagaaacuggagacugaguugcaagaagcuacgaaggaguuucagauuaaagaagacaucccugagaccaagaugaaauucuuauccguggagacaccagaaaacgauucucagcugucaaauauaaguugcagcuuucaggucuccucuaagguuccguacgagauccaaaaggggcaggcacuaauuacuuucgaaaaagaggaaguggcccagaacguagugucgaugucaaagcaucacguccagaucaaagacgugaaucucgagguuaccgcgaagcccgugccucugaacagcggagucagauuucaaguguauguagagguuaguaaaaugaagauuaaugugacagaaaucccagauacccuuagggaggaccagaugcgggauaaacuggaauuguccuucucuaagagccgcaacgguggcggggaggucgaccgaguggauuacgaccgucaguccggaucagcugugauaacuuuugucgaaauuggcguugccgacaagauccucaaaaagaaagaguauccccuguacauuaaucaaacaugucauagagugaccguaaguccuuauacggagauccaccugaagaaauaccagaucuucagcgguacuucuaagaggaccgugcucuuaacagggauggaaggcauucagauggaugaggaaauagucgaggaccugaucaacauucauuuucagcgggcaaagaauggaggcggggaaguggauguugugaaaugcucccuuggacaaccacacaucgccuauuucgaggaguga

SEQ ID NO: 59778 - RNA, 840 nt, Artificial Sequence
  derived and/or modified sequence opt3 from NMNAT1__Homo_sapiens__NP_001284707
auggagaacagcgaaaagaccgaggugguccugcucgccugcggcuccuucaaucccaucacaaacaugcaccuuagacuguuugaauuggcuaaagacuacaugaaugggacuggaagguauacgguugugaaggguauuauaucuccuguaggcgaugcauacaaaaagaaaggguuaaucccagccuaucaucgggugauuauggcggagcuggcuaccaagaacucaaagugggucgaaguggacacaugggagagucuacagaaagaguggaaggaaacucucaaaguucugcgccaccaucaagagaaacuugaagccagcgauugugaccaccagcaaaauuccccgacccuggagcgacccggacguaagagaaaguggacagagacccaggauucuucgcagaagaaaucauuggaaccuaagacuaaagcagugccaaaggucaaacuccugugcggcgccgaccugcucgagagcuucgcugugcccaacuuauggaagagugaagauaucacacagauuguagcaaauuacggucugaucuguguuaccagggccgggaacgacgcucagaaauuuauauaugaguccgaugugcuuuggaagcaucggucuaauauccacgucgugaacgaauggauugccaaugacaucagcuccacgaagauucgcagagcguugaggcggggacagucaauccgcuaccuggugccugaucuaguccaagaguauauagagaaacacaaccucuacaguagcgaaucugaggaccgaaaugcaggcguuauucuggccccacuucagagaaacacugcugaagccaagaccuga

SEQ ID NO: 59779 - RNA, 924 nt, Artificial Sequence
  derived and/or modified sequence opt3 from NMNAT2__Homo_sapiens__NP_055854
augaccgagacaacuaagacgcacgugauccugcucgccugcggcagcuucaaccccauuaccaaagggcauauacagauguuugaaagagcuagggacuaccuucacaagacaggacgguucaucgucauugguggcaucguuuccccugugcaugauucuuaugggaaacaaggacugguaucaagucgccaccgauugauuaugugucaguuagcagugcagaauagcgacuggauccgugucgauccaugggagugcuaccaggacacuuggcaaaccacauguuccgugcuggaacaucacagagaucuaaugaagaggguuaccggcugcauacucucuaacgugaauacuccgucgaugacacccgucaucggucagccucagaacgagaccccacagcccauuuaucaaaauucaaacguggccacgaaaccuacugcggcuaagauccuggggaagguaggagaaagccuuagucggauuuguugcguucgcccacccguggagagauuuaccuucgucgacgagaaugccaaccugggcacagugaugagguacgaagagaucgaauugcggauacuccugcuguguggcuccgaucucuuagagucuuuuugcauuccugggcuguggaaugaggcagacauggaagugaucgucggagauuucgguauuguugugguaccacgcgacgccgcugauacugaccgaaucaugaaccacagcuccauccuuagaaaauauaagaauaacauuaugguggucaaagaugacauaaaucauccgaugucagugguuaguagcaccaagucuagguuggcacugcagcacggcgacgggcauguggucgauuaccuaucccagcccgugaucgacuauauucucaaaucacagcuguacaucaacgccagcggauga

SEQ ID NO: 59780 - RNA, 492 nt, Artificial Sequence
  derived and/or modified sequence opt3 from NMNAT3__Homo_sapiens__NP_001186976
augaaaagcagaauccccgugguccugcucgccugcggcuccuucaacccuauuaccaauaugcaccuuaggauguuugagguugcucgggaccaucugcaccagacagcagugccagaauugaaguuacuguguggggccgauguacuaaagacuuuccaaacgccgaaccucuggaaagacgcgcauauacaggagaucguggaaaaguuuggacuggucugcgugggucgcguuggccacgaucccaaaggguacauugcugagucuccuauccuucgaaugcaucagcacaauauucaccuggccaaggaaccagugcagaacgagaucucagcaaccuauauacguagagccuugggacaaggccagagugucaaguaccucauccccgacgcugugauuacauauaucaaagaucauggucuguacacuaaggggagcaccuggaaaggaaaguccacacagucuaccgagggcaaaacuucguga

SEQ ID NO: 59781 - RNA, 462 nt, Artificial Sequence
  derived and/or modified sequence opt3 from NMS__Homo_sapiens__NP_001011717
augaagcaccugagaccccaguucccucucauccuugccauuuacugcuuuuguaugcugcaaauaccaagcuccggcuucccgcagcccuuggcugacccuucugauggguuagacaucgugcagcuggagcagcuagcauauugccucucacaaugggccccacugaguaggcagcccaaagauaaccaggacauuuacaagcgguuucuuuuccauuauagccgcacccaggaagcgacacacccugucaaaacuggauuuccacccguucauccucugaugcacuuggcugccaagcucgcaaaucgacguaugaaaagaauccugcaaagggguuccggcacggccgcuguggauuucaccaagaaggaccauacagcaacuugggggcggccauuuuuccuguuucgcccgagaaacggaaggaauauugaggaugaagcccagauccagugguga

SEQ ID NO: 59782 - RNA, 1491 nt, Artificial Sequence
  derived and/or modified sequence opt3 from NMT1__Homo_sapiens__NP_066565
auggccgacgagagcgaaaccgcugugaagcccccugcaccaccgcugccccagaugauggagggcaacgggaauggacacgaacauugcuccgauugugagaacgaagaggacaauucuuacaacagagguggccucaguccugccaaugauacaggggcgaaaaagaaaaagaaaaagcaaaagaaaaagaaagagaagggaucagaaacugacagcgcucaggaucagccagucaaaaugaacucccuucccgccgagaggauccaggaaauucaaaaggcaauagagcuguucucuguuggccaggguccugccaagacgauggaggaggcuucgaaacggucauaucaguuuugggacacccagccagugcccaaguugggggaaguagugaauacacacggaccugucgaaccagauaaagacaacauccgccaagagccguacacuuuaccccagggcuucaccugggaugcacuggaccuaggcgaucgaggggugcucaaggaacuguauacacuucugaaugagaacuacguugaggacgaugacaauauguuucguuucgacuauagcccugaauuuuugcucugggcccugagaccacccggauggcugccucaguggcauugcggugugagggucgugaguucccggaaacucguaggcuucauuucugcuaucccagccaacauucacaucuacgauaccgagaagaaaaugguugaaauaaacuuuuuaugugugcauaagaagcugcgcagcaaaagagucgcgcccgugcuuaucagggagauuacucggcgcgugcacuuggaagggaucuuccaggcagucuauacagccggaguugugcugccgaagccuguagguaccugccgauacuggcacagaucccuaaaucccaggaaacucauugaggugaaguuuucacaucugagucggaauaugacgaugcaacguacuaugaaacuuuaccgccugccagagaccccuaagacagcuggcuugagacccauggaaacuaaggacaucccagucgugcaccagcuccugaccagguauuuaaaacaguuccaucugacacccguuaugagccaagaggaaguggagcacugguuuuacccucaggaaaacauaauugauaccuucgucguggagaacgccaauggggagguaacggacuuucucucuuucuauacucuuccauccacaaucaugaaccacccgacccauaagucacugaaagcagcuuacagcuucuauaauguucacacucagacacccuugcuagaucugaugagugacgcccucgugcuggcgaagaugaaaggauuugaugucuucaacgcccuugaccugauggaaaauaagaccuuuuuggagaagcucaaauucggcauuggcgaugggaaccugcaguacuauuuauacaauuggaaguguccuucuaugggagcagaaaaagugggucugguccuacaauga

SEQ ID NO: 59783 - RNA, 1497 nt, Artificial Sequence
  derived and/or modified sequence opt3 from NMT2__Homo_sapiens__NP_004799
auggccgaggacagcgaauccgcugcaucucagcaaucacuggagcucgaugaccaggauaccugcggcaucgacggggauaacgaagaggaaacagagcacgccaagggaagucccgguggcuaccuuggggcgaaaaagaaaaagaaaaagcagaagaggaaaaaggagaaaccuaauagcggaggcacuaaguccgacucugcuucggauucacaggaaauuaaaauacaacagccaagcaagaacccgagugugcccaugcagaagcugcaggacauccaaagagccauggaguuguuauccgcaugucaggguccugcccggaauauugaugaagcugcaaaacaucgcuaucaguucugggacacgcagccaguccccaagcuggaugagguuaucaccucucacggggccauugagccugacaaagauaacgugcgacaagaaccauacagccuaccccagggauuuaugugggacacacucgaccuguccgaugcugagguacuuaaggaacuguauacuuugcucaaugagaacuacguggaagacgaugacaauauguuccguuuugauuauucaccugaguuccugcugugggcccucagaccaccgggcugguuacugcaguggcauugcggcgucagggugaguagcaacaaaaaguugguuggguuuaucucugcgauacccgcaaauauccggauuuacgacuccgugaaaaagauggucgagaucaacuuccuuugugugcacaagaaacugcgcucaaagagaguagccccuguucuaauuagggaaaucacccggcgcgugaaucucgagggaauauuucaagcugucuauacagccgguguggugcugccaaaacccauugcaaccugccgauacuggcauagaagccuuaacccuaggaagcuggucgaaguuaaauucagucacuugucucggaauaugacucuccagcguacaaugaagcuguaccgcuuaccagaugugaccaagacguccggccugagacccauggagccgaaagacaucaagagcguaagggaacucauuaacacuuaucuuaaacaguuucaccuggcuccugugauggaugaggaggaagucgcccauugguucuugccccgggagcacaucaucgacaccuuugugguugaaucgccaaaugggaagcuaacagauuuccugucuuuuuacacucucccuuccaccgugaugcaucaccccgcgcacaaaucacugaaggccgcauauaguuucuacaacauucauacagagaccccacuucuggacuugaugagcgacgcucucauacuggccaaguccaaaggauucgaugucuuuaacgcuuuagaccugauggaaaauaagacguuccuagagaaacucaaguuuggcaucggugaugggaaccugcaguauuaccuuuauaauuggcgaugucccggaacugacucugagaaagugggcuugguacugcaauga

SEQ ID NO: 59784 - RNA, 525 nt, Artificial Sequence
  derived and/or modified sequence opt3 from NMU__Homo_sapiens__NP_006672
augcugagaaccgagagcugcaggccccgguccccugccggccagguggcugcagccucuccacuccuucuguuguuacugcuacucgcguggugugcuggggccugccgcggagcaccgauccugccccaaggucuucagccugaacagcagcugcaauuguggaacgagauugacgauacauguucaaguuuccucagcauagacucccagccacaggccucuaaugcucuggaggaacugugcuuuaugaucaugggcaugcuccccaagccucaggaacaagaugagaaagacaacacuaagcgauucuuauuucacuacucgaaaacgcagaagcuggggaaaucaaaugucguuagcagugugguacauccacuuuugcagcuggugccccaccuacaugagcguagaaugaagagguuccgggucgaugaagaguuucaguccccuuucgcaucucaaagccgcggauauuuucucuucagaccaaggaacggccggcgcuccgccgguuuuauuuga

SEQ ID NO: 59785 - RNA, 1281 nt, Artificial Sequence
  derived and/or modified sequence opt3 from NMUR1__Homo_sapiens__NP_006047
augacaccccugugccucaacuguagcgugcuuccuggcgaccuguacccagggggagccagaaauccgauggcuugcaacgguuccgcagccaggggccacuucgaucccgaggacuugaauuuaaccgaugaagcgcugcggcuaaaguaucucgggccucagcaaacugagcuguuuaugccaaucugugcuacguaccuucugauuuucgucguuggagccgugggcaacgguuugaccugccucguaauacugcgccauaaagcaaugcgaacacccacuaauuauuaccuguuuucucucgccgugucagacuuacugguccuuuugguggggcugccucuagaacucuaugagauguggcacaacuacccauuccugcuuggaguuggcggcuguuauuuucguacccuguuguucgaaauggugugccucgcuaguguccugaaugugacagcauuaagcguagagagauacguugccgugguccauccccugcaggcuagguccauggugacccgggcccacgugcgcagaguccucggggcgguuuggggacuugcaaugcuguguucuuugccuaacacuucgcuacaugguaucaggcagcugcacgugccaugccggggcccgguacccgauucagccguguguaugcucguccgcccucgagcucuguacaauauggugguucagacaaccgcccuucuguuuuucugcuugccaauggcaauuaugagcgugcucuaucuguuaaucgggcugagacuaaggcgggagcgucuccugcuuaugcaagaagcuaagggacgcggcagugccgcggccagauccagguacacgugucgguugcagcagcacgaccgaggucgcagacaggucacuaaaaugcuguuugugcucguaguuguguucgggauuugcugggcacccuuucaugcugauagggucauguggucuguggucagccaauggaccgacggacugcaccuugccuuccagcaugugcacguuaucuccggcauauuuuucuaucugggcucagcugccaacccuguguuguacagucucaugagcucucgguuccgcgagacauuucaggaagcacugugcuuaggggccuguugccacagacugaggccacgucauuccucacacagccuaagucggaugacuaccggaucuacacucugugauguagguucccugggcagcuggguccauccccuugcugggaaugacggaccggaggcgcagcaagagaccgauccuucguga

SEQ ID NO: 59786 - RNA, 1248 nt, Artificial Sequence
  derived and/or modified sequence opt3 from NMUR2__Homo_sapiens__NP_064552
augagcggcauggagaagcugcagaacgccuccuggaucuaccaacagaaacucgaagaccccuuccagaagcaccuuaauucuaccgaggaauaucuggcauuuuugugcgggccuagaaggucacauuucuuuuuaccagugagugucguuuacgugccgauuuucguagugggagucauagguaacgugcugguuugucuagugauccuccagcaccaagcuaugaaaacacccacuaauuauuaccuguuuagccuugccgucuccgaucuguuggugcuccugcugggcaugccucucgagguauaugaaauguggcggaacuacccauucuuauuugggcccguuggaugcuauuucaagacggcgcuguuugagaccguguguuucgcuucuauucuuucgaucacaacugucucaguggagcgcuacguggccauuuugcauccuuuucgagcaaaacugcagagcacccguagaagggcccuacggauccucggcauagucugggguuucaguguucuguuuucccuuccaaauacaucuauccacgggauuaaguuccauuacuuccccaacggaagccuggugccuggcuccgcuaccugcacuguaaucaagccaauguggauuuauaauuuuaucauacaggugacaucauucuuguuuuaccuccugccgaugaccgucauuaguguguuauauuaccugauggcacuccgccuuaaaaaggacaaaagccuggaagccgaugagggcaacgcuaauauccagagacccuguaggaagucuguuaacaaaauguuguucgugcuaguccugguguuugccauuugcugggcgccuuuccacaucgaccggcucuuuuucuccuuuguagaagaguggucagagagccuggcagccguuuucaaucuugugcacgucgugaguggggucuuuuucuaucugucuuccgcugugaacccaaucauuuacaauuugcucagccgccgauuucaagccgcauuccagaacguuauaucgucuuuccauaagcaguggcacucccagcaugauccccaacugccuccagcucagagaaauaucuuuuuaacggaaugucacuucguggagcugacugaagacauuggaccccaguuuccgugccaaucaaguaugcacaacagccaucuaccugccgcgcucuccucugagcagaugagcaggaccaacuaucagucauuccacuuuaauaagacauga

SEQ ID NO: 59787 - RNA, 246 nt, Artificial Sequence
  derived and/or modified sequence opt3 from NNAT__Homo_sapiens__NP_005377
auggccgcuguggcagccgcgagcgcugagcugcucaucauuggcugguacauauucagaguccuucugcagguuuucuuggaaugcuguaucuauugggugggguuugccuuuaggaaucccccuggaacccaaccaauugcacgguccgagguauuccgcuacucuuuacagaagcuggccuauacagugucacgaacuggucgucagguccuaggcgaaagaaggcagcgggcuccgaacuga

SEQ ID NO: 59788 - RNA, 795 nt, Artificial Sequence
  derived and/or modified sequence opt3 from NNMT__Homo_sapiens__NP_006160
auggagagcggcuucaccuccaaggacacauaccugucucacuuuaaccccagagauuaucucgaaaaguacuauaaguucgggucaaggcauagugccgagagccagauccuuaaacaccuguugaagaauuuauuuaaaauuuucugccuggacggagugaagggugaucuacucauagacaucggcuccgggccuacuauuuaccaacugcuuucugcuugugaaucguuuaaggagaucgucguuacggauuauucagaccagaaccugcaggaauuggagaaauggcucaagaaagagccagaagcauucgauuggagcccggugguaaccuacgugugcgaccuggagggaaaucgggucaagggccccgaaaaagaggagaagcugcgccaggccgugaagcaaguucucaaaugugaugugacacagagucagccuuuaggugcggucccacugcccccugcugacugcgugcuuuccacuuugugucuggaugccgcaugcccagaccuacccaccuauugucgagcccuccguaaccuggggucucuucugaagccuggaggcuuuuugguaauuauggaugcucucaaaagcuccuacuacaugaucggcgaacagaaguucucaagucugccauuagggagagaggcaguugaagccgcugugaaagaggccggauauacaauagaaugguuugaggucaucagccaaucuuacuccucaaccauggcgaauaacgagggucuguucagccucguggcaaggaaacuuagucggccgcuguga

SEQ ID NO: 59789 - RNA, 2868 nt, Artificial Sequence
  derived and/or modified sequence opt3 from NNT__Homo_sapiens__XP_006714524
auggugaaccccacccugggcguccacgaggccgaccuccuuaagacaagcgggacucugaucuccuucauuuacccugcucagaauccagaauuguuaaacaaacugucucaaagaaagacgaccguucuagcaauggaucaggugccgaggguaacaauagcccagggauaugacgcgcucucaaguauggcuaauaucgccgguuacaaagcagugguccuggccgcuaaccauuuuggccgguucuuuacugggcagauuaccgcagccggaaaggugcccccugcuaaaauccuuauuguuggcggugggguggccggacuggcgagcgcaggcgccgcuaaguccaugggcgccaucguccgcggguucgauacacgagcagcugccuuggagcaauuuaagucucucggagcggaaccacuggagguggaccugaaagaaucgggugagggccaagggggauaugccaaggagaugucaaaagaguucauagaagcagaaaugaagcucuuugcucagcagugcaaagagguagauaucuuaauuagcaccgcccugauccccggcaagaaggcuccuguucuuuucaauaaagagaugauugaaaguaugaaggaggguuccguggucguggacuuggccgcagaagccgggggaaacuuugagacuacaaaaccaggcgaacuguacauccacaagggcauaacccauauuggguauacggaucuacccucucguauggcuacucaggcgagcacccucuacuccaauaacaucacaaaacugcuuaaggcaauuucaccugacaaagauaauuucuauuuugacgugaaggaugacuucgauuuuggaacuaugggucacgucaucagaggcaccguugugaugaaggacgggaaaguaaucuucccagccccgacacccaagaacauuccucagggagcuccagugaaacagaagaccgucgccgagcuggaggcagaaaaagccgcuacgauaacucccuucaggaagacaaugaguaccgccagcgcauacacugcgggcuugacagguauccucgggcugggcauugcugccccuaauuuagcauuuucucagauggugaccacguucggacuggccggcaucguuggguaccauaccguguggggagucacaccagcucuccacagcccccuuaugucagugacuaacgccauaagcggucugaccgcaguaggcggguuggcucuaaugggaggccaccuguauccgaguacaacuucucaaggucucgccgcgcuggccgcuuuuauuuccagcguuaauaucgcagggggcuuccuugugacccagcggaugcuggacauguuuaagcgcccuacagaucccccagaguacaacuauuuguaccuccugccugccggaaccuucgucggcggguauuuagcugcccuguacucgggauauaauaucgaacagauuauguaccuagguucuggccucuguugcgugggggcacuggcgggacuuuccacucaaggcacggccagauuggguaacgcucuggggaugaucggcgucgccggaggccucgcagcuacacugggggugcuuaaacccggaccagagcuguuggcccagaugucaggcgcaauggcccucggugggaccauuggacugacuauagcuaagaggauccagauuagugacuuaccccagcugguugcggccuuucauagccuagugggccucgcagcuguacugaccuguaucgccgaauacaucauugaguauccucacuucgccacagaugcugcagccaaccuuaccaaaauagucgcguacuuggguacuuauaucggcggggugacauuuuccggaucucugauugcuuacggcaagcuccaagggcuguuaaaaagcgccccacugcuuuugccgggacggcaucuccugaaugcaggccuacuggccgcuucaguuggugggaucauucccuucaugguggacccuaguuuuacgaccggaaucacuugccucggcuccgucagcgcacugucugccgugauggguguaacacuuaccgcggcuauaggcggggccgauaugccagugguuaucacagucuugaacucauauaguggaugggcacugugugccgagggcuucuuacucaauaacaaucugcuuacuauugugggggcucugaucggaagcuccggcgccauuuugucuuacaucaugugcguggcaaugaaccgcucgcucgcuaaugucauacuggguggguauggaaccacgagcaccgccggcgguaagcccauggaaauuuccggcacacacacugagaucaaccuagacaaugcgauugauaugauccgagaagccaacucaauaaucauuaccccuggguacggacugugugcagcuaaggcccaguacccaaucgcugaccucguuaaaaugcugacagagcagggcaagaaagugagauuugggauucaccccguggcaggaaggaugccgggccagcuuaauguauugcuggccgaagccggugucccuuaugauaucguguuagagauggacgagauaaaccaugauuucccagacacugaccucguucuggugauuggggcuaaugauaccgucaacagugcggcacaagaagaccccaauucuaucaucgccggaaugccugugcuugagguuuggaaguccaaacaggugauuguaaugaagcggucccugggcgucggcuacgcugccguggauaaccccaucuucuauaagccaaacacggcaaugcuacucggggacgccaaaaagacaugcgaugcucugcaggcgaaagugcgugaaucauaccagaaguga

SEQ ID NO: 59790 - RNA, 2097 nt, Artificial Sequence
  derived and/or modified sequence opt3 from NOA1__Homo_sapiens__NP_115689
augcugcccgccagacucccuuucaggcuucugagcuuguuuuuacggggcuccgcuccaaccgcagcccgccacgggcugcgagagccgcuacucgaacguagaugcgcggcugccucuucauuccagcauaguagcucccugggaagggagcuucccuacgacccuguggauacagaagguuuuggcgaagggggagacaugcaagaacgguuccuguuuccagaguauaucuuggaucccgagccucagccaacucgcgaaaagcagcuccaggagcugcaacagcagcaggaagaggaggaaagacaaaggcagcagcggcgcgaggaacgaagacagcaaaaccugagggcacggucucgugagcaccccgucguuggccauccugacccagcccucccgcccucgggugugaauuguucagggugcggagcugaauuacacugucaggaugcaggcguaccuggcuaccugccacgcgagaaauuccuuagaacggccgaggcugacgggggauuggccaggaccgugugccagcgguguuggcugcuaagccaucaccgacgcgcgcucagacugcaagucaguagggaacaguaucuugagcugguguccgcagccuugcggcgccccgguccuucucucguucuguacaugguggauuuacuggaccucccagaugcccuucugcccgacuugccggcucuagucggcccuaagcagcugauugugcucgggaacaaaguagaucugcuuccccaggacgcaccaggauauagacaaaggcugcgugaacgguugugggaggauugcgcucgagccggccuccuguuagcgccuggucaccaggggccccagagaccaguuaaggacgaaccccaggacggagagaauccuaacccaccgaauuggagcaggacagugguccgcgaugugcggcugauauccgccaaaacuggcuacggcguggaggaacuaaucucagcacuccaaagaaguuggagguaucgcggggacgucuaccugguuggagcuaccaacgccgguaagagcacacuuuuuaauaccuugcuggagucugauuacuguacugcuaagggcuccgaagccauugaccgagcaacaaucucacccuggccugggaccacgcucaaccugcuuaaauucccaauuugcaaucccacuccuuaucggauguuuaagcgucaucagagacugaaaaaggauagcacccaggccgaggaagacuugagugagcaggagcaaaaccagcucaaugugcugaaaaagcacggauacguagugggcagggucggucgcacauucuuauauucugaggagcagaaggauaacaucccauuugaguucgacgcugauucccuggcguuugacauggaaaaugaucccgugauggggacucauaaaagcaccaagcagguugagcuaacagcacaagacgugaaagacgcccacugguucuacgauaccccgggcauaacgaaggaaaacuguauccucaaucugcuuacugagaaagaagucaacauuguguugccuacacagucgaucguaccacggaccuucguucugaagcccggaauggugcucuuucugggcgcuauugggagaaucgacuucuuacagggaaaccaaucugccugguuuacugucguggcauccaauauacugccuguccacauuacaucacuugauagggccgacgcuuuguaucagaaacaugccggucacacccuccugcagauccccaugggcgggaaggagcgaauggcaggauucccaccucuaguggcggaagauauuaugcugaaggagggccucggugcuagugaggccguugcagacaucaaauuuagcuccgccgggugggugucuguaacgcccaacuucaaggaucgccugcaucuucggggcuacaccccagaaggaacagucuugacugugagaccgccucuguuacccuauaucguuaauauuaaaggccagaggauaaagaaaagcguggcuuacaagaccaagaaaccacccucacucauguacaacguccguaagaaaaaggggaaaaucaauguguga

SEQ ID NO: 59791 - RNA, 1239 nt, Artificial Sequence
  derived and/or modified sequence opt3 from NOB1__Homo_sapiens__NP_054781
auggcccccguggagcacgucguugcugacgcaggcgccuuccugagacaugcggcucuccaggauaucgggaagaacauuuacaccauaagggaagugguaacagagauccgggacaaagccacucgccgacgucuugcagugcugccuuaugaauugagauuuaaggagccauuaccggaauacgucaggcuggugacggaguucagcaaaaagaccggagauuaucccucccuaucugccacagacauucaaguucucgcucugacuuaccagcuugaggcagaauuugugggugucucacaccugaaacaggagccucagaaggugaagguaaguagcuccauccaacauccagaaacccccuugcacauuucuggcuuccaucucccuuauaaaccaaagcccccucaggagacagagaaagggcacucggccugcgaaccagagaaucuggaauuuagcucauucauguuuuggcggaacccgcugcccaauaucgaucacgagcuccaggaauuacugauagaccgcggagaggauguuccuagugaggaagaggaagaggaagagaacggcuucgaggacagaaaggaugacuccgaugacgauggugggggauggaucaccccaucuaauauuaaacagauccaacaggaacuugagcagugugacgugcccgaagacgucagggugggcugcuugacuacagauuuugcuaugcagaacgugcugcuacaaaugggccuccauguccuggccguuaaugggaugcuuauucgggaggcgcgcagcuacauccugcgaugucacggaugcuucaagaccacguccgacaugucaagaguguuuuguagucauugcgguaacaagacuuugaaaaagguaagcgugaccgucucugaugacggcacacuccacaugcacuucuccaggaauccuaaagugcugaacccacggggguuacguuauucacugcccacuccgaagggaggcaaauacgcaauaaauccucaucucaccgaagaucagcgcuuuccccagcuuagacugagccaaaaggccaggcagaaaacaaacguuuucgcuccagacuacauugccggugugaguccuuucgucgagaaugauaucucuucccggagcgcaaccuugcagguacgagacucgacgcuaggggcuggacgcagaaggcugaaccccaaugccucucggaagaaguuugugaaaaagcgcuga

SEQ ID NO: 59792 - RNA, 2076 nt, Artificial Sequence
  derived and/or modified sequence opt3 from NOBOX__Homo_sapiens__NP_001073882
auggcccugcuccuuacccugacaagccccgacuuggagggcacuugggauacgagagacaaggauggguucaaagcucaggaaggaccuccauuagcagugccggaguuucccgucugcggucuguacaggaucuauggcguuuguggguccuucucuucauuuuucauuauacggugcagucuaugugcccucgaaacccuuaagagcccucaacacgacccacuugagauccccgaacagucccugaaauugauuccucucgugucuggaaagcgcgagcugacacgaggccagaaagcgggugagaagccacuggcugccgggcccggagaagaggaacucuuacguggcucggcaccucaugcccaggauacucaaucagaggagcugccaccgagcugcaccaucaguggcgaaaagaaacccccugcuguauccggggaggcaacaggagccgacgcugguagacuuuguccacccccuaggucucgggccccacacaaggaucgcaccuuggcgagaagcaggccccagacucagggcgaagacugcucccugccggugggggaggucaaaauuggaaagcggucauacaguccugcacccggcaaacagaagaagccaaacgccaugggucuagcuccuacaagcucucccggggccccaaauuccgcacgcgcuacccauaaccccgugccuuguggaucaggccgaggcccaugccaccucgccaaucugcuuagcacgcuggcgcaaaguaaccagaauagagaucauaaacaggggccgcccgaaguuacuugucagaucaggaagaaaacccggacauuguaucguucugaccaacucgaggagcuggaaaagauauuucaggaggaucacuacccugacuccgauaaacgcagagaaaucgcccagacugugggagucaccccacaaaggauuauggugaagggugcaggcagcuuaguagcuggguggucgggaggcggucccacaaucgagacccuggaacuccagucugagcgguccgccguugcuugggugugguuccagaaccgacgcgccaaauggagaaagauggagaagcugaaugggaaagaaucaaaggacaacccugcagccccaggccccgcuaguagccagugcuccucugcggcagagauucugccggccgucccuauggaaccaaaacccgacccuuuuccccaagagagcccauuggauacguucccugaacccccaaugcuacugacuucagaccagacacucgcuccgacccagccuagugagggagcccagaggguggugacucccccacuguuuuccccucccccaguccggcgcgcagaucuucccuucccucugggcccgguucacacaccacaauugaugccccuccugauggacguggccgggagcgauucuucacauaaggacggaccuugugguaguuggggcaccagcaucacguuaccacccccuugcuccuaucuggaggaacuagagccgcaggauuaccagcagucuaaucaacccgggccauuucaguucucgcaggcuccucagcccccacucuuucaaagcccucagcccaaacugccauaucuuccgaccuucccuuucuccaugcccucaaguuugacacugccacccccugaagacucucucuuuauguucccaugcggacccagcggcgguacuucccagggguacuguccuggcgccucaagcggacaaauacugaugcagccgccagcaggcaacauugggaccgcgucuugguccgaucccugccuuccugagcugcccuuuccaggaccuuucuguccccaggcuuugggucacccaccuggcggggacggauacuuuccggaucucuuccccacaccaugcccucaggcccugggcagacaacccaguagcgcauuaucuuggaugccagagggugccaggccugggacuggcccccugcuauccaaggcuaaggaggaaccgccagccgcaucacucgaccagccuagugcucuggaagaggcccguggagacgauaaaaauagccauguacccuga

SEQ ID NO: 59793 - RNA, 2403 nt, Artificial Sequence
  derived and/or modified sequence opt3 from NOC3L__Homo_sapiens__NP_071896
augaaggccagaaggaacaaaaagcagauccccagcuuccggaaacugauuaagaccuccaaagugaagcucgagaauaaacuuaaaaacaagcaauuuaaacagcagucuacacugaagaaauaccgcaaggaacagcgaaaguugcgucaagcugucaaagacgcaguuucaaagaaaccuauaccauuagagaauccgaaggaaaagagacccggcaagaggaucgagcgggaagaggaggaagaggaagaggcccugccucuagauaugauggacgaggaugaccuccagcugaugaaagaucuugggcagcgcgugaguuuccugacuagagacuugagcuccucugaaccaguacacgcgaagaagaggaaacaugagcggauuaucgauaaguaugagaaaauuccccgcacgcuccagaccgcuccugaaaaggaacugauccaucugcucccaauaaaagacaagucgggaaucauuccccaaacacgagagaagccugugacugauucaaacaaagacgaggaagaucaggaggaagagagagaauuagaggaggaaaucauugaggacccaauccaggaacugaccauagaggaacaccuuauugagaggaagaaaaaguugcaggagaaaaagaugcacaucgccgcacuggccagcgcuauucuaagugauccggaaaauaacaucaagaaacucaaggagcugcgguccaugcuuauggaacaagaccccgacgucgcagugacaguucguaaacuggugaucgucucuuugauggagcucuuuaaggauauuaccccuagcuacaaaauacgcccacugacugaggccgaaaaguccacaaagaccagaaaagagacgcagaaguuaagggaguucgaagaaggucuggugucacaguauaaauuuuaccucgagaaucuugagcaaaugguaaaggacuggaaacagcggaagcugaaaaagaguaacguugugagcuugaaggcuuauaaaggccuagccgaagucgcggugaagucucugugcgagcuccugguggcacuuccccauuucaauuuucacaacaauaucauuguccugaucguuccuuugaugaacgauauguccaaacucauaucagaaauguguugcgaggccgugaagaaacuguucaagcaggacaaguuagggcaggcuagccugggaguaauuaaagugaucaguggcuuugucaagggucgaaauuacgaagugcgcccagagaugcuaaaaacuuuccucugucugagaaucaaggagguugaagugaaaaaggauaccgaggacauuaacaagcccaaaaaguuuaugacauucaaagaaaagaggaaaucucuuucccggaugcaacgcaaguggaagaaagccgaggaaaaguuggagagagagcugagggaagcagaggcuagcgaaucgacugagaaaaagcucaaacugcacaccgagacacuuaauaucgucuuugugaccuauuuccguauucugaagaaagcccagcggucuccguugcucccugcgguacuggaaggguuagccaaguucgcacaucugauaaacguugaguuuuucgaugaccuacucgugguccugcacacgcuuaucgaauccggagauuugucauaccaggagagucugcauugcgugcagacugcuuuucacauucucagcggccaaggcgacguccugaacaucgaucccuuaaaguucuacacacaccuguauaaaacccuuuuuaaguugcaugccggggcuacuaaugaaggaguggagaucguucuccagugucuggacgugaugcuaacaaaacgaagaaagcagguaucccagcaaagggcccuggcauucauuaaacgccucugcacccuggcccuucacgucuugccaaacucuagcauagguauccuggcuacgacccggauuuuaaugcauacauuuccuaagacugaccuccugcuugauucagagagucagggcuccgggguguuccugcccgaauuggacgagccagaauacuguaaugcgcagaacaccgcacucugggagcugcacgcccuaagaaggcauuaucaccccaucguucagcgcuuugcugcccaccugauugcaggagccccuagcgaaggcucuggugcucucaagccagagcugucacgacggagugccacagagcuuuucgaagcauacagcauggcggagaugacuuuuaauccgcccguggaauccucuaacccuaaaaucaaggggaaauucuugcaaggagauucguuucugaaugaggacuuaaaccagcucauaaagcguuauagcuccgaagucgcuaccgagucaccacuggauuucacaaaauaccuuaagaccagucugcauuga

SEQ ID NO: 59794 - RNA, 2862 nt, Artificial Sequence
  derived and/or modified sequence opt3 from NOD1__Homo_sapiens__NP_006083
auggaggaacagggccacagcgagauggaaaucauucccuccgagucucauccucacauacaacugcucaagucaaacagagaacuucuggugacccauaucaggaauacacagugcuuggucgacaacuuacugaaaaaugauuacuucagugccgaggacgcugagauuguuugugcaugcccaacucagccggauaaggugcggaaaauccuagaccucguacagagcaagggggaagagguguccgaauuuuuccuguaucuucugcaacaguuggccgaugcguacgucgaccuccgccccuggcugcuggagauuggauuuucuccuucgcucuuaacgcagucaaaagugguugugaacaccgauccagucagccgauauacacagcaacugcgucaccaucuugguagagacaguaaguucguguuguguuacgcucagaaggaggaacugcuacucgaggaaaucuauauggauacuauaauggagcugguaggcuuuuccaaugaaucucuugggagccugaacuccuuggccugccuccuggaccacaccacaggaaucuuaaaugagcagggcgagaccauuuucauccugggugaugcagggguuggaaaaucaaugcuccuucagaggcugcaaaguuugugggccacuggccggcuagacgcuggcgugaaguuuuucuuucacuuccgcuguagaauguuuagcugcuucaaagaaucugauaggcugugucuccaggaccugcuuuuuaagcauuacugcuaucccgagcgggacccugaagaggucuucgcauuccuguugcgcuuuccacacguggcccucuucacauuugaugggcuggacgaauuacauuccgaucuggaccuaucacgagugcccgauagcaguuguccuugggagccagcucacccgcucguccugcuugccaacuugcugucuggaaaacuccugaagggugcguccaaacuucugaccgcaagaacgggcauugagguucccaggcaguucuugcggaaaaaggugcuccugcguggguuuagcccuucgcacuuacgcgccuacgcuagaaggauguucccagaacgggcccugcaagaccgacuacucucucagcuggaggcaaaucccaaccuuugcuccuuguguucaguaccucuguuuugcuggaucauauuccgcugcuuucagcauuucagagcugccuuugaaggaaguccacagcuccccgauuguacuaugacccugacagacguguucuuacuggucacugaggugcaccuuaauaggaugcaaccgagcuccuugguucagcggaacacccgcucuccuguggaaacacuccaugcgggcagagauacccugugcagccuaggucaggucgcccacagggggauggagaaaucacuguuuguguucacgcaggaggaaguacaagcaaguggacuccaggagcgugacaugcagcugggcuuccuucgggcuuugcccgaacugggcccagggggagaucagcaauccuacgaguuuuuccauuuaacucuccaggccuuuuucacagccuuuuuccugguucuugacgaccgaguggguacccaggagcuguugagauuuuuccaggaauggaugccucccgcuggcgcagccacuacaagcuguuauccacccuuucucccuuuccaaugccugcaggggucuggaccagcuagggaggaucuauuuaagaauaaagaccacuuccaguuuaccaaccuguuccucuguggccugcuuucaaaggcgaaacaaaaguugcugcgccacuuagucccggcagccgcucuccggagaaagaggaaagcccugugggcacaucuuuucaguagccugcgcgguuaccuaaagucccucccccgagugcaggucgaaucuuuuaaucaggugcaggccaugccuacguucauuuggaugcugcggugcaucuaugagacccaaucgcagaaaguugggcaguuggcugcccguggcauuugugcaaacuaccugaaguuaacauauugcaacgcguguagcgcugauugcuccgcccucucauuugugcugcaccauuucccaaaaagacuugcacuggacuuggauaauaacaaucucaacgacuacggaguaagggaacugcagcccuguuuuagucgccuaacuguccugcggcuuucugugaaucaaaucaccgauggcgggguuaaggugcucagcgaggagcugacaaaguauaaaaucgucacuuacuugggacuguacaacaaucagauuaccgacgugggugccagauauguaacaaagauauuagaugaaugcaaaggccucacccaccugaaacuugggaagaacaagaucacuuccgagggaggcaaguaccuggcuuuggccgugaaaaauucaaagagcauuucugaaguugguaugugggggaaccaggucggcgacgagggagcaaaggcuuucgccgaagcgcucaggaaucacccuucccugacgacacuaagucuggccagcaacggcaucucuaccgaagggggaaagucccuugcucgagcacuccagcaaaauacuucacuggagauauugugguuaacccagaacgagcugaaugaugagguggccgaaagucucgcugagaugcugaaagugaaccagacacuuaagcaucugugguugauucaaaaccagaucaccgccaaggguacugcacagcuagcggacgcccugcagagcaauacaggcaucacggaaauuugccucaacgggaaucugaucaaaccagaggaggcuaaggucuaugaagaugagaaacgcauuauauguuuuuga

SEQ ID NO: 59795 - RNA, 3123 nt, Artificial Sequence
  derived and/or modified sequence opt3 from NOD2__Homo_sapiens__NP_071445
augggcgaggaagggggaagcgccucccacgacgaggaagagagagcuucugugcugcucggucauucacccggcugcgaaauguguagucaggaggcauuccaagcccagaggagccagcuugucgagcuguugguuuccgggucuuuagaaggauuugagucggugcuggauuggcuacucucaugggaaguacugagcugggaggacuacgagggcuuccaccuucugggucagccuuugagucaucucgcgcggcgccugcuggauaccguguggaacaaggggacaugggcuugccaaaaacucaucgccgcagcccaggaagcucaggcagacucccagucuccaaaguuacacggauguugggauccgcauagccugcaccccgcccgagaccuucaaucccaccguccugcuauugucagaagguugcauucacacguggagaauaugcuggaucuagccugggaacggggcuuuguuagucaguaugagugcgacgaaauacgccucccaaucuucacucccagccagagagcgaggcggcugcuugaucuggcaacggugaaagccaacggcuuggcugccuuucuccugcagcauguccaagaguuaccugugccacuggcacucccccuugaggcugccaccuguaagaaauacauggcgaagcugcgcacaacuguaucugcccagucccgauucuugucaaccuaugacggggcagaaacacuaugccuggaggauauuuacaccgaaaauguucucgaggugugggcugacgucggaauggccgguccuccacagaagucuccggcuacucugggccuugaggagcuguuuaguacacccgggcacuugaacgaugacgccgacaccgugcucguggucggagaggcaggcucugguaaauccacgcuguuacaaagacugcaccuacucugggccgcugggcaggauuuccaggaauuucuguucguuuuuccuuucagcuguaggcagcuucaaugcauggcgaagccauugucggugcggacucugcucuuugagcauuguugcuggcccgacguaggacaggaagauaucuuccagcugcuucuggaccacccugaucguguguugcucaccuucgacggcuuugaugaguucaaauuucgcuucacagacagagaaaggcauuguucuccaacugaucccaccuccguccagacacuguuauuuaaucugcuacaaggcaaccuccugaagaaugcacggaaagugguuaccucacgaccggccgcugugagugccuuccuucgcaaguauauuagaacggaguuuaacuugaagggguucagcgagcagggaaucgaacuguaccucaggaaacggcaccaugagccuggugucgcagaccgccugauaagauuacugcaggaaacuuccgcccuucacggcuugugccaccuccccguguuuucuuggaugguaagcaagugccaucaggagcugcuacugcaagaagggggaucaccaaaaacaaccacugauauguaucuccugauccuucagcacuucuugcugcaugcuacaccucccgacagugccucccagggcuuagguccaagccuccugagggggcgucuucccacccuguugcaccucggccggcuggcacuauggggacugggcauguguugcuacguuuuuagcgcgcagcaacuccaggcugcccaggugucaccugacgauauuagucugggguuccuuguccgagcaaagggaguggucccagguagcacggccccguuggaauuucugcacaucaccuuccaauguuucuuugcugccuucuacuuagcacucuccgcugacgugcccccugcccugcuuagacaucuguuuaauugcggcaggccagggaacucucccauggcgcgccuacucccuacaauguguauucaggccucggagggaaaagauagcuccguugcugcacuguugcagaaggccgaaccacacaaucugcagaucacugcugccuucuuagcaggccuccugucacgggagcauuggggucuucuggcggaaugccaaaccagugagaaagccuugcucagaaggcaggcuugugcccgcuggugccuggcacgaucucuacggaagcacuuucauagcauacccccggcugccccuggggaggcaaaguccgugcacgccaugccaggcuucauuuggcugauccguucacuuuaugaaaugcaggaggaaagacucgcuaggaaagcggcccgcggacugaacguaggccacuugaagcugacauuuuguagcgucgggcccacugagugcgcagcuuuagccuucgugcuccagcaucugcggagaccuguugcccuucaacuggacuacaauucugugggagauauuggugucgaacaguugcuccccugucugggcgugugcaaagcucuauaucugagggacaacaauaucuccgaucgagggaucugcaaacuuauugagugugcacuccacugcgagcagcugcagaaauuggccuuauuuaacaacaagcugaccgacggaugugcgcauaguauggcuaagcuccuggccugccgccaaaauuuccuugcacugcgguugggcaacaauuacauaacagccgcuggugcacagguacuagccgaagggcugagaggcaacaccagccuccaguuucugggauucuggggcaauagggugggggaugagggagcgcaagcucuugccgaagcauuaggcgaccaccagucucugcguuggcucuccuugguugguaacaauaucgggucagucggagcccaggcucuggcccucaugcuggcaaagaacgugaugcuugaggaacuguguuuggaggagaaucaucuacaggaugaaggcgugugcagucuggcugagggucucaagaaaaacagcucguuaaagauucugaaacuuuccaauaacuguaucacuuaucugggcgccgaagcgcucuugcaagcccuggagcgcaaugacacgauacucgaggucuggcugcgggggaacacauuuucucuugaagagguugauaagcuaggaugcagagacaccaggcuguuguuauga

SEQ ID NO: 59796 - RNA, 1044 nt, Artificial Sequence
  derived and/or modified sequence opt3 from NODAL__Homo_sapiens__NP_060525
augcacgcccauugccugcccuuccuccuucacgcuuggugggcacuguugcaggccggcgcggcuaccguggccacagcauuacugagaacuagggggcaaccuagcuccccaucuccgcuagccuacaugcucucacuguaucgggacccccuuccucgcgcugauaucauucgaagucugcaggcagaggacgucgccguugauggacagaacuggacguuugcuuucgacuuuagcuucuugucccagcaagaagaucucgccugggcggagcugcgucugcagcucucuucgccaguggacuuacccaccgaagguucacuggcaauagagaucuuucaucagccuaagccagauacagaacaggccagcgacaguugucuugagagauuccaaauggauuuguuuacuguaacccugucccaggugacauucucucuaggcagcaugguccucgaggugaccaggccccuguccaaauggcuuaagcacccuggggcucuggaaaaacagaugucacggguugccggagagugcuggccacgcccgcccacuccuccagcaacaaauguguugcucaugcuguacaguaacuuaagccaggaacaaagacagcugggcgguucuacccuccuuugggaggcugaguccucauggagggcccaggaagggcaacugagcugggaguggggaaagcggcaucgccgacaccacuugcccgacagaagucagcuauguaggaaagucaaguuucagguggauuucaaucugauuggcuggggcucuuggaucauuuauccuaagcaguacaacgcguaucggugcgaaggggaguguccaaaucccguaggagaagaguuucauccgacgaaccacgccuacauccaaucccuccugaaacguuaucagccucaucgcguucccagcacuugcugugcaccagugaagaccaaaccucuuucgaugcuguacgucgacaaugguagaguguugcucgaucaccacaaggacaugauaguggaggaaugcggcugucuguga

SEQ ID NO: 59797 - RNA, 699 nt, Artificial Sequence
  derived and/or modified sequence opt3 from NOG__Homo_sapiens__NP_005441
auggagagaugccccagccugggcgugacccucuacgcccuugucguugugcugggguugagggcuacuccugcaggaggucagcacuauuuacauauccggccagccccguccgacaaccugccccuaguagaucucauugaacacccugacccaauauucgaucccaaggagaaagaccugaaugaaacacuucugcgcucuuugcucggcgggcauuacgauccuggauuuauggcgacgucaccacccgaggaccgaccuggcggugggggaggcgcugccggcggggcagaagaucuggccgagcuggaccaacucuuacgucagagaccaaguggagcuaugccgagcgagaucaagggucuggaguucuccgaaggccuugcacaggggaaaaagcagagguugucuaaaaagcugcggcgcaagcuacaaauguggcucuggucgcagaccuuuugucccgugcuguaugccuggaacgaucuuggaucaagauucuggccuagguacgucaaagugggcagcugcuuuaguaagcgguccuguucuguuccagaagguauggugugcaaacccagcaaguccguccaccugacaguguugcgcuggcgaugucagagaaggggagggcagcggugcggcuggauuccuauccaauauccaauuaucucagaguguaaaugcaguuguuga

SEQ ID NO: 59798 - RNA, 1614 nt, Artificial Sequence
  derived and/or modified sequence opt3 from NOL11__Homo_sapiens__NP_001290201
auguucaacagcagaauccugaccaaguacacacuccuucugggccaggacgaaaauuccgugauuaaaucuuuuacugccucagucgauaggaaguucauaaguuugaugagcuuauccucugacgggugcaucuaugagacgcugauucccauccggccugcugauccagagaaaaaccaaucgcuaguuaagucacuccugcuuaaagcagugguaagcggaaaugcccgcaacgguguggcgcugaccgcuuuggaccaggaucacgucgccgugcucggcaguccgcuggcagccuccaaggaaugucugucuguuuggaauauuaaguuucagacacuccagacuagcaaagaguuaccccaagggaccuccggacagcugugguacuauggcgaacaucuuuucauguugcacgguaagucacugacagugaucccuuacaaaugcgaggucaguagccuagcuggggcacucggaaagcugaaacauucucaggacccaggcacccacgugguaucccauuuuguuaacugggagacuccccagggcugugggcuuggauuccaaaauucagaacagagccgacguauacugagaaggcggaagaucgaggugaguuugcagccugaagucccacccucuaagcagcuccuguccacaauuaugaaagauagcgagaagcacaucgagguggaagugcgcaaauuuuuagcccugaagcaaaccccugacuuccacacggucauuggugauacuguuaccggccuccuugagagaugcaaagcugaaccaucguuuuauccgaggaacugucugaugcaguugauccagacacaugugcuaucuuacucccugugccccgaccucauggagauagcccugaagaaaaaggauguacaacuucugcaguugugucuccagcaguucccugacauuccagaaucagugacuugcgcgugucugaagaucuuuuuaaguauuggggaugacagccugcaagagaccgacgucaauauggaguccguguucgauuauucuaucaacagcguucacgacgagaaaauggaggaacagacagagauccuacagaauggauuuaaccccgaagaggauaagugcaauaacugugaccaggagcucaauaaaaagccucaagaugaaaccaaagagucaacgaguugcccagugguccagaagcgggcagcccugcuuaacgcuauuuugcauuccgccuacagcgaaacuuuccugcucccccaccugaaggacauaccggcacagcacaucacacuuuuccugaaauacuuguauuuucucuaccugaagugcucugagaacgcuaccaugacuuuaccuggcauucaucccccaacacugaaucagaucauggauuggauaugucuacuccuggacgccaacuucaccgugguaguuaugaugccugaagcgaaacgccuuuugauuaaucuguauaagcucgugaaaucacaaaucagugucuacagcgagcugaacaagaucgagguguccuuucgagaauuacagaagcugaaucaggagaaaaacaauagaggucuuuauucuauugaagucuuggaacucuucuga

SEQ ID NO: 59799 - RNA, 627 nt, Artificial Sequence
  derived and/or modified sequence opt3 from NOL3__Homo_sapiens__NP_001263236
augggcaacgcccaggagagacccagcgaaaccaucgacagggagcggaagcgccugguggaaacacuccaagcugauuccgggcuucuguuggacgcauuacuggcccgaggaguccuaacugguccugaguacgaagcgcucgaugcucugccagacgccgagcguagaguuaggcggcuucuguugcucgugcagggcaaaggggaggcagccugccaggaacugcugcgcugugcucagagaacggcaggagccccggaucccgcuugggacuggcaacacguaggcccugguuauagggaucggucuuacgacccacccugcccugggcauuggaccccagaggcccccggaucaggcacaacuuguccuggccucccacgcgcgagugauccggacgaagcagggggacccgaggguagcgaggccgugcaguccggcaccccugaggaaccagaacccgaguuagaagcugaggccucuaaggaggcagaaccugagccagaacccgagccggaacuggagccugaggcugaagccgagcccgaaccagagcuugaaccugagcccgauccagagcccgaaccugacuucgaggaacgagaugagucggaggacucauga

SEQ ID NO: 59800 - RNA, 1725 nt, Artificial Sequence
  derived and/or modified sequence opt3 from NOL4__Homo_sapiens__NP_001185475
auggagagcgaaagagacauguacaggcaguuccaagauuggugccugcggaccuauggcgacuccgggaagacaaaaacugugacgcgcaagaaauacgagcgaaucguccagcuccuuaacggaucugaaucaaguagcaccgauaaugccaaguuuaaauucuggguuaaguccaaggguuuucagcugggccagcccgacgaggugcgugggggaggcgguggggcuaaacaaguauuguaugugccugucaagacaacugauggagugggcguugacgaaaaauuaucucugagaaggguggcagucguggaggauuucuuugacauuauauacucgaugcacguagagaccggcccaaacggggaacagauccggaagcaugccggacagaaacgcacauauaaggcgauuucagagagcuacgcuuuccuaccgagagaagccguuaccagguuucucaugaguuguuccgagugccagaagcggaugcaccugaaucccgaugguacugaccauaaagauaacggcaagccuccaacacuugugaccucuaugaucgacuauaauaugcccauuacgauggcauacaugaaacacaugaagcugcaauugcucaacagccagcaggaugaggacgaauccucaaucgagagugacgaguucgauaugagcgacucuacucgcauguccgccgucaauucagaucugagcaguaaccuggaagaacgaaugcagucuccucaaaaucuccaugggcagcaggacgaugacuccgcugcagagagcuuuaacggaaaugagaccuuaggccacucgucuauagccuccggugggacacacucaagagaaaugggagauaguaacagcgacggcaaaacuggccuggagcaagaugaacagccacuuaauuuguccgacucuccccugagcgcucagcuaaccucagaguacaggaucgaugaccauaacaguaaugggaagaacaaauauaagaaccuccugauuuccgaccuuaagauggaacgggaggcccgugagaauggaagcaaaucuccugcgcacucauacaguagcuaugauuccgguaagaacgaaucuguggaccgcggcgcagaggaucugucguugaauagaggggacgaagaugaggacgaucaugaagaccacgaugacagcgagaaagugaacgagacagauggagucgaagccgagaggcucaaggcuuucaauucccggccaaucccgucacaccugaccagugccguugcagaaucuauuuuagcuagcgccugugaguccgagucacgaaacgcggccaaacgcaugagacuggaaaggcagcaagacgagagcgcacccgcugauaagcagugcaagccugaagccacgcaggcuacuuacucuacauccgccgugccaggcagucaggacguacucuauaucaaugguaacgggaccuacagcuaucauucuuaccggggccuuggaggcgggcuguugaaucuaaacgacgcauccucaaguggacccacugaucugagcaugaaacgccaacucgccacaucguccgguucuagcucaaguuccaauucuagaccucagcugagcccaaccgagauaaacgcugugaggcagcuugucgcgggcuaccgugaauccgcagccuuucuguugcggucagcugacgagcucgagaaucugauuuuacagcaaaacuga

SEQ ID NO: 59801 - RNA, 3441 nt, Artificial Sequence
  derived and/or modified sequence opt3 from NOL6__Homo_sapiens__NP_075068
augggccccgccccugcuggggagcagcugagaggagcaaccggugaaccagaggugauggaaccggcccucgagggcacagggaaggaagguaaaaaggcgagcuccaggaaacggacucuugcugagcccccugccaagggccuguugcaaccagucaaauuaucucgcgcagagcuguacaaggaacccacgaacgaggaacuaaaucgacuccgugagaccgagauccuguuccacucaagucuucugagauugcagguugaggaacuccugaaggaagugaggcugagcgagaaaaagaaagaccggauugaugccuuucuccgcgaaguaaaccagagaguggucagggugccuuccguuccagagacagaguuaacugaccaggcuuggcugcccgccggugugcgggucccucuucaucaagugccauaugcaguaaaggggugcuuccgcuuuuugccgcccgcucagguuaccguggucggaucuuaccugcuaggcacauguauacgaccugauaucaauguggacguggcccucaccaugccaagagaaauucugcaggauaaagacggccuuaaccagagguauuuccggaagcgugcgcuguacuuggcacaccucgcccaucaccuggcucaagaucccuuauuugggucggucugcuucucauauacuaauggaugucaucugaagccuagccuccuucugcgcccaagagguaaagacgagagguugguuacagugcggcuacaccccugcccgccucccgauuucuuccgaccaugucgccugcucccuaccaagaacaauguaagaagugccugguacaggggccagucccccgcaggggacggaucuccagaacccccuacgccacgguauaacacuugggugcugcaggauaccguccuugagagccaucugcaguugcucuccacaauccugucaagugcucaaggcuuaaaagacgguguggcccugcuaaagguuuggcuccgccagagagaacuggauaaagggcagggaggcuuuacuggcuuccuugugagcauguuggucguguuucugguaucuaccaggaagauucacacaaccauguccggguaccaaguucuccguucagugcugcaguuccuugcgacgacugaccugacagucaauggaaucagcuugugccucaguucugacccgucccugcccgccuuagcagauuuucaccaggcuuucagcguggucuuccuggacucgucuggucaucuaaaccucugugccgaugugaccgcuuccacuuaccaccagguucaacacgaggcccggcugucaaugaugcuuuuggacagucgagcagaugacggcuuucaucugcuccugaugacaccuaaaccaaugauaagagccuucgaucacguguuacaucugaggccccuuagccgcuugcaggcugcgugccaccggcucaagcuguggccugagcuacaggacaaugggggagauuauguauccgcagcccugggcccacucaccacgcugcuugaacaggguuugggggcuagacugaacuuacucgcccauucuaggcccccggucccugagugggacaucagccaagauccacccaagcacaaagacucaggcacccugacacuuggacuguugcuccgcccugaaggccugacuagcgugcuagagcuggggcccgaagcagaccagccagaggccgcuaaguuucgacaguucuggggaucccggagcgagcuccguagauuucaggauggugccauuagggaagcaguugugugggaggcggcuucuaugucacaaaaacgccugaucccucaccaggucgugacccaucuuuuggcccugcacgcagacauucccgaaacauguguacauuacgugggcgggccauuagaugcccucauccagggacugaaggagaccaguagcacuggcgaggaagcucuuguugccgcaguccggugcuaugacgaucuguccagacuacucuggggucuggagggguugccgcugacagugucugcugugcagggcgcccacccugucuuaagguacaccgaaguuuuucccccaacucccgugcgaccugcguuuucguucuaugagacgcuccgcgaacggagcucccugcuuccaagacuggacaaacccuguccugccuacguggagccgaugacaguagucugccacuuggagggaucaggccaauggccacaggaugcugaagcagugcagaggguucgugccgcuuuucaacuccgccuggccgagcuacugacccagcagcaugggcuucagugccgggcaacugcgacccacacagacgugcucaaggauggauucgucuuuagaauaaggguggccuaucaacgagaaccccagauucugaaggagguucagaguccugaagguaugaucucuuugcgggacaccgcugccagccugcgcuuagagagagauacuaggcagcucccacugcuuacauccgcacugcauggcuugcaacagcagcaccccgcuuucucagggguggcccggcucgcaaaacgauggguaagagcccagcugcuaggagagggcuuugcugacgaaagccuggaucuugucgcggccgcacucuuccugcauccugagccguucacgcccccaucuuccccucaagugggauuuuugcgcuucuuauuucuggugaguaccuucgacuggaagaauaacccccucuuugucaaucugaacaacgaacuuacuguugaggaacagguggagauuaggagcggguuccuggcugcccgugcccaguugccaguaauggugaucgucacaccucaagaccggaaaaauucuguguggacccaggauggccccuccgcucagauccuacagcaacugguugugcucgcagccgaggcgcugccaaugcuugaaaagcaguuaauggacccgagaggaccuggcgauauuaggacagucuuucgacccccacuggacauauacgaugugcucauccgcuugucacccagacacauuccucggcacaggcaggcuguugacaguccagccgcaaguuucugucgcgggcugcucucgcagcccggaccuuccucucugaugccggugcuuggcuacgauccaccccaacuguauuugacucagcuacgugaggccuuuggugaccuggcucucuucuuuuacgaucagcaugggggagaagucaucggcguauuauggaaaccuaccagcuuccagccccaaccauuuaaggcaucaaguacgaaggguagaauggugaugucccggggcggggagcugguuauggugccuaacgucgaggccauacuugaagacuucgcggugcugggagagggccucguacagaccguggaagcuaggucugagcgcuggacagucuga

SEQ ID NO: 59802 - RNA, 3300 nt, Artificial Sequence
  derived and/or modified sequence opt3 from NOL8__Homo_sapiens__NP_001243323
augagcgugcugaacaagaccaaauggaagggcgggacacuccagauccaacuugccaaagaguccuuccugcacagauuggcucaggaaagggaggcagccaaggcgaaaaaggaagagucuacuacgggaaaugcuaacuuacuggaaaagaccgguggcgucgacuuucauaugaaagccguucccgggacagaggugccuggacacaagaauuggguagugucaaaauucggccggguccuaccagugcuccaucugaagaaccagcacaaacgcaagauuauaaaguacgauccgaguaaauauugccauaaucuuaagaaaaucggugaggacuuuagcaacacuauucccaucuccucucugaccugggaauuggaagggggaaaugauccuaugucgaagaaacgacguggcgaguucucagacuuucacggcccacccaagaaaauuaucaagguucagaaggaugagagcaguacagggucccucgcaaugucuaccagaccuaggcgggugauagagcgcccaccccugacucaacagcaggccgcucagaaaagaacaugugacagcaucaccccuuccaagucaaguccagucccggugagcgauacgcaaaaacugaagaaccuccccuucaaaacuucuggauuagaaaccgcaaagaagaggaauagcauuucagacgaugacacagauagcgaggacgaacugcggaugaugaucgccaaagaggaaaaccuucagcgcacuacccagccuaguauuaaugagucugaguccgauccauuugaaguaguucgagacgacuucaagagcggugugcacaaauugcauucgcugaucggccuagggauaaagaacagagucucuugccacgauuccgacgaugacauuaugaggaaugaucgggaguacgacucaggagauacagacgaaaucauugcuaugaaaaagaacguggccaaggugaaaaauaguaccgaguuuagccagauggaaaaguccacgaaaaagacuucuuucaaaaaccgugagaacugugagcucagcgaucauugcaucaagcugcaaaagcgcaaaucaaaugucgaaagugcgcuuucccacggccugaaguccuugaacagaaaaucucccucacacaguagcuccucugaggacgcagauucggccagcgaacucgcugacuccgaggguggggaagaguauaaugccaugaugaagaacugucugaggguuaauuuaacacuggcagaccucgagcagcuugcuggaucagaucugaaagugccuaacgaagacaccaagagugauggcccagagacuacaacccagugcaaauuugaccggggcucuaagagccccaagacgccgaccggguugcgacgcggaagacaauguaucaggccugccgaaauuguagcgucccuacuggagggugaggaaaauacaugcggcaaacagaagcccaaagagaacaaucucaagccaaaauuccaggccuuuaagggggugggaugucuguacgaaaaggagucaaugaaaaagagccuuaaagauucugucgcauccaacaauaaggaccagaacaguaugaaacaugaagauccuagcauaaucucuauggaggacggcucccccuaugugaaugguucacugggggagguuacuccaugccaacacgcuaagaaggccaacggccccaauuacauucagccucagaaacggcagaccacauucgaaagucaagaucgcaaggcugugagcccaucguccucugagaaaagaagcaagaacccgaucucaaggcccuuggaaggcaaaaagagucucucccugucugccaagacucauaacauaggauucgacaaagauagcugucacuccaccacaaagaccgaggcaucacaggaagaacguagcgacaguucuggguuaacuucccugaaaaagagcccuaaagucucgucaaaggauacgcgggagauuaaaacagacuuuucucuaaguaucuccaauagcucugacgugagcgccaaggauaagcaugcugaagacaacgagaaacgacucgcggcacuggaagccagacagaaggcuaaagagguacagaagaaacuuguucacaaugccuuggcaaaccuggauggacacccagaagacaagcccacccauaucauuuucgguuccgauucagagugcgagacugaagagaccaguacacaagaacagagccacccuggcgaggagugggugaaggaaucuauggggaaaaccuccggaaagcucuuugacucaagugaugacgaugagagcgacuccgaagaugacucuaauagguucaaaaucaagccacaguuugagggccgcgccggucagaaacugauggaucuucaaucgcauuucgggacugacgaccgguuuagaauggauagcagguuccuggaaacagacucagaggaggaacaggaggaagucaacgagaagaagacggcugaagaggaggaauuggccgaggagaaaaagaaagcacucaaugugguccaguccgugcugcaaauuaacuuaaguaauucuaccaaccgcggcagcguugcggcuaagaaauuuaaggauauaauccacuaugaccccacuaagcaggaucacgccacauacgagcgaaaacgggacgauaagccgaaagaauccaaggcaaaacguaagaagaaaagagaggaggccgaaaagcugccugaggugucaaaagaaauguacuauaauauugcuauggaccuaaaggagaucuuccagaccacaaaauacacuucugagaaggaagagggaaccccauggaacgaagauugcggcaaagagaagcccgaagagauccaggacccugccgcacucacgagcgaugcugagcaacccaguggguuuaccuucuccuuuuucgacagcgacacaaaggauauuaaagaagagacuuauaggguagaaaccgucaagccaggaaaaauaguguggcaggaggacccucgccugcaggauucuucauccgaagaggaggacguuacagaagagacugaucaucggaauaguagccccggugaagccucgcuuuuggagaaggaaaccacgagauucuuuuucuuuucuaaaaacgacgagaggcugcagggcuccgaucucuucuggcgaggggugggaagcaauaugucacgcaacaguugggaggcgcggacaaccaaccugagaauggacuguaggaagaagcacaaagaugccaagcguaaaaugaagccaaaauga

SEQ ID NO: 59803 - RNA, 2130 nt, Artificial Sequence
  derived and/or modified sequence opt3 from NOLC1__Homo_sapiens__NP_001271317
auggccgacgcuggcaucagaagggugguccccagcgaucuguacccucucguucuuggguuccugcgggacaaccaguuguccgagguggcaaauaaguuugccaaagcgaccggagcuacacaacaggaugccaacgcaucuucauuacuggacauuuauaguuucuggcuaaagagcgccaaaguaccagaacgcaagcuccaggcuaaugguccgguggcaaagaaggccaagaaaaaggcuuccucuucggauucagaggacagcagugaagaggaagaggagguccaggggcccccugccaaaaaggcggcagugccagccaaacgaguuggccugcccccuggaaaggcugccgcaaaggcuuccgaaucuagcuccucagaggaaaguagcgaugacgaugacgaggaggaucagaaaaagcagccagugcagaaaggcgucaagccccaggccaaagcggccaaggcaccuccgaaaaaggcuaagucuuccgacucagauagcgacaguucuuccgaagacgagccacccaaaaaccaaaagccuaaaauaacuccagugacgguaaaggcccagaccaaagcucccccuaagccagcccgugcagcccccaagaucgcuaaugguaaagcggcaagcucgucuuccucaaguagcuccucuagcucaagugaugacuccgaagaggaaaaggccgcugccacaccgaaaaagguuuggacuauuaccagcgugagagcagagacagucccuaaaaagcaagugguggccaaggcucccgucaaagccgcaaccacuccaacaaggaagucuucaaguagcgaggauuccucuucggacgaagaggaggaacagaaaaagccuaugaaaaacaagcccgggccauacagcuccguucccccuccaucagcgccgcccccuaagaaaagucuuggaacccaaccacccaagaaagcuguggaaaagcagcagccuguagagucuagcgaggauuccucagacgaaagcgauucuuccagugaggaagagaaaaagccacccacgaaagccguggucagcaaggcaacuaccaagccgccuccagccaaaaaggcugccgaaucuuccucagacaguagcgauucggacuccucugaggaugacgaggcacccagcaaaccugcuggcacaacuaaaaauucaaguaacaaacccgccgugaccacaaaguccccagcgguuaagccugccgcugcacccaaacaaccagugggcgggggacagaagcuguugacccggaaagccgacucuagcuccucagaagaggaaagcaguucuuccgaggaggaaaagacgaaaaagauggucgcuacuacaaagccgaaagccaccgcaaaggcggcccucagccugccugcuaaacaggcaccccaggguucgcgcgauucaucuagugacuccgauagcucuagcuccgaggaagaggaagagaagacuucaaaaagugcagugaagaagaaaccacaaaagguagcuggcggggccgcacccagcaaaccugccucugcuaagaaaggaaaggcggaguccucaaauaguagcuccucugacgauucgagcgaagaggaagaggaaaaacugaagggcaaggguucaccaagaccccaggccccuaaagcaaacgggacauccgcucucaccgcccagaauggaaaggccgcuaaaaacagugaggaggaagaggaagagaagaaaaaggcagccguuguggucucuaagagcggcucccugaaaaagaggaaacagaaugaagcggcuaaggaggccgagacgccgcaagccaaaaagaucaaguuacagaccccaaacacauuucccaaacggaagaaaggcgaaaagcgcgccucaucuccuuuccgaagagugagggaggaagagauugaggucgacagccggguggcugauaauaguuuugacgcaaaacguggggccgcgggagauuggggugaacgcgcuaaccagguucuuaaguucacuaagggcaaauccuuuagacacgagaagaccaaaaagaaaagggggagcuaucggggaggcucuaucucagugcagguaaacuccauaaaguucgacagugaauga

SEQ ID NO: 59804 - RNA, 2583 nt, Artificial Sequence
  derived and/or modified sequence opt3 from NOM1__Homo_sapiens__NP_612409
auggccgcuagcagauccgcaggcgaggccgggcccggagguucucagggcagggugguccggaugaagcgccgagggggacguggcccuagaagggguccagcugggggaggcgaaaaagcgcugaagcggcucaaacuugccguugaggaguucgugcacgcaaccucagagggcgaagcccccgggggaugcgagggucgcggcgcuccgguaaguuuuagaccugggggaaggaaaagccggaaagagcugcgcaaggaaaagcgacauuugagaaaagcaaggcgguuacaacguacagccggcccagagcagggucccgggcugggaggccgcuccggcgcugaagaggccucugggcacagacaggacacugaggaaagggcgcggccugcaccaucgcgagaucccucaccuccacgcaagccgagacccagcagggugaaagccaaggcuacggccgcaaccgcuaaaacacggccuagugccgcggccacugcagcugcccgcaagagagcucuacucgccgcaaacgaggaagaggacagggaaauccguaagcuggagcggugucuuggacugaauaaacgaaagaaaaaggaugguuccucuagcgucccauuguccuucgccagagacggccucgauuacauucugggggcucuggagucaggaaagaacaguggccucuaugacagcucuggugaagaggaagaggaugcggggcagaccuuacccgaauccgaccuggagucagauagccaagacgagagugaagaggaagaggaaggcgauguggagaaggagaaaaaggcacaggaagccgaggcucagucugaagacgaugacgaggacacagaggaagaacagggagaagagaaggaaaaaggcgcccaagagaagaggcgcgggaaacggguuagauuugcagaggaugaagagaaguccgaaaauagcucggaggacggagauauaaccgacaaaucucuuugcgguuccggcgaaaaguacaucccuccacaugugaggcaggccgaggagacugucgauuucaagaaaaaggaagaguuggaacgccugaaaaagcacgugaaagggcuacucaaccgacugucagagcccaauauggcuaguauuagcggacagcuugaagaacuguauauggcccauucccggaaggacaugaacgauacauugaccucugcacucaugggcgcguguguaacggcuagcgccaugccgucacgucugaugauggagcacguuuuacuggugaguauccuccaccauacugucgguauugaagugggggcacacuuucuugaggccguggucagaaaguucgacgcuaucuacaaauauggcuccgaaggaaaggagugcgauaaucuguuuaccguuauagcccauuuguacaacuuccacgugguacagagccuacugaucuuugacauucucaaaaagcugaucggcacauucacugagaaagauauugaacuuauccuguugaugcucaagaaugugggguuuucucugaggaaggacgacgcauuaucacugaaagagcuaauaaccgaagcucaaacaaaggccaguggagcggguagcgaguuccaggaucagacccgcauucgguuuaugcucgaaacgaugcuggcccuuaaaaacaaugacaugagaaagaucccuggcuaugaucccgagccagucgagaaauugaggaagcugcaacgagcucucgugcgcaacgcaggguccggaucugaaacucagcugcggguuucgugggacagcgugcuuuccgccgagcagacaggcagaugguggauugucgguucagcuuggaguggggccccuaugaucgauaauucucaccauacccaucugcagaaacaauuggugggcacuguaagcuccaagauccucgaacuggcaaggaagcagcguaugaacacagacauucgccggaauauauucuguaccaucaugacgucagaggauuucuuagacgcguuugaaaaacugcuaaagcucggacugaaagaucagcaggagagagagauuauccacguucuuauggacugcuguuugcaagaaaagaccuacaaccccuucuacgccuuucuggcuagcaaauucugcgaguaugaaaggcgauuucagaugacauuccaguuuucuauaugggauaaguuccgggaccucgagaaccugccagccacuaauuuuuccaacuuagugcaccuggucgcacaucuuuugaagaccaaaagucucagccugucuauucuaaagguggucgaguucuccgagcuggauaaaccccgcgugagauuucucaggaagguucugucaauccuuuugauggagacagaaguggaggaccugaguuuaaucuucacucggguaagcgacaauccuaaacucggcguccugcgagaagggcuuaagcuguuuauuucgcacuucuugcucaagaacgcucaggcccacagauccgcagaugaggccaaugugcugcgcgagaaagcugaccuagcgaccaagugucugcaaggaaaagccucucucaggauguga

SEQ ID NO: 59805 - RNA, 3669 nt, Artificial Sequence
  derived and/or modified sequence opt3 from NOMO1__Homo_sapiens__NP_055102
augcuggugggccagggggccggaccccucgguccugcugucguuaccgcagccgugguacuucuguugagcggcguggggccagcgcacggauccgaggacaucgucgugggcugcgguggguucguuaagucugauguggaaauuaacuacucauuaauagagaucaaacuguauacaaagcauggaacucuaaaauaccaaacggacugugcuccgaauaacggcuauuuuaugauuccccucuacgauaagggcgacuucauccugaaaauugaaccuccacuuggguggaguuuugagcccaccacagucgaacugcacguggauggaguaagcgacaucugcacuaaggguggcgauauaaauuucguuuuuaccggguucuccgugaacggaaaggucuugucuaaaggccagccucucgguccagccgggguccaggugucgcugagaaauacaggaaccgaggcaaagauccagucaacugugacacaacccggcggcaaauuugccuucuuuaagguucugccuggggacuaugagauucucgcuacccauccaacgugggcauuaaaagaagccagcacuaccgugaggguaacaaacaguaaugcuaacgccgcguccccgcugaucguggcaggauacaaugucucugguagcgugcgguccgauggcgagcccaugaaggggguuaaguuccuuuuguuuucaagucuggugacuaaagaagacguccuaggauguaacgugagcccuguaccaggcuuccagccccaggaugagucucucguuuaucugugcuacaccgugucccgcgaggacgguucauuuagcuucuacagucuuccuucugggggcuauacagucauuccauucuaccgaggagaacguaucaccuuugauguggcccccuccagacuggacuucacggucgagcacgacagcuugaagauagaaccgguguuucauguuaugggcuucucggugacugggaggguacucaauggaccugagggugauggcguccccgaagcugugguuacacugaacaaucagauuaaagugaagaccaaagccgacgggucuuuucgguuagagaacaucacuacaggaaccuauacgauucacgcacaaaaggagcaccuguacuucgaaaccgucacaaucaaaaucgcuccaaauacuccucagcucgccgauauuauagcgaccggcuuuuccguguguggucagaucucaauuauccgcuuccccgacacaguaaagcagaugaacaaguauaaagugguucuuaguagccaagauaaggacaaaucccuggucacuguggagaccgaugcccaugggucuuuuugcuucaaggcaaaaccaggcacauacaaggugcaggucaugguucccgaagcugagaccagagccggauugacucuaaagccucagacguuuccacugacagugaccaacaggccgaugauggacguggcuuucguacaauuucucgccagcgucucaggcaaagugaguugucuggauacuugcggggaccuucugguuaccuugcagucccucagccggcagggagaaaagcgcucucugcaguuaucagguaaagugaaugcaaugacauucaccuucgauaacguccugcccggcaaguauaaaauaaguauuaugcacgaggacugguguuggaagaauaagagccuagagguggaaguucucgaggacgauauguccgccguggaauuucgacaaacuggguacaugcugagaugcucucuuucgcaugcuaucacauuggaguucuaccaggacggaaacggcagggaaaauguagguaucuauaaccugagcaaaggggucaaucgguuuugucucuccaagccuggcguguacaaagugacgccacguucaugccaccgcuucgagcaggcguuuuauaccuacgauacuagcucucccagcauucugacacuuaccgcaaucagacaccauguccugggaacaauuacuaccgacaagaugauggauguuacggugaccauaaaauccucaaucgacagcgagccugccuugguacucggcccacugaagucugugcaggaauuaaggcgggagcaacagcuggcugaaauugaggcccgacgccaggagagagaaaagaacgggaaugaggaaggagaggaaaggaugacaaaacccccgguccaggagaugguggaugagcuacaaggcccuuucuccuaugacuuuaguuacugggcacggagcggugaaaagaucacuguuaccccaucuuccaaagagcuccuguucuaucccccuucaauggaagccguggucaguggggagagcugccccggaaaacuuaucgaaauucacggcaaggcugguuuguuucuggagggccagauacauccagagcucgaagggguggagaucguuauuucggaaaagggagccuccucuccucugaucacaguguucacugaugacaaaggcgcauacagcgucgggcccuuacacucagaucuggaguacaccguaacgagucagaaggaaggauaugugcuuacagcgguugagggcaccauuggugacuuuaaggcuuacgccuuggcagggguguccuucgagaucaaagccgaagaugaccagccacucccgggaguccugcuaucucugagcggcggucucuuucgcuccaaccugcuuacucaagacaauggcauauugacauucucaaaccugagcccugggcaguauuacuucaagcccaugaugaaagaguuuagauucgaaccaaguucucagaugaucgaggugcaagagggacagaauuuaaagauuaccaucacuggcuauaggaccgcuuacuccuguuaugggacaguaagcucgcucaacggagaacccgagcagggcguggccauggaagcagucggucagaaugauugcucaauuuacggggaggacacgguuaccgaugaagagggaaaauuucgucugcggggccuucugccugguuguguguaccaugugcaauugaaggcugagggcaacgaccacaucgaacgagcccucccacaccauagagucauagagguggggaacaaugauauugacgauguuaacaucauuguauucaggcagaucaaucaguuugaccugucuggaaacgugauaacaaguuccgaauaucuacccacucugugggucaagcucuacaaaagcgagaaucuggauaacccuauccagaccgugucucuuggccaaaguuuguucuuucacuucccgccacuguuacgcgacggggaaaauuauguugugcuccuggauuccacacuuccccggucacaguacgacuauauucugccucaggucaguuuuacugcggugggauaccauaagcacaucacccuaauuuucaacccaacgagaaaacuccccgagcaggauaucgcccaaggcagcuauauagcucugccuuugacacuguuaguacuccuggcagguuacaaucacgacaaacuuauuccgcuguugcuccagcugaccucuaggcuacaggggguccgcgcccugggacaagcugccuccgacaacucaggccccgaggaugcaaagcgacaggcgaagaagcagaaaacucggcguaccuga

SEQ ID NO: 59806 - RNA, 1416 nt, Artificial Sequence
  derived and/or modified sequence opt3 from NONO__Homo_sapiens__NP_001138881
augcagagcaacaagaccuucaaucuggagaaacaaaaccacacacccagaaagcaucaccagcaucaccaucagcagcaacaccaccagcagcagcaacagcagccuccaccgcccccuaucccagccaauggccagcaggcuuccucucagaacgaagggcucacuauugaccuuaaaaauuuuaggaagcccggagagaaaacguucacccagcggucacgccuguuuguggguaacuugccuccagauauaacagaagaggaaaugcgaaaguuauucgagaaguacggcaaagcaggggaggucuuuauccauaaggacaaaggauucggcuuuauucgucuggaaacuagaacccuagccgagaucgcgaagguugaacucgauaauaugccccugagggguaaacaacuucgggugcgcuucgcuugccacagugccagccugacaguaagaaacuugccucaguauguguccaaugagcuccuggaggaagcauuuucugucuucgggcaaguggagagggccguugugauugucgacgaucggggacgcccaucgggcaagggcaucguggaauuuucagggaagccggcugcacgaaaagcccuggacagauguagcgagggaaguuuccucuuaaccacuuuucccaggccuguaacaguugaaccaauggaucagcuggacgaugaggagggucuucccgaaaaguuggugaucaaaaaccaacaguuccauaaggagcgggaacagccuccacguuucgcucagcccggcuccuuugaguacgaauaugccaugcgcuggaaagcgcugauagagauggagaagcaacagcaggaccaggucgauagaaauauuaaagaagcaagggagaagcuagaaauggagauggaagccgcucggcacgagcaccaagugaugcucaugcgacaggaccugaugcgcagacaggaggaacuuaggcggauggaggaacugcauaaccaggaggugcaaaagcgcaaacaguuggagcucagacaggaagaggaaaggcgucggcgagaggaagagaugagaaggcaacaggaggaaaugaugcgccggcagcaggagggguucaagggaaccuuuccggaugccagagaacaagagaucaggaugggccagauggcaauggguggggcuaugggaauuaauaaccgcggcgccaugccucccgcgccagucccugccggcacgcccgcaccacccgggccugcuacuaugaugccagacggaacccuggguuuaacaccgcccacuaccgaacgauucggccaggccgcuacaauggaggggaucggagccauaggcgguaccccuccagcauuuaaucgggccgcucccggggcggaguucgcaccuaacaaacguagaagguacuga

SEQ ID NO: 59807 - RNA, 195 nt, Artificial Sequence
  derived and/or modified sequence opt3 from NOP10__Homo_sapiens__NP_061118
auguuccugcaguacuaucucaacgagcaaggcgacagaguguacacccuuaagaaauuugaucccauggggcagcagacaugcagcgcccacccugcuagguucuccccagacgauaaguauucucggcaucgcaucacuauuaaaaagcgauuuaaaguccugaugacgcagcaaccgcgucccguuuuguga

SEQ ID NO: 59808 - RNA, 2421 nt, Artificial Sequence
  derived and/or modified sequence opt3 from NOP14__Homo_sapiens__NP_001278908
auggccaaggcuaaaaaggugggcgcaagaaggaaagccagcggggcgcccgcuggagcccgggguggcccugcaaaggccaacuccaauccauucgaggucaaaguuaaccgccagaaguuucaaauccuggggcgaaagacccgucacgacgugggacucccgggcguaucuagagcuagggcacuucggaaacgcacacagacucuguugaaggaauacaaagagagagauaagucaaauguguucagggacaaacgguuuggugaauauaacaguaauaugagccccgaggaaaagaugaugaagcgcuucgccuuagagcagcagcgacaucacgagaaaaaguccauuuacaaccugaaugaagaugaggaacuaacgcauuaugggcaaucucucgcugacauagagaaacacaacgauaucgucgacucggauucagacgccgaggauagaggaacccugagcgcggaacuuacagcagcccauuuuggcggcgggggaggucuguugcacaagaaaacucagcaggagggcgaagagagggaaaagccuaaaagucggaaggagcucauugaggaacugaucgcuaaguccaaacaggagaagcgugaacgccaagcccagagagaggacgcacuggaacucaccgagaaauuagaucaggacuggaaggagauucagacacugcuuucucacaaaaccccaaagagcgaaaauagggauaagaaagagaagcccaaaccugacgcuuacgacaugauggugcgggaauugggguucgagaugaaggcccaaccauccaaccgaaugaaaacugaagcggagcuggccaaggaggaacaggagcaucuacgcaagcucgaagcagagagacugaggcggaugcuuggaaaagaugaggacgaaaauguuaagaaacccaagcacaugucagcugaugaccugaacgauggcuuuguguuggacaaagaugaccgcagacuccugaguuauaaggaugguaagaugaaugucgaggaagacgugcaggaggaacaaagcaaagaggccucugauccugaguccaacgaagaggaaggggacucaagcggaggcgaggacacagaagagagugauucuccagacucccauuuagaucuggagagcaauguagaaucggaggaagagaacgaaaagccggcuaaagagcagaggcagacccccggcaaggggcucaucucuggaaaagagcgugccgguaaggcaacgcgggacgaacuuccuuacacuuucgccgcuccagaguccuaugaggaacugcgaucauugcuacugggcagaaguauggaggaacagcuccugguuguggagaggauacaaaaaugcaaccaccccagccuugcggaagggaauaaggcaaagcuggagaaauuguuuggauuccuccuggaauacgucggcgauuuagccaccgacgauccuccagaccugacagugaucgauaagcuagugguccaccucuaccaucugugucagauguuucccgaguccgcuucugacgccauuaaauucguucuucgcgaugcaaugcacgagauggaagagaugaucgaaacuaagggucgggccgcuuugccggggcuggacgugcucauuuaucugaaaaucaccggccuucuguuuccuacaagcgauuucuggcaucccguagugaccccagccuuggucugccucucacagcuguuaacgaaguguccuauacugagucuacaggacgugguuaagggacucuucgugugcugucuguuucuugaguacgucgcauugucccaaagauucauucccgaacugaucaacuuucuccugggcauuuuauauaucgcgacuccaaauaaagcuagccaggggucuacacuggugcaccccuucagggcccuuggaaagaacucagaguugcucguaguuagugcacgcgaggacguggccaccuggcagcagagcucccugucucuacgaugggcuucgcggcugcgugccccuacuagcacagaagcaaaucauaucagacucuccugccuggcugucggucuugccuugcugaaaagguguguguuaauguacggcucacucccaaguuuucacgcgauuauggggccgcugcaagcccuucugaccgaucacuuggcugacugcucucauccccaggagcuccaggaacugugucagagcacgcuaaccgagauggaaucccaaaagcagcugugccgcccucucacaugugagaaaucaaagccagucccccugaaacuuuucacuccucgguuggugagcaacucuagaccacagguuauacaucugcccuggccgccuaauuauaggugcgagccacaacaccccgcaaagaaggugaucuuuuuccgaguaauuauguuauga

SEQ ID NO: 59809 - RNA, 699 nt, Artificial Sequence
  derived and/or modified sequence opt3 from NOP16__Homo_sapiens__NP_001243468
augcccaaggccaaaggcaagaccagaaggcagaaauucggguacagcgugaaccggaagcgccugaaucgaaacgcucguagaaaagcagccccuaggaucgagugcucccacauucggcaugcgugggaccacgcuaagucuguccgccaaaaucucgccgaaaugggacuugcaguugauccaaacagagccgugccgcugaggaagcggaaaguaaaggcuauggagguggacauagaagaacgccccaaagaauugguccgaaagccuuauguguuaaaugaucuggaggcagaggccucacuaccagagaaaaaggguaacacacucaguagagaccugaucgauuacguuagguauaugguggagaaucauggcgaagacuacaagcagagcgggaaaacuuccucuauucuuugucggcguggacgcuggagauggucggauugguuuacgucacagcugccccaggcugaggccagcccuggcccagucaaguuggagcccgguugcaaagcgaggcgguguugcguggcaccugaggaacucgcccgaagucacgggauccgcagacugcauacccacguacacacaccaagguccggagaaggcacuguucugcggggcucuaaccucuauagcuccgggggaucacgcaagagucaaaauuuacuguucagcgguugggugauguga

SEQ ID NO: 59810 - RNA, 2427 nt, Artificial Sequence
  derived and/or modified sequence opt3 from NOP2__Homo_sapiens__NP_001028886
augggcagaaagcuggaccccaccaaagagaagagggggccuggacggaaagcccgcaagcagaaaggugcugaaacagagcucgugcgauuccuuccagcagucagcgaugaaaacuccaagcgucugucuucaagagccaggaagcgggcggcuaaacgcagauugggcaguguugaggccccgaagacuaauaaaagccccgaagcaaagccuuuaccagggaaacugcccaagggagccgugcaaacggcuggcaagaaagguccucagucccuauuuaacgcaccaagggggaagaaacggcccgccccuggaucugacgaggaggaagaggaagaggauucggaggaagacggcaugguaaaucacggcgaucucugggggucagaggacgaugcugacaccguggaugacuacggagccgauagcaacagugaagacgaggaagagggugaggcgcugcuuccaaucgaacgcgcagcccgaaagcagaaagcuagagaggccgcagcuggcauucagugguccgaagaggaaacagaggaugaggaagaggaaaaggaggucacuccggaaucugggcccccuaaaguggaggaggccgacggaggccugcaaauaaauguugacgaggaaccauucguguugcccccugcgggugaaauggagcaggaugcccaggcaccagaccuccagaggguccauaagcggauccaagauauuguggggauccugcgugacuuuggagcucagcgcgaggaaggcagaagcagguccgaguaucugaaccggcucaagaaagauuuagccauuuacuauucauacggcgacuuccugcuugggaaguugauggaucuguuuccccuaagugaacucguagaguuccuggaagcuaaugagguuccgcgaccugugacccuucgcacaaacacccugaaaacuagaaggcgggacuuggcccaggcacucaucaaucgcggagucaaccuggaucccuuagguaaguggagcaaaacaggccuggugguguaugacucuuccgucccaauaggggccaccccugaguaccucgcuggacacuauaugcuucagggcgcgucaagcaugcugcccguuauggcauuggccccacaagaacaugagagaauccuagauaugugcugugcucccggugggaagacgaguuacauggcccagcugaugaagaauacuggcgugauucucgcaaacgacgccaaugcugaaaggcugaaaucuguagugggaaaccuucaccgucugggcgucaccaauacaaucauuucccauuacgacgggcggcaguuuccuaaggugguuggagguuucgaucgaguguugcucgacgccccaugcagcggcacuggggucaucucgaaagauccggcagugaagaccaacaaagacgagaaggauauacugagaugugcgcacuuacaaaaggaacugcuacucucugcuauugacuccguaaacgccacaucaaaaaccggaggcuaucugguuuacugcacguguaguaucacuguggaggagaaugaaugggucguggauuaugcacuuaagaaaaggaacguccgcuuggugcccacaggucuggacuuugggcaggagggcuucacccgguuuagagaaaggcgcuuccacccuagccuccgauccacucggcguuuuuacccacauacacacaauauggauggauucuucauugccaaguuuaaaaaguucucuaacagcaucccccagucacagaccggcaauagugagacggcuaccccuacaaacguugaccugccacaagugauccccaaguccgaaaauagcucucagccggccaaaaaggcaaaaggggcugccaagacuaaacagcagcuucaaaagcagcagcauccuaaaaaggcgucauuucagaagcugaacggaauuaguaaaggugccgauagcgaguuguccaccguaccaucugucacaaagacucaagcuagcagcuccuuccaggacucaagucagcccgcaggcaaagccgaggggauaagagaaccuaaggugaccggaaaacucaagcagaggucucccaagcugcaaagcuccaaaaagguugccuuuuuacgccagaaugcuccaccuaaaggcacagauacccagacucccgcagugcugucaccaagcaagacgcaagcgacacuaaaaccgaaggaccaccaccagccucucggucgggccaagggggucgagaaacagcagcugcccgaacaaccauucgagaaggcugccuuucagaaacagaacgacacccccaagggcccucagccacccacugugucuccuaucagauccaguaggccgccacccgcaaaacgaaagaagucgcaaucucgcggaaauucccagcuuuugcugucauga

SEQ ID NO: 59811 - RNA, 1785 nt, Artificial Sequence
  derived and/or modified sequence opt3 from NOP56__Homo_sapiens__NP_006383
auggugcugcuccacguccuuuucgagcaugccguuggcuacgcucuguuggcauuaaaggaaguggaggaaaucagccugcuacagccccaaguagaggaauccgugcucaaccuggggaaauuucacucuauugucagacuuguggccuucugcccuuuugcgucaagucagguugcucuggagaaugccaacgcagugagcgagggagucgugcaugaagacuugaggcuccugcuggagacccaccucccauccaagaaaaagaaaguauuacuggguguuggcgauccgaagauaggggccgcuauccaggaagaacuuggauauaauugucagacaggcggugugauugcagagaucuugcgcgggguccggcugcauuuccacaaccuagugaagggacucacugaccugucugccugcaaagcucaacuuggccugggccacucguacucacgagccaaggugaaauuuaaugucaaccguguugauaauaugauuauccagagcauaaguuugcucgaccagcuggauaaggacaucaacacguucuccaugagagugagggaaugguauggguaccauuuucccgaguuaguaaaaauuaucaaugauaacgcgaccuauugucggcuggcacaguucauuggaaaucgcagagaacucaacgaggacaaacuugaaaagcuggaggaguugacaauggauggugccaaggcuaaggccauccuagacgcaucuaggagcuccaugggcauggauauaucagcuauugaccugaucaauauugaaaguuuuagcucucggguggucucccucucagaguaccgccaaagccugcacacuuaucuucgaaguaaaaugucucagguggccccuucccugagcgcguugaucggggaagccguuggagcaagacucaucgcucaugccggcucgcugaccaacuuagcuaaguacccagccucuacagugcagauucugggugcagagaaagcccuauucagggcucucaagacccgggggaauacucccaaauacggacugauauuucacuccacauucaucggccgugcggcagccaagaacaagggccgcauuucaagauaucuugcuaacaaaugcaguaucgccagcaggauagauuguuuuuccgaagucccuaccucuguguucggggagaaguugcgggagcagguagaggagcgacugagcuucuacgaaacgggagagauuccacgcaaaaaucucgacguuaugaaggaagcaauggugcaagccgaggaggcugccgcagaaaucacuagaaaacuggagaagcaggaaaagaaaaggcuuaagaaagagaagaaacggcuggcggcuuuggcccucgcaucaagugagaacuccagcucuacccccgaagagugcgaagagaugucagaaaagccuaagaaaaagaaaaagcagaaaccacaagaggucccgcaggagaaugguauggaagaccccaguaucagcuuuuccaagccuaagaaaaagaaaucuuucucgaaggaggaacugaugagcuccgauuuagaggaaacagccggcucaaccaguauuccaaaacgcaagaaaucuacucccaaggaggagacagugaacgacccugaagaggcugggcacagaagcggauccaagaaaaagaggaaauuuucaaaggaggaaccagucagcucuggccccgaagaggccguggguaaauccaguagcaagaagaaaaagaaauuccauaaggcaucucaggaggauuga

SEQ ID NO: 59812 - RNA, 1911 nt, Artificial Sequence
  derived and/or modified sequence opt3 from NOP9__Homo_sapiens__NP_777573
augggccaggggcccagaagcccucacaaggugggaaggcgguucccagccgguggcaaacgcgggcgaggagcuaagggcuccggucguccgcugcccgggagaaaaaggcaaccuuggccacccccugacggacggucugagccagcacccgauucacauccucaccucaguccagaagcccuuggcuacuuucgcagagcgcugagcgcuuugaaggaggccccggaaaccggcgaggaaagggacuuaaugguccauaacaucaugaaagagguugagacacaggcacuggcccuauccacuaaucggacggggucugaaaugcuccaggagcugcuuggauucucgccccugaagccuuugugccgcgugugggcugcacuccgaucaaaccugagaaccguagccugucacaggugcggugugcauguccugcagagcgcucucuuacaacugccacggcuuuugggcagugccgcggaagaggaggaagaggaagaggaagaugggaaggacggacccacagagacucuggaggaacuggugcucggccuggcagccgagguuugugaugacuuucuuguguauugcggugauacccacggguccuucgucgugcguacacuguugcagguacucggaggcaccauucuggaaucugagcgcgcuagaccuaggggcagccaguccucagaagcccagaaaacuccagcacaagaguguaagcccgcugacuuugagguuccggaaacauucuuaaaucggcugcaggaucucaguagcucuuuucuuaaagacauagccguguucaucaccgauaagauuuccucauuuugccugcaggucgcgcuucaggugcuacaccgaaaacugccucaauucugugcccaucucugcaacgcagugaucggguaccugagcacgcgcggaaguucugucgacgguucccccuugcuguuguuucucagagaucagacuagcucgaggcuguuagagcagguucugcuagugcucgaaccaccucggcugcaaucucuuuucgaggaacacuugcagggccagcugcagacccucgcugcccaucccauugcuaauuuuccacugcaacgccuucuggacgccguaacaacucccgaguugcucuccccuguguucgaggaacugucaccagucuuagaggcagugcuggcccaggggcacccgggaguugugaucgcucuagucggcgcguguagaagggugggugcauaucaggccaagguacuccagcugcuuuuggaggcuuuccacugcgccgaacccaguagccgucaaguugcaugugugccucuguuugccacccucauggcuuacgaggucuauuacgggcugacagaagaggaaggcgccgugccagcagagcaucaggucgcgauggcugccgcacgggccuuaggagacgugaccguucugggcucccuuuugcuccagcaccuacuacauuucucuacgcccgggcuggugcuccgaagccugggagcucuuacugguccucaguugcugucauuagcccaaaguccagcaggcucccacguacucgaugcuauacugacaagccccucugucaccagaaaguugaggcgccgggugcugcagaacuugaaagggcaguauguugcccucgcgugcucaagacauggaaguagggugcuggacgccaucuggagcggcgcugcacuacgcgcccgaaaggaaauugcugccgagcugggugagcagaaucaagaacucauccgggauccguuugggcaccacgucgcacguaacguggcgcugacuacauuccuuaaaagaagggaggccugggaacagcagcaaggcgcuguagccaagcgccggagagcacuuaauuccauucuggaggacuga

SEQ ID NO: 59813 - RNA, 636 nt, Artificial Sequence
  derived and/or modified sequence opt3 from NOS1AP__Homo_sapiens__NP_001119532
augagccuguccucucucugccccguguucucagccgcugcaaguagccuucagguccaccuguugaaggaccaauuagccgcggaggcugccgcaagacuggaagcccaggcuaggguucaucagcuacuccugcagaacaaagauaugcuucaacacaucucccuguuggugaagcagguacaggagcucgaacugaaacugucuggccagaaugcaauggggucgcaagacucacucuuagagauuaccuuucggagcggagcccugccugugcuuugugauccaacaacuccgaagcccgaagacuugcauaguccuccacugggugcuggccuagccgauuucgcgcaccccgcaggguccccucucggacgccgagacugccuggucaaacuugaguguuuucguuuccugccacccgaggauacgccuccaccggcccagggcgaggcuuugcucggugggcuggaauuaauaaaguuuagagaaucuggaaucgccagcgaguacgaguccaacaccgacgaaucagaggaaagggauaguuggagccaggaggaacugccccggcuccuuaaugugcugcagcgccaagaguugggcgacggccuagaugacgagauugcaguuuga

SEQ ID NO: 59814 - RNA, 4305 nt, Artificial Sequence
  derived and/or modified sequence opt3 from NOS1__Homo_sapiens__NP_000611
auggaggaccacauguucggcgugcagcaaauccagcccaacgucauuagcguuagacuguuuaagaggaaaguugggggacucgguuuccuuguaaaggaacggguguccaaaccuccagucauaaucucugaucugauucgcggcggggccgcugagcagucaggauugauccaggcaggcgacauuaucuuagccgugaauggucgaccgcugguugaucuaaguuacgacagcgcgcucgaagugcugcgugggauagcuuccgagacccaugucgugcuuauccugagaggacccgaaggcuuuacaacucacuuggagacgaccuucacaggcgaugggacuccuaagaccauuaggguaacacaaccacucggacccccuaccaaagccguugaccugucucaucagccacccgcagguaaggagcagccucuggccguggauggcgcuucggggccaggaaacggcccgcagcacgcauaugacgauggucaagaagccgggucacucccccaugcuaauggauuagccccucggccacccggccaggacccugcgaagaaagcaacucgcgucagccugcagggcagaggggagaacaaugaacuuuugaaggagaucgagccagugcugagucuacucacauccggaucuaggggugugaaaggcggggcccccgcuaaggccgaaaugaaagauaugggaauacaggucgaccgggaucuggacggcaagagccacaagccgcuuccucuggguguugagaacgaccgcguguuuaaugauuugugggggaaaggcaacguacccgugguccucaauaacccauacuccgaaaaggagcaaccucccaccucaggaaaacagaguccaacgaagaauggcagccccucuaaaugcccucgauuccugaaggugaaaaacugggaaacugagguuguguuaaccgacacacugcaccucaaguccacucuugagaccggguguacagaauauaucugcaugggaucaauaaugcauccaagccagcacgcaagaaggccggaggauguccggaccaagggucaacuguuucccuuggcuaaagaguucauugaccaguacuauaguucuaucaagcguuuuggcuccaaagcccauauggagcgccuagaagaggugaauaaggagauugauacgacuagcacauaccagcugaaagacaccgaacucaucuauggggcgaagcacgccuggagaaacgcaucgagguguguaggacggauccaguggucuaagcugcaaguuuucgaugcucgagacugcacuacagcccacggcauguuuaauuacauuuguaaccaugugaaauacgcuaccaacaaggguaaucuucgcuccgccauaacgaucuucccucagagaaccgaugggaaacacgacuuuagggucuggaacucacagcugauucgguaugcaggcuacaagcagccagauggaaguacauugggcgaccccgccaaugugcaauucacugagaucugcauacagcagggguggaaaccuccacgcggaagauucgacguccucccccuguuacugcaggcuaacgguaaugauccggaacuauuucaaauuccuccagagcucgugcuggaaguucccaucaggcauccuaaguucgagugguuuaaggaccuuggcuugaaaugguaugggcugcccgcggugagcaacaugcuccuggagaucggaggccuugaguucuccgcauguccauuuucugguugguacauggggaccgaaauuggcguacgugauuauugcgacaauagccgguacaacauccuggaagaggucgccaagaaaaugaauuuggauaugcgaaagacaucaagucucuggaaagaccaggcucugguggagauuaacauagccguuuuauauuccuuccagagcgauaaggugacuaucgucgaccaccauucugcaaccgaaucauuuauuaagcacauggagaaugaauacagauguaggggaggcugcccugccgauuggguguggaucguacccccaaugagugggagcaucacaccgguguuccaccaggagaugcugaacuaccgccuaaccccuuccuuugaauaucaacccgacccauggaauacucauguuuggaaaggaacgaacggcacacccaccaagcggagagcuauugguuucaaaaagcucgccgaggcagucaaauuuucugcgaagcugauggggcaggcuauggccaaaagggugaaggcaacuauacuuuacgccaccgagacaggaaagucgcaggcuuaugccaaaaccuugugugaaaucuucaagcacgcauuugaugcuaaagugaugagcauggaggaauacgacauuguccaucuggagcacgaaacucucguucugguggugacauccacguucggcaauggugauccuccagagaacggcgagaaguucgggugcgccuuaauggaaaugcgccaccccaacucaguacaagaggaacgaaaaaguuauaagguccgguuuaauucugugagcuccuacucagacagccagaagucuuccggagacggcccugaucugcgugacaacuucgagagugcggggccgcuugccaauguuagauuuagcguguucggauugggcucuagggcuuauccacauuuuugcgcauucggucacgccgucgauacccuccuggaagaacuagggggagagcgcauccugaaaaugcgggaaggcgacgagcucuguggucaggaagaggcuuuuagaacuugggccaagaaaguguucaaggcagcgugcgauguguuuugugugggcgacgauguaaacauugagaaagccaauaacucccugaucucaaaugacaggaguuggaagcgaaacaaguuccgccuuacauuugucgcugaagcccccgaguugacccaggggcugagcaaugugcauaaaaagcgggugucggcagcuagauuacucuccaggcaaaaccugcagucuccuaaaagcucacguaguacaauauucguccgccuucacacuaauggaucccaggaacugcaguaccaaccaggcgaucauuuggggguuuuucccggaaaccacgaggaccucgugaaugcccugaucgaacggcuagaggaugcaccuccgguaaaccagauggugaaggucgagcugcucgaagagagaaauaccgcccugggcgugauuucuaacuggacggacgaacuuagguugcccccaugcaccaucuuccaggcuuucaaauacuaucuggauauuacaacuccucccaccccauuacagcuccaacaguuugcgagccuggccacauccgagaaggaaaagcagcgacuucugguucuaucaaaaggucuccaagaguacgaggaauggaagugggggaaaaacccuacuaucguggagguccuggaagaguuccccagcauacagaugccagcaaccuugcuguuaacgcagcucagucugcuucagccgcgguauuacucuauuuccagcucgccugacauguaucccgacgaagugcaccugacaguugcuaucgugucauaccgcaccagagauggagagggcccaauucaucacggugucuguucuaguugguugaauaggauccaagccgacgagcucguacccugcuuugugcggggcgccccuuccuuccaucugccacgaaacccccagguuccuuguauucuaguggggccgggaacuggcaucgcuccauuucgcagcuucuggcagcagagacaauuugauauucagcacaaggggaugaaucccugcccuaugguccugguguucggauguaggcagucuaaaaucgaccauauuuaucgugaagagacacuucaggcaaagaacaaaggcguauuucgggaacucuacaccgccuacagcagagagcccgauaagccaaagaaauaugugcaagacauccugcaggagcaguuggcggaauccgucuacagggcucugaaggagcagggugggcacauauauguuugcggagaugugacuauggccgcagacguguuaaaagccauucaacgcaucaugacccagcagggcaagcucucagcugaagaugcaggcgucuucaucagucgaaugagagacgauaaucgguaccacgaggacauuuuuggggugacacugaggacguaugaaguuaccaaccgccuucguagcgagucuaucgccuucauugaggaauccaaaaaggacacugaugagguauucucaaguuga

SEQ ID NO: 59815 - RNA, 3462 nt, Artificial Sequence
  derived and/or modified sequence opt3 from NOS2__Homo_sapiens__NP_000616
auggccugccccuggaaguuccuguuuaaaaccaaguuccaccaguacgcuaugaacggcgagaaagacaucaauaacaauguggaaaaggcaccuugugccacaagcuccccagucacucaagaugaccuccaguaucauaaccuuucuaaacagcagaaugagucaccgcaaccccugguugaaacggggaagaagaguccugagagcuuggugaaauuagaugcgaccccacuguccucucccagacacguaaggauuaagaacuggggaucggguaugacauuucaggacacucuacaucacaaagcuaagggcauacugaccugccggucaaaaagcugucucgggaguaucaugacaccuaagucccuuacccgcggaccacgagauaagcccacuccuccagacgaacuguugccgcaggccauugaguucgugaaucaguacuauggcucuuuuaaagaggcaaagaucgaggaacaucucgcccgugucgaagcugugacaaaagagauugagaccacggguacuuaccaacugaccggggaugaacugaucuucgcaacaaagcaggccuggagaaacgcucccaggugcauaggacggauccaguggagcaaucuccagguuuuugacgcccgcuccuguucaacugcgagagagauguucgaacacauuugcaggcacgugcgguauaguaccaacaauggcaacauccgcagcgcaauuacagucuuuccucaacgaucugauggcaaacaugacuucagaguguggaaugcccaguuaaucagguacgcuggguaucagaugccagauggauccauacggggugaccccgccaacguagaguuuacccaacuguguauugaucuuggcuggaagccuaaauacgggcguuucgacguugugccauugguccugcaggcaaauggacgcgaccccgaacuauuugagaucccgccugaucucgugcuggagguggcuauggaacaccccaaguacgagugguucagagaacuugagcugaagugguaugccuugccagcggucgccaacaugcuccuggaaguuggcgguuuagaguucccugggugccccuuuaacggaugguacaugggcacggagauuggcgugagggacuucugugauguacagcgguauaauauccuggaagagguggggcgacgcaugggacucgaaacucauaaacuugcaucacuguggaaggaccaggcugucguggagaucaacauugccguuuugcacagcuuucaaaaacagaaugugacaauaauggaucaccauagugcugccgaaucuuucaugaaguacaugcagaacgaguauagauccagggguggcugcccagcagacuggaucuggcuagugcccccuaugagcgggucgauuaccccagucuuucaccaggagaugcugaauuacguacucucuccguucuauuacuaccaaguugaagccuggaaaacucauguguggcaggaugagaagcggcgccccaagagaagggaaaucccucugaaaguccuugugaaggcuguccuguuugcguguauguugaugcguaaaacaauggcaucccgggugcgaguuaccauacucuucgccacggagaccggaaagucagaggcucuggccugggacuuaggcgcacuguuuaguugcgccuucaacccaaaagugguaugcauggauaaguauagacuaagcugucucgaagaggaaaggcugcuuuuggucgugacauccacuuuugguaauggggacugccccggcaacggagagaagcugaaaaagucucucuucaugcugaaagaacuuaauaacaaguuucgcuacgcuguuuucggccuggggagcucaauguauccucgguucugugccuuugcacacgauauugaccagaaauugagucaucucggagcgucccagcugaccccaaugggugagggcgacgaguuaagcgggcaagaagaugcuuucagaucuugggccgugcagacauuuaaggcagccugcgagacuuucgacgucaggggaaagcagcacauccagauccccaaacuguacaccucaaaugugacaugggauccgcaccauuaucgccuaguacaagacagucagccucucgaucugagcaaggcucuuuccucuaugcacgccaaaaacguguuuaccaugcgauugaagucgcggcagaaucugcaaagcccaacuuccucacgugcaacgauucucguugaacugaguugugaggacggccaggguuuaaacuaccugcccggggaacaucuuggcgucugcccuggaaaucagcccgcuuuggugcagggcauccucgagagaguggucgaugggccaacaccucaccaaaccguuaggcuggaggcccuagacgaaucuggaagcuauuggguguccgauaaacgccugcccccauguucacucagccaggcgcugacuuacuuccuugacauuaccacaccgccuacccaguugcuguuacagaagcucgcccaaguggcuacugaggaacccgagcggcagagacuggaagcacuuugccagccaucugaguacuccaaauggaaguuuacaaacagucccacguuccuggagguauuggaagaguuuccuagccucagggucucugccgguuuccugcuaucccagcugccaauacucaagccccgauuuuauucaaucaguagcucgcgcgaucacaccccuacugaaauucaucugacaguggcuguugugaccuaccacacacgggacggccaagggccgcuucaucacggagucuguuccacuugguugaacucucugaaaccacaggaucccgugccuugcuucguuagaaaugccagcggcuuucauuuaccagaggaccccucacacccuuguauccucaucgguccggggaccggcauugcacccuucaggaguuucuggcagcaacgucugcacgacucccagcauaagggagugcgcggcgggcggaugacgcuuguauuuggaugcagaaggccagaugaggaccacauauaucaggaagagaugcuggaaauggcgcagaaaggcguccuacaugccgugcacaccgcuuacucucgacucccugguaagcccaaaguguauguccaagauauccugcggcagcaguuggccagcgagguucugcgcguguuacauaaggaaccagggcaccucuacguaugcggagacgugagaauggcaagggaugucgcucacacacugaagcagcuuguggccgcaaaacugaaguugaacgaggagcaaguugaagacuauuucuuucagcucaaaucccagaagcgguaccaugaggauauuuucggcgccguguuuccuuacgaagcuaaaaaggaccgagucgcggugcagcccucaagccuggagaugagugcccuauga

SEQ ID NO: 59816 - RNA, 3612 nt, Artificial Sequence
  derived and/or modified sequence opt3 from NOS3__Homo_sapiens__NP_000594
augggcaaccucaagagcguggcccaggagcccgggccuccaugcggacucggucuuggccugggguugggauuauguggcaaacaagguccggcuacccccgcaccugaaccauccagagcccccgcgucucugcuaccuccagcucccgagcacucaccuccaaguagcccgcucacacagcccccugaagggccaaaguuccccagggucaaaaauugggagguuggauccaucacuuacgacacgcugucugcccaggcacagcaagauggcccuugcaccccacggcgcugucuuggcucgcugguguuuccccgaaaguugcaggggcguccgucaccuggacccccagccccugaacagcuccugagccaggcuagagacuucauuaaccaauauuacaguuccauaaaaaggucugguagccaggcacaugagcagcggcugcaggagguagaagccgagguggcugccacaggcacuuaucaacuccgcgaauccgaguuagucuuuggggcgaagcaggcauggagaaaugcccccaggugcgugggacggauccaguggggcaagcugcaaguuuucgaugcucgcgacugucgaucagcccaggagauguuuaccuacauuugcaaccacaucaaauaugcaacaaauagagguaaccuuaggagugcuauuaccguguucccacagcggugucccgggcguggagauuuucgcaucuggaauagccaguuggucagauacgccggcuauaggcaacaggacggcucugugcgaggggauccugcgaacguagaaauaacugagcugugcauccagcauggauggacaccagguaauggccgguucgacguucuaccgcuccugcuucaggcccccgaugacccuccagaacuguuuuugcugcccccugagcugguguuagaagucccacuggagcaccccacccucgagugguucgcagcucuugggcugcgcugguacgccuugccggcuguguccaacaugcuacuggaaauuggaggccucgaguuuccugccgcaccauucucagguugguacaugagcacggaaaucgggacuagaaaucugugugauccccauagguauaacauucuugaggacguggccgucugcauggaucuggacacccggacaacuagcucuuuguggaaggacaaagcugcgguugaaaucaauguggcaguacuccacuccuaccaacuggccaaggugaccauagucgaucaccaugcugccacagcaaguuuuaugaaacacuuagagaacgagcagaaggcccgcggcggauguccugcugacugggccuggauugugcccccaaucucgggcucucugaccccuguuuuccaucaggaaauggugaauuauuuccuaucccccgcauuuagauaccagccagauccguggaaggggucagcggcuaaaggaacggguauuacuaggaagaaaacauucaaggaggucgccaacgcagugaaaaucagugccagccucaugggcaccguaauggcuaagcguguuaaagccacuauccuguauggguccgaaacaggacgggcacaaucuuacgcucagcagcuuggccgauuguuuagaaaggccuucgacccuagggugcugugcauggaugaguaugacgucgugagccucgaacacgagacccugguccuugugguuacgucaaccuuugguaacggggaucccccagagaauggcgaaaguuucgcggccgcucugauggagauguccggacccuacaacagcucuccucgcccagaacagcacaagucauacaaaauucgguuuaauaguauaagcugcuccgaccccuuggugucuucguggagaaggaagcgcaaagagagcuccaacacagauucagcaggcgcccucgggacucugcgauucuguguauuuggauuagguagucgggcuuauccucauuucugcgccuuugcacgugcggucgacaccagacuggaggaacuaggcggggagaggcuccugcaacuuggacagggcgaugaauuguguggucaggaggaagccuuccgcgggugggcucaagccgcauuucaggcugccugcgagacauucugugugggcgaggacgcaaaggccgcugcgcgggacaucuucucuccgaaaagaagcuggaagaggcagcgauaccgccuguccgcccaggcagaaggacuccaacuguuaccaggccugauucacguucaucggagaaagauguuucaggcuacuaucaggucaguggagaaucuucagagcucuaaauccacccgugccacaauauugguccgccucgauaccgggggacaggaaggccugcaauaucagcccggugaccacauuggggugugcccuccaaaccggcccggccuaguagaggcccugcucaguagaguggaagauccuccggcucccacugagccaguugcagucgagcagcuggaaaagggcagcccugguggacccccaccugggugggugagggacccccgacuuccaccguguacguugcggcaggcccugacauucuuuuuagauaucaccucuccucccuccccacaacuccugcgccuucugucaacuuuggcggaggaacccagagagcagcaggaacucgaggcucugagucaagacccuaggcgguacgaggaauggaaaugguuccgaugcccaacccuacuggaggugcucgaacaguuucccagcgucgcccugccugcaccgcuuuugcugacacaguuaccacuccugcagcccagauauuacucgguuuccucugccccuagcacccaucccggagagauccaccuuacuguggcugugcuggcauaucgcacacaagauggccuagggccacuccacuacggaguauguucaacguggcugagucaguugaagccuggcgaccccgucccaugcuucauuaggggugccccuuccuuucgucugccgcccgauccaucuuuaccuuguauccucguggggcccggaaccggcauugcgccauuccgggguuuuuggcaggagagacugcaugacauagaaagcaaaggccuucagccuacucccaugacacugguuuucggguguaggugcucccaauuggaucaccucuaccgcgacgaggugcagaaugcucagcagcgaggagucuuuggcagagugcugaccgccuucucacgggaaccggauaacccaaagacauauguucaagacauccuaaggacugagcuggcagccgaagugcaucgcguacuuugccucgagcgugggcacauguuugucugcggagacgugaccauggcuacgaaugugcugcagaccguccagagaauuuuggccacagagggcgauauggaacuggacgaggcuggugauguuaucgggguguuacgggaccagcaaagguaccacgaagauaucuucggacucacucugcgcacccaggagguaacaagccgaauuagaacucagaguuucucucuucaagaacggcagcugaggggcgcagugccuugggccuuugaucccccagguuccgacaccaacagccccuga

SEQ ID NO: 59817 - RNA, 906 nt, Artificial Sequence
  derived and/or modified sequence opt3 from NOSIP__Homo_sapiens__NP_057037
augaccagacacggcaagaacugcacagccggggcuguguacacuuaucaugagaaaaagaaagacacggcagccagcggauacgguacccagaauaucaggcugucccgggaugcggucaaggacuucgauuguugcugucucucucuucaacccugccacgacccuguugugacaccagauggcuaucuguacgagcgcgaggcuauuuuggaauauauauuacaucagaaaaaggagaucgcccgacagaugaaggcauacgaaaaacagcgugggacuagaagggaggagcaaaaggaacugcagcgggccgcuucacaggaccacguacgcggauuucuagagaaagaaagugcaauugugagcagaccgcucaaccccuucaccgccaaggcucuguccggcacaucuccugaugacguccagccaggucccucgguggggccuccaucaaaagauaaggacaagguucuucccagcuuuuggaucccuagucugaccccagaggccaaagcgacuaaguuggagaaaccguccaggacagugaccugucccaugucuggaaagccucuccggaugagcgaucugacgccaguccauuucacuccccuggacuccucaguggaucgcguaggccucauuacccgaagugaaagauauguuugcgcagugacaagggacagcuuaucuaaugccacuccuugugcuguccugcggccauccggcgccguggugacccuugagugcgucgaaaaauugauccguaaggacaugguugaucccgugacaggggacaaacugaccgaucgcgacauaaucguacuacaaagaggagguacgggcuuugcagggucaggagugaagcuccaggcugaaaagagcaggccggucaugcaggccuga

SEQ ID NO: 59818 - RNA, 1521 nt, Artificial Sequence
  derived and/or modified sequence opt3 from NOSTRIN__Homo_sapiens__NP_001034813
augagagacccccugaccgauugcccuuacaacaagguguauaaaaaucucaaggaguucagccagaacggcgaaaauuuuuguaaacaagucacauccguucuucagcagagggccaaccuggagaucucuuacgcuaagggguugcagaaauuagcaucaaagcugaguaaggcccuacaaaauacucggaaaagcugcguguccucugcgugggcuugggccucggaaggaaugaagucaacggcagaccuccaccagaaacuggguaaggccauugagcuugaagcuauaaaaccaaccuaucagguacugaacgugcaggagaagaagcgcaaaucuuuggauaaugaggucgaaaagacagcaaaccucgugaucaguaauuggaaccaacagauuaaagccaagaaaaagcugaugguuuccacuaaaaagcaugaggcucuguuccagcucguggaaucuagcaagcaguccaugaccgagaaagagaagcgaaaauuacugaauaaacuuacaaaaucaaccgaaaaguuggagaaggaagacgagaacuacuaucaaaagaauauggccggcuacaguacucgucugaagugggaaaacacacuagagaauuguuaucagagcauccucgagcuggaaaaagagaggauucagcuucugugcaacaacuugaaucaauacucucagcacaucucccucuuugggcagacccugacgacuugucauacccagauacacugcgcgaucucaaagauugauaucgaaaaagacauucaagcagucauggaggaaacagccaucuuaagcacugagaacaagagugaguuccugcucaccgauuacuuugaagaggacccgaauagcgcuauggauaaggaaagacggaaaucccuucugaagcccaaauugcuacgccugcagagagacauagagaaggccagcaaagauaaggaaggacucgagaggaugcugaagacauauucgucuaccuccucauucagugacgcaaaaagccagaaggauacggcugcccuuauggacgagaacaaucugaaauuggaccuccuggaagcgaacuccuacaaguuaucuagcaugcuggccgagcuagaacagcggccucaaccaucacaucccuguaguaauuccauuuuucgcuggcgagagaaagagcacacucacagcuaugugaagaucucuagaccuuuccucaugaaaaggcuggaaaacauuguaucaaaggcaaguagcggcggucaguccaauccagggucuucgacacccgcuccuggagccgcucagcuuagcucccgguugugcaaggcccuguacucauuucaggcacgucaagaugacgagcucaaccuggaaaaaggcgauaucguuaucauucaugagaagaaagaaggcggguggugguucggaagucuuaaugguaagaaaggccacuuuccagccgcuuauguggaggagcugccgucuaacgcggggaauaccgcaacuaaggccuga

SEQ ID NO: 59819 - RNA, 7668 nt, Artificial Sequence
  derived and/or modified sequence opt3 from NOTCH1__Homo_sapiens__NP_060087
augcccccucugcucgccccacuucugugcuuggcuuuacugccggcacuggccgcgcgaggccccagguguagccagccuggggagaccugccucaacggggguaagugugaagcugccaauggcacugaggcaugcgugugugggggagccuucgucggcccacggugccaagaccccaacccuugucuguccacuccaugcaaaaaugcugguacgugucacguuguggaucgccgagggguggcagacuacgccugcucuugugcucuuggauuuucaggcccccugugcuugaccccucucgauaacgccugccugaccaauccaugucguaacggcgggacuugcgaccugcucaccuuaacagaauauaaguguagaugcccgcccggauggagugguaaaagcugucagcaggcggauccuugcgcauccaauccaugugccaacggcgggcagugccugcccuucgaggcuucuuacaucugucacugcccuccaucguuucacggacccaccuguaggcaagacgugaaugaaugcggccagaagccgggucuuugccggcaugggggaacuugucacaacgaggucggcucauaucgcugcguguguagagccacacauaccggcccuaauugcgagaggcccuacguuccauguagcccuagucccugccagaacgggggaacgugucggccaacuggugaugugacccacgaaugcgcauguuugcccggcuucacagggcagaauugcgaggaaaacauugacgauuguccuggaaauaacugcaaaaacggcggugcuugcgucgacggggugaauacuuauaacugucgcugcccaccggaguggaccggccaauacuguacagaggauguagacgaaugccagcugaugcccaaugccugucagaacggaggaaccugccacaauacgcaugggggauauaacuguguuugcgugaaugguuggacuggcgaggauuguuccgaaaacauagacgacugcgcgucugccgcauguuuucacggggcuacaugccaugaucgagucgccagcuucuacugcgaguguccucacggaagaaccggccuucucugccaccugaaugacgcuuguaucuccaacccaugcaaugaagguucaaacugugauacuaaucccgugaacgggaaggccauuugcacauguccuaguggcuacaccggaccagcaugcagccaggacguggaugaguguucucuuggcgccaaucccugcgagcaugcugggaaguguaucaacacgcugggauccuuugaaugccaaugcuugcaggguuauaccggcccgaggugugagauugacgucaacgaaugcguuucaaauccuugucagaacgaugcgacaugccucgaccaaaucggggaguuccaguguauaugcaugccaggauacgaaggcgugcacugugagguaaauacugaugagugcgcaagcagucccugucugcauaacggucggugcuuagacaaaaucaaugaauuucagugugagugcccuaccggguucacaggccaccugugccaguaugauguggacgaaugugccucuacucccugcaagaacggagcuaaaugucucgacggcccaaauaccuacacaugcgucuguaccgagggguauacuggaacgcauugcgaaguggauauugacgagugugauccugaccccugccacuacggcuccuguaaggaugguguugccacauuuaccugccuuugucguccaggguauacuggacaccauugcgagaccaacaucaaugaauguagcucgcaaccgugccgccacggcgguacaugccaggacagagauaacgcauaccuguguuucugcuugaaaggcaccacugggccuaauugugagauuaaccuagacgauugcgccucuucccccugugacucaggaacaugccuggauaagaucgacggcuacgaaugugcuugcgagccaggguauacgggaaguauguguaauauaaacauugaugagugcgccggcaaucccugucauaacggugggaccugcgaagacggaaucaacggcuuuacuugcagaugcccugaggguuaccacgacccaacaugccucagcgaagugaaugaguguaacuccaaucccugcguccacggcgcaugucgggauucucugaacggguauaagugcgacugugauccuggauggagcggcaccaauugcgacauuaacaauaacgaaugugagucaaauccgugcgugaacgggggaacauguaaagauaugacaaguggcuacguauguaccugccgagaggguuucuccgggccaaauugucagacgaacaucaaugaaugcgcgagcaaccccugucuuaaucagggaaccugcaucgacgauguugcuggcuauaaguguaacugccuguugccuuacacaggugccacuugugaggugguccucgcaccaugcgcccccucuccuugucgcaacggcggggaaugcagacaaucagaggacuaugaaaguuucagcugugugugcccgaccggauggcagggccagacaugcgaggucgauauuaaugagugugugcugucccccugcaggcauggggcuucuugucagaacacucacggaggcuaccggugccauugucaagccgguuacucggggcgcaauugcgaaaccgacauagaugacuguagaccaaacccuugccacaauggaggcagcuguacggauggcaucaacacagcauuuugcgacuguuuacccggguucaggggaaccuuuugcgaggaagacauuaaugagugcgcuuccgauccaugucguaacggugccaauugcacugacuguguugauucauauacaugcaccuguccugcgggcuucagugggauccauugcgaaaacaauacucccgacuguaccgagucuagcugcuuuaacggaggcacauguguggaugguauaaauuccuucacgugccuguguccaccgggguuuaccggaucauacugccagcacgacguaaacgagugcgauagccagccuugucuacacggcggcacuugccaggacggguguggaucuuaucggugcacauguccccaagguuacaccggcccaaauugccagaaccucguccauuggugugauuccagucccugcaaaaaugggggaaaguguuggcagacacacacucaauaucgaugcgaauguccuagcggcuggaccggucuguacugcgacgugccaucuguuuccugcgagguggccgcucagagacagggggucgauguggcaaggcuuugucagcauggaggcuugugcguagacgccggcaacacgcaccauugucgcugccaagcuggguauacaggaucauacugugaagaccugguggaugagugcagucccagcccuugucagaacggugcaaccugcacugacuaccucggcggguauucguguaaaugcguugcaggauaccacggcgucaauuguuccgaggaaauugaugagugccugucucacccgugccagaacggugggaccugucuugaccugccaaauacauauaagugcagcuguccccggggaacucagggcgugcauugcgaaaucaacguggaugacuguaauccucccgucgauccaguuucaagaaguccuaaaugcuucaacaauggcaccuguguggaccaaguagggggcuacuccugcacaugucccccagguuuuguaggcgagaggugcgaaggggaugucaacgaguguuugucuaauccuugcgacgcgcgcggaacgcagaacugcgugcagcgaguuaaugauuuccacugugagugccgggccggccauaccggucguagaugugaaagcgugaucaacgggugcaagggaaagccguguaaaaauggcggcacuugcgcugucgccuccaacacagcaaggggguuuauuuguaagugccccgcuggauucgagggugccaccugugaaaaugacgcacgcacuugcggcucacuccggugucugaacgggggaacaugcaucagcggcccaagaaguccuaccugcuuaugucugggucccuuuacggggccagagugccaguucccugccucuucccccugucuaggcggaaacccgugcuauaaucaaggcacuugugaaccaaccagcgagucgccuuucuacaggugccucugucccgcuaaauuuaacgggcugcuuugccacauuuuggauuauucauucggagguggcgcggggcgagacauaccacccccucugaucgaggaagccugugagcucccggaaugccaggaggacgcaggaaauaagguguguucucugcagugcaacaaucacgcuugcggcugggaugguggggacuguaguuuaaacuuuaaugaucccuggaaaaacugcacacaaucccugcaguguuggaaguacuucagcgacggccauugcgauucucaguguaauagcgccggaugccuuuuugacggcuucgauugucagcgcgccgaagggcaaugcaacccauuguacgaccaguauuguaaggaucacuuuuccgacggacauugcgaucaggguuguaauucagcugagugcgagugggacggccucgauugcgcagaacacguuccugagcggcuggccgcggggacccuagugguagucgugcugaugcccccugaacagcucagaaacaguagcuuccauuuucugagggagcuuucucguguguugcacacuaaugucguuuucaaacgcgacgcucacggacaacagaugauuuuuccauacuauggccgggaggaggaacugagaaagcaucccaucaaaagggccgcagaagguugggccgcuccugacgcauuacucggacaggugaaggccucccugcuuccaggcggaucagagggcgggcgacggcgcagagaacuggaucccauggacguaaggggaaguaucguguacuuggagauugauaaccggcaguguguccaagcgagcucccagugcuuccagucugcuacagacguggccgcauuucucggcgcccuggcuucgcuagguagccugaauauaccguauaaaaucgaggccguucagucagaaaccguggagccuccacccccugcacaacuccacuucauguacgucgcugccgcggccuucgugcugcuauuuuucguuggguguggaguguugcugucccgaaagagacgcaggcagcauggccaguuaugguuuccagaagguuucaaggucagugaggcaucuaaaaagaaacgucgggaaccccucggcgaggauagcguagggcugaagccgcuuaaaaacgcuuccgacggagcccugauggaugacaaccaaaaugaguggggcgaugaagaccuagagacaaagaaguuuagauucgaggaaccugugguucuccccgaucuggacgaccagacugaucacaggcaguggacccagcaacacuuggacgcugcagaucugcgcaugucagccauggccccaacgccuccccagggggaaguggacgcugauugcauggacgucaacgugcgaggaccagauggcuuuacacccuuaaugauugcgucuuguagcggugggggacucgagaccggcaauagugaggaagaggaagacgccccugccguaaucuccgauuucauuuaucagggugcuagccugcauaaccagacugacagaaccggcgagacagcccuucaccuggcagcccgguacucuaggucagaugcugcgaaacgcuugcucgaggccuccgcagacgcuaauauccaagauaacauggggcguacuccacugcaugccgcagugagugccgacgcucagggagucuuucagauacuaaucagaaaucgggccaccgaccuggaugcgaggaugcacgacggcacgacaccgcuuauucucgcagcccgccuggcuguugaagggauguuggaggaucugaucaacagccaugccgacgugaaugcuguggaugacuuaggaaagucggcacuccacugggccgcugccgucaacaauguggaugcagcgguuguacugcuuaaaaacggcgccaauaaggacaugcagaacaaucgagaagagacaccccuguucuuggcugccagagaagguucuuacgagacugcaaaagugcuccuggaucacuuugcuaaccgggacauuacagaucauauggacaggcuaccucgcgacaucgcccaagagagaaugcaccaugauauagucaggcugcuugacgaauauaaccucgugcgguccccacagcugcacggggcacccuugggaggcaccccuacuuuaagcccaccccugugcucaccuaauggcuaccucgggagucugaagccgggaguucaggguaaaaaggugcguaagccaucuuccaaaggccuugccugugggagcaaggaggcuaaagaucugaaggcgcgcaggaaaaagucacaagacggaaagggcugcuugcuagauaguagcgguaugcugucccccgucgacucucucgaaagcccucacggguaucuguccgauguggccucacccccacuuuuaccuucucccuuccagcagaguccaucgguaccgcugaaccaucucccuggaaugcccgacacacacuugggcauuggccaucugaaugucgcagcuaaaccagagauggccgcccucgggggagguggcagacuggcauucgaaaccgggcccccuaggcuuagccaucugccaguggcuuccggaacgucuacuguuuugggcucaagcuccgguggggcccuaaacuuuaccgugggaggcaguacaucucugaauggccagugugaguggcucagccgguuacaaucagggaugguccccaaccaguacaauccucugcgcggauccguggcgccggguccacuuaguacccaggcucccagccugcagcauggcaugguugggccucuccacucuuccuuggccgcaucagcccugagccaaaugaugucguaucagggacucccaucuacaagacuggcuacucagccccaccuugugcagacccaacagguccagccucagaaccuacaaaugcagcagcaaaaucugcagcccgcaaacauccagcagcaacagaguuugcagccaccgccucccccaccucagccccauuuaggcguguccagcgccgcgucaggucaccuggggagguccuuccucucuggagagccaagccaagcugauguacagccucugggccccaguucccuugccgugcauacgauucugccgcaggaaagcccagcacucccuacaucuuugcccucaagucugguuccacccgucacugccgcucaguuucuaaccccuccgucccaacacagcuacucuucgccaguggacaauacacccucacaucagcuacaggugccugagcaccccuuccucaccccaagcccugaaucccccgaucaauggaguucuagcuccccacacucaaacgucagugacuggucugagggcguaagcuccccuccgacuucaaugcagagccagaucgcccggauacccgaagcauuuaaguga

SEQ ID NO: 59820 - RNA, 7404 nt, Artificial Sequence
  derived and/or modified sequence opt3 from NOTCH2__Homo_sapiens__XP_011539821
augaacaccuaccuggugagcgccgucucccucagaugcguuucuguggagagguauaaggcacuucagugccgggacggcuacgaacccugcguaaaugaggggaugugcgugacauaucacaacggcacugguuacugcaaauguccugaaggcuuccugggggaguauugccaacaucgcgauccaugugaaaagaaucgaugccagaacggcggcacgugugucgcucaggccauguuggguaaagcgaccugccguugugcuucaggguuuacaggcgaggacugccaguacaguacuagccacccgugcuucguguccagacccuguuuaaauggcggaaccugccauaugcugucuagggauacauaugaguguaccugccaaguuggguuuacugggaaggaaugucaguggacagacgccugccuaucgcacccuugugccaacgguucaaccugcacgacuguggccaaucaguucagcuguaaaugccucaccggcuuuacagggcagaagugugagacugaugucaacgaaugcgacaucccaggacauugccaacacggcgguaccugucugaaucuucccgggaguuaccagugccaguguccucagggauucacaggccaauacugcgauucccuguaugugccaugugcucccucuccuugcguaaacggcgggaccugucggcagacgggagacuuuacuuucgagugcaauuguuugccagguuuugagggcagcacaugcgaacgcaacauugaugacuguccgaaucacagaugccagaacgggggaguuugcguggauggcgucaauaccuacaacuguaggugucccccucaauggacuggucaguucuguacagaggacguggaugaaugccuccugcagccaaacgccugucagaaugggggaaccugcgccaaccggaauggaggcuaugggugugugugcgucaacggaugguccggugacgacuguucagagaauauagaugacugcgcuuuugccaguuguacgcccggcucuaccugcaucgaucgcguugcgagcuucuccugcauguguccugaagggaaggccggacugcucugccauuuagacgaugccuguauuucaaacccaugccacaaaggcgcucugugugacacaaauccccuuaacggucaauacaucugcacuuguccgcagggguauaagggcgccgauugcaccgaggacguggaugagugugcaauggcuaauagcaacccuugcgaacaugccggaaaauguguaaauacagacggcgcguuucacugcgagugcuugaagggguacgccggaccccgaugugaaauggauauuaacgagugccacagugacccaugucagaaugacgcaacuugccuggauaaaaucgguggcuucaccugucuaugcaugccuggguucaagggagugcauugugaacucgagauaaacgagugccagucuaaucccugugucaacaacggccaaugcguggacaagguuaauagauuucagugucugugcccacccgguuucacagggccugugugccagaucgauauugacgauuguuccagcaccccaugccuuaacggcgcuaaauguaucgaccacccgaauggauaugaaugccagugugccacuggcuuuacggggguccugugcgaggaaaacauugauaauugugaccccgauccuugccaucacggacaaugucaggacggcaucgauucguacacaugcauauguaacccagguuacaugggggcuauuugcucugaccagaucgaugaguguuauuccucacccugcuugaaugacggaaggugcauugaccucgugaacggcuaccaguguaauugccaaccugguaccaguggcguaaacugugaaaucaauuucgaugacugcgccagcaacccauguauccaugggauuugcauggauggaauaaaucgguauuccuguguuugcucucccggcuuuacugggcagcguuguaacaucgacauugaugagugcgcaagcaauccgugucgcaagggagcaaccugcaucaacggcgugaacgguuucagaugcauauguccugaggggccacaccaccccucaugcuacagucaggucaaugaaugucuguccaacccuugcauucauggaaauuguacaggcgguuuaagcggcuauaaaugccugugugacgcugggugggugggaaucaacugcgaggucgauaagaaugaaugucucucuaaccccugccaaaauggcgggaccugugacaaccuugugaauggauacaggugcacuugcaaaaagggcuuuaaagguuauaacugucagguuaauaucgaugagugcgcgucaaacccaugucugaaucaggggacaugcuucgacgauauuaguggauacacgugucacugcguguugccuuacaccggcaagaacugucagacuguacuagcacccugcagcccaaauccgugugagaacgccgcugucugcaaggaauccccuaacuuugagucuuauacaugucugugcgcccccgguuggcaaggccagcggugcaccaucgacauugaugaauguauaucgaaaccaugcaugaaucaugggcucugucacaacacacagggaagcuacaugugcgagugucccccuggcuucuccgggauggacugcgaagaggacaucgaugacugucuggcaaauccaugccagaacggaggcucauguauggauggugugaauacuuuuaguugccuuugucugcccggguucaccggagacaagugccaaacggauaugaacgagugcuugucugaaccuuguaaaaauggcggaaccugcagcgacuauguuaacuccuacacauguaagugccaggccggguuugauggagugcacugugagaauaacauuaaugaaugcacugagucaagcuguuucaacgguggaaccugcgucgacgggaucaauucuuucuccugucucugcccggugggauuuacaggcaguuucugucugcaugaaaucaacgagugcagcucucacccaugcuuaaaugaggguacuuguguagaugggcugggaaccuaucgaugcuccuguccccuaggcuacacgggcaaaaacugccagacacucgugaaucuguguucacgcaguccuugcaagaacaaggggaccuguguucagaaaaaggcugaaagccaaugccuuuguccaucgggaugggccggugcauauugcgacguccccaacguguccugugauauugcggcuucuagaaggggcguguuggucgagcaucugugccagcacagcgggguuugcauaaaugccggaaacacucauuacugucagugcccucucggcuacacagguucauauugugaggaacaacuggacgaaugcgcaaguaauccgugucagcacggggcaaccugcuccgacuuuaucggaggcuaccggugugagugcgugcccggcuaucagggggugaacugugaguacgaaguagaugagugccagaaucaaccaugucagaacggagguacuugcauugaccuugucaaucacuucaaaugcucuuguccucccggcacccgcgggcuguugugcgaagagaacaucgaugacugugcuagaggaccacauugccucaauggcggucaguguauggauaggauugggggauauagcugccguugucugccuggcuuugccggcgagcggugcgaaggggacaucaacgaguguuuauccaaucccugcucaagcgaaggaagucuggauuguauacagcuaacaaacgacuaccucugcgugugccgaucugcauucacggguagacacugugagaccuuuguugaugugugcccacaaaugccgugucugaauggcgggacuugcgcugucgccuccaacaugccugacggauucaucuguaggugucccccaggcuuuagcggugcgcgcugucagucgucaugcggacaggugaagugucggaaaggagaacagugcguucauacagccucuggccccagauguuucugcccuaguccaagggauugcgaguccggcugugcuagcucucccugccaacacgggggaagcugucauccucagcgccagccgccauauuacuccugccagugugcacccccuuuuucagguagucgaugcgagcuuuacaccgcacccccaagcacaccucccgcuacuuguuugucucaauauugcgccgacaaggcacgggauggcgugugugacgaagcgugcaauucccacgccugucagugggacgggggagauugcucacugaccauggagaacccaugggcuaacugcaguagcccucucccguguugggacuacauuaauaaccagugcgaugaacuguguaauacgguagagugcuuauucgacaacuuugaaugucaaggcaauuccaagacaugcaaauaugauaaguacugugccgaccacuucaaagauaaccauugcgaccaggguuguaauucugaggagugcgggugggauggccuggacugugcagcugaucagcccgaaaaccuugccgagggaaccuuggucaucguggugcucaugccaccugaacagcugcuacaagacgcacguucguuccugagagcccucggcacucugcuucacaccaauuugaggauuaagcgcgauagccagggggagcugauggucuaucccuacuauggagaaaaaucagcugcgaugaagaagcagcggaugacaagaagguccuuaccaggugagcaggagcaagaaguugccggcaguaaaguguuucucgagaucgacaaccgacagugcguacaggacucugaucauugcuucaagaauacugacgcagcugccgcccugcuugcuagccacgcaauacaggggacccuguccuacccuuuggugucagucgugucugaaagccucacacccgagcgcacgcaacugcuauaccugcucgccguugcgguggucauuauccuguuuauuauccuuuugggagugauaauggcuaaacggaagagaaaacacggcagucugugguuaccggaggguuucacccucaggcgugaugccuccaaccauaagcgccgggaaccaguugggcaggacgcagugggccugaaaaaucuuagcguccagguaucugaggccaaccugaucggaacuggcacaucagaacacuggguggaugacgaggggccucaacccaagaagguuaaagcugaagaugaggcacuacucuccgaggaagacgauccaauugacagaaggcccuggacccagcagcaucuggaggccgcggauauccgacggacuccuaguuuggcucugacaccgccccaggccgaacaagagguggacgucuuagacgugaauguacgcggaccagaugguuguaccccucucaugcuggcaagccuuagaggcgggucgucugaccuguccgaugaagacgaggaugccgaggacagcucagcuaacauuaucacggauuugguguaucagggagccagucuccaggcacagacugacaggaccggcgaaauggcucugcaccuagccgcgcgguacucucgagccgaugcagcuaagagacugcuugacgccggugcugaugcaaacgcccaagacaauauggggcgcugcccccuccaugccgcugucgcggcagaugcccagggcguuuuucagauacugauuaggaaccgugugacagacuuggacgcucggaugaaugauggaaccacuccucugaucuuagccgcaagacucgccguggagggcauggucgcugaacugaucaacugucaggcggacgugaaugccguugaugaccacgggaaauccgcacuucacugggcugccgcaguaaacaauguggaggccacacuguugcuccugaagaacggagcuaauagggauaugcaagacaacaaagaagagaccccacuauuccuggccgcgcgcgagggcagcuaugaagcagccaagauucuucucgaucauuuugcuaaucgagacaucacagaucacauggacagacugccccgggaugucgccagggaccgcaugcaucacgacauugugcguuuguuagaugaguacaacguuacuccuucaccacccgguaccgugcugacgagugcucucagcccggucauaugcgggccuaauagauccuuccugucucuuaagcacacaccaaugggcaaaaagagccggaggcccuccgcaaaaucaaccaugccuacuucucugccaaacuuggccaaggaagcuaaagacgccaagggcagucgccgaaagaaaucgcuaagcgagaaggugcagcuguccgagucuucaguaacccucagccccgucgauucccuggaaaguccgcauacauaugugucugacacuaccagcucaccuaugaucacgucccccgguauucuucaggcaaguccaaauccuauguuagcgacagccgcucccccagcccccguucacgcacagcaugcucugagcuuuucuaaccuccacgagaugcaaccuuuggcccauggcgcauccaccgugcugccaucagucagccagcuccugucgcaccaccauaucgugucuccggggaguggauccgccggcagccuuucaagacugcaccccguuccugugccagcugauuggaugaaccggauggaagucaaugagacucaguacaacgaaauguucgggaugguguuggcgcccgccgagggaacacauccuggcauugcaccacaauccaggcccccugaggguaaacacaucaccacuccgcgcgaaccacuacccccuauaguaacauuucagcugauccccaaggggucuauugcucagccagccggagccccucagccccaaagcaccuguccaccggcaguggcuggcccucuccccacgauguaucagaucccagagauggccagauuacccaguguugcguucccuacugcuaugaugccacagcaggacggucaagucgcccagaccauucugcccgcauaccacccuuucccggccuccgugggcaaauacccaacacccccuagccagcauucuuaugcuucaaguaaugcagccgaaaggaccccaucccacagcgggcaucuucagggagagcaccccuaccugacaccuucucccgaaucgccagaucaauggucaagcuccaguccgcauucugcgagcgacugguccgaugugacuaccucaccuacgcccggcggggcuggaggcggucagcgggggccaggaacacacaugagugagccuccccacaacaauaugcaggucuaugccuga

SEQ ID NO: 59821 - RNA, 6966 nt, Artificial Sequence
  derived and/or modified sequence opt3 from NOTCH3__Homo_sapiens__NP_000426
augggccccggggcaagaggaaggcggcgccgacguagaccuaugucaccaccgcccccuccacccccugugagggcucugccacuccuucuguuguuagcaggucccggcgccgcggcuccuccaugccuggacggguccccgugcgccaacggaggccggugcacccagcuccccucucgcgaggcagccugucucugcccuccagguugggucggggaaagaugucaacuggaggaucccugccacucaggaccuugugcuggcaggggcguuugccagaguuccgugguagcagggaccgcccgguucuccugucgcugcccacgaggauuuagaggucccgacuguucucuuccggauccuugccugucgucacccugcgcucauggcgccagguguagcguggggccagacggacgguucuugugcaguuguccucccggcuaccagggucguuccugccgcucugaugucgacgaauguagagugggggagccaugcaggcacggaggcacuugucucaauacgcccggcagcuuucggugccaguguccugcgggguauaccggaccacugugcgaaaacccggcaguucccugugccccuuccccaugccgaaaugguggcacaugccgccaaucaggggaucugacuuacgacugugcuugccuccccggauucgagggccagaacugugaggugaaugucgaugacugcccuggucauagauguuuaaacgggggaaccugcguggauggaguaaauacauauaacugucagugcccacccgaauggaccggccaguuuuguacugaggacguugaugaaugccaacugcagccgaaugccugucacaacgggggaacaugcuucaauacccuugguggccauaguugcgugugugucaacggguggacgggagagagcugcucucagaauaucgacgacugugcaacugcugugugcuuucacggcgccaccugucacgauaggguggcguccuucuacugcgccuguccuauggguaagacaggguugcugugccaucuagacgaugcaugugucucaaacccaugccacgaggacgcuauuugugauacuaaucccguuaacggccgggccauauguaccugcccucccggauuuacaggcggggcuugugaccaggauguggacgaaugcagcaucggagccaacccaugugagcaucucggucgcugcguaaauacccaaggcaguuuccugugucagugcgggagaggauauacgggcccuaggugugaaacugaugugaacgagugccuuucuggucccugucguaaucaggcaacaugccuggaccggauugggcaauuuaccuguaucugcauggccggcuucacuggaacauacugcgaagucgauauugacgagugucaguccagcccaugcgugaacggcgggguuuguaaagaccgagugaauggauuuucgugcaccuguccgucuggcuucuccgguucaacgugccaguuggaugucgacgagugugcuaguaccccuugcagaaacggggcgaaguguguggaucagcccgacggauaugaauguaggugcgcagagggcuucgaagguacacucugcgaucgcaauguagacgauugcagcccagaccccugccaccacggccggugcguugaugggaucgccuccuuuucuugugcuugcgccccuggauacacuggcaccagaugugagagccaaguggacgaaugcaggucacagccaugucgccaugggggaaaaugccuggauuuagucgacaaguaccugugucgaugccccaguggcacaacuggugugaacugugaggucaauauagaugacugcgcauccaacccuuguaccuucggggugugccgggacggaaucaaucguuaugauugcguuugucagccgggcuuuacagguccacucugcaacguggagauuaaugaaugugccagcucucccugcggcgaagggggcucauguguagacggcgaaaacggguucagaugccuuuguccuccaggaagucugcccccuuugugccuaccgcccagccacccaugugcucaugagccuugcucccacggcaucuguuacgaugcccccgguggguuuaggugcgucugcgaaccaggauggucuggcccucgcuguucgcagagccuggcacgggacgcgugcgagucccaacccuguagagcuggugggaccugcucaagugauggcaugggauuccauuguacuugcccaccgggcgugcaggggaggcagugugagcuccugucuccuugcacgcccaauccaugugaacacggaggccgaugcgagagcgcccccggucagcuuccuguuuguuccugcccacaaggguggcagggaccccgcugccagcaggacguggaugaaugugcaggcccugccccgugcggcccacacgggauuuguacaaaccuggcuggaucauuuagcugcaccugucaugguggcuauacugggcccucuugcgaccaagauaucaacgacugugauccuaaucccugcuugaacggaggcuccugucaggacggugucgggaguuucagcugcucuugucucccaggauuugccggcccucggugcgcaagagauguggacgagugccuguccaaucccuguggcccagggaccugcacagaccacguagcuucauucaccuguacuugcccuccgggauacgguggcuuucauugugagcaggauuuacccgacugcaguccaagcucguguuucaacgggggaacaugcguggauggcguuaauuccuuuucuugucugugcaggccugguuauacgggggcccacugucaacacgaagcggaccccugccuaagccguccaugccuccauggaggcgucuguucagccgcucacccuggcuuccgcugcaccugucuggagaguuucacugggccccagugccagacacuuguggauugguguucccggcagccgugccaaaacggagguagaugugugcagaccggcgcauacugcuuguguccaccuggguggucuggaaggcugugcgacauacgaagccuccccugucgggaagccgcugcccagauuggcguccgccuggagcagcuuugccaagccggugggcagugcguugaugaagacuccucacauuauugugugugcccagagggaagaacaggcagccacugugagcaggaaguggaucccugccuggcgcagccuugucaacauggcgggacuugcaggggauacauggguggcuacaugugugagugcuugccgggguauaauggagacaacugugaagaugacguagacgagugcgccagucagcccugucagcacggcgguucuugcaucgaucucgucgcucgguaccugugcuccuguccaccugggaccuuaggagugcugugcgaaauuaaugaggacgauuguggccccggcccuccacuagacagcgggccccgaugccuccacaacggaacguguguugaucugguggguggcuuuagaugcaccuguccuccaggguauacaggacuucgcugcgaggccgacaucaaugaauguaggucgggcgcaugccaugcugcccacacucgugauuguuugcaagaccccggugggggcuuccggugccugugccaugcaggauuuucaggcccgagaugucagaccguccucucuccuugcgagagucagccaugucagcacgggggacaaugcaggcccuccccugguccaggcgggggacugacauucacuugucauugcgcccagcccuuuuggggcccgcgcugugaacgaguggcuagaagcugccgggaguuacaguguccuguuggugugcccugccagcaaaccccaagggggccucgcugugcgugucccccaggccugucuggacccagcugccguuccuucccuggcucaccaccgggggccaguaacgcaagcugugcugccgcccccugccuucacggagguucuuguagaccugcuccauuggcacccuuuuuccggugcgccugugcgcagggcuggacggggccuaggugcgaagcuccagccgcagcccccgagguauccgaggaaccucgcuguccgcgagcugcaugccaggccaaaagaggagaucagcggugugacagggagugcaauucaccaggcugugguugggaugggggcgacugcagucucagcgucggagaucccuggcgccaaugcgaagcgcugcaguguuggagacuauuuaacaauuccaggugcgacccugcuuguucuucgcccgccugccuguacgacaacuucgauugucacgcaggcgggcgggagcguacaugcaacccaguguaugagaaguacugugccgaccauuuugcugauggacgcugcgaccagggcuguaauaccgaagagugcgguugggaugggcucgacugugccagcgaagugccugcacugcuugcucgaggagucuugguucugacuguguuacuacccccagaggaacugcuuagaucauccgccgauuuccugcagagguugagugcgauccuccggacaucucugcgcuuuagacuagacgcccacggccaagcaaugguauucccguaucauaggccuagccccgguuccgagccacgggcucgaagagagcuggcccccgaagugauuggcucagucgugaugcucgagauagauaaccgccugugccuucagucuccugaaaaugaccacugcuucccagaugcucagagcgcagccgacuacuugggggcccugagugcuguugagagguuagauuuucccuacccucuccgggacgugcguggagaaccgcuggagccacccgagccuuccgucccacuucugccccuacucguggcgggcgcaguucuguugcuggugaucuuaguccucgggguaaugguggccagaaggaagcgcgaacacagcacccugugguucccugagggauuuucucuucauaaagacguugcuucaggccacaagggucggcgagaacccguggggcaagaugcccugggaaugaaaaacauggcaaagggcgaguccuugaugggugaagucgccacugacuggauggauaccgaguguccagaggcuaaaagacucaagguggaggagccgggcaugggggcggaagaggccguagacugcaggcaguggacacagcaucaccugguggcagcugauauucgcgucgccccugcaauggcccuaacgcccccacagggagacgcugaugccgacggcauggauguuaaugugcgggggccugacggauucacaccccugaugcuugcgaguuuuuguggcggugcacucgagccaaugccuacugaagaggaugaagccgacgacacaagcgcuucgaucauaucugaucugauuugccaaggggcccaguugggagcuagaaccgaccguacaggcgagacugcacugcauuuagccgcuagguaugcccgggcagaugcggccaagcgccuccuggacgcuggcgccgauaccaacgcacaggaccacuccgggcgaacgccccuucacacagcugugaccgccgaugcacagggagucuuccaaauccugaucagaaauaggagcacugacuuggaugcccggauggcugacgguucaaccgcgcucauucuggccgcacgccuagcuguggaaggcaugguugaggagcugaucgccagucaugccgauguaaacgcaguggacgaacuugggaaaucugcucuccacugggccgcggcugucaauaacguggaggccacacuggcauuguuaaagaauggagccaacaaagauaugcaggacuccaaggaagagacuccgcuguuucucgcugcaagagaaggcagcuacgaggccgcgaaacugcuucuggaccauuucgcuaauagggagauuaccgaucacuuggaccgacuaccacgggauguugcccaggaacgucugcaccaggacauagugagacuccuggaucaaccuucagguccccgcaguccacccgggccucauggacuuggcccguuacuguguccacccggcgcauuucucccuggguugaaggccgcucagagcggauccaaaaagucuaggcggcccccagguaaggccggccuggggccucagggacccagaggccgcgguaaaaagcucacacuggcaugcccagggccucuugcugacagcuccgucacgcugucaccgguggauucuuuggacagucccaggccauucggaggcccucccgccucgccaggcggguuuccucuagagggacccuaugcggccgcaaccgcuacugccguaagccuggcacaacucgguggcccggggcgagcuggauuaggccggcagccaccugguggguguguccugucccuuggacugcucaaccccguggccguuccauuggauugggccagacugcccccucccgcgccaccuggcccgucuuuccuccugccccuugcuccaggcccucagcuacugaaucccgggacaccagugucaccucaggaaaggcccccgccuuacuuggcagucccaggacacggugaggaauaucccgccgcuggcgcccauagcuccccuccaaaagcacgcuucuuacgugugcccagugagcacccuuaccugaccccaucucccgagagcccggaacauugggccucaccuagucccccaagccucagcgacuggucugaguccacucccagcccugcuacagcgaccggggccauggcaacgacuaccggagcucugccagcccaaccccuuccucugagcguuccaucgucucucgcacaggcccagacacaguugggcccgcaacccgaagugaccccuaagcggcagguccuggcuuga

SEQ ID NO: 59822 - RNA, 6012 nt, Artificial Sequence
  derived and/or modified sequence opt3 from NOTCH4__Homo_sapiens__NP_004548
augcagcccccuagccugcuccuucuguuguuacugcuacuccugcuuugcguguccgucguuagaccaaggggccuguugugugggucuuucccggagcccugcgccaacggagguaccugucucucacugagccugggccaagggacaugccagugugcuccuggauuucucggcgaaacuugccaguucccagaccccugucagaaugcccaauuaugccagaacggugggagcugucaggcccugcuuccugcgccauugggacugcccuccucuccuucgccacuaacgccgucauuucucugcaccugucugcccggcuucacaggcgagcggugccaggcuaaacuugaagauccuugcccacccagcuuuuguaguaagcgcgggcgaugccacauccaagccuccggacguccucaguguucuugcaugccagguuggacuggcgagcagugucagcugagagacuucugcagcgccaaucccugugugaacgggggaguaugcuuggccaccuacccgcaaauucagugucauugcccucccggcuuugaaggucacgcuugugagagggaugugaaugagugcuuccaggacccagggccuugccccaagggaacauccugucauaacacccucggcucauuucaaugccuguguccagucggccaggaagggccccggugcgaguuacgcgcaggaccuuguccaccgagagguugcaguaauggcgggacuugucagcugaugcccgaaaaagauagcacauuccaccucugccuuuguccuccaggauuuaucggccccgacugcgaggugaacccugauaauuguguuucucaucagugccaaaacggugggaccugccaggacggccuggauacguauacuuguuugugcccagagaccuggacaggaugggacuguuccgaagauguggacgagugcgaaacucagggacccccgcacuguaggaaugggggaaccugccagaacucagccgguagcuuccacugugucugcgugaguggcuggggagggacaucuugugaggaaaaucuagaugacugcaucgcugccaccugugcgccuggcuccacgugcauugaccggguagguagcuuuucgugccuguguccacccgggcgcacuggccuccugugccaucuugaggauaugugucugucucaaccuugccacggagacgcacaguguuccacaaaccccuugaccggcucaacucucugccugugucagccaggguacaguggaccuacaugccaucaggauuuagacgagugucugauggcccaacagggucccagcccaugcgaacacggcggguccugucuaaauaccccgggaucuuucaacugccucugcccucccggcuauacggguagccgaugugaggcugaucacaacgaaugccugucacagccaugucaucccgggaguaccugccuugacuugcuggccacauuccacugucucugcccuccaggccuggagggacagcuuugugaaguugagacuaaugagugcgcauccgcucccugucugaaccaugccgauugccacgacuugcucaauggcuuucaauguaucugccugccuggguucagcggaaccagaugcgaagaggauauugacgaauguaggucuucaccgugcgcgaacggcggucagugucaggaucaaccaggggccuuucauugcaaguguuuacccggauucgagggcccucggugccagacagaaguggacgagugucugagugacccaugccccgucggugcaagcugucuagaucucccuggcgcuuucuucugccuguguccguccggguuuacuggacagcuuugcgaggugcccuugugugccccaaaucugugccagccuaaacaaaucugcaaggaccagaaggauaaagcuaacugucucugccccgacggcucuccagggugugccccucccgaagauaauugcaccugucaccacggacauugccagcguucgagcugugugugcgacgucggcuggacagguccagagugugaagcagaguuagggggcugcauauccgccccgugugcucacggcgguaccugcuacccucagcccucaggcuauaacugcacuuguccaacgggguacacaggaccaaccugcagugaggaaaugacugcgugucauucuggcccuugccugaaugggggaagcuguaacccaucccccggcgguuauuacugcaccuguccuccgucacacacagggccacaaugccagaccagcacugauuacuguguuucugcacccugcuucaauggaggcacaugugugaaccgcccugguacguuuuccugccugugcgccaugggcuuccaggggcccagaugugagggaaaacuuaggccaaguugcgcugacagcccuugucggaaucgagcaaccugccaggauucuccccaaggcccacgcuguuugugcccuacuggguauacaggaggcuccugucagacccucauggaccugugcgcacagaaaccgugucccagaaacucacacugccuacaaacagguccaaguuuucauugucugugccuccagggguggacuggaccucugugcaaucuucccuugagcucgugucagaaggccgcucugucccagggcaucgauguaucuagcuuaugccacaacggcgggcucuguguggacucaggaccaaguuacuucugccauuguccucccgguuuucaaggcucccugugccaggaucacgucaacccgugugaaucuaggccaugccagaauggggccaccuguauggcacagccuagcggauaucuuugccaaugugcgcccggcuacgacggucagaacugcuccaaagagcuggacgcuugccagucacagccaugucauaaucacgggacgugcacccccaagccuggaggcuuccacugugccugcccgcccggcuucgugggguugcggugugaaggagauguugacgagugccucgaucaaccaugucauccuacagguacugcagccugccacagccuggcuaacgccuuuuauugucagugccuacccggccauaccgggcaguggugugagguggaaauugacccuugccacagucagccaugcuuccauggaggcacaugugaggcaacugcugguucuccccugggguuuaucugccacuguccuaagggauucgaaggcccaaccugcucccaccgcgcccccagcuguggcuuucaucacugccaucacgggggacucugucugccgucgccuaaaccagguuuucccccuagaugcgcgugucuuucaggcuacgggggaccagauugcuugacgcccccggccccuaagggcuguggucccccaucuccuugccuguauaaugggaguugcuccgagacaaccggauuaggcggccccggguuuagguguagcugcccacacucuagccccggaccucguugucaaaaaccaggugcuaagggcugcgaagggcgguccggagacggcgcaugugaugccgguugcucagggccgggaggcaacugggacggcggggauuguagucucggaguccccgacccuuggaaagguugcccaagccauucucgauguuggcugcuuuucagagauggccagugccacccccagugugacuccgaggagugccuguuugauggguacgacugcgaaacuccuccagcuuguacacccgccuacgaccaauauugccaugaucacuuccauaauggacacugugagaagggcugcaacaccgcagaaugugguugggacgggggcgauugcaggccugaggacggagauccggaauggggcccaucacuagcgcuccuggugguauugagucccccugcccuggaccagcaguuauuugcucucgcccgcguucugagccuuacucugcgggugggguugugggucagaaaagauagggacggacgcgauaugguguaccccuauccaggugcacgagcugaggagaagcucggcgggacccgggacccuacauaccaggaacgugccgcaccccaaacgcagccacugggaaaggagaccgauucccuaucugccggcuucgucgugguuauggguguggaccugucgagaugugggccggaccacccugcuaguaggugccccugggauccaggccuucuccugcgcuuuuuggcggccauggcagcuguaggagcccuggaacccuuacucccuggcccacugcuugccguccauccccacgcugggacugcaccuccggccaaucagcugccauggcccguguuguguucaccuguugcgggagugauucuccuggcucuaggugcccugcuuguccuccagcugauccggagaaggcgacgcgagcauggcgcauugugguuaccacccggguucacacggagaccuaggacccaauccgcaccccaccgucgccggccaccgcugggagaggacaguauaggccucaaagcucugaagccuaaagcagaaguggaugaggacgguguagugaugugcucugggcccgaagagggcgaagagguuggacaggccgaggaaacaggcccaccuagcacuugucagcuuuggucccugucagggggaugcggcgcguugccccaggcugccaugcuaaccccaccucaagagucugaaauggaggcacccgaucuggacacgagagguccggauggggucacaccacucaugagcgccgugugcuguggagaagugcagaguggcaccuuccagggugcuuggcugggcugcccugagcccugggagccacuuuuagacgggggagccuguccccaagcacacacugucggcaccggggaaacaccucugcaucucgcugccagguuuucccgaccgacugcggcccggcgcuugcuggaggcaggagcuaacccaaaucagcccgauagagccggcaggaccccucuccacgcugcaguugccgccgacgcucgggaagugugccagcugcuucugcgaagcagacagacagcgguggaugcacgcacggaggacgguaccacucccuugaugcuagccgcuaggcuggccguagaagaucucgucgaggaguuaauugcagcccaagcugacgugggggcgcgugacaaguggggaaaaacagcccugcauugggcagcugccguuaacaaugcacgggccgcuagaucucuucugcaggccggcgcggauaaggacgcacaggauaacagggaacagaccccacucuucuuggccgcucgcgagggugccguggaagucgcucaacugcuccugggccuuggggcagcccgagagcuaagagaccaggcuggacuggccccugcagauguggcgcaccagcggaaucauugggacuuguuaacucugcucgagggcgccgggcccccagaagcuaggcacaaggccacaccuggacgcgaggcaggcccguuuccccgugcuagaaccguuucaguguccguaccaccucacggugggggagcccugccccgguguaggacgcuuagugcaggcgccggcccacgcgggggaggugcuugccugcaggcgcgaacuuggagcgucgaucucgccgcaagaggcgggggagcuuauucgcauugucggucuuuguccggcgugggugccgggggaggcccuacccccaggggccgcagauucagcgccgggaugaggggaccgcggccaaacccugcaaucaugcguggucgcuacggcguggcugccgggcgaggaggcagagucucaacagacgauuggcccugcgacuggguugcgcugggugcuugugggagugccucuaacauuccaauacccccucccugccuaaccccauccccugaaaggggaagcccgcaacuggauuguggaccucccgcacuccaggagaugcccaucaaucagggcggggaaggcaagaaguga

SEQ ID NO: 59823 - RNA, 1491 nt, Artificial Sequence
  derived and/or modified sequence opt3 from NOTUM__Homo_sapiens__NP_848588
augggcagaggggugaggguccugcuccuucugagcuuguuacacugcgccggagguuccgagggccggaagaccuggcgccgacgugggcagcaacccccuccaccgcccagaacagaagcugcacccgccgcgggacagccaguugagucuuucccccuggacuuuacugcuguggaaggcaacauggauucauucauggcccagguaaaaagucuagcacagagccucuacccuuguuccgcccaacagcugaaugaggaccuuaggcugcauuugcuccugaacacgucugugaccugcaaugaugguucgccagcuggguauuaccugaaggaaucacggggaagccgcagauggcucuuauuucuggagggcggcugguauuguuucaacagggagaauugcgacagucgguacgauacaaugcgccgacuuauguccucuagagacuggcccaggacucggaccgggacaggaaucuugagcucccagccugaagagaacccauauugguggaaugcaaacauggucuuuauuccguacuguucaagugauguguggagcggugccucuuccaaaucagaaaagaaugaguaugcuuucaugggcgcccugauaauccaggagguugugcgugaacuacucgggcgcggacugagcggcgcgaaaguccuucuguuggcagguaguucugccgggggaaccggcgugcuccugaacguagacagaguugcugagcaauuagaaaagcugggcuaccccgccauucaggugagggggcucgcagauuccggaugguuucuugacaauaagcaguaccggcacacugauugcgucgacacaaucaccugugcuccuacggaggccauucgacgcgguaucagauauuggaacggcguggugccagaaaggugccggcgccaguuccaagagggggaggaauggaauugcuuuuucggauacaaagucuaucccacucugagauguccuguuuuugugguacagugguuguucgaugaggcgcagcuaaccguggacaacguccaucugacaggccaaccagugcaggaaggucucaggcuguacauacagaaucuugggcgugagcugcggcacacuuugaaggacguucccgccagcuuugcaccggcuugucucucgcaugaaaucauuauccgaucucacuggaccgaugugcaggucaaaggcacaucccugccuagagccuuacacugcugggacaggucacugcaugauagucacaaggcuagcaaaaccccucuaaagggaugcccagugcaucucguagacuccuguccuuggccccacugcaacccaucuugucccacgguucgcgaucaauucacuggccaggagaugaacguggcccaguuccugaugcacaugggguuugacaugcagacagucgcacaaccucagggacuugagccaagcgaauugcuggguaugcucucaaauggcaguuga

SEQ ID NO: 59824 - RNA, 1524 nt, Artificial Sequence
  derived and/or modified sequence opt3 from NOVA1__Homo_sapiens__NP_002506
augauggccgcugcacccauccagcaaaacggcacccacacaggggugccuauugaccuggauccaccggacagcagaaagaggccccucgaggccccuccagaagcgggauccacuaaacggacgaauaccggugaggauggccaguacuuccuuaagguccugauacccucuuaugcugccgggucaaucauuggaaaaggcggucagacaaucguucaguugcaaaaggaaacuggggcaaccauuaaauuaaguaagagcaaggacuuuuacccuggaacaaccgagcgcgugugccugauccagggcacuguagaagcccuaaacgcugugcauggcuucauagcagagaaaauccgagagaugccacagaaugucgccaagacagaacccguguccauucuccagccucaaaccacgguuaacccagaucguaucaaacagacucugccgucuucgcccaccacaacuaagucaagcccuagugacccaaugaccacauccagagcuaaucaggugaaaauuaucguccccaacucuaccgccgggcuuauaauuggaaaggguggcgcgacggugaaggcaguaauggagcagagcggggccuggguucaacugucccagaaaccugauggaaucaauuugcaggaaaggguggucacugugucaggcgagccagagcaaaaccggaaggcuguggaacucauuauccagaaaauccaggaggacccccagagugguagcugucugaauauuucuuaugccaacgucacagggccgguugcaaauuccaacccuaccggaucacccuacgcuaauacugccgaagugcugccaacagcggccgcagcugccggccucuuaggccacgcuaaccuggccgggguagcagccuuuccugcugugcuuagcggauucaccgguaaugauuuggucgcgauaacgagugcacugaacacccuagccucuuauggcuacaaccucaauacacuggggcuuggacugucccaagcugccgcaacuggcgccuuggcugccgcagcggcuagcgccaaccccgcagccgcugccgcaaaucuccuggcuaccuaugccucggaggcgucugccuccgguucaacagcugggggcacugcaggaaccuuugccuuaggcagucuggcugccgcaacagcggccaccaacggguacuucggagcugccagcccacucgcagcuuccgccauccuugguacugaaaagucuacggacggcagcaaagaugugguugagauugcagugcccgagaaucuggucggggccaucuugggaaagggcgguaaaacccuaguggaauaccaggagcugacaggggcucgcauacagauuucaaagaagggcgaauuuguaccuggaacuagaaacaggaaaguuaccaucacaggcaccccagcggccacucaggcagcucaauaucucaucacacagcggauuacguacgagcagggggugcgcgccgccaauccgcagaaggucggauga

SEQ ID NO: 59825 - RNA, 1479 nt, Artificial Sequence
  derived and/or modified sequence opt3 from NOVA2__Homo_sapiens__NP_002507
auggagcccgaagccccugacagcagaaagaggccacuggagaccccgcccgaaguggucugcacaaaacgguccaacacuggcgaggaaggggaguacuuccucaagguucuuaucccuucuuaugcugcaggaucaauuauagguaaaggcgggcagacgaucgugcaacugcagaaggagaccggagccacaauuaaauugaguaagagcaaggauuuuuacccaggcacuaccgaacgcguauguuuagugcaggguacagcggaggcucugaaugccguccacuccuucaucgcagaaaaagugcgagagauuccccaggccaugaccaagccugagguugugaacauccuacaaccacagacuacaaugaaucccgaccgugcuaaacaggcaaagcucauagucccuaacucuaccgccgggcugaucauuggaaaaggcggcgcuacggugaaggccguaauggaacagucgggggcguggguucaacuuucacagaagccagagggaaucaaucugcaggaaagaguggucacugugagcggugagccggaacaggugcauaaagcagucagugccauuguucaaaaggugcaggaggauccccaguccucuagcugcuugaacaucuccuaugcuaauguagccggcccuguggcaaacucaaauccaaccgggagucccuacgcuagcccugccgacguccucccagcggccgcagcugccucugcugccgcagccuccggacugcugggccccgcuggucucgcgggggugggagcauuuccggccgcuuuaccugccuucucaggcacagaucugcuugcaauaagcacugccuugaacacccuggcuaguuauggcuacaauacaaacucucuagggcucggacuuaauuccgccgcagcgagcgguguucuggcugccguggcagccggcgcuaaccccgccgcagcugccgcggccaaucuguuggcuucguaugcaggggaggccggagcuggcccagccgguggggcagcgccucccccacccccuccaccgggcgcccucggaucuuuugcucuggccgcagcugccaacggcuacuuaggggcaggagccgguggcggggcuggaggcggugggggcccccuggucgcggccgcagcugccgccggagcugcaggcggguuccucaccgccgaaaaacuugcggcugaguccgccaaggaacugguggagauugcaguaccugaaaacuugguuggagccauccuagguaaaggcgggaagacgcugguggaguaccaagagcucacuggagcuaggauucagaucaguaaaaagggcgaauuucugccagguacacggaaucgcagagucaccaucacugggucacccgcagccacacaggcggcucaguaucuuauuagccaaagggugaccuacgagcagggcguccgggccuccaacccucagaaggugggauga

SEQ ID NO: 59826 - RNA, 1074 nt, Artificial Sequence
  derived and/or modified sequence opt3 from NOV__Homo_sapiens__NP_002505
augcagagcgugcaauccaccucuuucugccugagaaagcagugucucugccuuacauuucuguuguuacaucugcuaggccaggucgccgcuacucagaggugucccccucaaugcccagggcgguguccggcaacgcccccuaccugcgccccaggaguucgcgcggugcucgacgguuguucaugcugucugguaugcgcucgacagcguggcgagaguuguagcgaucuugaacccugcgacgaguccucugggcuguacugcgauagaucggccgacccuucaaaccagacaggaaucuguacugcaguggaaggcgauaauugcgucuucgacggugugauuuauaggagcggggagaaauuucagccaaguuguaaguuccaaugcaccugucgggauggacagauaggcugcguuccccgcugucaguuggacgugcuccugccugaaccaaacugcccggcccccagaaaagucgaggugccuggcgaguguugcgaaaaguggaucugugggccagaugaggaagacucccugggaggucucacauuagcugcauacaggcccgaggccacccugggcguagagguuucugauagcuccgugaauugcauugaacagacuacagaguggaccgcuugcucaaaaaguugugggaugggauuuagcacgcgggucacuaaccgcaaucgacaaugcgaaaugcuuaagcagaccagauuguguauggugaggccuugcgagcaggaaccagagcaacccacagacaagaaaggcaagaaaugucugcggacuaagaaaucucuaaaggccauccaccuccaguucaagaacugcaccucccugcacacauauaaaccgcguuuuuguggugugugcucagaugggcgcuguugcaccccucauaauacgaagacuauucaggcggaguuccaguguagccccggacaaaucgucaaaaagccaguuauggugauaggcacauguaccugccacacuaacugcccuaaaaauaacgaagcauuucuucaggagcuggaauugaagacaaccagaggcaaaauguga

SEQ ID NO: 59827 - RNA, 1584 nt, Artificial Sequence
  derived and/or modified sequence opt3 from NOX1__Homo_sapiens__NP_001258744
augggcaacuggguggucaaucacugguucagcguucuguuucucgugguauggcuugggcugaacguguucuuguuugucgacgccuucuuaaaguacgagaaagcugauaaguauuacuauaccagaaaaauccugggauuuugcuccaggacacuacggaagcagcucgaccauaaucugacuuuccacaaacuuguggcauacaugauuugucugcauacggccauacacaucauugcgcauuuguuuaacuucgauugcuauucucgcucacgacaagcuaccgacgguagucucgccagcauccuguccucucugucgcacgaugaaaagaagggcgggucauggcucaaucccauucagagccguaacacaacuguugaguacgugaccuuuacaaguaucgcaggauuaaccggcgucauaaugacuaucgcccugauucuuauggugacauccgcuaccgaguucaucagaaggucuuauuuugaaguauucugguacacgcaccauuuguuuauuuucuacauccugggucuagggauacacggaauuggcggcaucguucgggggcagacugaagagagcaugaaugagucccauccucgcaaaugugcagaaucauucgagaugugggacgauagagacagucacugcaggcggccaaaguuugaaggacacccgcccgagagcuggaaauggauucucgccccugugauccuguauaucugugagcgcauucuucgauucuacagaucucagcaaaaggucgugauaaccaaaguggucaugcauccauccaagguucuggaauugcagaugaacaagagggguuuuucaauggaggugggccaguauaucuucguaaauugccccagcauuagucuccuggaauggcacccuuuuacauuaacuucugcuccagaggaagauuucuuuuccauccauauacgggccgcgggggacuggaccgagaaccugauucgugcauucgagcagcaauacagccccaucccucgcaucgaaguggauggaccauuuggcacagccucggaggacgucuuccaguaugaaguggcuguucucgugggugccgggauuggagucaccccguuugcaucuauccuuaaauccauuugguacaaguuccagugugcugaucacaaucugaaaacgaagaaaauauauuuuuacuggaucugcagagagacuggcgccuucucaugguucaacaauuugcuaacaagucuggaacaggagauggaggaacucggcaaggugggguuucugaacuacaggcuuuuccugaccggaugggacagcaauauuguaggucaugcggccuugaacuuugacaaagcaacugauaucguuacaggccucaagcaaaagaccuccuucgggcggcccaugugggacaacgaguuuucuacgaucgcuaccagccacccuaaaucaguggucggaguguuccuguguggcccacgaacauuagccaagagucugcgcaaaugcugucacagauauuccagccuagaucccaggaagguccaguuuuacuucaauaaagaaaacuuuuga

SEQ ID NO: 59828 - RNA, 1707 nt, Artificial Sequence
  derived and/or modified sequence opt3 from NOX3__Homo_sapiens__NP_056533
augaugggcugcuggauccugaacgaggggcucagcaccauucuugugcuguccugguugggaauaaauuucuacuuauuuaucgacacauucuauugguacgaagaggaagagucuuuucacuauacuagagucauucuggguucaacgcuagccugggcuagggcaagugcccucugucugaacuucaauugcaugcuuauccugauucccguuagccggaacuugaucuccuuuauacgcggcaccucuaucuguugccgagggccuuggcguagacagcucgauaagaaucugagguuccauaaacugguggcguacggaauugcuguaaacgccacaauccacauuguggcacauuucuucaaucucgaacgguaucacuggucgcaaucagaggaggcccagggcuuacuggcugcacuuagcaaguuggguaacacuccaaaugaaaguuaccugaacccgguccgcaccuuucccacaaauaccacuacagagcuacucagaaccaucgccggggugacgggacugguuauaucccuugcucugguguugauuaugacuucuagcaccgaauuuaucaggcaggccuccuaugagcucuuuugguacacacaucacgucuucauuguguuuuuccugucauuagcgauccacggcacuggccggaucguacgcgggcagacccaagacagucugagccuccauaacauuacauucugucgagauagauacgcagaguggcagaccguugcccagugcccugugccacaguuuucuggaaaagaacccuccgcuuggaaguggauacuugguccugucgugcuguaugccugugagaggaucauucgguucuggcguuuucaacaggaaguggucaucacgaaaguugugucacacccaagcggcguauuggagcuacauaugaagaagcgcggguucaaaauggcacccggacaguacauacuggugcagugcccugcuauuaguucucucgaauggcacccauuuacucugacauccgccccgcaagaggacuucuuuagcguccacaucagagcggccggcgauuggaccgcagcccuucuggaggcuuucggugcugaagggcaggccuugcaggagcccuggucgcucccuaggcuggcaguggacggaccauuuggcacugccuuaacagauguuuuccauuaucccgugugugucugcguggcugcgggcaucgggguaaccccuuuugcagcccugcuaaagucuauuugguacaaauguuccgaagcucaaacgccacucaagcugucaaaaguuuauuucuacuggaucugccgggacgcccgagcauuugagugguucgccgaucuuuugcugagucucgaaacccgcaugagcgagcagggaaagacacacuuccuguccuaucauauuuuucuuacugguugggacgagaaucaggcucugcacauagccuugcauugggaugaaaacaccgacgugaucacaggccucaagcagaaaacuuucuacgggagacccaauuggaacaacgaguuuaagcaaauugcauacaaucacccgucuagcucaaucggagucuucuuuugcggcccuaaagcgcugaguaggaccuuacagaagaugugucaccuguauuccagcgcugauccccggggugugcauuucuacuauaacaaagaaucuuuuuga

SEQ ID NO: 59829 - RNA, 1617 nt, Artificial Sequence
  derived and/or modified sequence opt3 from NOX4__Homo_sapiens__NP_001137308
auggccgugagcuggagauccuggcuggcuaacgagggcgucaagcaccucugccuuuucaucuggcugucuaugaauguuuuguuauuuuggaaaaccuuccugcuauacaaccaggggcccgaauaucauuaccuccaccaaaugcugggacuuggucuguguuugucaagggcaagugccagcgugcucaaucugaacugcucccugauucucuuaccuaugugucggacacugcuugcguauuugcgcggcucucagaagguaccaucgcgacguacuagaaggcugcuagacaaaucacggacguuucauauaaccugcggggugacaaucuguauuuucagcggaguccacguggcugcccaucucguuaaugcacugaacuuuagugugaauuacuccgaggauuucgucgaacuuaacgccgcucgcuauagagacgaggauccgaggaagcuguuguuuacuaccgugcccggccucacagguguaugcaugguugugguccuguucuuaaugaucaccgcaucuacuuacgccauucgggugagcaauuaugacaucuuuugguacacacacaaccuguucuuuguguucuacaugcuccuuacccugcacgucuccgggggauugcuaaaauaucagacgaaucuggauacucauccuccaggcuguauaucacucaaccgcaccaguagccagaauaucucucugcccgaauacuuuuccgagcacuuccaugagccuuucccagaaggcuuuucaaagcccgcugaguucacacaacacaaguuuguuaaaauuugcauggaggaaccucgauuccaggccaacuuuccacagacuuggcuuuggaucagcgggccgcuguguuuguauugcgcggagagacucuacagguauauucggaguaauaagcccgugaccaucauaucuguaauuucccacccuagcgacgugauggaaauccguauggucaaagagaacuucaaggcacgcccaggacaguacauuacacugcauugucccucggugucugccuuagaaaaccacccuuuuacccugacgaugugcccaacugagacaaaagcuaccuucgguguucaucuaaagaucgugggcgauuggacugaaagauuuagggaccuccugcuucccccguccucacaagauagugagaucuugccuuucauucagagccggaauuaucccaaggacgauuggaaaccauacaagcugcgacgccucuacuuuauaugggucugcagagacauccaguccuucaggugguuugccgaucugcuuuguaugcugcacaacaaauucuggcaggagaaucggccugacuaugugaacauucaauuguaccucucucagacagacgggauccagaagauaauuggagaaaaauaucaugcacugaauagccgcuuauucaucggcagacccagguggaagcugcuauuugaugagaucgcuaaauacaaccgugguaagaccguagggguuuucugcuguggaccaaauucacucaguaagacgcugcacaaacuuuccaaccaaaauaacagcuauggcacccgguuugaauacaauaaggagucuuucucauga

SEQ ID NO: 59830 - RNA, 2214 nt, Artificial Sequence
  derived and/or modified sequence opt3 from NOX5__Homo_sapiens__NP_001171708
augaacaccagcggcgaccccgcccagacagggccugagggaugccgugguacuauguccgcugaagaggaugcaagguggcugcggugggugacgcaacaguucaagaccaucgccggcgaagacggggagauuucucuccaggaauuuaaagcggcccuucacgucaaggagucauucuuugcugagcgcuucuuugcacuguucgauagugaccgaagcggaacaauaacuuugcaggaauuacaagaggcccugacccuacucauccauggcuccccaauggauaaacugaaguuucuuuuccagguuuacgacauugaugguucugggucgaucgacccggaugaacugcguacaguguugcagucaugucucagagagagcgcuauuagucugcccgacgagaaacuggaucagcucaccuuagcacuguuugaauccgccgacgcugauggaaauggcgccaucacuuucgaggaacuuagggacgaguugcaacgguuuccuggcguaauggaaaaccugacaauaucugcggcacacuggcuaaccgccccagcuccccgcccuagaccaaggcggccccgccagcucacgcgagccuauuggcauaaucacagaagccagcuguucugccuugcaacuuacgcugggcugcauguguugcucuuuggacuggccgcguccgcccacagggacuuaggugcaucagucaugguggcuaagggcugugggcagugccugaacuucgauuguaguuucaucgccguucucaugcuucggcguugccugaccugguugcgcgcuacauggcuagcccaagugcugccucucgaccagaauauucaguuucaccaacugaugggauaugucgugguaggccuuagccugguucauacuguggcacacaccgucaacuucguguugcaggcccaggcugaggcgucuccauuucaguucugggagcuccuguuaacaaccagaccggguaucgggugggugcauggauccgcaucacccacgggcgucgcccugcuacuccugcuuuugcugauguuuauuuguagcaguucuugcaucaggcgguccggccacuucgaaguguuuuacuggacucaccucagcuaucugcuuguuuggcuguugcucauauuccaugggccuaauuuuuggaaguggcuguuaguaccagguauucuguucuuucuagagaaagcuaucggacucgccgugucgcgaauggcagccgucuguauuauggaagugaaccugcuucccucuaagguuacacacuugcugaucaaacgcccuccauucuuucauuacagacccggcgauuaucucuaccugaauaucccgaccauugcuagguacgaguggcacccuuucacuauauccucagcccccgaacaaaaggacacaaucugguuacauauucggagucaggggcaguggaccaaccgccuguaugagagcuucaaagcauccgauccacuuggaagaggcucuaagagguugagccguucagugacgaugcggaagagucagcgauccagcaaagguucugagauccuccuggaaaagcacaaauuuugcaauauaaaguguuacauugacgggccuuauggcacccccacaagaaggaucuucgcgucagagcacgcuguccuaaucggagccggcauugggaucacuccauuugcaaguauucugcaaagcauaauguaccgccaucagaaacggaagcauaccugccccuccugccagcacucuuggaucgaaggagugcaggauaacaugaaacuccacaagguagacuucauuuggaucaauagagaucaaaggucguuugagugguucguuagccugcuuacaaaguuggaaauggaccaggccgaggaggcucaguauggucgcuuucuggaauuacacauguacaugacuuccgcccucggcaaaaacgauaugaaggcaaucgggcugcagauggcucuugaccuguuggccaauaaagagaagaaagacucaauuaccggacuccaaacacgaacccagccuggccggccagauuggaguaagguguuccagaaggucgcggccgagaaaaaggguaaagugcaagucuuuuucugugggucuccggcucuggcaaaggugcuaaaaggccauugcgaaaaguuuggauucagauuuuuccaggagaacuucuga

SEQ ID NO: 59831 - RNA, 1284 nt, Artificial Sequence
  derived and/or modified sequence opt3 from NOXA1__Homo_sapiens__NP_001242997
auggccagccugggcgaccucgugagagcuuggcaccuuggggcacaggccgucgauaggggagacugggcgcgggcucugcauuuguucuccgguguucccgccccuccagcacgcuuaugcuuuaacgccggcugugugcaucugcuagcuggggauccggaggcagcccuccgagcuuucgaccaagccguaaccaaggauacaugcauggcggugggauuuuuccagcguggcgucgcaaauuuucagcuggccagauuccaggaagcucuuucugacuuuuggcuggccuuggagcaacucaggggucacgcagcuaucgauuacacucagcuggggcugcgguucaaacuccaggccugggaaguguuacacaacguugcgucagcccagugucaacugggacuuuggacggaggcagcuaguagcuugcgcgaagccauguccaaguggcccgagggcucucugaauggccuagacucggcucucgaucaggugcaggggccuggagccaaccaugacgcaagaucacugauuauggauagcccaagggccgguacccaccagggcccccuugacgcugagacagaagucggggcggaucggugcaccaguacugcauaucaagagcagcgcccucagguggaacaaguaggaaaacaggccccacugucccccggcuugccugcuaugggugggccaggaccgggccccugugaggacccugccggcgcagggggagccggugcuggcgggucugagccacucguuacagugaccguccagugcgccuuuacuguggcacugcgagcgagaaggggagcugacuuaagcucccugcgggcccuccuuggccaggcacugccccaccaagcccaguugggucagcuaucauaccuggcuccuggggaagauggccauugggugccaauacccgaggaagagagucuccagcgugccuggcaagacgcagcugccuguccgcgcggacugcagcuucagugcagaggcgccgggggaaggccuguccuguaucagguuguggcgcaacacagcuacucugcucagggucccgaagauuugggcuuccggcagggggacacaguagaugugcucugugaggagccagacgucccucuggcaguggaucaggccugguuagaaggacauugcgacggccgaaucgguauuuuucccaaguguuucguugugccagcugggccccgcauguccggcgccccuggaagacugccaaggucacaacagggcgaucagccguga

SEQ ID NO: 59832 - RNA, 1113 nt, Artificial Sequence
  derived and/or modified sequence opt3 from NOXO1__Homo_sapiens__NP_653204
auggccggccccagauacccugugagcguccagggggcugcacugguucaaaucaagaggcuccagaccuucgccuuuuccgugcgguggucugacggaucagauacauucguacgccgaaguugggacgaguuucgucagcuuaaaacucugaaggaaacguucccaguggaggcggguuuguuaagaaggagcgaucggguccugccgaaacuacucgacgcuccccugcuuggccgcguggggagaaccuccaggggacuggcccgguugcagcuccuggaaacauauucucgccgacugcucgcaacugccgagagaguugcuaggucgccuaccauuacaggcuuuuucgcaccacaacccuuagaucuggaaccugcccuuccacccgguucacgggugauauugccuaccccagaggagcagccgcugagccgugcugccgggcgccuaaguauccacucccucgaagcgcagucucugagaugccuucagcccuuuuguacucaagacacaagggaucggccuuuccaggcacaggcccaggagagccuggacgucuugcuccgacauccauccggaugguggcugguggaaaacgaggaucgccaaaccgcuugguuucccgccccuuacuuagaggaagcagcuccaggccagggcagagaggguggacccucacuggguaguagcggcccgcaguucugcgccucuagggcguaugaauccucacgggccgacgagcucagcguaccugcaggggcucgcguuagagugcuugaaacgagugauaggggaugguggcugugucguuacggcgaccgggccgguuugcuacccgcuguccugcuccgaccagaggggcugggagcccuucugucuggcacuggcuuuagagggggagaugacccugcaggggaggccaggggcuuccccgaaccaucccaagcuaccgcgcccccuccaacagugccgacucgccccagcccuggggcaauucagucgcggugcuguaccgugacaagaagggccuuggagcgccgaccacggcgucagggaagacccaggggcugcgucgacucuguuccucacccaaccacggaacaguga

SEQ ID NO: 59833 - RNA, 3471 nt, Artificial Sequence
  derived and/or modified sequence opt3 from NPAP1__Homo_sapiens__NP_061831
augggcaaccugcucagcaaguucagacccgggugcaggcggcgcccucuuccaggaccgggucgaggcgcccccgcuccucugucccgugacgcaucuccacccgggagagcccacucagugccuaccccaaggcccuuucggggauuguuccgcagaaaugcgaggcggcgcccuagugcugccagcaucuuugucgcaccaaaacgaccgugucccuuaccuagagccgcugcagccccacugggcguucuacccgcuguggguugggggcucgccauuaggaagacaccuaugcugccagcgcggaacccaccgcguuucggacauccuuccucuguacgcauacccccaccuucgagaauguuuacucuucuguugcccucaccaagggagcccgcagugaaagcccggaagccuaucccagcuacgcuccuggaagagaccgaagucugggcccaggagggcccgcgacgcgugaaaaaggaugaagaccccguucaaauugagggcgaggaugacgaaaagagaacaccucugagcaguggggaggcauccucuacuagcaggucccagggaacccagggugauguggcuucauuccggugcaguccaggcccccucgaagggaaugucuaccacaaauuuagcgagaacucuauguccgagaaggcccaggcgaguccugccagcaguuguuuagaaggaccagcaaugcccucuacacauucccaagcuggcugcgcccgccaccuggguaaaccggacccugaugcuaccgccccacccgagccugcagugggguguagccuuuugcagcagaagcuggccgcugaaguacuaaaugaggaacccccaccuucgucucucggacugcccaucccacuuauguccggcaaaagaaugccggacgagaagccuuucugcauucccccaaggucagcggcacccccucgugccgcucggaaccgaccauguaagagaaaaaugaguaucccccuguugcucccucugccgcccagcuuaccccugcucugggauaggggcgagcuuccuccacccgccaagcugccuugcuuguccguugaaggggaccuacauacucuggagaaaucuccggaauauaagcgcaauagccggauacucgaggauaaaacagaaaccaugacgaacucaaguaucacucagcccgcaccauccuuuagccaaccugugcagaccacagacucucugccccuuacuaccuacacaucacaggucagugccccacugccuauucccgauuuggcugaccucgccaccggaccacugaucuuaccgauuccuccccugagcacgacuccaaagauggacgagaaaaucgcauucacaauacccaauuccccucuagcgcucccagcugaucuggugcccauucuuggugaccagucuaacgagaagggcgggucguauaauagcguggucggagccgcaccuuugaccuccgauccgccaacucccccuucaaguacacccucuuuuaagccaccuguuaccagagaaagccccaucuccauguguguggacucaccaccuccgcugagcuuccucacgcugcuucccguaccaucuaccggcacauccgugauuacuucaaaaccuaugaacagcaccucugucaucuccacagugacuaccaaugccucagcucaccugacaagucaaaccgccguugaucccgagguggucaacauggacacuacggcaccaagccaggugguaaucuuuacaucguccuugucuagcaggguuucaagucucccuaauucccagauucacugcucugcugaacaacgccaucccgguaagaccagcguguacacuuccccgcugccauucauauuccacaacaccacaccuucauuuaaccaguuauucgggaaagaggccacuccccagccaaaguuugaagcgcccgauggccagccucaaaaagccagccugccgagugcuugugucuuccuaucucuccccaucauuccaccucccgacacuuccacacuggugaauagcgcaucgacggccucaucuaguaagccuccaaucgagaccaacgcuaugcauacuacacccccuuccaaggccgucauacuucagagcgcaucugugagcaaaaaguauuugccauuuuaccugggacuccccggcuccgggaauacccagccgucaggaaacacagcgaguguucaggguagcacuucucugccugcccaauccgugcgagcuccagccaccgcaucaaaucaccccuuaaacccuggcgcuacgccacagcccaaauucggggccccggauggaccucagcagaagaccagucugcccagcgcacacgacuuucuuuccuugccaauuaugguaccucccgauacaucuacucucgucucgagcgccucagcugcgucccugaguaaaccagccaucgacaccucugacaugaauacaacucccccuagcaagaccgugauccuacaauccacguucguuucacggaaggaggaauauauucguuuuuacaugggccugccagguucugggaacacacuccauagcgauaguaucgcauccgcucaggugagcaccucuuucccggcccaggccgacagaaggcccacuacaaccucaucccacccucugaauacuggcaguauuagccauucgacccuuggagcuacagauggccagcaaaaaucugacuccagcuuuauauuggggaacccagcaacgcccgccccugucaucggacugaccucaccaagugugcagcccuuaucugguuccauuaucccuccgggcuucgcggagcucacuagcccauacacagcucuggggacccccguaaaugccgaaccuguggagggacacaacgcaucagccuuucccaauggcacagcuaagaccagugguuuccgcaucgcaaccgggaugccaggcacgggagauagcacacuucugguuggcaacaccauuccugggccccaggucauaaugggaccaggcacuccgauggacgguggguccaucggauucucuaugagcgccccuggccccuccucaaccucuggugaguugaauauuggccaagggcagaguggaacaccaucgacuaccagcguguuucccuucggccaggcggcuugggauccuacagggcauuccauggccgcagccccacagggagcuucuaacauccccguguuuggcuauacgucagccgcagcuuacauuccuggucucgacccgccaacccaaaacagcugcuccgggaugggaggcgaugguacucggaguaucgucggcgggcccugcguuccugccuuccagcaguguauacugcagcacacauggaccgaaagaaaauuuuauacuucuagcacacacuacuauggacaagagaccuacgugaggcgacaugugugcuuccagcuaccauga

SEQ ID NO: 59834 - RNA, 2475 nt, Artificial Sequence
  derived and/or modified sequence opt3 from NPAS2__Homo_sapiens__NP_002509
auggacgaggaugaaaaggacagagccaaaagggcuagccggaacaaguccgagaaaaagcgccgagaucaguucaaugugcugaucaaagaacucucuucaaugcuucccggcaacacccguaagauggacaagacaacuguccuggagaaaguuauuggguuuuugcaaaagcacaaugaagugagugcacagacggagauaugcgauauccagcaggacuggaaaccuagcuucuuauccaacgaggaauuuacccaacugaugcuagaggcccucgauggauucauuaucgcgguaacaacugacgguucuauuaucuacgugucggauucaauaaccccacugcuuggccaucugccgagcgacgucauggaucagaauuugcucaacuuucugcccgaacaggagcacagugagguguauaagauccuguccucucauaugcucguuacagacagcccuuccccagaauacuuaaaaucagauagugaccuggaguucuauugucaccuuuugagagggagccugaaucccaaggaauuuccuaccuacgaguauauuaaguucgugggaaacuuuaggucuuacaauaacgucccaucccccucaugcaauggcuucgacaacacucuaagccggccuugucgcgugccacucgguaaagaaguaugcuuuaucgcuacaguuagacuggccaccccgcaguuccuuaaggagauguguauuguggaugagccccuggaagaguuuacgaguaggcauucuuuggaauggaaauuccucuuccuggaccaccgggcaccuccaaucauaggguauuuacccuuugagguccugggaacuuccggcuacgauuacuaucacauugacgaucucgaacuucuggcccgcugccaucaacacuugaugcaguucggcaaggggaaaagcuguugcuaccgauuucuaaccaagggacagcaguggaucuggcugcaaacacauuauuacauuacuuaucaccaguggaacucgaaaccugaguucaucguguguacccacucuguggucuccuacgcugacguuagaguggagaggcggcaggaacucgcacuggaggauccacccucagaagcccuucauaguagcgcucugaaggacaaggguuccucuuuggagccgcgucaacacuuuaauacacucgauguaggcgccagcgggcugaauaccucacauaguccuuccgcgagcucucgcucaagucacaaaagcucccauacggcaaugucugaacccacuucgacaccaaccaaguuaauggccgaggcuagcacuccugcccugcccagauccgcaacacuaccacaggagcuccccgugccuggacugucacaggcugccaccaugccagcgccgcuucccaguccuucuagcugcgacuugacgcagcaacugcucccacagaccguccugcaguccacacccgccccuauggcacaguucucagcucaauuuagcauguuccagacuaucaaagaucagcuugaacagaggacccggauucugcaagccaacauacgauggcagcaggaggaauugcacaagauccaggagcaacucugucuggugcaggacucuaacguucagauguuuuuacaacagccagcugugucccugaguuucagcucuacacagcgccccgaggcccagcaacagcuacagcagagauccgcagccgucacucaaccgcagcucggcgcugguccucagcugccagggcagauuucaagugcgcaagugaccagccagcaccuuuugagggaaucguccguaaucucuacacagggacccaaaccuaugcggagcucacaacugaugcagaguuccggccgcucuggcagcucccucguuucacccuuuagcagugcaaccgccgcucugccaccuucuuuaaaucugacuacgcccgccuccacaagccaggacgcaucgcagugccaaccaucaccggauuucucucaugacagacagcuuagguugcuccugagucagccuauacagcccaugaugccaggguccugcgaugcccgucaacccagcgaggugucucggaccggacgacaggucaaguaugcucagagccagacuguguuucaaaacccugacgcccacccagcaaauuccucaagugcgcccaugccuguccuacugaugggucaggcugugcuccauccgagcuucccagccucucagcccuccccucugcagccagcacaagccagacagcagcccccucaacacuaccuucagguucaggcuccgaccucauugcacagugaacagcaagauagccuguuacucuccacauacucucagcagcccggcacccugggguauccacagccucccccagcccaaccucagccccuuaggccaccgcgccgggugucgagccugucagaguccaguggauugcagcagccucccagauga

SEQ ID NO: 59835 - RNA, 2802 nt, Artificial Sequence
  derived and/or modified sequence opt3 from NPAS3__Homo_sapiens__NP_001158221
auggcccccaccaagccuagcuuccagcaagacccauccagaagggagcggaucacagcucagcacccgcugcccaaccagucugaaugccgcaaaauuuaccgauaugauggcauauacugugagucaacuuaucagaaucuccaagcacuucguaaggaaaaaucuagagacgccgcgaggagccggcgcgggaaggagaacuuugaguucuacgaacuggcuaaauuguuaccucugccagccgcaaucacgucccagcuagauaaggccucuauuaucagacucaccauuucguaucugaagaugagggacuuugcuaaucagggagaucccccuuggaaccuucggauggaggguccacccccuaauacaucagugaaagucaucggcgcacagcgccgaagaagcccaagugcccuggcuauagaaguuuucgaggcccauuuggggucccacauccuccaaucucuggacggauuuguguucgcgcugaaccaggaaggcaaguuucucuacauuagcgagacuguauccaucuauuuaggucugucacagguggagcuuaccgggaguagcgucuucgauuacgugcauccgggagaccacguugaaauggcagagcaguugggcaugaaacugcccccuggcagggggcuacucucucaaggaacagccgaagauggugcuuccucagccagcaguucuucccagagcgagaccccagaacccguggagucgacuucuccuucccugcuuacaaccgacaauacgcuggagcggucauuuuucauucguaugaagaguacuuugaccaaacgcggcguccauaucaagagcuccggguacaaggugauacacauuacaggaagacucaggcugcggguaucuuuaagccacggccgaacuguuccaucacagaucaugggucugguggucguggcacaugcucucccgcccccuaccauuaacgaagugcgcaucgauugccacauguuugucacaagaguuaauauggaccuuaacaucauuuauugugagaauaggauaagugauuacauggaccugacccccguggacaucguagggaaacggugcuaucauuucauucacgccgaagauguggagggaauccgccacucccauuuggaccuacugaacaagggccaaugugucacgaaauacuauagauggaugcagaagaauggcggguacauauggauucagagcucugcgacuaucgccaucaacgcuaaaaaugcuaacgaaaagaacauuaucugggugaauuaucuccugucaaacccagaguacaaagauacaccuauggacauugcccagcuuccccaucugccagagaagaccagugaaagcuccgagacuucugauucggaaagcgacuccaaggauacaucaggaauaaccgaggacaaugaaaacaguaaaucugaugagaaggguaaucaaagcgagaacuccgaagaccccgagccugauaggaaaaagucaggcaaugcuugcgacaacgacaugaauuguaacgaugacgggcacagcaguuccaauccagauagucgugacagcgaugacucuuuugaacacuccgauuucgagaacccgaaagccggagaggacggcuucggugcauugggggccaugcagaucaagguugaacgguacguggagucagaaagugaucuccgacugcagaauugcgagagcuuaacgucggacuccgcuaaggauucugacagcgcgggcgaagcaggagcccaggcuucaaguaaacaucaaaagaggaaaaagagacgcaaacggcagaagggcggguccgccucuagaaggcgccugagcuccgcaucaagccccggaggucuagaugccggccucgucgagccuccacgacugcuuaguucucccaacuccgcuagcguguugaagauuaaaaccgagaucucggaaccuaucaauuuugacaacgacucaucuauuuggaacuauccacccaaucgggagauaagucguaacgaauccccguacagcaugacaaagccuccaucuagcgagcacuuccccuccccucaagggggaggcggugggggcggaggcgggggaggucugcacguagccauccccgauucaguucucacuccaccuggcgcagacggggcggcugccagaaaaacccaguuuggagcaagugccacagcugcccuggcacccguggcuagcgauccacuuucuccgccucuguccgccucacccagggacaagcauccaggcaauggugggggcggaggcgggggaggcgguggggcgggaggcgguggccccagugccagcaacuccuugcucuauacuggggaucuggaagcauuacagcgccugcaggcaggaaaugucgugcuaccucucguccaccgggugaccggcacacuggccgcuaccucuacugccgcacagagaguuuacacgacagggaccauuagguaugcgccagccgaggugacucuugcuaugcagucgaacuugcugcccaaugcccaugcaguaaacuucgucgacgugaauagcccuggauuuggccucgauccgaaaaccccaauggagaugcuguaccaccacguucaucgauuaaacaugucaggucccuucgggggagcuguguccgccgcaagucugacacaaaugccugccggcaaugucuuuaccacugcugaaggucuuuucucuacauugccauuucccguguauagcaacggcauccacgcggcccagacgcucgagcgcaaggaagacuga

SEQ ID NO: 59836 - RNA, 2409 nt, Artificial Sequence
  derived and/or modified sequence opt3 from NPAS4__Homo_sapiens__NP_849195
auguacagaucgaccaagggcgccuccaaagcuaggcgggaccagaucaacgcagagauucgcaaucugaaggaacuccuuccccuggccgaggcggauaaagugcgauugucuuauuuacacauaaugucacuggcuugcaucuacacacguaagggggucuucuuugccggagguacuccucuagcaggcccaacggggcuccugagugcccaagaacuugaggacauuguugcugcacugccgggauucuugcucguguuuaccgccgaaggcaaacugcuguaucucagcgaguccguaucugagcauuuaggucacucgaugguggaucuggucgcucagggggacucaaucuacgauauuaucgaccccgccgaucaucuuacagugagacagcaguugacucugccuagcgcgcuagacaccgauaggcuguuccggugucgcuuuaacacaaguaagucccugagaaggcaaucugcaggaaauaaguugguucugauacggggccgcuuccacgcccauccacccggcgcuuauugggccgggaacccuguguuuaccgcauucugcgcuccauuggaaccccgaccuagaccaggaccgggucccggcccugggccagccagccucuuucuggcgauguuccaguccaggcacgccaaagacuuagcacugcucgauaucucagagaguguccuuauuuaccugggauuugaacggagcgaguugcuauguaagucuugguauggccugcuccaccccgaggaccuggcucaugccuccgcucagcacuaccgucuucuggccgaaucaggugauauccaggcagagauggugguacgcuugcaagccaaaacugggggaugggcuuggauuuacugccuccuguauagcgaaggcccugagggcccaaucacagcgaauaacuaccccauaagugacauggaagcauggucuuuaagacagcagcucaauuccgaggacacccaggccgcuuauguucuagggacgccgacuaugcucccuagcuuccccgagaacauucugucgcaagaagaguguucuuccaccaauccacuuuuuacagccgcauugggagccccuaggucaaccaguuuccccagcgcuccagaacuguccguggucucugccagcgaggaacucccccggccuucaaaggagcuggauuucaguuaccuuaccuuuccauccgguccggagcccagccugcaggcagaauugucuaaagaccucgugugcacaccuccauauacuccccaucagccuggcgggugugcguuccuguuuucauuacacgagccauuccaaacgcaucugcccacuccgaguagcacacuacaggaacagcucaccccuuccacugcuacauuuucugaucagcugaccccaucgagcgccacguuccccgacccucuuaccucccccuugcaaggacagcugacagagacuucagugcgaaguuacgaagaucagcucaccccaugcacaucuacuuuuccugaccagcuguuacccagcaccgcaacauucccagagccgcugggcuccccugcccacgagcaacuuacucccccaucaaccgcuuuucaggcccacuuggauagccccucucagacguucccugaacagcucuccccaaaccccacaaagaccuauuuugcacaagaggguuguaguuuccuguacgaaaagcuaccuccgagcccaucuucccccgggaauggcgacugcacucugcucgcucuggcccagcuucgcggaccuuugucagucgauguuccacuggugcccgagggcuuacucaccccugaggcgaguccgguaaaacagagcuuuuuccauuacucggaaaaggagcagaacgaaaucgacagacugauucaacagaucucccagcuugcccaagggauggauaggcccuucucugcugaggcaggaacagguggccuggaaccacuugggggacucgagccucuggacagcaaucuaucacugaguggcgccggucccccagugcucucccuggaccuuaaaccuuggaagugucaggaguuggauuuucuggcugaccccgauaacauguucuuagaagagaccccagucgaagacaucuuuauggaucucucuacuccggacccuagcgaggaauggggguccggcgaucccgaggccgagggaccaggcggggcacccucaccuugcaauaaccugagcccagaagaccacaguuuccuugaggaucuggcgacauaugaaacggccuuugagaccggagugucugcuuuccccuacgacgguuuuacugaugaacuacaucagcuccagucccaaguucaggacagcuuccacgaggauggcagcgggggagagccuacauuuuga

SEQ ID NO: 59837 - RNA, 4284 nt, Artificial Sequence
  derived and/or modified sequence opt3 from NPAT__Homo_sapiens__NP_002510
augcugcuccccagcgacguggccagacuuguccugggcuacuugcagcaagagaacuuaaucagcacgugccagacauucauucuggaaucuucagaucuaaaggaguaugcugaacacuguacugacgagggguuuauaccugcaugccuccugagucuuuucggaaagaaucugacgaccaucuugaacgaauacguugccaugaagacaaaagagacuagcaauaacgugccagcgauuauguccucucucuggaagaaacuggaucauacccugucgcagaucaggucaaugcagagcaguccgcgguuugcugguucccaacgcgcccgaacacguaccggcauugcagagaucaagagacagaggaagcucgccucucagacugcucccgcaagcgccgaauuacugacacuuccuuauuuguccgggcaguucaccacgccacccucaacuggaacccaaguaacacggccuaguggccagauaagcgacccaucucgcuccuacuuuguggucgugaaucacucacagagccaggauacuguuaccacaggugaggcucugaacgugauccccggggcccaagagaaaaaggcgcaugcaagucuaaugucuccuggaagaaggaaauccgaaagccagcggaagucgaccacgcucucuggcccacacuccacuauucgcaauuuccaggacccgaacgccuuugcugucgagaaacaaauggugaucgaaaaugcccgagagaagauucugucaaacaagagucuucaggaaaaacuggcagagaauaucaacaaguucuugacaagcgauaauaacauagcucagguacccaaacagaccgacaauaacccuacugaaccagagacauccauugaugaguuucucggccugcccucugaaauccauaugagcgaggaagccauucaagacaucuuagagcagaccgaaucagauccugcguuccaggcccuguuugaccucuucgauuaugggaagacgaaaaacaauaagaacaucagucaguccauuagcucucaaccaauggagucaaaucccaguauaguucuugcagacgagaccaaccuggcugugaaagguagcuuugaaacagaggaauccgacggacagucuggccagccggccuucuguacuucguaccagaaugaugacccuuugaacgcucuaaagaauagcaacaaucacgauguccugagacaagaggaccaggaaaacuucucccagaucucaaccaguauucagaagaaagccuuuaagacagcagugcccacugagcaaaaaugcgauaucgacauaaccuucgagucugugccaaaucucaacgauuuuaaucagagggggaacagcaaugccgaauguaacccucacugcgcugagcuguauacaaaccagauguccaccgaaacugagauggcgauuggaaucgagaaaaauucacuuagcucuaacguccccuccgaaagucaacugcagccagaccagcccgauaucccuauuacgagcuucguuucuuugggcugugaggcaaauaacgaaaaucucauccuguccgguaaaucaagucaguuacugagccaagacacaucgcuaaccgggaagccauccaagaaaucucaguuuugcgagaacagcaaugauacugugaagcucaaaauuaacuuccauggaucaaagaguuccgacucuagcgaaguacacaaauccaagauagagaucaaugugcuggagccggucaugucacagcuuagcaacugucaggacaauaguugcuugcaaucugaaauucugcccguguccguugagagcucgcaucucaacgugucaggccaggucgaaauccaccugggcgauucucuuaguuccaccaagcagccuagcaaugacucugccagcguggagcugaaccacacagaaaaugaggcucaggccuccaaaucagagaacagucaagaaccauccucuuccguaaaggaggaaaacaccaucuuuuugucacucgggggaaaugcaaacugugagaaaguugcccugacucccccugaagguacaccaguggagaauagucauagcuuacccccggaguccgucuguucuucggugggcgauagccacccugaaucacagaacacggacgauaagccauccaguaauaacucugcugagauugacgccagcaauauagucucccugaaagugaucauuucagaugaccccuucguuucuagcgauaccgaacuaaccagugcaguguccagcaucaacggggagaaucucccuacaauuauccugucuucacccaccaaguccccaacaaagaacgcggagcuuguaaaaugcuugaguagcgaagagacugucggagcugugguuuacgccgaagugggcgacucggcaucuauggagcagucccugcucaccuuuaagagcgaagauucagccgucaauaacacgcaaaaugaggacgguauagcuuucagugccaacgugaccccuugcguaucuaaagaugggggcuacauccagcugaugcccgcaacauccacugcuuuuggaaauagcaacaacauuuuaaucgcgaccugcgugacagacccaacugcccugggcaccucaguuagucagagcaaugucguggugcuuccggggaacuccgccccuaugacggcucagcccuugccaccccaacuccagacaccuccacggucuaauagcgucuucgcaguuaaccaggccgugucccccaauuuuucacagggaucugcuauuaucauagccaguccugugcaaccgguacugcaggguauggucggcaugauuccagugucgguuguggggcagaacggaaauaacuucagcaccccuccccgucagguccuacauaugccacugacugcacccguguguaaucgcuccaucccucaauucccgguucccccaaagucucagaaagcgcagggccucagaaacaagccuugcauugguaaacaggugaauaaccugguagacucaagcgggcacuccgucggcugucaugcccaaaagacagaggugagugauaagucuaucgcuaccgaccuuggcaaaaagagcgaagagacuaccgugcccuuuccagaagagucaauagucccugccgcaaaacccugccacaggcggguuuuguguuucgauuccacaacggcuccaguggccaauacccagggaccgaaccacaagaugguaagucagaauaaagaacgaaacgcagugagcuuuccuaaucuggacucucccaacgucuccucaacuuuaaagccacccagcaacaaugccaucaagcgcgagaaagagaagccuccacuccccaaaauucugucgaagucugaaagugcuaucuccagacauacaaccauuagggagacacaaagcgagaaaaaggugucaccuacugaaaucguucuugaauccuuccacaaggcgaccgccaacaaagagaaugagcugugcucugauguggaacggcagaagaacccggagaauagcaaauugaguauagggcagcagaacggaggucuccgcuccgaaaagagcauugcaucucugcaagagaugacgaaaaagcagggcacaucaaguaauaacaagaauguccuauccguggggaccgcuguuaaagaccugaagcaggagcagacuaaaagcgccucuucgcucaucaccacagaaaugcugcaagauauccagagacauucaagcguguccaggcuugccgacaguucugauuugccagucccccguacuccuggaagcggcgcuggugagaagcacaaagaggaacccauugacaucauuaaggcaccauccucacggcgauuuagugaagauucuagcaccuccaaaguaauggugccucccguuacaccagaccugccugccuguucaccggcgagcgagacggggucugagaacuccgugaauauggcugcccacaccuuaaugauacucaguagagcagccaucagcaggacuacaucggcuacuccccugaaggauaacacucagcaguuccgcgcauccucucggucaacaaccaagaaaagaaagauugaggaacuugacgaaagggagcgcaauagccgaccaaguuccaaaaaccugaccaauucuagcaucccuaugaagaaaaagaagauuaaaaagaaaaagcuacccucauccuuuccagccggcauggacgucgauaaauuccuccugaguuugcauuaugacgaauga

SEQ ID NO: 59838 - RNA, 378 nt, Artificial Sequence
  derived and/or modified sequence opt3 from NPB__Homo_sapiens__NP_683694
auggccagaagcgcuacccuggcagccgcggcucucgcccuuugccuguuguuagcacccccuggccuggccugguacaagccagcugcagggcacuccucuuauucagugggaagggccgcuggucuacucaguggccugcggcgcagcccguacgcccgacguucccagcccuauagaggggcggagccuccaggaggcgccggugcaucucccgaacuucaacugcauccuagguugcggucgcucgcugucuguguucaggacguggccccaaaccugcagcgcugcgagagacugcccgaugggaggggaacauaccaguguaaagcaaauguauuccucucauuacgggcugccgacugccuggcggccuga

SEQ ID NO: 59839 - RNA, 987 nt, Artificial Sequence
  derived and/or modified sequence opt3 from NPBWR1__Homo_sapiens__NP_005276
auggacaacgccagcuucuccgagcccuggccugcuaaugcaucuggcccagauccggcccugucaugcaguaacgcgagcacccucgcuccccuuccugccccacuggcaguggccguccccguuguguacgcuguaaucugugcagugggguuggccggaaauuccgcugucuuauaugugcugcuaagagccccuaggaugaagacaguuacuaaccucuuuauucugaaucuugcgauagcagacgaacuguucacguuggugcucccaaucaacauugccgauuuucugcugcggcaguggcccuucggugagcucaugugcaaauuaaucgucgcuauugaccaauacaauaccuuuucuucgcuguauuuccuuacagugaugucagccgaucgcuacuugguaguucuggcaacugcugaaagccgacguguggccggcagaaccuauagugcggccagggcagucucccuagcugugugggggaucgugacacucgucguucugccuuuugccguguucgcucggcuugacgaugagcagggacgcagacaguguguacugguguuuccacagccggaagccuucugguggagggcaucucgguuguacacccucguccugggcuuugccauacccgugagcacuaucugcguuuuauauacaacccugcucugucgccuucacgcuaugcgacuggacucccaugcgaaggcauuggagagagccaaaaagagggugacguuccuagucguggcuauucuggccguaugccuccuguguuggacuccuuaccaccuuucaaccguuguggcacugacaacugauuugccacaaacaccccucgucaucgccauuaguuacuuuaucaccagccugucuuaugcuaacuccugcuuaaauccuuuccuguacgccuuccuagacgcaucauuucggcguaaccuccgccagcugauaaccuguagagcggcugccuga

SEQ ID NO: 59840 - RNA, 3837 nt, Artificial Sequence
  derived and/or modified sequence opt3 from NPC1__Homo_sapiens__NP_000262
augaccgccagaggccuggcucucgggcuucuguuguuacugcuaugccccgcacagguguucagccaauccugugucugguacggagagugcgguaucgccuauggcgacaagagguacaacugugaauauucugggccuccaaaaccgcuccccaaggauggauacgaccugguucaggagcuuugcccuggcuuuuucuuugguaaugugucacuguguugcgauguacggcaguugcagacacucaaagacaaccugcaacugccacuccaguucuuaagucgcugucccagcugcuuuuauaaucugcuuaacuuguucugugaacugacuugcuccccucgacagucucaguuucuaaaugugacggcgaccgaggauuacgucgacccagugacaaaccaaacuaagaccaauguuaaagaacuccaguauuacguggggcagucguucgcuaacgccauguacaaugcaugucgugaugucgaggcccccucaagcaacgacaaggcucugggacuucugugcggcaaggaugcagacgccugcaaugcuacaaacuggauugaguauauguuuaauaaagauaacggccaggccccuuucaccauaacuccaguguuuagugacuucccgguacacgggauggaacccaugaauaacgcgacaaagggaugugaugaguccguugacgaagugaccgcaccuugcucuugucaagacugcagcaucgucugugguccaaaaccccagccuccacccccgccugcccccuggacgauuuugggccucgaugcuauguacgugaucauguggauuacuuauauggccuuucuguuaguguucuucggggcauuuuucgcugucuggugcuacagaaagagguauuuuguuuccgaguacaccccaaucgacucaaacauagccuucagugugaaugcgagcgauaaaggagaggccucuuguugcgacccuguauccgcagcuuuugaaggcugucugcggcgccucuucacaagaugggguucauuuugcgugaggaaccccgggugugucaucuucuuuagccuuguguucauuacugccugcaguucuggacugguuuuugugcgggucaccacaaauccaguggauuugugguccgcucccagcucgcaggcccgccuagagaaggaauauuucgaccaacauuuuggcccuuucuuccgaaccgagcagcugaucauuagagcaccacucacggauaagcacaucuaccagccguaccccucuggcgccgacguaccuuuugggccaccccuggauauacagauucuucaucaaguucuggacuugcagaucgcuauugaaaacaucacugcguccuaugauaaugagacagugacccuccaggacaucugccuggcaccuuuaucaccauacaacacuaauuguacaauucugaguguccuaaacuauuuccagaauagccacuccgugcucgaccauaaaaagggagaugacuuuuucgucuacgccgauuaucacacccacuuucuguacugcgugagggcucccgccucucuuaacgacacgagcuugcugcaugauccgugucucgguaccuucggcgggccuguuuuuccauggcuggugcuuggaggcuaugacgaucaaaauuacaacaaugcaacagcccugguaauaacuuuccccgucaacaauuacuauaacgacaccgagaaauugcagcgggcucaggccugggaaaaggaguuuaucaacuucgugaaaaauuacaagaacccuaaucucacaauuucauuuacugcagaacguaguaucgaggaugaacugaaccgcgaguccgacagcgauguuuucaccguggucauaucuuaugcgauuauguuuuuauacaucucacuggcucuaggucacaugaaaaguugcagaaggcuccugguggacagcaagguaucccuugggaucgccggcauuuugaucgugcugucuucgguugcauguagccucggagucuucuccuauauuggccugcccuuaacacugauagugaucgaggugauuccauuccuugucuuggccguugggguggauaauaucuuuauccucgugcaggcuuaccaacgggacgaacgacugcagggagagacccuagaccagcagcugggucgcguacucggcgaagucgccccuucaauguuccugaguucuuuuagcgagacuguggcauucuuucuuggggcuuuguccguuaugcccgccgugcauacguucucacuguuugcgggauuagccgucuucauugauuuucuccugcaaauaacaugcuucgugagccuucugggcuuggacaucaagagacaggagaaaaacaggcucgauaucuuuuguugcguucggggugcugaagacgggaccucugugcaggcauccgagaguugucuguuccgcuucuuuaagaauagcuauucuccacuacugcucaaagauuggaugagaccgauuguaauugccaucuucgucggcgugcuguccuuuucaauagcugugcuuaacaaggucgacaucggauuggaucaaagucugagcaugccugacgauucguacaugguugacuacuucaaauccauuucucaguauuuacacgccgggcccccaguguacuuuguacucgaagagggccacgauuauacuagcucaaagggacagaauauggugugcgguggcaugggguguaacaaugacagucugguccagcaaaucuucaacgcagcgcagcuugauaauuacaccaggauuggauuugcccccuccucuuggaucgacgacuauuucgauugggugaagccucagagcuccugcugccguguugacaacauaacagaucaguuuuguaaugcuucaguggucgacccagccugcgugcggugucgaccccugaccccugaaggcaaacaaagaccgcaggguggggauuucaugagguuucuaccaauguuccucagcgacaaccccaacccuaagugcggcaaaggaggccaugcagcuuacaguucugccguuaauauucuguuggggcacggaacucgcgugggcgcaacauauuuuaugacguaccauaccguccugcagacuuccgccgauuucaucgacgcuuuaaagaaagcgcggcucauugccagcaacguaacagagaccauggguaucaaugggucggcauacagaguguucccauauucaguguuuuacguuuucuaugagcaguaccugacaauaaucgaugacacuauuuuuaaccuuggagucucucugggcgcuaucuucuuggugaccaugguacuccuggguugugaacuauggagugccgugauuaugugcgccacgaucgcuaugguccugguuaauauguuuggcgugauguggcuuugggggauaucccucaacgcagugagccuggucaauuuggugaugucuuguggaauuagcguugaguucugcucccacaucaccagggccuuuacaguaucaaugaagggcagucgcguggaacgagcggaggaagcucuggcccauauggggagcucugucuucuccggaaucacuuuaaccaaguuuggcgguauugugguucucgcauucgccaaaucacaaaucuuucagauuuucuauuuucggauguaccuggcuauggugcuucugggggcaacacacggauugauauuccuccccguccugcuaaguuauaucggcccuagcgugaacaaggccaaauccugugcgacugaggagcguuacaaggguaccgaaagagagaggcugcuuaauuucuga

SEQ ID NO: 59841 - RNA, 3999 nt, Artificial Sequence
  derived and/or modified sequence opt3 from NPC1L1__Homo_sapiens__NP_001095118
auggccgaggcuggccugagaggguggcuccuuugggcacuguuguuaaggcuggcccagagcgaacccuacaccacaauccaccaaccuggauauugcgcguucuacgacgagugugguaagaacccagaacuauccggcucucucaugacucugucaaaugugaguugccuuagcaacacgccggcucggaaaauuaccggggaucaucugauauugcuccagaagaucuguccccgccuguauacaggaccuaauacucaggccugcuguuccgcaaaacagcuggucucucucgaggccucguuaucaauuaccaaggcucugcuuacacgaugcccagcauguagcgacaacuuuguuaauuugcacugccauaacaccuguagucccaaucaaucccuguucaucaacgugacucguguagcccagcuaggcgcuggucagcucccugccguggucgcguacgaagcauuuuaucagcacucuuucgccgagcaaagcuacgauuccugcucaagagugaggguuccagcugccgcaacacuggcuguggggaccauguguggagucuauggcagugcccuuugcaaugcgcagcgguggcugaacuuucagggcgacacggggaauggauuggccccucucgauauuacuuuccaucuguuagagccuggucaggcagugggcagcgggauccaaccacugaacgaaggaguagcucgcugcaaugagucucagggcgacgauguugccaccuguuccugccaggacugugcugccucaugcccggcaauagccagaccccaagcucucgauagcacauuuuaccuuggucagaugccugggagucugguguugaucauuauccuauguucugucuucgcgguggugacuauucugcucgucggauuuaggguugcaccagcccgggacaaauccaagaugguggaucccaagaaaggcaccagccugucggacaaacuuucuuucuccacacacacccuguugggccaguuuuuccagggguggggaacguggguagcuucauggccucucacuauccugguguuaagugucauaccagugguugcccuggcagccggucuaguguuuacagaacucaccacugaucccgucgagcuguggagcgcuccgaacucccaagcccgcucugagaaggcauuccacgaccagcauuucggccccuuuuuccgaacaaaucaggugauucuuaccgcgcccaacagaagcucauacagguaugacaguuugcugcucgggccaaagaacuuuuccggaauccuggaucuugaccuguugcucgaacuguuagagcugcaggaacggcuacgucaccuccaaguauggagcccugaggcucagcgcaauauuucucugcaggauaucugcuacgcaccccuuaacccagacaauacgucauuguaugauuguugcaucaacagucugcuccaguacuuccaaaauaacagaacccuguuacugcuuacagccaaucagacuuugaugggccagaccagccagguugacuggaaagaucauuuucucuauugugccaacgcuccccugacauucaaggacgguacugcccuagcacuguccugcauggcugauuacggggccccuguguuuccauuccucgcgauuggcggauauaagggcaaagacuacucugaagccgaggcucugauaaugaccuuuucgcuuaauaacuacccggcaggggaucccagguuggcccaagcuaagcugugggaggaagccuucuuagaggaaaugcgggcauuucagcgacgcauggcgggaauguuccaggucacauuuauggccgagagaagccucgaagacgagaucaauaggaccacugcugaggaccugccuauuuucgccacguccuauaucgugauauuccuuuacauuucacuggcauuggguaguuauucuagcuggucccgggucaugguggauucaaaagcuacacucggccuggguggaguugccgugguacuaggcgcagucauggccgcuaugggguuuuucagcuaccuggggaucagaucuucccucgugauccugcaaguugugccauuucuugucuugagugugggcgcggacaacauuuucaucuuuguacuggaauaucagagauuacccaggcguccuggagagccacgggaagugcacauuggccgagcccucgggagaguugcacccagcaugcugcuuuguucucuguccgaggcuauaugcuucuuucuaggagcccucaccccgaugccugccgucaggacuuucgcucugaccucagguuuggcagugauccuggauuuucuccuccagaugagugccuucguggcgcugcuuagccuggacucgaagcgccaggaggcuucccgguuggaugucugcuguugcguuaaaccacaagaauuacccccucccggccagggggagggacugcuacugggcuuuuuccagaaggccuacgcaccauuucuucuccacuggauuacaagagguguggugcuguugcuguucuuagcccucuucgggguaucucuguauagcaugugucauaucucagucggccuugaccaggaacuggcuuugccuaaagauaguuaccuccuggacuacuuucuauuccugaauagguauuuugaggugggagcacccguuuacuucgugaccacucuuggcuauaacuuuuccucugaagccgggaugaaugcgaucugcagcuccgcuggauguaacaacuucucauuuacacaaaagauucaguacgccacggaguucccagagcagagcuaucucgcaauaccggccaguucuugggucgaugacuuuaucgauuggcugaccccuuccagcugcugucgcuuguacauuucgggccccaauaaggacaaauucugcccaucaacugugaacucuuuaaauugucugaagaacugcaugaguaucacaauggguuccguucgacccagcguggaacaguuucacaaauaucucccuugguuccugaaugaucggccaaacauuaagugucccaaagggggacuugcugccuacucuaccagcguaaaucugacauccgacggccaagucuuggcaucacguuucauggcuuaccauaagccucuaaagaacagucaggacuauacugaggcccugagagcggccagggaacucgcagcuaauaucaccgccgaucugcgcaaagugccggguacggacccagcuuuugagguguuccccuacaccauaacaaacgucuuuuaugaacaguaccuuacuaucuuaccugagggccuguucaugcucagcuugugccugguuccaaccuuugcagugucuugccuccugcuugggcuggauuugcgguccggacuacugaaucucuuaucaauuguaaugauccugguggacacagucggcuucauggcccuuugggggauuaguuauaacgccgugagccugaucaaucucguuuccgcugugggaaugucugucgaguuugugucgcacauaacucgcagcuucgcgauuucaaccaagcccacgugguuggaaagggcaaaagaggccacaaucuccaugggcagugcuguuuuugccgguguggcaaugaccaaccugccugggauucucguccugggacuugccaaggcucaacuaauccagauauucuuuuuccgacugaauuuguuaaucacucugcucggccugcuucauggucugguauuucucccggugauuuugucuuacguuggccccgaugugaacccagcgcuggcccuagaacagaaacgcgcagaggaagcugucgccgcagugaugguagccagcuguccuaaccaccccucccgggugucaacagcugacaauaucuaugucaaccacucuuucgaggggagcauuaagggagccggcgcgaucaguaauuuccugccaaacaaugggagacaguuuuga

SEQ ID NO: 59842 - RNA, 456 nt, Artificial Sequence
  derived and/or modified sequence opt3 from NPC2__Homo_sapiens__NP_006423
augagauuccuggccgcuaccuuucuccuucuggcauugagcacagccgcgcaggcugagcccgugcaauucaaggacugcggcuccgucgaugggguuaucaaagaagugaacguaucuccuuguccaacucagccgugccaguuaucaaagggacagaguuacagcgugaaugucacguuuaccuccaacauucaaucuaaaucgucaaaggccgugguucacgguauacugaugggcgugcccgucccuuucccaauccccgagccugacggguguaaaagcggaauuaauugcccaauccagaaggauaagacauauaguuaccuaaacaaacuccccgugaaguccgaauauccuucuauuaaacugguaguugaguggcagcuucaggacgauaagaaucaaagccuguuuuguugggaaaucccagugcagauagucucccauuuguga

SEQ ID NO: 59843 - RNA, 978 nt, Artificial Sequence
  derived and/or modified sequence opt3 from NPDC1__Homo_sapiens__NP_056207
auggccacaccccugccuccaccgagccccagacaccucaggcuucugcgguuguuacuguccggccuagugcucggggcugcacugcgcggagccgcggcuggucauccugacgucgccgcaugcccaggcucucuugauugugcccugaagcgacgugcuagaugucccccuggggcacacgccugcggaccaugcuugcagcccuuccaagaggaccagcagggccucuguguuccuaggaugcggcgcccaccgggugggggaagaccccagccuaggcuggaagaugagaucgacuuucuggcucaagaacucgcccggaaagagucaggccauaguaccccacccuuaccuaaggaucgccagcgacugccagaacccgcgacucuuggcuucagcgcaagagggcagggauuggagcugggucuaccguccacgccuggcacccccacaccaacuccucacaccucucucgggucgcccgugucaagcgacccaguacauaugaguccccuggagccuaggggaggccagggugaugggcuugcccugguguugauucucgcuuuuugcgucgccggagcagcugcccuguccguggcgucuuuauguuggugccggcugcaacgugaaauacgccucacacagaaagccgacuacgcaaccgcuaaggccccaggcagcccggcugcccccagaaucuccccuggcgaucagaggcuugcacagucagccgagauguaucacuaccaacaccagcggcagcaaaugcuguguuuggaacgacauaaagagccacccaaggagcuagacacugcuaguagcgaugaagagaacgaagacggggauuucacaguuuaugagugcccuggacuggcgccaaccggugaaauggaggugcgcaauccccucuuugaccacgcagcccugucugcuccgcuuccugccccauccucacccccugcacugcccuga

SEQ ID NO: 59844 - RNA, 1488 nt, Artificial Sequence
  derived and/or modified sequence opt3 from NPEPL1__Homo_sapiens__NP_001191801
auggagcugcacggcgggaacagaggagguuaccagcccaaggcccucgaacaaagcggcugcuggcuuuggcaggcugcacuguccaccuugaauccuaacccaacagacucuuguccguuauaucugaauuacgccacuguggcggcucuacccugcagggucucacggcauaacaguccuagcgccgcacacuucaucacgcgccucguucgaaccugucugccacccggggcccaucguugcauugugaugguaugugagcagccugaaguguuugcuuccgcaugcgcccuugcuagagccuucccacuguuuacacacaggucuggagcgucgcggcgcuuggagaaaaagacugucaccguggaguucuuucucguuggccaggauaauggucccguggaagucucaacacugcaaugucuggcaaacgccaccgacggggugagacucgcugccaggauaguagauacuccuugcaaugagaugaacacagacaccuucuuagaagagaucaauaaaguuggaaaggaacugggcauuaucccaacgauuauccgggaugaggagcuuaaaacucgcggcuuugggggaauauauggugugggcaaggcagcuuugcauccgcccgcccuggcgguccuaagccacaccccugacggggccacacagacuaucgcaugggugggaaagggcauuguguacgauaccggugggcucaguaucaaaggaaagacaaccaugccaggcaugaaacgagacuguggcggggcugccgcuguccugggagccuucagagcagccauuaagcaggguuuuaaagauaaccuucacgcuguuuucugccuggcggaaaauuccgugggccccaacgcaacgaggccugacgauauccauuugcucuauucugggaagacuguagagauaaauaacacagacgccgaaggacggcugguguuagcugauggcgucagcuacgccuguaaggaccugggugcagacauuauccucgauauggccacccuuacuggggcucagggcauugccacaggaaaauaucacgcagcggugcugaccaauuccgcugagugggaagccgcaugcguuaaggccggccguaaaugcggggacuuggugcauccccuagucuacuguccagagcugcacuuuucagaguucacgagugcuguggccgauaugaagaacagcguagcagaccgcgauaacucuccguccucaugcgcuggacucuuuaucgccagccacaucgguuucgacuggccuggcguuugggugcaucuggauauugcggcccccguccacgcuggggaaagagcaaccggauucggcguggcccuucuguuggcucucuuugguagggccagugaggacccacuguuaaaucuggucucuccucuagggugugaaguggauguugaggaaggcgaccucggacgggauuccaaacgacgcagacugguguga

SEQ ID NO: 59845 - RNA, 2760 nt, Artificial Sequence
  derived and/or modified sequence opt3 from NPEPPS__Homo_sapiens__NP_006301
auguggcuggccgcugcagcccccagccucgcgagaaggcuucuguucuugggcccuccaccgcccccuuuacugcuacucguguuuucccggucuucacgccgacgucugcacagucuugggcuggcugccaugccagagaagagacccuucgaaagguugccugcagacgucagcccaaucaacuacucccucugccugaaacccgaucugcucgacuuuaccuucgagggaaaguuagaagccgcugcacagguucggcaagccacaaaucagauugugaugaacugugcugauauagacaucauuacugccucuuaugcgccugagggugaugaagagauccaugcaacgggcuuuaauuaccagaacgaggacgaaaaaguaacccugucguucccaucaacacuucagacugggaccggaacauugaagauugauuuugugggcgagcugaaugacaaaaugaaggguuucuaucgcagcaaguacaccacuccgaguggggaagucagauaugccgcugugacacaauuugaggccaccgaugcaaggcgggcuuuccccugcugggacgagccugccaucaaagcgacguuugauauaucccuaguugugccaaaggaccgcgucgcccucucuaacaugaaugugaucgaucgaaaacccuacccugacgacgaaaaccugguagagguuaaguucgcaagaacuccagugaugagcaccuaucuugucgcuuuuguggugggagaauacgauuucgucgagacaagguccaaagacggcguuugugugcggguauacacucccgugggcaaggccgaacaggggaaguucgcucuggaggucgccgcaaaaaccuugccguuuuauaaggauuacuucaaugugccuuauccccucccaaaaauugaccugaucgccauugcugauuuugcggcaggagccauggagaacugggguuuaguuacauaccgugaaaccgcucugcucaucgacccuaaaaauucaugcaguagcucucgccaguggguggcccuugucgugggccacgagcuggcacaucagugguucgggaacuugguaacgauggaaugguggacucaccuauggcugaaugagggauuugccuccuggauagaauaucucuguguugaucauugcuuccccgaguacgacauuuggacacaauuugugucagcugauuauaccagagcccaggagcuggacgcacuugauaacagccacccaaucgaagucagugugggccaccccucugaggucgacgaaauuuucgacgcgaucuccuacagcaagggugcuucggugaucaggaugcugcaugauuacauuggggacaaggauuuuaaaaagggaaugaauauguauuugacuaaguuccagcagaaaaacgccgcaacagaggaccucugggaaucucuggagaacgccuccggcaagccuauagcugccguuaugaauaccuggacgaaacaaaugggcuuuccauuaaucuacguggaggcagaacagguagaggaugaccggcugcuacgacucucacagaagaaauucugugcugggggaaguuaugucggugaagauugcccgcaauggauggugcccauuaccaucagcacauccgaggacccuaaccaggccaagcugaagauacuuauggauaaaccagagaugaauguuguguugaagaacgucaaacccgaccagugggugaagcugaaucucggcacuguaggguuuuaccgcacccaguauucuagcgcgaugcuggaaucacuucugccuggaauuagagauuugagucucccacccguggacaggcugggcuuacaaaacgaucuguucucccuagcccgggcugguaucaucagcacaguugagguccucaaagugauggaagcauucgugaaugagccgaacuacacugucuggucugaccugucauguaaucuugggauuuugaguacccugcucagccacacagacuuuuaugaagagauccaggaguucguuaaggauguguuuuccccuauuggcgaacgccugggaugggacccaaagcccggcgaggggcauuuagaugcccugcuuagaggauuggugcucgguaaacugggcaaggcugggcacaaagccacccuagaagaggcaaggcgucgguucaaggaccacguagaaggaaaacagauacugucugcggaucuccgaucgccugucuaccugacugugcuuaagcauggcgacgguacgacauuggauaucaugcugaaguuacacaaacaggccgacaugcaagaggagaagaacagaauugaaaggguucucggggcuacccugcuucccgaucugauccagaaaguguugacuuuugcccucagcgaggaaguccgcccacaggacaccguguccguuaucggcggaguggcaggcgggucaaagcauggacggaaagcugccuggaaguucauuaaagauaauugggaggaacuguacaacagauaucaggguggcuuucuaauaaguaggcugaucaagcucucuguagagggguucgcagucgacaagauggccggagaggugaaagcguuuuucgaaagccacccugcucccuccgccgagcgcacaauucaacagugcugugaaaauauccugcuuaacgcagcuugguugaagcgagaugccgagucaauucaucaguaccuguuacagcggaaagccagcccaccgaccguguga

SEQ ID NO: 59846 - RNA, 342 nt, Artificial Sequence
  derived and/or modified sequence opt3 from NPFF__Homo_sapiens__NP_003708
auggacagcagacaggccgcugcacugcucgugcuucuguuguuaaucgauggcgggugcgccgagggacccgguggccaacaggaagaccagcuguccgcggaggaagauucugagccucuaccaccgcaggacgcucaaaccucagggagucuccugcacuaccuucugcaggccauggaaaggcccggacggagccaggcauucuuguuucagccucaacgcuucggccgaaacacacaggguuccuggcguaaugaguggcucucuccaagagccggggagggacugaacucgcaguuuuggucacuggcugcaccccagagguucggcaagaaauga

SEQ ID NO: 59847 - RNA, 1272 nt, Artificial Sequence
  derived and/or modified sequence opt3 from NPFFR2__Homo_sapiens__NP_001138228
auguucaucaugaacgagaagugggacaccaauagcuccgaaaacuggcaccccauuuggaaugugaacgauacaaaacaucaccuguacucugacauaaauaucacuuaugucaacuacuaucuccaucagccucaaguugccgcuauuuuuaucauuucauacuuccuuaucuuuuuccugugcaugaugggcaauacggugguauguuuuauagugaugagaaacaagcacaugcauaccgucacaaauuuguucaucuuaaaccuggcaauuagugaucuacucguggggaucuuuugcaugccaauuacucugcuugacaauaucauagccggauggccguucgguaacaccauguguaaaauuagcggccugguucaggggaucuccguggcggcuucugucuuuacauugguggccauugcaguagauagguuccagugcguuguguaucccuuuaagccuaaacucaccaucaagacugccuucgucaucauuaugauaaucugggugcuggcuauuacaaucaugucgccaucagcagugaugcugcacguccaggaggaaaaguacuaucggguucgccucaauagccaaaacaaaaccagucccguguacuggugucgagaggacuggccuaaucaggaaaugcguaagauauacacgacuguauuauuugccaacauuuaucuggcuccacuuuccuugaucgugaucauguacggaagaauuggcaucucucuguucagggccgcggucccccacaccggucggaaaaaccaggagcaguggcaugugguuagccgcaagaaacaaaagauuauaaagaugcuacucaucguggcacugcuuuucauucuguccugguugccucucuggacacugaugauguuaucagauuaugccgaccugaguccaaaugagcuccagaucaucaacauuuacauauauccguuugcucacuggcuugccuucgggaauagcucugucaaccccaucauuuacggauuuuucaaugaaaacuuuagaaggggcuuccaggaggcauuucagcugcaauugugccagaaacgggcuaagccuauggaagccuaugcgcuaaaagccaagucccaugugcugaucaauacuucaaaccagcucguacaagagagcaccuuccagaauccacacggcgagacacugcuuuaccgcaaaagugcagaaaagccccagcaggagcugguuauggaagaguugaaagaaaccacgaacucuuccgagauuuga

SEQ ID NO: 59848 - RNA, 2202 nt, Artificial Sequence
  derived and/or modified sequence opt3 from NPHP1__Homo_sapiens__NP_000263
augcuggccagaaggcagcgggacccccuccaagcacuucgccgacguaaccaggagcugaagcaacagguggauagcuuguuauccgaaucucagcugaaagaggcucuagaaccuaauaagagacagcacaucuaccagaggugcauucagcucaaacaagccauagacgagaacaagaaugcgcugcagaaacuuucaaaggcugaugaaagugccccagucgcaaacuauaaucagcggaaggaggaggaacauacccuguuggacaaacucacacagcaacugcagggccuggccguuacuaucagccgcgagaacauuacggaagugggggcuccgaccgaggaggaagaggaauccgagucugaagauucggaggacucaggaggugaggaagaggaugcagaagaggaagaggaggaaaaggaggaaaaugagagccacaaauggaguacaggcgaagaguacaucgccguaggggacuucacugcucagcaagugggagaucucaccuuuaagaaaggcgagauuuuacuggucaucgaaaagaagcccgacgguugguggauagccaaagaugcgaaggggaacgagggacuugugccuagaacauauuuggaaccauacuccgaggaggaagagggccaggaaucuagcgaggaaggcuccgaggaggacguugaagcaguggaugagaccgccgacggggcugaagucaaacagaggacugacccccauuggucagccgugcagaaggcaaucagugaggcuggaauuuucugucugguaaaucacguuagcuuuugcuaucuaaucgugcucaugcggaaccgcauggaaacagucgaggauaccaaugguucugagacgggcuuccgagccuggaacgugcaauccagagggaggauuuuucuggugucaaaaccuguccuucagcagaucaauacuguugacgugcugaccacaaugggagcgauaccagccggcuuccggcccagcacuuugagucagcuccuggaagaggguaaccaauuucgugcaaauuacuucuuacagccugaacugaugccaucucagcucgcuuuucgcgaucuuaugugggacgccaccgaggggacaauuagauccaggccgagccggaucucgcugauuuugacccuauggucuuguaagaugaucccccugccuggaauguccauccagguacucucacgacaugugcgccugugccuuuucgauggcaacaaaguccugaguaacauucacacggugagagcuacuuggcaaccaaagaagcccaaaacauggaccuuuagcccucagguuacuaggauauugccaugucuccuggacggcgauugcuucauccgguccaauucugccagccccgacuuagggauucuguuugaacuaggaaucucauauauacgcaacaguacaggugagagaggcgagcucuccuguggguggguguuccugaaacuuuucgaugcaagcggagucccgauuccugccaagaccuacgaauuguuucugaauggcgguacgcccuacgagaaggggaucgaaguggacccaucuaucucaaggcgugcucacggcaguguauucuaucagauuaugaccaugcggcgacagccucaacuccugguuaaacuuagaagccugaacaggcgcucccggaauguguugucucuccugcccgagacauuaaucggaaacaugugcucgauucaucugcuaauauuuuacagacagauccucggcgauguccugcuuaaggacaggaugagcuugcaguccacugaccugauuucacacccaaugcucgcgaccuuccccaugcuguuagagcaaccugaugugauggacgcacugcgcaguucuugggccgggaaggaaagcacacuuaaacgauccgagaagcgggauaaagaauuuuugaagucaacuuuccuccuggucuaucaugacugugugcuaccacugcuccacagcacccgucugccgcccuuuagaugggcugaggaagagacagagaccgccagguggaaaguuaucacugauuuccuuaagcagaaucaggaaaaccagggagcauugcaagcccuguuaucuccugacggugugcacgagccauuugaucucuccgaacagacguacgacuuccugggcgagaugcgcaagaaugcuguauga

SEQ ID NO: 59849 - RNA, 3993 nt, Artificial Sequence
  derived and/or modified sequence opt3 from NPHP3__Homo_sapiens__NP_694972
augggcaccgccagcucccuggugucucccgcugggggagaggucaucgaagacacauacggugcaggcgggggagaggccugcgaaauuccuguugaggugaagccaaaagcgagacuccuuaggaacucauuccggcgcggcgcuggugccgcagccggggcuggaccgggcagucugccccgaggcguaggggcaggagguuuguuaggcgccagcuuuaaguccacugggucuucggugccugaacuggaguaugcugccgcggaguacgaacgucuaagaaaagaguaugaaauauucagggucucaaagaaucaggagcuccugagcaugggacggcgcgaggcaaaacuugauacggaaaacaagagacugagggccgaguugcaagcucuccagaagaccuaccagaaaauccugcgggaaaaggagagugcccuggaagcaaaauaucaggcuauggagcgcgccgcgacauuugagcacgaccgagauaaggugaaaagacaauucaagauuuuuagggaaacuaaggagaaugaaauccaggaccucuuacgggccaaacgugagcuggaauccaagcuccagcgcuugcaggcacaaggcauucagguuuucgauccaggugagucugacagcgaugacaacuguaccgaugugacagcugccgggacccagugcgaguacuggacuggaggcgcucugggcuccgaacccucaaucgggaguaugauacagcuacaacagagcuuuagaggaccugaguucgcccauucuuccaucgacgucgaagguccauuugcaaaugugaacagggaugacugggauauugccguagcuucacuccugcagguuacaccccuuuucagccacagucuguggucuaauaccgugcgguguuauuugaucuacacggacgagacucaaccugaaauggaccucuuucugaaagauuacuccccaaaguuaaaacgaaugugcgagaccaugggcuauuucuuucaugcggucuacuucccgauugacguggagaaccaguaucugacagugcgcaagugggaaaucgagaaaagcucgcucgucauacuuuucauucaccugacuuugcccucucuacugcucgaagauugugaggaggcauuucugaagaauccugaagggaagccaagacuuaucuuccauaggcuggaggacggaaaaguuuccucagauagugugcagcaguugauugaccaaguaagcaaccucaauaagaccuccaaagccaagaucaucgaucacucuggcgaccccgcugaagguguguacaaaacauauauuugcgucgagaagauaaucaagcaggauauucugggguuugaaaacaccgacuuagagacgaaagaucugggcagcgaggacucaaucccugaagaggacgauuucggagacgugcuaugggauauacacgacgaacaggagcagauggaaacuuuucaacaggccaguaauuccgcacaugagcucggcuucgagaaguacuaucagcggcugaacgaucuuguugccgcuccagcccccauuccgccuuugcuggugagcgggggacccgguucuggcaaaucacuccugcuuaguaaguggauccagcugcaacagaaaaauagcccaaacacauugauccucucccacuuugucgggcgcccuaugucuaccucgagcgaauccucacugauuaucaagagauuaacucugaagcuaaugcagcauaguuggucugugagcgcacucacacuggaccccgcgaaacuuuuggaggaguucccaagguggcuggagaagcucuccgcucgucaccagggaucaauuauaaucguaauugauagcaucgaccaaguucaacagguggaaaaacacaugaaguggcugaucgaucccuuaccugucaacgugcgggucauugugucuguuaauguggagaccuguccaccggccuggcgacuguggcccacgcuucauuuggacccucucuccccaaaagaugcaaagaguauaaucauugccgagugccacagcguagacaucaagcugucuaaagaacaggagaagaaacuagaaagacauuguagguccgcuaccacaugcaacgcccuguacgucacucucuuuggcaagaugauugcacgcgcuggucgggccgggaaucuggauaaaauccuucaccaguguuuccagugccaggacaccuugucacuguacagauuagugcuccauaguauaagggagagcauggcgaacgacguugauaaggagcugaugaaacaaauccuuugccuggugaaugucucgcacaacggcguguccgaaucugaguugauggaacucuaucccgagaugagcuggacauuucugacuucacuaauucacagucuguacaagaugugucuccugaccuauggaugcggccuuuugcgcuuccagcaucugcaggccugggaaacaguacgauuagaguaccucgaggggccuaccgugacuuccucuuaucggcagaagcugaucaauuacuuuacgcuucaacugagccaggaccguguuacauggagauccgcugaugaacuaccauggcuuuuccagcagcaaggaucaaaacagaagcugcacgacuguuugcugaacuuauucgucagccagaaucucuauaaaaggggucauuuugcagagcugcuuaguuacuggcaauucgugggcaaggauaaaucugccauggcuaccgaauacuuugacucccugaagcaguaugagaagaacugcgaaggggaggauaauaugagcuguuuggccgaccucuacgagacucugggacgcuuccuaaaagaucugggccuucucucgcaggcaauugugccccugcagcggucauuggaaaucagagagaccgcgcuggacccggaucacccuagggucgcccaaucuuuacaccagcucgcuaguguuuaugugcaguggaagaaauuugguaacgccgaacagcuguacaagcaagcacuugagauauccgaaaaugcuuauggggccgaccauccauacacagcacgagagcuggaggccuuggcuacccucuaucagaaacagaacaaguacgaacaggcggagcacuuccgcaagaaaucuuuuaagauucaucaaaaagccaucaagaaaaagggcaaucuguacggauucgcacuacugcggagaagggcccuucagcucgaagaacugacuuugggcaaggauacacccgacaacgcucguacguuaaacgagcugggggugcucuauuaccugcagaauaaccuugaaaccgccgaccaguuucugaaacgcagcuuggagaugcgggaaagaguacuaggaccugaucaccccgacugcgcucaaagccugaauaaccucgcagcccuguguaaugagaagaaacaguaugauaaggcggaggaacuuuacgagagggcuuuagacauucgacggcgcgcccuggcaccagaucauccuucccucgccuauacugucaaacacuuggcuauccuguacaagaaaaugggcaagcucgacaaggcagugccccuguaugaacuugccguugagauaagacagaaaucauucgguccaaagcacccgaguguggcgacagcucuggucaacuuggccgugcuauacagccaaaugaaaaagcauguugaagcacugccucucuacgagagggccuuaaaaaucuaugaagauucucuggggcggaugcacccccgagugggagagacccuuaagaaucuggcuguacucuccuacgagggcggugacuuugaaaaggccgcagaguuguauaaaagagcuauggaaauuaaggaggccgaaacaucacugcucggcgggaaagcgccaagucgccauagcuccucuggagauacuuucucgcugaagaccgcccacagccccaacgucuuucuucagcagggccagagguga

SEQ ID NO: 59850 - RNA, 2742 nt, Artificial Sequence
  derived and/or modified sequence opt3 from NPHP4__Homo_sapiens__NP_001278522
augcaccccagaagccuguccguggccccuaaguggucuggcgggcucccaggaaaccauccgaggccccuucgggaguucccucuggaagcugguaucucacacuuggaggcagacuuaagucagaccagccugguccuagaaacauccauugccgagcaacuccaggaacugccauuuacuccccuucaugcgccuauaguugugggcacgcagacccgaucuucggcugggcagccaucacgcgccagcaugguacuguugcaaaguuccggauuccccgagauccucgaugcaaauaaacagccugccgaggcugugucugcaacagaaccagucacuuuuaacccgcagaaggaggaaagcgacugccugcaguccaaugagauggugcugcaauuccucgccuuuucacguguugcucaggauuguagaggcaccaguuggcccaaaacaguguacuucaccuuucaguucuauagguuuccuccagccacuacaccccgguuacagcugguccaacuugacgaggcgggucagccuagcucuggggcauugacccacauucuggugccaguaucccgcgauggaacguucgacgccggcucacccggcuuucagcuaagauacaugguugggccgggauuccucaagccuggugaaaggcggugcuuugcucgcuaucuggccgugcaaacucuucagaucgaugucugggacggcgauagccuguugcucauugggagugcagcugugcagaugaaacaucuguuacgacagggaagacccgccgugcaagcgucucacgagcuggaagucguugccaccgaguacgaacaggacaacauggugguauccggcgauaugcucgguuucgggagggugaagccaaucggaguccacagcgugguuaagggccggcuucaucugacauuggcaaaugugggccacccuugugagcagaaaguccgugggugcucgacucuacccccaucucgcuccagagugauaucaaacgacggagcuaguagguucagcgguggcucccugcucaccacagggucuagccggcgaaagcauguaguucaggcccaaaaacuggcugauguggacucagagcuugccgcaaugcuguugacccacgcccgccagggaaagggcccccaggacgucaguagagaauccgaugcuacgaggcggcgcaaacucgagagaaugaggagcgugcgucugcaggaagcggguggggacuuaggccggcgaggaacuucuguccuggcacaacagucagugagaacacagcaccuaagggaucuccagguuaucgccgcuuaucgcgagcggaccaaggccgaaaguauugcaagccugcuuuccuuggccaucacuacagagcauacccugcacgcuacgcucggcguggccgaguuuuucgaauuuguacugaagaauccucauaacacccaacacacagucacuguggagauugacaauccagaacuuucuguuaucguggauucgcaggaguggagagacuucaaaggggcagcgggacugcauaccccggucgaagaggauauguuucacuugagggguagccucgcuccccagcuguacuuacgcccucacgagacagcccaugugccauucaaguuucaauccuucucagcaggccagcuggccaugguacaggcuagucccgggcuaucuaacgaaaaaggaauggacgccgugagcccuuggaaguccucagcaguuccaacuaaacacgcuaagguccucuuucgagccagcggcgguaaacccauagcggugcugugucuuaccguggaguugcagccgcaugucguugaucaaguguuccgguuuuaucacccugaacugucuuuccucaagaaggccauucgucugccacccuggcacacauuuccuggggcucccgugggcauguuaggagaggacccaccuguacaugucagaugcuccgaucccaaugugaucugugagacccagaacguuggcccaggggaaccgagggacauuuuccugaaaguggcaaguggaccuagccccgagaucaaggacuucuuugucaucauuuacucugaucgcuggcuugccacuccaacgcagacauggcaaguguacuugcacucccuccagcggguugacgugucaugcguagcuggucagcugaccagacuaagucugguccucaggggcacucagaccgugcgaaaagugcgcgccuucacaagccauccccaggaacugaagaccgauccuaaaggggucuuuguucuuccaccccggggagugcaagacuugcacguaggcgugagaccucugagggcagguucgcguuucguccauuuaaaucucguggauguugacugucaccagcugguggcguccuggcuugucugccuguguugccgccagccguugauaucuaaggccuuugagaucaugcucgcugccggggaaggcaagggagugaacaaacggauuacuuauacaaauccauaccccagcagaaggacguuccaucugcacucagaucacccugagcuacugcgauuucgggaggacaguuuccaaguuggcgggggagaaaccuauacuaucggccuccaguuugcaccaucccagcgcgugggugaggaagagauacugauuuacaucaacgaucaugaagacaagaacgaggaggcuuucugcgucaaaguaaucuaucaguga

SEQ ID NO: 59851 - RNA, 3726 nt, Artificial Sequence
  derived and/or modified sequence opt3 from NPHS1__Homo_sapiens__NP_004637
auggcccugggcaccacacucagagcuagccuucuguuguuagggcugcuaacugagggacucgcacagcuggccauccccgcguccgugccuagggguuucugggcccuuccagaaaaccugacggucguugagggcgccucuguggaauugcggugcgggguaucaaccccgggaagugcagugcaaugggccaaggacggccuccugcugggucccgauccucgcauuccaggguuuccccgauaccgucucgagggagacccugcuagaggcgaguuccacuuacauauagaggcaugugaucugagcgacgaugccgaguaugaaugccaggucggcagguccgagauggggccagaacuugugucuccccggguuaucuugucgauucuggugccuccaaaacuacuccugcuuacaccggaggcuggaacuauggucaccuggguggccggucaggaguacguaguuaauugugugucaggcgacgcgaagcccgcaccugauaucacaauucuguugagcgggcagaccaucagugacauauccgccaacgucaaugaaggaucucaacagaaacucuuuacuguggaggcuacagcccgcgugaccccaagaagcuccgauaacaggcagcuguuagucugcgaagcaucaagucccgcucuggaggccccuaucaaggcgagcuucacgguuaaugugcucuuuccacccggcccgccuguaauugaauggcccggucuugacgaggggcacgugcgggccggacagucucuggaguugccaugugucgcacgcggcggcaacccucuagcuacucugcaauggcucaaaaaugggcagcccguguccaccgccuggggaacagaacauacucaggcuguugcccgaucagugcuggucaugaccgugagaccagaggaucacggugcacagcuuagcugcgaagcccauaacaguguaucugcuggcacacaagagcacgggaucacccugcagguuacguuucccccuuccgcgauuaucauauugggaagcgcaucgcagacugaaaauaagaacgugacacucucuugugucuccaagucaaguaggccacgggugcuguuacguugguggcugggcuggcgccaacuacucccgauggaggagaccgucauggacggucugcacgggggccauauuagcauguccaaucuuaccuucuuggccagaagggaagauaacggacugacacugaccugcgaggcuuucucugaagccuuuacgaaagagaccuucaagaaaagccucauccuuaaugugaaguaucccgcacagaaacuguggauugaaggcccuccagaggggcagaaguugcgggccggaacacgaguucgccucgugugucuggcuaucgguggcaaccccgagccuucauuaaugugguacaaggacaguagaacuguaaccgaauccaggcugccacaggagagccggcgcguccaccuagggucuguggaaaaaucaggaaguacauuuagcagagagcucguucuggugacuggccccuccgacaaucaagccaaguuuaccugcaaagcaggucagcuuucugcgucgacacaguuggcuguccaguucccgccuaccaacgugacuauccuggccaacgcaagcgcccucaggccaggggaugcucugaauuuaacguguguauccgugucaaguaaucccccuguuaaccugucuugggacaaggagggcgaacgucuugagggagucgccgcacccccacggcgagcuccuuucaaaggcagcgccgcggccagauccguguugcuccaagugucaagcagggaucaugggcagcgcgucacaugccgggcucacucugcagaacugagagagaccguuuccaguuucuauaggcuaaacgugcuguaccgccccgaauuucucggagaacaggugcugguagucacugccguggagcagggugaagcucuuuugccaguuagcgugucugccaauccggcaccugaggcguucaacuggaccuuucgaggcuaucggcugucccccgccgggggaccacgucacagaauuuuaucaaguggcgcucuccaucuguggaaugucacaagggccgacgauggucuuuaccaacugcacugccagaacagcgaagggaccgcagaggcucgcuugcggcucgacgugcauuacgcccccacuauaagagcacugcaggauccuacagaaguuaaugugggcggaucgguagacaucgucuguacgguggaugccaacccaauucuacccggcauguucaauugggagaggcugggggaggacgaagaggaucagucccucgacgacauggaaaagaucucucgaggaccuaccggccgccugcggauacaccaugcuaaacuugcgcaagccggugcauaucagugcauuguggauaacggggucgcuccgccagccagaagguugcugcguuuaguugugcgcuuugcuccccagguagagcacccuacuccacucacaaagguggcugcagccggagacagcaccucaagugcgacacugcacugucgggcuagaggcguccccaauaucguguucacuuggaccaagaacgguguuccucuugaucugcaagacccgagguacacggaacauaccuaucaccagggcggggugcauuccucucuacucacaaucgccaaugucagcgcagcccaggauuacgcucuguuuacuugcaccgcaacaaacgccuugggauccgaccagacuaacauucaacuggugucaaucagccgacccgauccaccuaguggcuuaaaaguugugucucucacuccccacuccgucgggcuggaguggaagccaggauucgacggcggucuuccucagcgguuuuguauucgcuaugaggcgcuggggacgcccggauuccacuacguagaugugguuccaccgcaggcuacaaccuuuacuuugacaggccuccagccuagcaccagauauaggguguggcugcuagccucgaaugcacugggugacucaggccuugccgauaaagggacucaacuccccauaaccacaccaggacugcaucagcccucuggcgaaccugaggaccaguugccaacggaacccccuagugggccguccggacugccauuacuccccguccuguucgcucuuggcggucuguugcuccugagcaacgccucuugcguagggggagugcuauggcagcggcgacugagacgccuugcagagggcaucagcgagaagaccgaagcugguuccgaggaagauagggugcguaaugaguacgaagagucacaauggacuggcgagcgggacacacagaguagcaccgucucuacaacugaagccgagccuuacuauagaucccucagggacuuuucaccccagcugccaccuacccaagaagagguuaguuacagccgcggguucacgggagaagaugaggacauggcguuccccggccacuuguaugaugagguggaacgaacauacccaccuuccggggccuggggaccguuauaugacgaggugcagaugggccccugggaucugcauuggccagaagacaccuaccaggauccuagagguauuuaugaccaggucgcaggggaucucgacacucuggagcccgauucucuuccauuugaacugcggggacacuugguguga

SEQ ID NO: 59852 - RNA, 948 nt, Artificial Sequence
  derived and/or modified sequence opt3 from NPHS2__Homo_sapiens__NP_001284504
auggagagaagggcccggagcuccucucgcgaaucacgaggccgugggggaagaacaccccacaaggagaacaaaagggcuaaggcagaacggagugguggcgggcgcggaagacaggaggccggcccugaaccaagcgguuccgggagggcgggaaccccgggcgagccccgggcuccugccgcaacuguggucgacguugaugaggugcgcggcucuggggaagagggaacggaaguaguggcccugcucgagucggagcgaccagaagaggguaccaaaucaagcggccuuggggcuugcgaauggcuguuggucuuaaucagucugcuauucauuauaaugacauuucccuucuccaucugguuuugugugaagguugugcaagaguacgaaagagucauuaucuucaggcucggacaucugcuuccuggccgggcaaaagguccagggcuguuuuucuuuuugcccugccucgacacuuaucacaagguggaucugcgucugcagacccucgagauuccuuuccaugagguagccuuagacucuguuacauguaucuggggaauaaagguggaacgcaucgagauuaaagaugucagacugccagcuggccuucagcacagcuuggccguggaagcggaggcacagaggcaagccaaggugcggaugaucgcugccgaagcagagaaagcugccuccgagucacugcgaauggcggccgaaauucuaaguggcaccccggcagcuguccagcuccgcuaccugcauacucuucagagccugucuacagagaagcccuccaccguuguguugccucucccauuugaccuguuaaauugccugucaagccccaguaacagaacgcaggggucucucccuuucccaucccccagcaaaccgguagaaccucuuaaucccaagaagaaagauucgccaaugcuguga

SEQ ID NO: 59853 - RNA, 906 nt, Artificial Sequence
  derived and/or modified sequence opt3 from NPL__Homo_sapiens__NP_001186979
augagcagagcccccggcauccuggcuuccuggaggcgggcaccuucucucucagugcagaaggggagucaaaccgcccgccacacaugccauccagaggucccgcuuggaaacuguuuccugcccguuuacaaagcgagcccuuugacugugacgcgauuaugggcugaacgucuggaccagguaauuauacacgugggugcccuaucccucaaggagucucaggaacuggcacagcaugccgcugagaucggcgcagaugggauugccgucaucgcuccauuuuuccuuaaacccuggaccaaggacauucugaucaacuuuuugaaagaaguggccgcggcagccccugcucucccauucuauuacuaucacauacccgcccugacaggaguuaagaucagagcagaggagcugcucgauggcauuuuagacaagaucccuacuuuucaaggucugaaauucucggauaccgaccuuuuggauuuugggcagugcguggaccagaauaggcagcaacaguucgcuuuucuguucggagucgaugaacagcuacucucagcccuggugaugggcgcgacaggcgccguagggagcaccuacaauuaucuuggaaagaaaacuaaccagaugcuggaggcauuugaacaaaaggacuucaguuuggcucucaauuaccaguuuuguauucagcgguucaucaacuucguugugaaacuggguuuuggcgucucccaaacaaaggccauaaugaccuuagugucugggauuccaaugggaccgccccgccugccucuccagaaggcuagcagagaguucacggauuccgccgaggcaaaacuuaagucacuggacuuuuugaguuucacugaucuaaaagacggcaaucuggaagccgguagcuga

SEQ ID NO: 59854 - RNA, 1827 nt, Artificial Sequence
  derived and/or modified sequence opt3 from NPLOC4__Homo_sapiens__NP_060391
auggccgagagcaucauuauaagagugcagucccccgacggcgucaagaggaucaccgcuacaaaacgggaaacugcagccacguuccugaagaaaguugcgaaggaguuuggguuccaaaacaauggauuuucuguguacauuaaccgcaauaaaaccggugaaaucacagcuucaaguaacaagagccucaaucuucugaagauuaaacacggcgauuuguuauuccuguuuccuuccucucuagccgggccaucgucagagauggaaacuagcguaccgcccggauucaagguguuuggcgcaccuaacgucguggaggacgagaucgaucaguaucucaguaaacaggacgguaagauauaccgaucccgugauccacagcugugcagacaugggccccuuggaaaauguguucacugcgugccucuggaaccauucgacgaggauuauuugaaucaucucgaacccccugucaagcacaugucuuuucaugccuacaucaggaagcugaccggcggcgcugacaaagggaaguucguggcacuggagaacauuagcuguaaaaucaaguccggaugcgagggucaccucccauggccgaauggcauuuguacaaaaugccaacccucagccaucaccuuaaaccggcagaaguaucgccacguagauaauauaauguuugaaaaccauacuguugcugacagauuccuggauuuuuggaggaaaacagggaaucagcacuucggauaccuuuauggccgguacaccgagcauaaggacauuccuuuggguauccgcgccgaaguggcggcaauuuacgagccaccccagaucgggacgcaaaacagucuggaacuacucgaggauccuaaggccgaggucguggacgaaaucgcugccaaacugggacuucgaaaggugggcuggauuuucacugaccuggucagcgaggauaccagaaaaggcacaguuagguauucucggaauaaggacacuuacuuuuuguccucagaagaguguauaaccgcaggggauuuccagaacaaacacccaaacaugugccgucucagccccgacggacacuuugguaguaaguucgugacagcuguagccaccggcgggccggauaaucaggugcauuuugaaggauaucaggucucuaaccaauguauggcgcuggugcgcgacgagugcuuacugccuuguaaggaugcccccgagcucggcuacgcaaaagaauccagcucggagcaguauguuccagacguguucuacaaggaugucgacaaauuugguaaugaaaucacgcagcuugcuagaccucugcccguggaguauuugauuaucgauauaacuacaaccuucccaaaggaccccguauacacuuuuucuauuucccaaaacccuuucccaaucgaaaauagggacguucuaggggagacacaggauuuucacucacuggccaccuaccucagucagaacacgagcuccguguuccuggacaccaucucugauuuucaucuucuguuguuccucgucacaaaugaggugaugccgcugcaggacagcauuucauuacugcuagaagcuguccggacucgaaacgaggaacucgcccaaaccuggaaacgcagugagcagugggcaacaaucgagcagcugugcuccacugugggcggacagcuucccggcuugcacgaauauggggccguuggagguagcacccauacagcuaccgcggcaaugugggccugccaacacuguacuuucaugaaucagccuggcacggggcacugcgagauguguucucugccaagaacauga

SEQ ID NO: 59855 - RNA, 780 nt, Artificial Sequence
  derived and/or modified sequence opt3 from NPM1__Homo_sapiens__NP_001032827
auggaggacagcauggauauggacaugucuccccugagaccucagaacuaccucuucggcugcgaacuuaaggccgauaaagacuaucacuuuaagguggauaaugacgagaacgaacaucaacuguccuugaggaccgucucauuaggggcuggagcaaaagaugagcugcacaucguugaagccgaggcgaugaauuacgaggguaguccaauuaaggugacacuagcuacucucaaaaugagcguacagccgacggugucccugggcggguucgaaauaacacccccugucgugcuucggcugaaguguggaucuggcccaguucauaucucgggucagcacuugguggccgucgaggaagacgcagagucagaggaugaagaggaagaggacgugaagcuccugagcauuagugggaaacgcuccgcccccggaggcggcucuaagguaccucagaaaaagguuaaacuggcugcagaugaagacgaugacgacgaugacgaggaggaugacgaugaagacgaugacgaugacgauuuugacgacgaggaagccgaggaaaaggcuccagugaagaaaagcauccgagauacccccgccaagaacgcgcaaaaauccaaucagaacgggaaggacucaaaaccuaguagcacuccacguucuaagggacaggaguccuucaaaaagcaggagaagaccccgaaaacacccaaggguccuucaagcgucgaagauauuaaagcaaagaugcaagccaguaucgagaaagcucauuga

SEQ ID NO: 59856 - RNA, 411 nt, Artificial Sequence
  derived and/or modified sequence opt3 from NPM2__Homo_sapiens__NP_001273610
augaaccugagcuccgccucuucaaccgaggaaaaggcugugacaacuguccucuggggcugcgagcuuagucaggaaagaaggacguggaccuuccggccccaacuggaggggaaacagagcugucgcuuguuacugcacacaaucugccuaggagaaaaggcaaaagaggagaugcaucgaguugaaauucucccuccagccaaucaggaggacaagaaaaugcagccggugacuauagcgucccugcaggcuucuguacuucccauggugucgauggucggugugcaacugucaccuccaguuaccuuucaguugcgugccggcagcgggcccguguuccucaguggacaggaaagauacgagaagaaggcaggcaaaaggcggcgcgguaacaagucccaaagauga

SEQ ID NO: 59857 - RNA, 1698 nt, Artificial Sequence
  derived and/or modified sequence opt3 from NPNT__Homo_sapiens__NP_001028219
auggacuuccugcucgcccuugugcuggucagcuccuuguacuuacaggcugcagccgaguuugauggcagauggcccaggcaaaucguuucuucaauugggcugugccgguauggaggucgcauagacuguugcuggggcugggcgcgacagaguugggggcagugucagccugugugccaaccacguuguaagcacggagaaugcaucggcccgaacaaauguaagugccaucccgguuacgcugggaaaaccuguaaucaggaucuaaacgagugcggacucaagccuagaccauguaaacacaggugcaugaauacauauggcagcuacaagugcuauugucugaacggcuacaugcuuaugcccgacggguccuguucuucggcccugacuugcucaauggcaaauugccaguauggaugugauguagugaagggucagauucggugccaauguccuagcccaggcuugcagcucgcccccgacgggcgcacgugcgucgauguggacgaaugugcuaccggcagagcaaguugcccuagguuccggcaguguguuaacacauuuggauccuacaucugcaaaugccauaaggguuucgaucugauguacauugggggaaaauaucagugucacgacaucgaugagugcucucugggccaauaccaguguagcuccuuugcccgcugcuauaauauacgaggcucauacaaguguaaaugcaaggaaggguaucagggagacggucucacuuguguguacaucccaaaggucaugauugagccgaguggccccauccaugugccuaaagggaacggaaccauuuuaaagggcgauacagguaauaacaauuggaucccagacguagggagcaccugguggcccccuaaaacuccauauauacccccgauuaucacaaacagaccuaccucuaagcccacgacuaggccaaccccuaaacccacaccaauucccacuccuccaccgcccccuccacugcccaccgagcuucggacaccuuugccacccaccacgccggaacguccuacuacaggccugaccacuaucgcuccagccgcguccacacccccuggaggcaucaccguugacaaucgcgugcaaacggauccccagaagccaagaggggacgucuucauuccuaggcagcccucaaacgaucuauuugagauauucgaaaucgagcggggagugagcgcagacgaugaggccaaagacgauccaggugugcucguccacaguugcaauuuugaccacggccuguguggguggauucgagaaaaggauaacgaccuucauugggagccgauccgcgauccugcuggaggccaguaccugaccguuucugccgcaaaggcucccggugggaaagccgcgagauuggugcucccacugggcagguuaaugcacuccggagaccugugccucagcuuccggcauaagguaacaggccuucacucggggacucugcaaguguuuguccgcaaacacggagcccauggugcagcuuuguggggcagaaacgggggacacggcuggaggcagacccagauaacacuacguggugccgacauuaagucugugguuuucaaaggggaaaagcggcgaggccauacuggagagaucggccuggaugacgugucccucaagaaagggcacuguucagaagagagauga

SEQ ID NO: 59858 - RNA, 381 nt, Artificial Sequence
  derived and/or modified sequence opt3 from NPPC__Homo_sapiens__NP_077720
augcaccugagccagcuccuugccugcgcucuguuguuaacccugcuaucccucagacccucugaggcaaagccuggcgccccaccgaaagugcccaggacaccuccagcggaggaacuggcugaaccccaagccgcagggggaggucagaagaaaggcgacaaggccccugggggaggcggugcuaaccuuaaaggggaucggucacgccuguugcgagaccuccgugucgauacuaagaguagagcagccugggcuaggcugcugcaggagcauccaaaugcccggaaguacaaaggagcgaacaagaaaggccucagcaagggcuguuucggguuaaaacuggaccgcaucggauccaugucuggucuuggcugcuga

SEQ ID NO: 59859 - RNA, 3186 nt, Artificial Sequence
  derived and/or modified sequence opt3 from NPR1__Homo_sapiens__NP_000897
augcccggcccuagaaggccagccgggagccggcugcgccuccuucuguuguuacugcuaccgccccuccugcuucuguugcgaggaucccacgcugguaaccucaccguggcagucguucugccucuggccaauacaucuuacccauggucaugggcgcgugugggccccgcuguagagcucgccuuagcacaggugaaggccagaccugaccugcuuccaggguggacugucaggacgguguugggaaguagcgaaaacgcucugggcguuugcuccgauaccgcagcuccccuagccgccguggaccucaaaugggagcauaauccugcggucuuccuggguccaggguguguguaugcagccgcuccgguaggacgguuuacagcccacuggcgcguuccccuucugacugcaggcgcuccugccuugggcuucggggugaaggaugaauacgcgcucaccacaagagccggaccaucuuaugcaaaacugggugacuuugucgcugccuuacauaggcggcugggcugggagcgccaagcucucaugcuuuacgccuaucgacccggggaugaagaacacugcuucuuucugguggagggauuguucaugagagugagggaccggcuaaacaucaccgucgaucaucuggaauuugcagaggacgaucucucgcacuacacucgucugcuucgcacaaugccuagaaagggcaggguuauuuauauauguucaagcccagacgccuuccggacccugauguugcucgcucuggaagcggguuuaugcggggaggauuacguguuuuuccaccuggacaucuuuggacagagucuacagggcggccaggggcccgcaccgcgacgcccuugggagagaggagauggucaagacguauccgccaggcaggcuuuccaggccgcaaaaauuaucacguacaaggaccccgauaauccagaauaucucgaguuucugaagcagcuuaaacauuuggccuacgaacaauucaacuucacuauggaggacggccuggugaauaccauuccugcuucuuuucacgaugggcuccugcuuuauauccaggccgucacagaaacucuggcacauggaggcaccgugacagacggugagaacauaacccagcggauguggaaucgcagcuuccaggggguuacgggcuacuugaagaucgauuccucaggagacagagagacugauuuuagucucugggacauggaucccgaaaacggcgcguucagggugguccugaauuauaacgggacaagccaagaguuaguggcuguaucuggacguaaacugaauuggccacuagguuaucccccuccagacauuccgaaguguggcuuugauaacgaagaccccgccugcaaucaggaccaccucuccacccuggagguucuugcauugguggggucacugagccuccugggaaucuuaauugucaguuucuuuaucuaccggaaaaugcagcuggaaaaggagcuugccucugaguuguggcgagugagaugggaagaugucgagccuuccagccucgaaaggcaucugcgcucggcuggcucucggcuaacucuguccgguagagggucaaacuacggcagucuccugacaaccgagggacaauuccagguguuugccaagacggcauacuauaaaggcaaccuuguugcugugaagaggguaaaucgcaaacgaauagaauugacccggaagguccuguucgaguuaaaacacaugcgugacgugcagaacgagcaccucacaagauuuguuggggccuguacugauccacccaauauuugcauccugaccgaauacuguccuaggggaagccuucaggacauucuggagaacgaauccaucacauuggauuggauguuccgcuauucucucacuaaugacaucgugaaggguaugcuguuucuacauaacggcgcgauuugcagccacgggaaucugaaaucaaguaacugugucguggauggacgguucguacucaagauaaccgacuacggccuggaguccuucagagaucuugacccagagcaaggucauacaguguaugccaagaaauuguggaccgcucccgaacuguuaaggauggcaagcccgccuguucgagggucucaggccggcgaugucuacucauuuggaaucauucuccaggagaucgcucugcgcaguggcguguuccacguggaagggcuugaccugagcccaaaggagauaauugaacgggucacuagaggagagcagcccccuuuuaggcccucccuagcccuccaaucucaccuggaggaauugggccuguuaaugcagcguugcugggcagaggauccacaggaacgcccucccuuccagcaaauccggcucacgcugagaaaauuuaauagggagaacucgagcaauauccuugacaaccuguugucccgaauggaacaguaugcgaauaaccucgaggagcugguugaggagcggacacaggccuaccuagaagagaagcgcaaagcugaagcccugcuuuaccagauucucccacauucaguggcagagcaacugaagagaggugagaccgugcaggcugaagccuucgacaguguaacuaucuauuuuucugauauugucggguucaccgcauugagcgccgaguccacaccgaugcaagugguuacccuguuaaaugaccucuacacuugcuuugaugcugugauagacaacuucgaugucuauaagguggaaacaaucggagacgcguacaugguugugucaggccugccuguaaggaacggucggcuucacgccugugaggucgcacgaauggcucuggccuugcucgaugccgugagaucuuuucgcauuaggcaucguccccaggagcagcugcggcuaagaaucggcauccacacggggccagugugcgcuggagucguuggccugaaaaugcccagguauugucuuuucggggacaccgugaauacugcaucucgcauggaauccaacggagaggcccucaagauucaccugaguagcgaaacaaaagcgguauuggaggaauuuggcgguuucgaguuagagcugcgaggggauguggaaaugaagggaaaaggcaaggucagaaccuacuggcuccugggugagcggggcagcuccacaaggggguga

SEQ ID NO: 59860 - RNA, 3144 nt, Artificial Sequence
  derived and/or modified sequence opt3 from NPR2__Homo_sapiens__NP_003986
auggcccugcccagccuccuucuguugguggcugcauuagccggcggggucagaccuccaggagcgaggaaccugacccuagcuguugugcucccggagcacaaucuguccuacgccugggcauggccccggguagguccugccguggcucuugcagucgaagcccugggccgcgcuuugccaguggaccuccgauucguuucuucagagcuggaaggggccugcagugaguaucuggcgccccucagcgcaguggauuuaaagcuguaccaugacccugaucuuuugcugggaccaggcugugucuaucccgccgcuuccguggcccguuuugcaucucacuggagacuaccucuccugacagcuggugccguagcgucgggguucucagccaaaaacgaccauuacaggacucuuguucggacgggaccaagcgcaccgaagcugggcgaauuuguggucaccuugcacggccauuucaauuggacagcucgcgccgcucuccuguauuuagaugccagaacugacgauaggccccacuacuuuaccaucgaggggguguucgaggcacugcagggaaguaaccucuccgugcaacaccaggucuaugcccgggaaccugguggcccagagcaggcuacacauuuuauucgcgcgaaugggcgaauaguuuacaucugcggaccccuugaaaugcugcacgagauuuugcuacaggcacaaagagagaaccugaccaauggcgacuacguguucuuuuaucucgauguauucggugaaucucugagggccgggccuacucgggcuacaggacguccauggcaggacaaccgcaccagagagcaggcccaggcacuuagggaagccuuucaaacggugcuggucaucacuuaccgggagcccccgaauccugaauaucaggaguuccagaaccgauugcucauucgcgcuagagaggauuuuggcguggaacugggccccagcuuaaugaaucugaucgccggguguuucuacgacggaauacuacucuaugcagagguucugaacgaaaccauccaggaggguggcacaagggaagaugggcuucggauuguggagaaaaugcaaggacgcagauaccauggcgucacugguuuggugguaauggacaagaauaacgacagggagaccgauuucguucugugggcgaugggggaccucgauuccggcgacuuucagccagcugcccacuauucaggagcagaaaaacagaucugguggacaggccguccuauucccugggugaagggggccccacccagugauaauccuccaugcgcuuucgaccuggaugacccgagcugugauaagacgccccuuucuacccuggccaucgucgcauugggaacugguauaacauuuauuauguucggcguguccucauuucucaucuuccggaaacugauguuagagaaggaacuggcuagcaugcuauggcgaauuagaugggaggaacuccaauuugggaacagugagagguaccacaaaggagccggcucucgccugacccuuuccuugcgggguagcucguacgggucucugaugacugcgcauggcaaguaucagaucuucgccaacacaggacacuuuaaaggcaaugucguggcuaucaagcauguuaacaagaaaagaauugagcucacccgccaggugcuguucgaauuaaagcacaugagggacguacaguuuaaucaucugacgcgauucauaggggcaugcaucgauccuccaaacauuuguaucgucaccgaguacugcccccggggaucccuucaagacauauuggaaaaugacucaauuaaccucgauuggauguuucguuauagucugaucaaugaccuagugaaagguauggccuuccugcacaacagcaucauuuccucucacggcagccucaagucaaguaauuguguuguggauuccagauucguccugaaaaucacagacuacgggcuugcuagcuuuaggucuacugccgagccugaugacucacaugcauuguaugcgaagaaacuguggaccgccccagaguuacucaguggaaacccccugccgacaacuggcaugcagaaggcugauguguacagcuucgguauuauacuucaggaaaucgcccugcgcuccgggccuuuuuauuuggagggccucgaccugucuccaaaggaaauuguacagaaagugcggaauggacaaagacccuacuucaggccuucgaucgaucgaacccagcuaaacgaggaacugguucuccugauggagcgcugcugggcacaggaccccgcugagcggccagauuuuggccagaucaagggguucauuagaagguuuaauaaagaaggaggcacaagcauacuugacaacuugcuguuacguauggagcaauacgccaauaaccucgaaaagcuggucgaggaacgcacccaggcauaucuugaggagaaacggaaggccgaagcucugcuauaccagauccucccucacuccguggcggagcagcugaagagaggugaaacugugcaagccgaggcauucgauucagucacgauuuauuuuagugacaucguuggguucacagcuuugucugccgaaagcacccccaugcaaguggugacucuguuaaacgaccucuacaccuguuuugaugccauuaucgacaauuucgauguauauaaagucgagacaauaggagacgcuuacauggugguuuccggccugccagguaggaacggccagcgacaugcaccggagaucgcccggauggcgcuugcucuguuggaugccgugagcucauuucgcauuagacacaggccucacgaccagcuccggcugcgaaucgggguccauaccggacccgugugcgcaggcguuguggggcuaaagaugccaagauauugccuguucggagauacuguaaauacagccucucgcauggaauccaacggccaggcucuuaaaauucacgucaguagcacgaccaaggacgcacucgaugagcuggguuguuuccaguuggaacugaggggcgacguggagaugaaaggaaagggcaagaugcguacuuacugguuacucggugagcggaaagggcccccugggcugcuuuga

SEQ ID NO: 59861 - RNA, 1623 nt, Artificial Sequence
  derived and/or modified sequence opt3 from NPR3__Homo_sapiens__NP_000899
augcccagccugcucgugcuuaccuucuccccuugcguccuguugggcugggccuuacuggcugggggaacagguggcgggggaguuggcggugggggaggcggcgcagggaucggagguggcagacaggagagggaagcccuaccaccgcaaaagauugaggugcucguacugcuuccccaggacgauucuuaccuguuuucauugacucgggugcgcccugcgauagaauaugcucuccgaagugucgaggggaacggaacgggccguagacugcugccacccgguaccagguuccagguggccuacgaagacagcgauugugggaaucgggcacucuuuuccuuaguugaccgcguggccgcugcaagaggagccaaaccugaucugauccuuggcccagucugcgaguaugcugccgcgcccguggcaagguuggccucucacugggaccugccuaugcuaucggcuggcgcccucgcagcuggguuccagcauaaggauucagaguacagccaccugacacggguagccccagcguaugccaaaaugggagaaaugaugcuugcacuguuucgccaucaccauuggagucgagcugccuugguuuacuccgacgauaagcucgagagaaacuguuauuucacucuggaaggugugcacgaggucuuucaagaggaaggcuuacacaccucuauuuacagcuucgacgagacaaaagaucuggaccucgaagauaucgugaggaauauucaggcuuccgagcggguggucaucaugugcgccucaagugacaccauacguagcaucaugcuuguugcacaucgccacgggaugacuucuggagacuacgccuuuuucaacauugaacuguuuaauuccucaagcuauggcgaugguaguuggaagagaggggacaagcaugauuucgaggcuaaacaggcguacucuuccuugcagacagugacccuacugaggacgguaaagccggaguuugaaaaauucagcauggaggugaagucgucugucgaaaaacaaggccucaacauggaggacuaugugaauauguucguugaaggauuucacgaugcaauccugcuuuacgugcuggccuugcacgagguccuccgggcuggcuauuccaagaaggacgggggaaaaauuauccagcagacuuggaaccgaaccuucgaggguauagccggccaggugucaauugaugcaaauggggaccgcuacggagauuuuaguguaaucgccaugacagacguugaagcuggcacucaagaggugauuggugauuauuucgggaaggaaggcagauuugagaugaggcccaacgucaaauacccuuggggaccacugaaguuacggaucgacgaaaaucgcaucguggagcauaccaacagcucccccuguaaaucuugcggccuggaggaaagcgccgucacagggauugugguuggagcacuacucggugcgggccugcuuauggcuuucuacuuuuucagaaagaaauauaggauaaccaucgagcgucggacgcagcaggaagagucaaauuuggggaagcaccgagagcugagagaagacaguauuaggucccauuuuagcguggccuga

SEQ ID NO: 59862 - RNA, 1143 nt, Artificial Sequence
  derived and/or modified sequence opt3 from NPRL2__Homo_sapiens__NP_006536
augggcagcgggugcagaaucgaguguauuuucuuuuccgaauuucaccccacccugggaccuaagauaacauaccaggugccagaggacuuuaucucuagggaacucuucgauacuguccaaguuuauauuaucacgaaaccggagcuucagaacaagcugauuaccgugacagccauggagaaaaaguugaucgguugccccguauguauagagcauaaaaaguacucacggaaugcuuuacuguuuaaccuaggcuucgugugcgacgcacaggccaagacuugugcgcucgagccuaucgucaaaaagcuggcuggguaucuuaccacacuggaauuggagaguagcuuuguguccauggaagagucuaaacagaagcucguuccaauuaugaccauccugcuggaggaacucaaugccucgggacgcugcacuuuacccauugaugagucaaacacaauccaccugaaagugauagaacaacgaccugacccacccgucgcacaggaguacgaugugccuguauucaccaaggacaaggaagauuucuucaauagccagugggaccuuacgacucagcaaauuuugccauauaucgauggcuuucgucauauucagaaaaucagugccgaggcugacguugagcugaaccuagugagaaucgcaauucagaaucuccuguacuauggugucgugacccuuguguccauacugcaguacucuaacgucuacuguccgacacccaagguucaagauuugguggacgauaaaagccuccaggaagccugccuguccuauguaacuaagcaggggcacaaaagggcuucauuacgggacguguuccaacuguacuguagucucagcccuggaaccacaguccgcgaccuuaucggcagacauccacagcagcugcagcacguggaugagaggaaguugauucaauuuggccuaaugaaaaaucugauccggcgccuccagaaguaucccguucgagugaccagagaagaacagucucacccugccaggcuguacacggggugccauuccuaugacgaaauauguugcaagacuggaaugucauaccacgagcuugaugagcggcuggaaaacgacccaaauauuaucaucugcuggaaauga

SEQ ID NO: 59863 - RNA, 1173 nt, Artificial Sequence
  derived and/or modified sequence opt3 from NPRL3__Homo_sapiens__NP_001034565
auggccgacggcaacgaggggccccagagcccuuuccaccauauccugccaaagugcaaacucgcuagagaucuuaaggaagcauacgacucccuguguaccucuggaguggucagguugcacauuaauucaugguuagagguuaguuuuugccugccgcauaaaauacacuaugccgcgagcucccuaauucccccugaagcuaucgagcggucucucaaggccauccgcccauaccaugcacugcuucuguugucggaugaaaaaucacuccugggugagcugcccauugacuguagcccugcccucgugcgaguaaucaagacaacgagugcugugaagaacuuacaacagcuggcacaggaugccgaccuugcuuugcugcaggucuuccaacuagccgcgcaccucguguauuggggcaaagcaauaaucauuuacccacugugcgagaauaacguuuauaugcuuucccccaaugccucugugugucuguacagcccuuuggcugaacaguuuucccaccaguucccaucacaugaucucccgaguguccuggccaaguuuagcuuacccgugucucuguccgaguuccguaacccucucgcaccagcuguacaggaaacucaacuuauccagaugguuguguggaugcugcagagaagguugcuaauucagcugcacaccuaugucugccucauggccucacccagcgaggaggaaccucggccacgcgaggacgaugugcccuuuacagcgagagucgggggaaggagucugucuacuccgaaugcccuuuccuucggcagcccuaccucgucugacgauaugacacugaccucccccucaauggacaacaguagcgcagaauugcucccauccggugauucuccucugaaucaacggaugacugagaacuuacuggcuagccuaucagaacaugagcgcgccgcuauccucagugugcccgccgcacagaauccagaggaccugcgaauguuugccagacuuuugcacuacuucagggggcggcaccaucuggaagagauaauguacaacgaaaauacacgucgcucccagcuccugaugcuuuuugacaaauucagaagcguucuggugguaaccacgcacgaggaucccgugauugcugucuuucaagcguugcucccuuga

SEQ ID NO: 59864 - RNA, 270 nt, Artificial Sequence
  derived and/or modified sequence opt3 from NPS__Homo_sapiens__NP_001025184
augaucagcuccgugaagcugaaccucauucuuguccugucuuugucaaccaugcacguuuucuggugcuaucccgugccuaguagcaaaguauccggcaagucugacuacuuuuuaauacugcuaaauucguguccaacaagacucgauaggucaaaagaacuggccuuccuuaagccgauccuggagaaaauguuugugaagcggagcuuccgcaacggggucggaacugguaugaagaaaacgaguuuucagcgagcuaaguccuga

SEQ ID NO: 59865 - RNA, 918 nt, Artificial Sequence
  derived and/or modified sequence opt3 from NPSR1__Homo_sapiens__NP_001287863
augcccgccaacuucaccgagggcagcuuugacuccucugggacaggacagacucuggauucaaguccuguggcuugcacggaaaccgucacauucacugagguuguggaagguaaggaguggggcagcuuuuacuauuccuucaaaaccgaacaacucaucacacuuuggguacuguuuguguucaccauugucggaaauucugugguuuuguuuucgacuuggagaaggaagaaaaagucacggaugacauucuuugugacccaguuagcaauaacggagaaacaggcccgcguccugaucgugauugcguggagccuaaguuuccucuuuuccaucccaacucugauuaucuucgggaagcgaacccuuucuaacggcgagguacaguguugggcucuguggccggacgauagcuacuggacacccuauaugacuauaguugccuuuuugguguacuucaucccucucaccauuaucuccauuauguaugguaucgucauacguacaauuuggaucaagucaaaaaccuacgaaacggugauuaguaauugcagcgacgggaagcuguguucuuccuauaacagaggacugaucucaaaagcaaagaucaaagccauuaaguacagcauaaucauuauccucgcuuucauaugcuguuggaguccauacuuuuuauucgauauucuggacaauuuuaaccuuuugcccgauacucaagagagguucuaugcaucugugaucauccagaaucugccugcccuaaacuccgcuauuaauccacucaucuacugcgucuuuagcucgucuauuuccuuccccugucgggaacagcgcucacaggacaguagaaugacauuuagggagcggaccgagcgccacgaaaugcaaauacugagcaagccugaguucaucuga

SEQ ID NO: 59866 - RNA, 1185 nt, Artificial Sequence
  derived and/or modified sequence opt3 from NPTN__Homo_sapiens__NP_001154835
augagcggcuccucucugcccucagcccucgcucuuagucuguuguuagugagcgggucccugcuaccuggaccaggugcagcccagaacgcgggcuucgucaagucuccgaugucggagaccaaacucacaggggacgcuuuugaacuguacugcgauguugugggaucacccacuccugagauccaauggugguaugccgaaguaaauagagcagagagcuucaggcagcuuugggacggcgcccggaagcgccgagugacggucaacaccgcuuacgguaguaaugggguguccguucugcguauuacaagauugacucucgaagauucuggaaccuaugaguguagggcaagcaacgacccaaaacggaaugaucugcgccagaaccccuccauaacauggaucagagcccaggcuaccauuucagugcugcaaaagccuaggaucgucacaagugaggaagugauuauccgggacagcccaguacuccccguuacuuuacagugcaaucugaccucuuccucacacacgcuuacuuacagcuauuggaccaaaaacggcguggaguugagugccacacgcaagaaugcgucuaacauggaauaccgaauaaauaagccuagagcagaggauuccggcgaguaucauugugucuaccacuuugugagcgccccaaaagcuaacgccacuaucgaagugaaggcagcuccggacauuaccgggcauaaaaggucggagaauaagaacgaaggacaggaugccacaauguacugcaaaucugucgguuauccccacccugacuggaucuggcggaagaaggagaauggcaugccaauggauauuguuaacaccuccgggcguuucuuuaucauaaacaaagaaaauuacacggagcugaacauugugaaucuacagaucacugaggaccccggagaauaugaguguaacgcgacaaaugccauuggcucagcaaguguagugaccguccuccgcgugagaagccaucuggcuccucuuuggccauuccuggguaucuuggccgaaaucauuauacucguugugaucauugucguguacgagaagaggaaacggcccgaugaaguaccggacgcugggccuaugaagacuaacuccacaaauaaccacaaagacaagaaucugcgacaacgcaacaccaauuga

SEQ ID NO: 59867 - RNA, 1299 nt, Artificial Sequence
  derived and/or modified sequence opt3 from NPTX1__Homo_sapiens__NP_002513
augcccgccggcagagcugcaaggaccugcgcccugcucgcgcuuugucuguugggggcuggagcccaggacuucgguccuacacgguuuaucugcacuagcgugccagucgaugcagacaugugugccgcuuccguugcagccggcggggcugaggaauuacgaucuucagugcugcaacuacgcgagacgguacuccagcagaaggaaaccauucugagucagaaagagacaauacgugaacuuacugccaagcugggaagaugcgagagccaauccaccuuggauccgggcgcgggugaggcaagggccgggggaggccggaaacagcccggcucugggaagaacacaaugggagaccucucgcgcaccccugcugccgaaacucugucacagcugggucagacacuccaaagccugaaaaccagacuggagaaucuugaacaguacaguagguugaacuccucuagccagacuaauucccugaaggaucuacuccagucaaagaucgacgagcuggagcggcaagugcuuagucgcgucaacacgcuggaagagggcaaagggggaccacgaaaugauaccgaagagagagugaagauugaaacagcauugacuagccuccaccagaggaucucugagcuggagaaaggccagaaggacaaccggcccggugauaaauuccaauuaaccuuuccucugcguacaaauuauauguacgcuaagguuaagaaaucccucccagaaauguaugccuucaccguguguauguggcuuaagucaagcgcgacgcccggggucggaacuccuuuuaguuacgccgugccaggccaggcaaacgagcugguauugauugaauggggcaauaacccgauggagauccuaauaaaugacaaaguugcuaagcugcccuucgugaucaacgaugggaaauggcaucacauuugcgucacauggaccacucgcgacggagugugggaagccuaucaggaugguacacagggcgggucuggagagaaucucgcuccuuaccauccaaucaagccccaaggcgugcugguccuuggucaggagcaggacaccuuagggggcggauuugacgccacgcaggcauucguuggcgaauuggcccacuuuaacauuugggauagaaaacucaccccuggggagguguauaaucuggcuacauguuccacuaaggcguuaagcggaaacguaaucgcaugggccgaaucgcauauagagauuuacgguggcgcuaccaaguggacauucgaagccugcaggcaaaucaacuga

SEQ ID NO: 59868 - RNA, 1296 nt, Artificial Sequence
  derived and/or modified sequence opt3 from NPTX2__Homo_sapiens__NP_002514
augcuggcccuccuugcugcaagcguggcccuggcggucgcugccggcgcacaggacucccccgccccugggucuagauucguuugcaccgcuuugccaccggaggcagugcacgccggaugucccuuaccugcuaugccaaugcaagguggcgcccagucacccgaagaggaacugagggcggcaguacuacagcuccgggagacagugguccagcaaaaggaaacucugggggcccagcgcgaggcuauccgagagcuuacgggaaaacuggcccguugcgaaggcuuggcuggugggaaggcaagaggagccggcgcgaccggcaaagauacaaugggggaccucccuagggauccaggacaugugguugagcagcugagucggagccugcagacucucaaggaccgcuuagaaucccuggagcaccaacuuagagccaacgugucuaaugcagguuugcccggcgauuuuagggagguccugcagcagcggcuaggggaacucgagcgccagcugcuucgaaaaguggcugaacuggaggacgaaaagucguugcuccauaacgagaccucagcccacagacaaaagacagagagcacccugaaugcuuuacugcagaggguaacugaacucgagcggggaaacagugccuucaaauccccugaugcauuuaagguuucucuuccacugcguacaaauuacuuguauggcaaaauuaagaaaacccuaccggaacuguacgccuucacgauaugucucuggcugcgcagcuccgcuucacccgguaucgggacuccuuuuaguuaugcggugccaggacaggcaaacgagauuguccuuaucgaauggggcaauaaccccauugagcuguugaucaaugacaagguggcccaacucccucuguucgugagcgauggcaaguggcaucacauaugcgucaccuggacaacuagagacgggaugugggaggcuuuucaggauggagaaaaauuagguaccggcgagaaccuggccccauggcaccccaucaagccugggggaguucuaauucucggccaggaacaggacacagugggugggagguucgaugcaacccaagccuuuguaggcgagcugucucaguucaauaucugggaccgggugcuucgagcucaggaaauugucaacaucgccaauuguuccacgaacaugccgggaaauauaauucccuggguggacaacaacguugauguguuuggcggggcaucaaaauggccagucgagacuugcgaggaacgcuugcuggaccucuga

SEQ ID NO: 59869 - RNA, 1503 nt, Artificial Sequence
  derived and/or modified sequence opt3 from NPTXR__Homo_sapiens__NP_055108
augaaguuccuggccgugcuccuugcugcaggcaugcuggccuuuuugggggcggucaucugcauuauagcuagcguucccuuagccgcauccccugccagagcucugccaggaggugcagacaacgccucuguggcuucaggcgccgcggcaaguccggggccccagaggagccuauccgcccuccacggagcuggcgguucugccgggccuccagcacugcccggagcuccugccgcgucggcccauccacuucccccuggcccacuguucucacgguuuuuguguaccccgcucgcagcugccugccccagcggcgcucaacagggggaugccgcaggagccgcuccuggugagcgcgaggaacugcugcucuuacagaguacagcggaacagcugcgacaaacugcacuucagcaggaggcccguaucagagcugaccaggauacgauuagggaauugaccggcaaacuggggcggugugaguccggacuaccacgcggccuccaaggugccgggcccagaagggacacaauggcagauggaccuugggacucuccagcccugauccuugagcuggaagaugcuguacgggccuugcgcgaccgaauugauagacucgagcaggaacugcccgcaagggugaauuuaagcgcggcuccggccccugucuccgcagugcccacuggccugcacucaaagauggaccagcucgagggccagcuucuggcccaaguuuuggcucuagagaaagaacggguggcccugagucauagcucucgucgccagagacaggaggucgaaaaggagcucgaugugcugcaagggaggguagcagaacuugagcacggauccucagcuuacagcccaccugacgccuucaaaaucaguauacccauccggaacaauuauauguacgcgcgaguucgcaaggcccugccagaguuguaugcuuuuaccgcaugcauguggcucagaucuagguccagcgguacaggccaggggacccccuucucguacucugugccuggacaggccaacgaaauuguccuguuagaggcuggccaugaaccaauggagcugcuaaucaaugauaagguggcccagcucccgcugucccuuaaagacaacgguuggcaccacauuuguaucgcauggacuacacgggacggguuguggucagcguaucaagauggcgaacugcagggaaguggcgagaaucucgccgcuuggcaucccauaaagccucacgggauucugauccuuggacaggagcaggacacccuggguggccgcuuugaugccacgcaagcauucgugggggacauugcucaguuuaacuugugggaucaugcccucacuccagcacagguccugggaaucgccaauugcaccgcucccuuacugggcaacguucuaccuugggaagacaaacucguggaggcguucgguggggccacaaaggcagcuuuugauguauguaaaggcagagccaaggccuga

SEQ ID NO: 59870 - RNA, 591 nt, Artificial Sequence
  derived and/or modified sequence opt3 from NPVF__Homo_sapiens__NP_071433
auggagaucauuagcuccaagcuguucauacuccuuacccuggccacaucuucauuguuaacgaguaacaucuuuugcgcugacgaacuggugaugagcaaucuacacuccaaagagaacuacgauaaguauucugaacccagaggcuacccuaaaggggagaggucgcucaauuucgaggaacugaaggacuggggaccgaaaaacgucauuaagaugucaacuccagcaguuaauaagaugccccauagcuuugccaaccuuccucugcgguucggucgcaaugugcaggaggaacgaagugcgggcgcuaccgccaacuugccacuccguuccgggagaaauauggagguaucucuggugaggcggguccccaaccugccucaacgcuuuggaagaacaacuaccgcaaaaagcguguguaggaugcucuccgauuuaugccagggcucaaugcacaguccaugugccaaugaccuguucuauagcaugacaugccagcaucaggaaauccaaaaccccgaucagaagcagucucggcgccuuuuguuuaaaaagauugacgaugcugagcugaaacaggagaaguga

SEQ ID NO: 59871 - RNA, 498 nt, Artificial Sequence
  derived and/or modified sequence opt3 from NPW__Homo_sapiens__NP_001092926
auggccuggagacccggcgagaggggagcuccugcaagccggccacgccuggcccuccuucuguuguuacugcuacucccgcugcccuccggggcgugguacaagcacguggcuucuccucgauaucauaccgucggucgugccgcaggccuucugaugggguugagaaggucaccauaccucuggcggcgcgcccugagagcugcagccggaccccuggcuagggacacacucaguccugaaccagccgcgcgggaggcacccuuacugcuuccuagcuggguucaggaauugugggagacucgccgaagauccucucaagccggcaucccagugagggcuccgcggucgccccgugccccugaaccagcacuggagcccgagucacuagauuucagcggugcugggcagcgccucagaagggacguaagucggccugccguggauccagcggccaaccgacugggacuucccugccuggcaccgggcccuuuuuga

SEQ ID NO: 59872 - RNA, 1155 nt, Artificial Sequence
  derived and/or modified sequence opt3 from NPY1R__Homo_sapiens__NP_000900
augaacagcacccuguucucccagguggagaaucacucuguccauucaaacuuuagugaaaagaaugcccaacuccuugcuuucgagaacgacgauugccaucugcccuuggcaaugaucuuuacauuagcccuggcguacggcgcuguuauuauacuaggggugagcggaaaucucgcccugaucauuaucauucuuaaacagaaggaaaugagaaacguaacuaauauccugauagugaacuuguccuucucugaccuccuggucgcaaucaugugucugccuuuuacguucguguauacccucauggaucacuggguuuuuggugaggccaugugcaaauuaaauccauucgugcagugugucucgauuacagugucaaucuuuagccugguacuuauugcuguugaaaggcaccaguugaucauaaacccgcggggcuggcgccccaauaaccgacaugcauacguggggauugccgucaucugggugcuggcuguggccaguucccuaccuuuccucauuuaucaagucaugacugacgagccauuucagaauguuacccuggaugcguacaaggacaaauaugugugcuucgaucaguuucccucugacagccaccgucuuuccuacacaacccuguugcucguacugcaguauuucggaccuuuauguuucaucuuuaucugcuacuucaagauuuacauaagacugaagaggcggaacaauaugauggauaaaaugcgcgacaacaaguauagaucaagugagacuaaaaggaucaacauuaugcuccuuagcaucguggucgcauuugccguguguuggcugccauugacaauauucaauaccguuuuugauuggaaccaccaaauuaucgcuacgugcaaucauaaccuacuguuccuccugugucaccuuacugccaugaucucuaccugcgugaaucccaucuuuuacggcuuccugaacaagaauuuucagcgggacuugcaguucuuuuucaacuuuugugauuuccgcucccgagacgacgauuaugaaacaauugcaaugucaacuaugcauaccgacgucagcaaaacaagucucaagcaggcuucuccuguggccuucaagaaaauuaauaacaaugaugacaacgagaagauauga

SEQ ID NO: 59873 - RNA, 1146 nt, Artificial Sequence
  derived and/or modified sequence opt3 from NPY2R__Homo_sapiens__NP_000901
augggccccaucggggccgaggcugacgaaaaccagaccguggaggaaaugaaggucgagcaauacggaccucagacaacuccaagaggugaacugguuccggaucccgagccugagcucauugacagcacgaaacuuauagaagugcagguagugcugaucuuggcauauugcuccauuaucuuacugggcgucauuggaaauucucuagugauccacguugugauaaaguucaaaucaaugaggaccgucacaaacuuuuucaucgccaaucucgcgguggcugaucugcuuguaaacacucuguguuugccauuuacccucacauacacccugaugggggaguggaagaugggccccguucugugccaucucgugccuuaugcccaggguuuagcaguccaagugaguacuauuacacugaccgugaucgcccuugaccggcaccgcuguauugucuaccauuuggaaagcaaaaucuccaagcgaauaucuuuccugauuaucgggcuagcuuggggaauuucggcacuccuggccucaccacuugcuaucuuucgugaguauagccugaucgagauuauacccgauuucgaaaucguugccugcacggagaaguggccuggcgaagagaaaaguauuuacggcacuguguauuccuugucuagccuccugaucuuauacguacugccacucgggauaauuuccuuuucauacaccagaaucuggaguaaacuuaaaaaucacgugagcccgggagcggcaaacgaccauuaucaccagaggcggcagaagacaacuaaaaugcuggucugugugguuguggucuucgccgugucuugguugccccuacacgcuuuucagcuggccguagauaucgacucccaaguucucgaucugaaggaauacaaacuuauuuucaccguguuucauaucauugcaaugugcucaacauucgcuaauccucuguuguaugguuggaugaacagcaauuaccgcaaggccuuucucagugcguucagaugugagcagaggcuggacgccauacacucugaggucuccgugaccuucaaggcaaagaagaacuuagaaguccggaaaaauagcggcccaaacgauucguuuacggaggcuacuaauguguga

SEQ ID NO: 59874 - RNA, 1362 nt, Artificial Sequence
  derived and/or modified sequence opt3 from NPY5R__Homo_sapiens__XP_011530316
auggacagcaagcaggauuacaacauggaccuggagcucgaugaauauuacaauaaaacccuugccacagagaacaauacugcugcaacgagaaacuccgacuuccccgugugggaugacuauaagucuucagucgaugaccugcaauacuuuuugaucggcuuauauaccuucguuagucugcuaggguuuaugggaaaucuccugauucuuauggcccugaugaaaaagaggaaccagaaaacaacugugaauuucuugauagguaaccucgcguuuagcgauauccugguagugcuguucugcuccccuuuuacccucacaucugucuuacuggaccaguggauguucggcaaggugaugugucacauuaugccauuucuucagugcguuucgguguuggucucaacccugauccuaauuagcaucgcuauagugcgguaccauaugaucaagcacccgauuaguaauaaccucacugccaaucauggguauuuccugaucgcaacaguauggacccuuggauuugccauuuguucuccccugccuguuuuccacuccuugguggaacuccaagagacguuuggcagcgcucuguuauccucacgcuaccugugcgucgaaaguuggccaagcgauucuuaccgaaucgcauucacuauaucccuccuucuggugcaguauauuuugccccuagugugucugaccgucucacauacaagcguuugccguaguaucucuuguggucucuccaacaaagagaauagacuggaggaaaacgagaugauuaaucuuacucugcacccuagcaagaaaucggggccacaggugaaguugucuggaucccacaaauggucauacaguuucaucaagaagcauaggcggcgcuauagcaaaaagaccgccugcguacuccccgcuccugaaagaccaucccaggagaaccacucuaggauccugccggagaacuuuggcagcgugcggucacaauuaaguuccagcucuaaauucauucccggcgucccuacauguuuugaaauaaagccagaggaaaauucagacgugcaugagcugcgcguuaaacgaagugugaccagaaucaagaaaaggagccgguccgucuucuaccgucuaacgauucucauccugguguuugccguaucuuggaugccccuucacuuguuccacguugugacugauuuuaacgacaaucugauaucgaaccgccauuucaagcucgucuauugcauuugucaucugcuugggaugaugagcugcugccugaauccuaucuuguacggauuucucaacaaugguaucaaggcggaccugguguccuuaauucacugucugcacauguga

SEQ ID NO: 59875 - RNA, 294 nt, Artificial Sequence
  derived and/or modified sequence opt3 from NPY__Homo_sapiens__NP_000896
augcugggcaacaagagacucgggcuuagcggacugaccuuggccuuaucccugcuagugugccucggugcucuggcagaggccuaccccucuaaaccugacaauccaggcgaagaugcgccggcugaggacauggccagguauuacucagcacuucggcacuauaucaaccugauuacacgccagcgauacgggaagcguaguagccccgaaacuuugauauccgaucuccugaugagagagucuacggaaaaugucccuaggacccggcuggaggacccagccaugugguga

SEQ ID NO: 59876 - RNA, 825 nt, Artificial Sequence
  derived and/or modified sequence opt3 from NQO1__Homo_sapiens__NP_000894
auggugggcagaagggcccugaucguccucgcucacagcgagcggaccuccuucaacuacgcaaugaaggaagccgcggcugccgcacuuaaaaagaaagggugggagguuguggaaucugaccuguaugccaugaauuuuaaccccauuauaucacgcaaggauaucacaggaaaauugaaggacccugcuaauuuccaguacccagcagagaguguauuagccuauaaggaaggucaucugagcccggauauuguggcugagcagaaaaagcuagaggccgcggaccucgucaucuuucaauucccccugcagugguuuggcgugccugcaauucuuaaagggugguucgaacgaguuuuuaucggagaguucgccuacacuuaugcugccauguacgauaagggcccauuucguuccaaaaaggcagugcugucuauaacgaccggugggucgggaucaauguauagcuugcagggcauccacggcgacaugaacgucauucucuggcccauccaaagugggauucugcauuucugcggauuucaggugcuggaaccucagcucacauacuccaucggucacacuccagcugaugccagaauacagauuuuagagggcuggaagaaaaggcuggagaauaucugggacgaaacaccccuuuacuucgcgccuucuagcuuguuugaucugaacuuccaagccggguuccuaaugaagaaagagguacaggacgaagagaagaauaaaaaguuuggacucuccguuggccaucaccuggguaaaucaauuccaaccgauaaccagaucaaggcacggaaguga

SEQ ID NO: 59877 - RNA, 582 nt, Artificial Sequence
  derived and/or modified sequence opt3 from NQO2__Homo_sapiens__NP_001277151
auggccggcaagaaagugcugaucgucuacgcucaccaggagcccaagagcuucaacgggucccucaaaaauguugcaguggacgaacuuucuagacaaggaugcaccguaacagugucagaucuguaugccaugaacuuggagccuagggcgacugacaaggauauuacggguaccuuaaguaauccagaagucuuuaacuacggcguggagacacaugaggcuuauaaacagcggagccuggccuccgacauaacugaugagcagaagaagguucgcgaggcagaccuagugaucuuccaggggaaacucgcccugcuuucugucaccacaggaggcaccgcugaaauguacacuaagacaggugugaauggggauucgcgauauuuucuguggccguugcaacacggaacccuccauuucuguggcuuuaaaguacuggcaccccagauuucauucgccccugagaucgcuagcgaagaggagcguaagggcaugguugccgcguggagucagagacugcagacgauuuggaaagaagaaccaauccccugcacugcacacuggcauuuugggcaauga

SEQ ID NO: 59878 - RNA, 1413 nt, Artificial Sequence
  derived and/or modified sequence opt3 from NR0B1__Homo_sapiens__NP_000466
auggccggcgagaaccaccaguggcaagggagcauccuguacaauaugcucauguccgcuaagcagaccagagcagcccccgaagcgccugagacaaggcuuguggaccagugcuggggauguucuugcggugaugaaccaggcgucgggcgggagggacuguugggcggucgcaacguugcuuuacuguaucgauguugcuucugugggaaagaccauccgcgucagggaucaauucuauacaguaugcucacuagcgccaagcaaacguaugcagcccccaaagcuccugaagcaacccugggcccaugcuggggcuguuccugcgggucugaucccggaguggguagagccggccuuccugggggaaggccaguagcucuguuguaccgguguugcuuuuguggcgaggaccacccccgccaggguucgauacucuauucacugcugacaagcaguaagcagacucauguggccccugcggcaccagaggccagacccgggggagcuuggugggauagguccuacuucgcccagcggccgggcggcaaagaagcacucccugggggacgcgcuaccgccuuacuguaucgaugcugcuuuuguggugaggaccacccacaacagggcucuacacuuuacugcguccccaccagcacuaaucaggcgcaggccgcaccugaagagagaccaagggcucccuggugggauacauccucaggggccuugcggccgguggcucugaagaguccucaaguugugugugaggccgcaagcgccggacuacucaagacccugcguuucgucaaauaccuucccugcuuucaggugcugccauuggaccagcaacucguacugguucgcaacuguugggcuucuuuacugaugcucgaacuugcgcaggauagacugcaguucgagacgguggaagucuccgagccuucaauguugcagaagauccuaacuaccaggcggcgagaaacaggcgguaaugagccccugccagugcccacucuccaacaucaccuggcaccuccagccgaggcucgcaaagugccgagcgccagucagguccaggcaauuaagugcuuucuuucuaaauguuggucccugaacaucagcaccaaggaauaugccuacuugaaggggacaguucucuucaaucccgacgugccuggccugcagugcguaaaauauauucaaggauuacaguggggcacccagcagauccugucggagcacacgagaaugacucaucaagggccacacgauagguuuauagaacuaaacucuacacucuuccugcuucgguuuaucaaugcuaacgugauugccgaguuguucuuucgccccaucauuggaaccgucuccauggacgauaugaugcuggaaaugcucuguacuaagaucuga

SEQ ID NO: 59879 - RNA, 1845 nt, Artificial Sequence
  derived and/or modified sequence opt3 from NR1D1__Homo_sapiens__NP_068370
augaccacacuggacagcaacaauaacacuggcggggugaucacguacauuggauccucugguucaagucccagcagaaccuccccugagucucucuauucggauaauucaaacggcagcuuccagagucuuacacaagggugcccaacuuacuuuccgcccuccccuaccggaucucugacacaggacccagccaggagcuucggcuccauacccccuucauugagugaugacgguagcccaucuuccucaagcaguucuuccagcucgucuuccucauuuuauaaugggagucccccuggcagcuuacaggucgcuauggaagauuccucucggguuagcccaucaaagaguaccuccaacaucacuaaacugaauggaauggugcuacucuguaagguaugcggcgacguggcaagcggguuccacuacggaguccaugccugugaggguugcaaaggcuuuuuccgccgaucuauucagcaaaacauccaguauaagcguugucugaaaaaugaaaacugcucaauugugagaaucaauaggaaccggugucagcagugccgcuuuaagaagugucuuaguguugggaugagcagagaugcggugagguucggacggauaccgaaacgcgagaagcaacgaaugcuggcugaaaugcaguccgccaugaauuuggcaaacaaucagcucucuucgcagugcccccuggagacaagcccuacccaacacccaacgcccggcccuauggguccaucacccccgccugcccccgucccauccccucuggugggguuuagucaguucccccagcaacucacuccacccagaucuccuagcccagagccgaccguagaagacguuaucucccagguggcuagggcacaucgggagauuuuuacauacgcccacgauaaauuaggaucaagccccggcaacuucaacgcuaaucaugccucuggcuccccuccagcgacuacaccccaccguugggaaaaccagggguguccuccagcacccaaugacaacaauacccuggccgcucagcgccacaacgaggcccuuaauggauugagacaagcaccgaguagcuauccuccaaccuggcccccuggucccgcucaucacucuugccaucaguccaacucaaauggccacaggcugugcccaacgcacgucuacgccgcgccugaggggaaggcccccgcaaacaguccacggcagggaaauagcaaaaacgugcuacucgcuuguccgaugaauauguacccucauggccgaucgggucgcacugugcaggaaaucugggaggauuuuuccaugucuuucacacccgccgucagagaaguuguggaguucgcuaagcacauuccaggguuuagggaccugagccaacaugaucagguaacccuucugaaggccggcacuuucgaaguguugaugguccgguuugcaucacucuucaacgugaaagaccagacaguuauguuucugagucgcaccacguauuccuuacaggagcugggagccaugggcaugggggaccuccuuucugcuauguucgauuuuagcgagaaguuaaauuccuuggcgcuaaccgaagaggaacugggacucuucacagcagugguccuggugucagccgacagaagcgguauggagaacagugcuucuguagaacaacuucaggagacucuguugagggcccuccgugcacugguucugaaaaaccggccccuggagaccucccgauuuacaaagcuacuccugaaacuuccugauuugagaacucugaauaacaugcacagcgaaaagcuccugucguucaggguggacgcccaguga

SEQ ID NO: 59880 - RNA, 1740 nt, Artificial Sequence
  derived and/or modified sequence opt3 from NR1D2__Homo_sapiens__NP_005117
auggaggugaacgccggcggggucaucgcuuacauuagcuccucuucaagugcaagcucccccgccucuugccacucggaaggaucagagaauagcuuccagaguuccucuagcuccguuccuucaaguccaaacagcucuaauuccgacaccaacgguaauccgaagaacggcgaucuggcgaauauagaagggauccucaaaaacgacagaauugauuguucaaugaagacaagcaaaaguucugcucccggaaugacuaagucccauagcggcgugacgaaauuuucggguaugguacuucugugcaagguguguggggacgucgccucuggauuccacuauggcgugcaugcaugcgagggcuguaagggguuuuucaggcgguccauccaacagaauauucaguacaaaaagugcuugaaaaacgaaaauuguucaaucaugcgcaugaaccgaaaucguugccagcaauguagauuuaagaaaugcuuaaguguuggaaugagcagggaugccgugcgguucggucgcauaccuaagagagagaagcagaggaugcugaucgagaugcaguccgcuaugaaaaccaugaugaacucucaguuuagcggccaccuacaaaaugacacacucgucgaacaucacgagcagacugcacugccagcccaggaacagcuucggcccaagccucaacuggagcaggagaacauuaaaucaaguuccccacccagcucugauuucgcuaaggaagaggugaucgggaugguaacccgcgcccacaaagacacauuuauguauaaccaggaacaacaggaaaauucagcggaaaguaugcagccucagcgaggagagaggauuccaaagaacauggagcaauacaauuugaaccaugaucacuguggcaauggucucagcucccauuucccgugcucugaaucgcagcagcaccugaacgggcaguuuaaaggaagaaauaucaugcacuaucccaacggccaugcaauaugcauugccaauggccacuguaugaacuucagcaaugcuuacacccaacggguuugcgaccgugugccuaucgauggguuuucccagaacgagaauaagaacucauaucuguguaauacuggaggucgcaugcaucucgucugcccaaugaguaagucucccuacguggacccucacaaaagcggccaugaaauuugggaggaguucuccaugucauucacaccagccgugaaggaggucguugaguuugcaaaaagaauccccggguucagggauuuaagccagcacgaccaggugaaccugcuuaaggcuggaaccuuugaaguauugauggugcgguucgccucucuguuugacgcgaaagagcgaacggucacuuuccuauccggcaagaaguacaguguggaugaccuccacagcaugggugccggggaucugcuuaacucuauguuugaguucuccgaaaaacugaaugcauugcaacucucagacgaagagaugagucuguuuaccgcuguuguguuagucagcgccgaucgcucgggcaucgagaacguaaauuccguggaagcucugcaggagacacucauuagagcccuuaggacucugauaaugaagaaccauccgaaugaagcaucuaucuucaccaaauugcuacugaagcucccugaccugcggagccuuaacaauaugcacucagaggagcuguuggccuuuaaaguucaucccuga

SEQ ID NO: 59881 - RNA, 1095 nt, Artificial Sequence
  derived and/or modified sequence opt3 from NR1H2__Homo_sapiens__NP_001243576
augagcucccccaccacaucuucacuggacacuccucucccaggcaacgggccgccccagccuggagccccaaguagcucccccacggugaaggaggaagguccugagccauggcccggcgggccugauccagacgucccgggaaccgaugaggcuucuucggcaugcucaacagacuggggcguucuuagcgaagaacaaaucagaaagaagaaaauuaggaagcagcagcagcaagagagucagucccagucucagagccccguggguccucaaggguccucaaguagcgccucuggaccaggcgcgucccccggcgggucagaggcuggaagccaggguaguggcgaaggggagggaguacagcugacugccgcacaggaauugaugauacaacaguuaguggccgcucagcugcaauguaauaaacggucuuucuccgaucagccuaaggucaccccauggccccuaggcgcagacccgcagagccgcgaugcccgacagcaacguuuugcucacuucacagagcucgccaucauuucggugcaggagaucguugacuuugcgaaacaggugccugguuuccugcagcuugggagagaagaucaaauugcacuguugaaagccucuaccaucgagauaaugcuccuggaaacugcuaggcgguacaaccaugagacagaaugcaucaccuuucugaaggacuucacguauuccaaagaugacuuucaccgcgccggacuccaggucgaguucauuaaucccaucuuugaguucucaagagcaaugaggcgguuaggccuggaugacgcugaauacgcccuuuugauugcgaucaacauauuuagugccgaccgcccaaaugugcaggagccuggccgaguagaagcacugcagcaacccuauguugaggcucuacucagcuacacuagaauuaagaggccacaggaucagcugcgguucccccguaugcuuaugaaacugguguccuugcgcacccucucuagcguccauucagaacagguguuugcccugagauuacaagacaagaagcugccuccacuccuuagugagaucugggaugugcacgaguga

SEQ ID NO: 59882 - RNA, 1164 nt, Artificial Sequence
  derived and/or modified sequence opt3 from NR1H3__Homo_sapiens__NP_001123573
augagccuguggcucggcgcccccgugccugacaucccaccggauuccgcugucgagcuuuggaagcccggggcacaggacgccucuucacaagcgcagggagguaguagcugcauucugagagaagaggcuaggaugccucacuccgccggcgggaccgcaggaguuggcuuggaagccgcugagccaacagcauuacugacucgggccgaacccccuucugagccaacggagauacgcccccagaaacgaaagaaagguccugcuccaaagaugcuagggaacgaacucuguucggugugcggagauaaagccucaggcuuccauuacaauguacugagcugugagggcugcaagggguuuuuccguagaagugugaucaagggagcgcacuauauuugucauuccgguggccacugcccgauggacaccuacaugaggcggaaaugucaggaaugccgccuuagaaaguguaggcaagcagggaugcgggaggagugcguccugucugaggaacagauccgcuugaaaaagcucaaacgacaggaagaggaacaggcccaugcuacaagccugcccccuagagccuccucaccaccccaaauucugccucagcucaguccagagcaguuaggaaugaucgagaagcugguggcagcucagcaacaguguaacaggcggagcuuuucugaucgucuucgcguuacugugauguugcuggaaaccuccagaagguauaaucccggcucagagagcauaacauuccuaaaggacuuuaguuacaaccgggaagauuucgccaaagcgggucuccaggucgaguuuaucaauccgauuuucgaauuuucucgagccaugaacgagcugcaacuuaaugacgcagaguucgcucuguugaucgccauuuccaucuuuagcgcugaucgcccuaacgugcaggaccagcuccagguagaaagacugcaacacaccuauguugaggccuuacacgcauacgugucgauacaucacccccaugauaggcugauguucccacggaugcucaugaaacuugucucucugcgcacuuuguccucagugcacagugaacagguguuugcccuaagacugcaggacaagaagcucccuccccugcuuagcgagauuugggauguccacgaauga

SEQ ID NO: 59883 - RNA, 1278 nt, Artificial Sequence
  derived and/or modified sequence opt3 from NR1H4__Homo_sapiens__NP_001193907
augggcagcaagaugaaccugaucgagcacucccaucuccccaccacagacgaguucucuuuuucagaaaaucuuuucggggugcugacugaacaggucgccggaccuuugggucaaaacuuagagguugaaccauacagucaguauagcaaugugcaguuuccgcagguacaaccccagauuuccucuucgucauacuauagcaaccugggcuucuacccucagcagccagaggagugguauagucccgggauauacgaacuaagaaggaugccugcugagacgcucuaucaaggagaaaccgagguggcagagaugccagucacuaaaaagccccggaugggcgccuccgcgggucgcaucaaaggggaugaacugugcgugguuuguggagaccgagcuucuggcuaccacuacaaugcccuuacaugcgagggcuguaaggggcuguugaccgaaauucagugcaaaagcaagcgucucagaaagaacgugaaacagcaugcagaucagacagucaaugaggacuccgaaggaagggaucugcggcaagugaccucaacuacaaagaguugucgcgagaaaaccgagcugacgccugaccagcagacucucuuacacuuuaucauggauagcuauaacaagcaaagaaugccacaggaaauuaccaauaaaauccugaaggaggaguucucugccgaagaaaacuuucuuauauugacagagauggcuacuaaucauguacagguucugguggaguucaccaagaaacuaccggguuuucagacacucgaccacgaagaucaaaucgcacugcuuaagggcuccgccgucgaggcuauguuccugaggucagccgaaauuuuuaacaaaaaguugcccagcgggcacagugaccuccuggaggaacggauccgcaauucuggaauuuccgaugaguacaucaccccuauguucagcuuuuauaaaucgauaggcgaguuaaagaugacgcaggaagaguacgcgcugcucacugcaauugugauccuuucuccagaccgacaguauauuaaagauagagaagccguggagaagcugcaggagcccuugcuagacguccugcaaaagcucugcaaaauccaucagccugaaaacccacagcacuucgcuugucugcuugguaggcugacagaguugcggaccuucaaucaucaccacgccgaaaugcucauguccuggcguguuaacgaccauaaguuuacuccccuguuaugcgagaucugggaugugcaguga

SEQ ID NO: 59884 - RNA, 1422 nt, Artificial Sequence
  derived and/or modified sequence opt3 from NR1I2__Homo_sapiens__NP_071285
augaccgugacaagaacucaccauuucaaggagggcagccugagggcccccgcuaucccucuccacuccgcagccgcggaacuugcuucuaaccauccacgggggccggaggccaaucuggaaguccgccccaaagagucauggaaccacgcagacuuuguucauugcgaagauacggagagugugccuggaaagccaagcguaaaugccgacgaggaaguggguggcccccagauuugucgagucugcggggauaaagcuaccggauaccacuucaacgugaugacaugugagggcugcaagggguuuuuccguagagcaaugaaaaggaaugcccgguugcgcuguccuuuuagaaagggugcuugcgaaauaacuaggaagacccggcgccaaugucaggccugccgauuaagaaaaugucuggaguccggaaugaagaaagagaugaucaugucugacgaagcgguugaggaaaggcgggcacuaauuaagcguaaaaagucggagcgcacaggcacccagccacucggcgugcaggggcugacugaggaacaaagaaugaugaucagggagcuuauggaugcccagaugaagacauucgacaccacguuuucacacuucaaaaacuuucggcugcccggagucuugagcagugguugcgaacucccugagucccugcaggcuccaucucgagaagaggccgcaaaguggagccaggugcgcaaagaucuguguucccucaagguaucauuacaacugagaggcgaagacgggaguguuuggaauuauaaaccgcccgcugauagcggaggcaaggagauuuucucucuuuugccucauauggccgacauguccacuuacauguuuaaagguaucauaucauucgcgaaggugaucagcuauuuuagggaucugccaauugaggaccagaucagucuacucaagggggccgcauucgaacugugccagcuucgguucaacaccgucuuuaaugcugagacaggaacuugggaaugcggccgccugucuuacuguuuggaggauaccgccggcggguuccagcaacuccuguuagaacccaugcugaaauuucacuauaugcucaagaaacuucagcugcaugaggaggaauacguguugaugcaggcuauuucccuauucagcccugacagaccaggagugcugcaacacagggucguugaccagcuccaggagcaguuugccaucacacugaagucguauauagaaugcaaccguccccaaccggcacaccgguuccuuuuucugaaaauuauggccauguugaccgagcuccgaucuaucaaugcucagcauacgcagagacuguuaaggauucaggauauccacccuuucgcgacuccccugaugcaagagcuauuugguaucacaggcuccuga

SEQ ID NO: 59885 - RNA, 1023 nt, Artificial Sequence
  derived and/or modified sequence opt3 from NR1I3__Homo_sapiens__NP_001070937
auggccagcagagaggacgaacugaggaacugcguggucuguggcgaucaggcuaccggguaccacuucaaugcacucacaugcgagggauguaagggcuuuuuccggcgcacuguuuccaaaucuaucggucccacgugcccuuuugccgggucaugugaagugaguaagacccaacgacgucauugcccagcguguagacuucagaaaugccuggacgcuggaaugaggaaggauaugauuuugagcgccgaggcauuagcccugcggcgcgcuaaacaggcacagagaagggcccaacagacaccgguacagcuauccaaggaacaggaggagcucauacggacucugcuuggcgcucacacccgccauauggguacaauguucgaacaauuugugcaguuccgacccccugcccaccuguuuauccaucaccagccauugcccacccucgcgccuguccugccacuggugacucacuucgcagacauuaacacauuuaugguucuccaggugaucaaguucaccaaagauuuacccgucuuuagaucucugccuauugaggaccaaaucucgcuuuugaagggggccgcuguggaaauaugucauaucguacugaauacgacuuucugccuacagacccagaacuuucucuguggaccacugagguauacaauugaggauggcgcccggguuggcuuccaaguggaguuccuugaacuguuguuucacuuccaugggacucuccguaaacugcaguuacaggagccggaauacguccugcucgcagcuauggcccuguuuucacccgcgccuuaucuuaccgaccgcccaggagugacacagagagaugagaucgaccaauugcaggaagagauggcccuaacccugcagagcuacauuaagggucagcaaaggcggccccgagaucgcaguccuggcacgccauggauccacugguccgggaaaaugcucggacccaagauaggcccggguucuaagggggcacaguggcugcaguga

SEQ ID NO: 59886 - RNA, 1404 nt, Artificial Sequence
  derived and/or modified sequence opt3 from NR2C1__Homo_sapiens__NP_001027458
auggccaccaucgaggaaauugcucaccagauaaucgagcaacagaugggcgaaauugugacagagcagcagacugggcaaaagauccagauugucacggcacuggaccauaacacccagggaaaacaguucauccucacaaaucacgaugguagcacucccuccaagguuauacuugccagacaagacucuaccccuggcaaaguguuucugacaaccccagaugcggcugggguaaaccaguuguucuuuacuacaccggacuuaucagcccagcaucugcagcuacucaccgauaauagucccgaccaaggaccuaacaagguguucgaucugugcgucguguguggcgacaaagcaagcgguaggcacuacggggccguuacgugcgaaggauguaagggcuuuuucaagcgguccauccgcaaaaaucuuguguauucuugccgaggcucgaaggauuguauuaucaacaaacaucaccguaauagaugccaguacuguaggcugcagcggugcauugcuuuugggaugaagcaagacucaguccagugugagcgcaaaccaaucgaggugagcagagaaaagaguuccaacugcgcagccucuacugagaagauauauauuaggaaagauuugcggagcccccucaccgcuacaccuacuuucguaaccgacuccgaaucaacacgcaguaccggacugcuggauagcgguauguuuaugaauauccacccaucuggcguuaagacggaguccgccgugcucaugacuucagacaaagcggagagcugucagggggacuuaaguacacuggcaaacgucgugaccucucuugccaauuugggaaagacuaaagaucugucccagaacagcaaugaaaugucgaugauugagucucuauccaacgacgauacaucacucugcgaguuccaagaaaugcagaccaauggcgacgugagucgagcuuuugauacgcuggccaaggcacuuaaccccggugaaagcaccgcuugccaguccucugucgccgggauggagggaagcguucaucugaucacaggcgacucaaguaucaacuacacugagaaagaaggcccuuugcucuccgauagccacguggcguucagacugaccaugccaucuccgaugcccgaguauuuaaauguacauuacauuggggaaucagccaguaggcugcucuuucuuagcaugcacugggcacuguccauaccuucuuuccaggcuuugggacaagagaacucgaucagccuagugaaggccuauuggaaugaacuguucacacucggucuggcucaguguuggcaggucaugaacguggccacuauucuugcaaccuuuguuaauugccugcacaacuccuugcagcaagccgagggcuga

SEQ ID NO: 59887 - RNA, 1791 nt, Artificial Sequence
  derived and/or modified sequence opt3 from NR2C2__Homo_sapiens__NP_001278623
augaccagccccuccccuagaauccagauuauaucuacagacucagccguggcuaguccacaaaggauccagauugucacugaucagcagacgggccaaaagauccagauuguuaccgcaguggacgccagcggguccccgaaacagcaguucauccugacaucucccgauggagcggguacuggcaagguaauacucgcuucgccugagaccucaagcgccaaacaacuuaucuuuacaaccagugacaaccuggugccagggcggauucagaucgucacugauuccgcaucuguggaacgcuuguuaggaaagacagacguucagcgaccccagguggucgaguacugcgugguauguggcgauaaagccagcggucgucacuauggggcuguuuccugcgaaggauguaagggcuucuuuaagagaucagugaggaaaaaucugaccuacaguugccggagcaaccaagacuguauuaucaauaagcaucaccgcaacagaugccaguucuguaggcuuaaaaagugccucgagaugggcaugaaaauggaaucuguccaguccgagcggaagccuuuugaugugcaacgcgagaagccaucaaauugugcagccagcacggagaaaauauauauucgaaaggaccugagaaguccccuuaucgcuacuccuaccuucguggccgauaaagacggggcgaggcagacaggacuguuggauccagguaugcucgucaacauucagcagccgcugauccgggaagacggcacuguucugcucgcaaccgacucuaaggccgaaacaucccaaggggcuuuaggaacccuggccaaugugguaacgagccuugcaaacuugucggagucucugaauaacggcgauacuuccgagauccagcccgaagaccagucagcuagugagauuacacgugccuuugauacccuagcgaaagcccucaauacuacagacagcuccucuagcccuucacuggcagaugguauagacaccagugggggaggcuccauccaugugauuagccgcgaucagucuacgccaaucauagaagucgagggcccccuucugucagacacccacgugacauucaaguugacuaugccuaguccaaugcccgaauaccucaacguucauuauauuugcgagagcgcuuccagacuguuauuucugucuaugcacugggccaggucgaucccggcuuuccaagcccucgggcaggauuguaauaccagccuugugcgggcaugcuggaacgagcuguuuacauugggacuagcccagugcgcucaggucaugucccugucaacuauccucgcggcaauugugaaucaucugcaaaacaguauccaggaagacaaacuuucuggugaucgaauuaagcagguaauggagcacauauggaagcugcaggaguucuguaacagcauggccaaauuggacaucgacggcuacgaauaugcuuaccucaaggccauuguucuguuuuccccugaucaccccggguuaaccucaacaagccaaaucgaaaaauuccaggagaaggcacagauggagcugcaagacuacgugcagaaaaccuauucugaagauacuuaccgccuagccagaauccucgucaggcugccagcucuacgguugauguccaguaauauuacggaggaacuguucuuuacaggacucauaggcaacgugagcaucgacucuauuaucccuuauauucugaagauggagaccgccgaauacaauggucagaucacuggggcaucccuuuga

SEQ ID NO: 59888 - RNA, 1269 nt, Artificial Sequence
  derived and/or modified sequence opt3 from NR2E1__Homo_sapiens__NP_001273031
auguucagagccggcgcugagggggcagaaaaggagcccagcccuaggccagaaugccgggccgacccgggacccggucugggcuuuccucucggguccggacuuccauggcccucucuguuggagucaccuggcggucgcaucuuagauauuccauguaaagugugcggggaccgaaguagcggaaagcacuacggcgucuaugcgugugauggcugcuccggguucuuuaaacguucuauaagaaggaaccggaccuacguuuguaagucgggaaaucaggguggcugccccguggacaaaacacaucgcaaccaauguagagcuugcaggcugaagaagugucuagaaguaaauaugaacaaagaugccgugcagcacgagcgggggccucgcacuucaacgauccgaaagcaggucgcacucuauuucagaggacauaaagaggaaaauggcgccgcugcacacuuuccaagcgccgcucugccggcccccgcguucuuuaccgcagugacacagcuugagccucauggucuggaauuggccgcuguuaguacuaccccagagaggcaaacacucgugucccuggcccagcccaccccuaaguacccacacgaggucaacgggacucccauguaucuguacgaaguggcaacagagucuguaugcgaaagcgcugcccggcucuuauucauguccauuaaaugggcgaagucaguuccggccuuuaguacccugagccuucaggaccaguugaugcugcuagaggaugcauggcgugaacucuucgugcugggaaucgcucaaugggccauuccugucgacgcuaauacgcuucuggccgugucuggcaugaacggcgauaauacugacucccagaaguugaacaaaaucauaucagagauccaggcacuccaggagguggucgcccgcuuuagacaacugagguuagaugcuaccgaguucgcgugucugaagugcauuguuacauuuaaagcagugcccacucacagcgggagugaacuccggucuuuccgaaaugccgcugccaucgcagcccuucaggacgaagcucagcugaccuugaacuccuauauucauacacgcuacccaacccaaccuugcagauucggaaagcuacugcuccugcuucccgcccugaggagcaucucgccaucuacgauagaggaaguauuuuucaaaaagacuauugguaaugugcccaucacacgguugcucuccgauauguacaaaucaagugacauuuga

SEQ ID NO: 59889 - RNA, 1233 nt, Artificial Sequence
  derived and/or modified sequence opt3 from NR2E3__Homo_sapiens__NP_055064
auggagaccagacccacagcccugaugagcuccacuguggcugcagccgcgccugcugccggcgcagccucuaggaaggaaucaccagggcgguggggacucggugaggacccgacgggcgucagucccagccuucagugccgcguuuguggggauuccucuucgggaaaacacuacggcaucuaugcuugcaacgguuguucaggguucuuuaagcgaagcgugcguagaaggcugauuuaccggugccaaguaggagcaggcauguguccuguggacaaagcccaucgcaaucagugccaggcuuguagauugaagaaaugcuuacaggccggcaugaaccaagaugcgguccagaaugaaaggcagccacggaguaccgcacaggugcaccuggacuccauggagucuaacacagaaagccgccccgagucccuaguugccccuccagcucccgccgggcgaucaccuagaggaccaacuccgaugagugcagcuagggcccucggucaucacuucauggcgagccugauaaccgccgagacaugugcaaaguuggaacccgaggaugcugacgaaaauaucgaugugaccucuaacgacccugaguuuccauccucacccuauagcaguucuuccccuugcggccuggauagcauucaugagacuucggcccggcuucucuucauggcugucaagugggccaaaaaucugccaguguuuucuucccugcccuuccgugaccaaguaauccucuuagaagaggcauggucagaacuguuucuuuugggggccauucaguggagucugccgcuagauagcuguccucuccuggcucccccagaggcguccgcagccggaggcgcucagggucgccuuacacuggccucuauggaaaccagaguuuugcaggagacgaucagcagguuccgggcacucgccguggacccuacugaguuugcuugcaugaaggcccuggucuuauucaaacccgaaacccgagggcugaaggauccagagcacguggaagcacuccaagaccagucacaggugaugcuuagucaacacuccaaagcgcaucaccccagccagccuguccgcuuuggaaagcuguugcuacugcucccaucucugagauucauaacagcugagaggaucgaacuucuguuuuuccggaagacuauuggcaacaccccgauggagaaauugcucugcgacauguucaagaauuga

SEQ ID NO: 59890 - RNA, 1272 nt, Artificial Sequence
  derived and/or modified sequence opt3 from NR2F1__Homo_sapiens__NP_005645
auggccaugguggucagcuccuggagagacccccaggaugacguugcuggcgggaacccuggagguccaaauccggcagcccaagcggcuaggggcgggggaggcggugccggggagcagcagcagcaagcaggaucuggcgcuccccacaccccucagacaccaggccagcccggggccccugcaacuccaggaacggccggugauaagggccaggggcccccuggaucaggccaaagucagcagcauaucgaaugcgugguauguggugacaaaagcuccgggaagcacuacggacaguuuaccugcgagggcuguaaaucuuucuucaagcggucggugcgccgaaaccugacauauacuugccgugcuaauagaaacuguccaauugaucaacaucacaggaaucagugccaguacugucggcucaaaaagugccuuaaggucggcaugcgcagagaagccgugcaaagggggcggaugccgcccacccagccuaacccaggacaguaugcgcugacaaauggugaccccuugaacggccauuguuacuuaucaggguauauaagccugcuacuccgcgcagagccuuacccaaccagucgauauggaucccagugcaugcaacccaauaacaucaugggcauugaaaauaucugugagcuggccgcuagacuucuguuuucugccguugagugggcaaggaacauuccguucuuuccugauuugcagaucacugaccaggugagccuccugcggcugacaugguccgaacucuucgucuuaaaugcugcccagugcucaaugccccugcacguggcgccacuuuuggccgcagcuggucugcacgccaguccuaugagcgcugaucguguaguugccuuuauggaccauauacgcaucuuccaagaacagguggagaaacuaaaggcacuccacgucgauucugccgaguacuccugccugaaagcuauugugcuuuuuaccucagacgcgugugggcugagcgaugcagcccauaucgagaguuugcaggaaaagucucagugcgcucucgaggaauacgugagaucccaauaucccaaccagccaagcagguucggcaaacuguuacugcggcuccccucgcuucgaacggucucuuccucaguuauugagcagcuguuuuucgugcgcuugguaggaaagacuccuaucgaaacccuaauaagagacaugcugcucaguggcagcuccuuuaauuggccauacaugucuauucaguguagcuga

SEQ ID NO: 59891 - RNA, 846 nt, Artificial Sequence
  derived and/or modified sequence opt3 from NR2F2__Homo_sapiens__NP_001138627
augcaggccgugugggaccuggagcaaggcaaguacggguucgcuguccagagaggaaggaugcccccuacccagccaacacacggucaguuugcacucacuaacggcgauccgcuuaauugccauagcuaucuguccggguacaucucuuuguuacugcgggccgaacccuauccuacgucacgcuucggaagucaauguaugcagccaaacaauauuaugggcauagagaacaucugcgaacuagcggcucgaaugcucuuuagcgccguugagugggcacguaauauucccuucuuuccugaccugcagaucaccgaucagguggcccuucugagauugacaugguccgaacucuucguacugaacgcugcacaauguucuaugccacugcacguggcuccccucuuagccgccgcgggucugcaugcaucgccuaugucagccgacagggucguggcuuuuauggaucacauucggaucuuccaggagcagguugagaaacuuaaggccuugcauguggacagcgcagaauacaguugccugaaagcuauaguccuauuuacuuccgaugccugugggcucucugacguggcgcacguagagagccugcaggaaaagucccaaugcgcccuugaggaguauguucgcucacaguacccaaaucagccgaccagauucggaaaacuguugcucaggcugcccaguuuacggacagugucuagcuccgucaucgaacaacuguuuuucgugcgccucgugggcaagaccccuauugagacucuuauccgagauaugcuguugucaggcagcaguuuuaacuggccauauauggcaauucaguga

SEQ ID NO: 59892 - RNA, 1215 nt, Artificial Sequence
  derived and/or modified sequence opt3 from NR2F6__Homo_sapiens__NP_005225
auggccauggugaccggcggguggggaggucccggcggggacacaaacggagucgauaaggcuggcgguuacccuagagcagccgaggacgauagcgcguccccaccgggggcugccucugacgcagaacccggagaugaggaaaggccuggccugcagguugacugcgugguauguggcgauaaaucaagugggaagcacuauggaguguucacuugcgaggguuguaagagcuuuuucaaacgguccauccgccgaaaucucucuuacacgugccguucgaacagagacugucaaauugaucagcaucacaggaaucagugccaguauugucggcuuaaaaagugcuuucgcgucggcaugagaaaggaagccgugcaaagggggcggauaccacauucacugcccggagcuguugcagccagcaguggcuccccuccagguucugcuuuggccgcgguggcaagcgggggagacuuauuccccggccagccugucuccgagcugaucgcccagcuacuccgcgcugagccauacccggccgcagcuggccgauuuggggccggagguggcgcggccggggcagugcugggaauugauaacguaugugaacuugcugccagacuguuguucucaaccguugagugggcuaggcacgcccccuuuuucccugaacucccaguggcagaccaggucgcccugcugcggcucaguuggagcgaguuauuugugcugaaugcugcgcaagcagcccuucccuugcauacagcuccucugcuagccgcagccggccuccacgcugccccaauggcagcggagcgugcuguggccuucauggaucagguccgcgcauuucaggaacagguugacaaacuggguagacuucaaguggacucugccgaguaugggugccugaaggcuaucgccuuguucacucccgaugcauguggccucuccgacccggcucacguagaaucacugcaggagaaagcccagguggcguuaaccgaauacgucagggcccaauauccuagccagccccagcgguuuggacgacugcuccuucgccugccagcuuugagagcagugccugccagucuaauuucucagcuguucuucaugaggcucguuggcaagacacccaucgagacccugauacgggauaugcuucuguccgggagcacuuuuaacuggccauacggaucgggucaauga

SEQ ID NO: 59893 - RNA, 2334 nt, Artificial Sequence
  derived and/or modified sequence opt3 from NR3C1__Homo_sapiens__NP_001018085
auggacagcaaggagucccugacccccggcagagaagagaacccuucuucagugcucgcccaggaaaggggggaugucauggacuucuacaaaacacuucggggaggugcuacuguuaaggugagugcaagcuccccaucucuggccguagcgucgcaaucagauagcaaacagcgccgauuguuaguggacuuuccgaagggcagugucuccaaugcucagcagcccgaucugucuaaagccgugagccuauccauggggcucuauaugggagagacggaaaccaagguuaugggcaacgaccuggguuucccucaacaggggcagaucucacuuaguagcggagagacagaucugaaguugcucgaggaaucuauugcaaaucugaaccguuccacuucagugccagagaaucccaaaagcagugccucuaccgcugucuccgcagccccuacagaaaaggaguuuccaaaaacccacagcgacgugucgucugagcagcaacaucugaagggccagacuggcacaaacgggggaaauguaaaacucuacaccacggaucaguccacuuucgacauauuacaggaucuggaauuuucaagugguagccccggcaaggagaccaacgaauccccuuggagaucugaccuuuugaucgaugagaauugccugcuaagcccacucgcuggggaagacgacucauuccugcuugagggaaacaguaaugaggauuguaagccgcugauuuugcccgacacaaaaccuaagaucaaagauaacggcgaccucguucuguccagcccaucuaaugugacuuuaccccaagucaagaccgaaaaagaggauuuuauugaacugugcacaccuggugugaucaagcaggagaaacucgggaccguguauugucaggccucauucccaggagcgaacauaaucggcaauaagaugagugcaauuagcguccacggcguuuccacgucugggggacaaauguaccauuaugacaugaacacugccucgcuuagccagcagcaggaucaaaagcccaucuuuaacgugauuccgccuauccccguagguuccgaaaauuggaacaggugccagggcucaggggacgauaaucugacaaguuugggaacccuaaacuucccaggccggacuguguuuucuaaugguuacagcuccccuucaaugcgccccgacgucagcucuccacccuccaguagcucuacagcuaccacggggccuccaccgaaacugugucucgugugcuccgaugaggccucaggcugucacuauggaguucugaccugcggcaguuguaagguguucuuuaaaagagcagucgaggggcagcauaacuaccuuugcgcuggaaggaaugacuguauaauugacaagauccggcgcaaaaacugccccgccugccgauacagaaagugucugcaggcggguaugaauuuggaagccaggaagacaaaaaagaaaauuaagggcauccaacaggcaacuaccggggugagccaggagacaucggaaaacccuggaaauaaaacuaucguaccagcuacccucccccagcugacaccuaccuuaguuucccugcuagaggugauugaaccagagguccucuaugccggcuacgauucuagcgugcccgacucaacuuggcggauaaugacgacacugaacaugcuuggugggcgucaagucaucgcugccgugaagugggcaaaggccauuccgggcuuccgcaauuugcaccuggaugaccagaugacccuccugcaguauaguuggauguuccuuauggcuuuugcgcugggauggagauccuacaggcagucuagcgcaaacuugcucugcuucgccccugaucugaucauaaaugagcaacggaugacuuuaccauguauguaugaccagugcaaacacaugcuguacguuuccucagaacuacaucgacuccaggugagcuaugaggaauaccuguguaugaagacccuuuugcugcucaguucuguacccaaagauggccugaagucccaagaguuauuugacgagauucgcaugacauacaucaaagaacuggggaaggcuaucgucaagagagagggaaacagcucgcagaacuggcagagguucuaucagcuuaccaaauugcucgauucaaugcacgaagugguugagaaucugcuaaacuacugcuuucaaacuuuccuggacaagacaaugucuauugaauuuccugagaugcucgccgagaucauuacgaaucagauacccaaauauaguaacgguaauaucaagaaacugcuuuuccaucagaaguga

SEQ ID NO: 59894 - RNA, 2955 nt, Artificial Sequence
  derived and/or modified sequence opt3 from NR3C2__Homo_sapiens__NP_000892
auggagaccaagggcuaccacagccugcccgaagggcucgacauggagagaagguggggacaggugucccaagccgucgaacggucuucacuugguccuacagagcgcacugaugaaaacaauuauauggagaucguuaacgugaguugcguaagcggcgcuauuccaaauaacuccacgcaggggucuucgaaagagaagcaggaacuguugccguguuuacagcaagacaauaaccgacccggaauacugaccucagauaucaaaacagagcuagaaagcaaggagcucagugcaacuguggccgaguccaugggccuguacauggacucuguccgugaugcggacuauagcuacgaacagcagaaucagcaagguuccaugagcccugcuaaaauuuaucagaacguggagcagcuuguuaaguucuacaaggggaauggacauagaccaaguacccugagcugcgugaacacacccuugaggucuuuuauguccgauucaggcagcagugucaauggcggggugaugcgggccguaguuaaaucuccuaucaugugucacgaaaaguccccaagcgugugcucgccccucaacaugaccucuuccgucuguaguccugcaggaauuaauucagugagcuccacuacagccucuuucgguagcuuuccagugcauucaccgaucacccagggcacgccccugacuugcaguccuaacgucgagaaucgcggguccagaagccacucuccagcucaugcaucaaacguuggaaguccccugagcuccccucucucuucgaugaaaagcuccauaucaaguccacccucucacuguagcgugaaguccccgguaucaagcccuaacaaugugaccuuaaggucuuccgucaguagccccgccaacaucaauaacucucggugcuccgugucaaguccaagcaauacaaacaaucgcucgacucuguccucuccugcugccagcaccguuggcucaauuuguagucccgugaacaaugcguucuccuauacagcaucugguaccagcgccggguccucaacgcuucgagacgucgugccaagccccgauacucaagaaaaaggagcucaggagguaccuuuuccaaagacagaggaaguugagagugccaucucuaacggcgugaccggccaguugaauauuguccaauacaucaagccggaacccgacggggcauucuccagcucgugccugggagguaacucaaaaauaaauucugauaguuccuuuagcgugccuauuaagcaggagucuacuaaacacagcuguuccggcacaucauucaaggggaacccaaccgucaaucccuuuccuuucauggacggaaguuacuuuagcuucauggaugacaaagacuauuacucucuauccggcauccucgguccacccgugccgggguuugauggcaacugcgaaggaucaggcuucccuguugggauuaagcaggagccagacgauggaaguuauuaccccgaggcuagcaucccuuccucugccaucguggguguaaacucgggcgggcagagcuuccauuauagaauuggagcgcaaggcacgauaucacuguccaggagugcccgggaccagucuuuucagcaccuuagcuccuuucccccagucaauacccugguggaaucauggaaaucucauggugauuugagcagucgucgcuccgacggguacccuguucucgaguauauccccgaaaacgugucaucuucaacacugagauccgucaguacuggcagcucgaggccaucuaagauuugcuuaguguguggagaugaggcauccggcugccacuacgggguagugaccuguggaagcugcaagguuuucuucaaacgggcugucgaaggucagcacaauuaccugugugccggccgaaacgacugcaucauagauaagauucgcaggaaaaauuguccggcuugcagacuccaaaagugucuucaggccgggaugaaccugggagcacggaaaucaaagaaguugggcaaacuaaaggguauccaugaggagcagccucagcaacagcagcccccacccccuccacccccuccgcagaguccagaagaggggacaacuuauaucgcccccgcuaaagaaccuucugugaauaccgcgcuggugccacaacucuccacaauuagccgcgcacugacccccucaccugucaugguucuugagaacaucgagccggaaauuguguacgccggcuaugacaguagcaagcccgauacugcugagaaucuguuguccacgcucaacagacuggccggaaaacagaugauacaggugguaaagugggcaaaggucuuaccaggcuuuaaaaaucugccucuagaagaccaaaucacacucauucaguacucuuggaugugccugagcuccuucgcccuuucauggaggucuuauaagcacaccaacagucaguuuuuguacuucgcucccgaccugguguuuaaugaggagaaaaugcaucagucggccauguaugaacucugucaagggaugcaccagaucagccugcaguucguucgucuucagcugacuuuugaggaauacaccaucaugaagguguugcuccuguuauccacaauuccaaaagauggacugaagucucaagcagcguucgaggaaaugcggaccaacuacauaaaggagcuacgaaaaauggucacuaagugcccuaauaacucaggccagagcuggcagagauuuuaucagcucacaaaacugcuugacuccaugcaugauuuggugagugaccugcucgaguucugcuucuacacguuuagggaaucucacgcucugaagguugaguuccccgccauguuaguggaaaucauuagcgaucaacugccaaaaguagagucagguaacgcaaagccgcuuuauuuucaccgcaaauga

SEQ ID NO: 59895 - RNA, 1836 nt, Artificial Sequence
  derived and/or modified sequence opt3 from NR4A1__Homo_sapiens__NP_001189162
auguggcuggccaaggcuugcuggagcauccaguccgagaugcccuguauucaagcacaguacggcaccccugccccaucuccggggcccagagaccaccucgcgucagauccucuuacaccagaauuuauaaaacccacuauggaccuggcuaguccugaggccgcaccagccgcucccacggcauugccuagcuuuuccaccuucauggauggauauacaggugaauuugacacuuucuuauaccagcugccaggcaccgugcagccgugcagcucggccucaagcagugcuuccucuacaagcuccucaagugccaccagccccgcgucugcauccuuuaaguucgaggauuuucaagucuauggguguuacccuggaccacuaucaggccccguugacgaagcccucagcaguucugguuccgauuauuacgggagcccuugcucggcuccaucucccuccacuccgucauuccagccuccccagcugaguccaugggacgguagcuuuggccauuucuccccuucucagacauaugagggccuuagggccuggaccgagcaacugcccaaagcaagcgggccaccccagccuccagcuuucuucucauuuaguccgcccacgggaccuuccccaucuuuggcccagucuccccucaagcuguucccuucacaggcgacucaccaacugggugaaggcgagaguuacagcaugccaaccgccuuccccgggcucgcaccgacauccccucauuuagaaggaucuggcauccuggauacuccagugaccucgacaaaagcucggagcggugcccccgggggauccgagggccgcugugcuguaugcggcgacaacgccucaugucagcacuacggggugcgaaccugcgagggauguaagggauuuuucaagcguacgguccagaaaaaugcaaaguauauuugccuugccaacaaagauuguccuguggacaagagaaggcggaaucgcugccaauuuugcagauuccagaaauguuuggcuguuggcauggugaaggaagucgugaggacugauagucugaaggggcggcgcggacgacuacccucuaaaccaaagcagccucccgacgcgagcccagcaaaccuccugacaucccuuguaagagcccaucuggacucaggcccgagcaccgcuaaauuggauuacucuaaguuucaggagcucguucugccucacuucgguaaagaagacgccggggaugugcaacaguuuuaugacuuacuguccggcagucucgaggucaucaggaagugggcagagaaaauucccggauucgccgaacuuagcccagcugaucaggaccuguugcuagagucugccuuucuggaacucuucauccugcggcuugcauaccguuccaagcccggcgaggggaagcugauauuuugcucaggauuggugcuccaccgccugcagugugcgagagguuucggcgauuggaucgacaguauuuuagcuuuuagcaggucgcugcauucccuacucguggaugucccugccuucgcaugccugucugcccuuguuuugaucacugaccggcacgggcugcaagaaccacgacgcguggaggaacuccagaauagaauugcuagcugucugaaagagcauguagccgcaguggcuggagagccccagccugccucaugccuuaguaggcuguugggcaagcucccggaacugcggacauuauguacccagggucugcaacgcaucuucuaucuaaaacucgaggaucuggucccacccccuccaauaauugacaagaucuuuauggacacgcuucccuucuga

SEQ ID NO: 59896 - RNA, 1797 nt, Artificial Sequence
  derived and/or modified sequence opt3 from NR4A2__Homo_sapiens__NP_006177
augcccugcgugcaggcccaauacggcagcuccccucagggggcuucuccagcaucacagaguuauagcuaccacuccucuggagaguauucgucagacuuccugaccccggaauuugucaaguucagcauggaucucacaaacacugagaucacggccaccacaagucuucccuccuuuucuacuuucauggacaauuacagcaccgguuaugauguuaaaccuccaugucuguaccagaugcccuuguccggccaacagucaaguauuaagguggaagacauacagaugcauaacuaucagcaacacagccauuuaccuccacagucugaggaaaugaugccccacuccgggucaguauacuacaaaccuagcaguccaccgacacccaccacuccuggauuucaggugcagcauucuccaaugugggaugaccccggcucccugcacaauuuccaccaaaacuaugucgcgacaacccauaugaucgagcagagaaagacgccugugagcaggcuaucgcucuuuucuuucaaacaguccccacccgguacuccgguuucaaguugccaaaugcgguuugaugggccucugcacgugcccaugaauccagagccugcuggaagccaucacgucguggacggccagaccuucgccguacccaacccaauucgcaagcccgcauccaugggcuuuccugggcuucagaucggacacgccucucagcuguuggauacacaaguuccaagcccgcccucacgagguaguccuuccaaugaaggccucugugcugugugcggggacaacgcagccugucagcauuacggaguccguacuugcgagggcuguaaggguuucuuuaaaagaaccgugcagaagaaugcuaaauaugugugccuggccaacaagaauuguccagucgauaaaaggcggcgcaacagaugccaguacuguagguuccaaaagugccuggcgguugggauggugaaggaaguagugcggacagacagccucaaaggacgccgaggcagauuacccucuaagccuaaaucaccacaggagcccaguccgccuagcccacccgucucccugauuucugcacuugugagggcccacguugauucgaauccugcuaugaccagcuuggacuauucccgguuccaggccaaccccgacuaccagaugucaggcgaugacacgcaacauauccagcaguuuuaugaucugcuaacugggaguauggagauaauccguggaugggcagaaaagauuccagguuucgcugaccucccuaaagccgaucaggaccugcuuuuugagucugcguuccuggaauuguuugugcuccgccuggccuacagaagcaaucccgucgagggcaaguuaaucuucugcaacggggugguacugcacaggcuccaauguguucggggauuuggcgaauggauugauuccaucguggaguucucaagcaaccuucagaauaugaacauagacauuucugcauuuuccugcaucgcugcccuggcuauggucacagagcgacaugguuugaaagaaccaaagcgcguggaggaacuacagaauaagauugucaacugucugaaagaucacgugaccuucaauaacgggggccucaauagaccgaacuaccugaguaaacuucugggaaaguugccugagcucaggacucugugcacacaaggcuuacagcggaucuuuuaucugaagcuagaagaccucguucccccacccgccaucauugauaaacuguuccuugacaccuugccuuuuuga

SEQ ID NO: 59897 - RNA, 1881 nt, Artificial Sequence
  derived and/or modified sequence opt3 from NR4A3__Homo_sapiens__NP_008912
augcccugcgugcaggcccaauacagcccuuccccaccgggcuccucauaugcugcacagaccuacaguagcgaguauacaacugaaaucaugaaccccgacuacacgaagcugaccauggaucucggguccacagagauuacugccaccgcgacaaccucucuuccuucgauaucaacuuucgucgaaggauauagcaguaauuacgagcugaagccauccuguguuuaucagaugcagagacccuugaucaagguggaagaggguagggcuccuucuuaccaccaucaccaucaccaucaccaccaucaccaucaccaccaucaacagcagcaccagcaaccaagcauucccccugccuccucaccagaggacgaaguauuaccgaguacaagcauguacuuuaaacagucucccccuuccaccccaacgacucccgcauucccuccacaggccggcgcucugugggaugaggcacuacccucagccccggggugcaucgcuccuggaccccuccuggacccaccuaugaaggccgugcccaccgucgcgggcgcacgguuuccacuuuuccauuuuaaacccagcccuccacacccgcccgccccuaguccagcuggugggcaucaccugggauaugaucccacagccgcagcugccuugucucucccucugggcgcggccgcagcugccggcucccaggcugccgcacuggaaagccacccauacgggcuccccuuagccaagcgcgcugcgccgcuggcauucccuccacuuggauugacucccucgccuaccgccucuucccugcuaggugagucacccagucucccaagcccucccucccgaucuagcucaaguggcgaggggacaugugcugugugcggagacaacgccgcaugucaacauuauggcguucguaccugcgaagguuguaagggguuuuucaaaagaacggugcagaagaaugccaaauacgucugccuggcuaacaagaauuguccaguggauaaaaggcggcgcaacagaugccaguauuguagguuucaaaagugccuuuccguaggaaugguuaaggaggugguccggacugacagccugaaaggccgccgaggcagauugccgucuaagccuaaaucaccccuccagcaggaaccaagucagcccagcccuccaucucccccuauuugcaugaugaaugcccuggugagggcauuaacagauucuaccccgcgggaccuggauuacucgcguuauuguccaacugaccaagcggcugccgggacagaugcagagcacgugcagcaguucuacaaccuccuuaccgccagcaucgacgucucccgcucaugggcugaaaagauacccggauuuacggaccugccuaaagaggaucagaccuugcuaaucgagagugccuuccuggaacucuuuguucugagacuuucuauuaggagcaauacagcagaggacaaguucguguucugcaacggucugguauugcaucggcuccaaugucugcgaggcuuuggggaaugguuagauuccaucaaagacuucucacugaaucuacagagccucaaccuggauauucaggcucuugccugcuugucugcgcuguccaugaucacugagcgccacggacucaaggaaccaaagagaguggaggagcuguguaauaaaauaaccaguagccuuaaggaccaccagucuaaaggccaagcccuggaacccacagaguccaaggucuugggugcucucguggaacugaggaaaauuugcacuuuagggcugcagcggaucuuuuaccuaaagcucgaggaucugguuucaccuccgaguauuaucgacaaacuuuucuuggauacccugcccuuuuga

SEQ ID NO: 59898 - RNA, 1386 nt, Artificial Sequence
  derived and/or modified sequence opt3 from NR5A1__Homo_sapiens__NP_004950
auggacuacagcuaugaugaggaccuggaugaacucugccccguguguggcgacaaggucuccggguaccacuauggacuucugaccugcgagucuuguaaagguuucuuuaagagaacaguucagaacaauaaacauuacacuugcacggaaucacaaaguuguaagaucgauaaaacccagaggaagcggugcccuuucugucgcuuucagaagugcuugacagugggcaugcgauuagaggccguacgugcugacagaaugcgagggggacggaacaaauucggcccaauguauaagcgcgauagagcacugaaacagcaaaagaaagcccagauuagggcgaaugguuuuaagcuagaaacugggccgcccaugggagugccuccacccccuccacccgcuccugacuacguccucccaccgagccugcacggccccgagccuaagggccuugccgcagggccacccgccggaccucugggugauuucggcgcuccagcauugcccauggccgugccgggggcucauggaccucucgccggcuaucuguaccccgcguuuccaggucgggcaauaaaauccgaguacccugaacccuaugccucuccaccccagccugggcugccauacggauauccggagcccuucucgggcggcccuaacguuccagaacucaucuuacagcugcuucaauuggagcccgacgaggaucaggugcgcgcuaggauucuggggugucuacaggaaccuaccaagucaagaccagaccagcccgccgcauuuggacuccugugcaggauggcugaucaaacauucaucagcauugucgacugggcccggcguuguaugguguuuaaagagcuugaaguagcggaccagaugacccuguugcagaauugcuggagugagcuccugguuuucgaucacaucuaccgccaagugcagcaugguaaggaaggcuccauauuacuggucacugggcaggagguggagcucacaaccguggccacgcaggcaggaucucuucugcacagcuugguccuaagagcucaagaacugguucuccagcugcuugcccugcaguuggacaggcaggaguuugugugccucaaauucaucauucuguucuccuuagaucugaaguuucuaaacaaucacauccucguaaaagacgcucaagaaaaggccaacgcagcccugcuugauuauacuuugugucauuacccgcacugcggcgacaaguuccagcagcugcuccugugucuuguggagguccgggcucugucaaugcaggcgaaagaauauuuguaccauaagcaccucgguaaugagaugccucgaaacaaucuguuaauugagaugcugcaagcaaaacagaccuga

SEQ ID NO: 59899 - RNA, 1410 nt, Artificial Sequence
  derived and/or modified sequence opt3 from NR5A2__Homo_sapiens__NP_001263393
auggugaacuacagcuaugacgaggaucuggaggaacucugccccgucuguggcgacaagguuuccggguaccacuauggacuucugaccugcgaaucuuguaaagguuucuuuaagagaacagugcagaauaacaaaagguacacuugcaucgagaaucaaaacugucagauugauaagacgcagcggaaacgcugcccuuauugucgauuccagaagugcuugucaguaggcaugaaguuagaagccgugcgugcugacagaaugaggggagggcggaauaaauuuggcccaauguacaagcgcgauagagcacugaaacaacagaagaaagcccuaauaagggcgaacggucucaagcuggaggcuaugagucaggucauccaggccaugccgagcgaccuuaccauuuccucugcaauccaaaauauucauucggccucaaaggggcugcccuugaaccacgcugcacucccuccaacagauuaugaccggagccccuucgugaccaguccuaucuccaugacuaugccaccccauggaucucugcagggcuaccagacauacggccacuuuccuagccgcgccauaaaauccgaguauccagauccguacaccucaagucccgaaagcaucaugggguauucuuacauggacuccuaucagacuucaagcccugcuaguauuccacaucugauccucgaguuacugaagugugaacccgaugagccucaaguucaggccaaaauuauggcguaccuucagcaagagcaggcaaaucgaucuaagcacgaaaaauuguccacauucggacugaugugcaagauggccgaccagacccuauuuagcaucguggagugggcuagaucgucuauauucuuuagggaacucaaagucgaugaccagaugaagcugcuucaaaacuguugguccgagcuguugauucucgaccacaucuaucgucaggugguacaugguaaggaaggcucaauuuuccugguuacggggcaacagguggauuacaguaucaucgccagccaggcaggagcuacuuuaaauaaccugaugucccacgcccaggagcucgucgcgaaacuucggucucugcaguuugaccagcgcgaguucgugugcuugaaguuucuagugcuguucagccucgaugucaaaaaucuggaaaacuuccaacuuguugagggcgugcaggaacagguaaaugccgcacuguuggacuacaccaugugcaacuauccacagcaaacagagaaguuuggucagcuccuguuaagacugcccgaaauuagggcuauaucaaugcaggccgaggaguaccuauauuacaaacaucucaacggggaugugccguauaauaaccugcuuaucgaaauguugcacgcuaagcgggccuga

SEQ ID NO: 59900 - RNA, 1431 nt, Artificial Sequence
  derived and/or modified sequence opt3 from NR6A1__Homo_sapiens__NP_001265475
auggagagagacgaacccccuccaagcggcgggggagguggcgggggauccgccggcuuccuggagccgcccgcugcacucccuccacccccuaggaacgguuuuugccaggaugaacuugccgagcuggacccagggaccaaugaucgggcggaacaacgcacauguuugaucugcggagaccgagcuacuggcuuacacuacggcauuauaucuugugaggggugcaagggauucuuuaaacguucaaucuguaacaagagaguguauaggugcagucgggauaaaaauugugucaugagccgcaagcagagaaacaggugccaguacugucggcugcuaaaaugccuccagauggguaugaaucgcaaggccauucgagaggacggcaugcccgggggaagaaacaaguccaucggcccuguucaaauuucugaagaggaaaucgagaggauaaugucgggucaggaguucgaagaggaagcaaaucauuggucaaaccacggggauagcgaccauaguuccccaggaaaucgggccucugagagcaaccagccgucccccggcucaacgcugaguagcucucguuccguggaacuuaauggcuuuauggcuuuccgcgagcaguauauggggaugucaguaccuccacacuaccaauauaucccccaucuguuuagcuacaguggacacucuccuuugcucccacagcaggcaagaucccuggauccccagagcuauucgcugauucaccaacucuuaucugccgaggaccuggaaccgcuugguaccccuauguugaucgaggauggcuacgcugugacacaggccgaacuguucgcgcuacucuguaggcuggcagacgagcuucuguuucggcagauugccuggaucaaaaaguugcccuucuuuugcgaacucuccauaaaagauuacacuugccuguuaucaaguaccuggcaagagcugauucuccuuagcucccugacagucuauucuaagcagaucuucggggaguuggcugacgugaccgccaaauacagcccaucagacgaggaacuacaucgauuuagugaugaaggaauggagguuauugaacgccugaucuaucucuaccacaaguuccaucagcugaagguguccaacgaggaguaugcauguaugaaagcuaucaauuuccuuaaccaggacauuagaggccugacuagcgccucucaauuggaacagcucaauaagagguacugguauauaugccaggauuuuacagaguacaaauacacccaccagccuaaccgguuccccgaccugaugauguguuuaccagaaauccgcuauauugcggguaagauggucaacgugccccuggagcaacuaccucuccuguuuaaaguaguucuucacucaugcaagacgaguguggggaaagaguga

SEQ ID NO: 59901 - RNA, 5088 nt, Artificial Sequence
  derived and/or modified sequence opt3 from NRAP__Homo_sapiens__NP_006166
augaacgugcagcccugcagccgauguggcuacggggucuauccugcagaaaagaucuccugcauugaccaaauauggcacaaggcuuguuuccauugcgaaguuuguaagaugaugcugucugugaauaacuuuguaucacaccagaaaaagccauacugccaugcacacaauccgaaaaacaauacauucacaaguguguaucauacuccccucaaccuuaaugucaggacguuuccugaggccaucagcgguauucacgaucaggaagacggagagcaguguaaguccguguuccacugggauaugaagucuaaagacaaggaaggcgcgccaaaccggcaaccccuggcuaaugagcgcgcauacuggaccggguauggagagggcaacgcauggugcccuggugcauugccagaucccgaaaucguucgaaugguggaggcucguaaaucguuaggggaagaguacacagaggacuaugaacagccuaggggaaagggcucauuuccagcaaugauuacuccggccuaccagagggcuaaaaaggccaaucagcuggcgagccaagucgaguacaagcggggccaugaugaacgcaucaguagauucuccaccgugguagacacacccgagcuacucaggucuaaagcaggggcccagcugcagagcgauguucgguauaccgaagacuacgagcagcaacgcggaaaggguuccuuuccugcuaugauaacuccagccuaucagaucgcaaaacgagcuaacgagcuugccucagaugugagauaccaccagcaauaucagaaggaaaugaggggcauggcggggcccgccauuggagcagagggcauccugacacgggaaugugcugaccaguacggucagggguauccugaggaauacgaggagcaucguggaaaaggcaguuucccagccaugauuacccccgcuuaccaaaaugccaagaaagcacacgaauuggccagcgauaucaaguaucgccaggacuuuaacaagaugaaaggcgcugcgcacuaccauucucucccggcacaggacaaucugguccugaagcaggcccaauccgugaacaaacucgugucagagaacaaguauaaagaaaauuaccagaaccacaugagagggagguaugagggagucgguauggaucggcgaacguuacaugcuaugaagguuggcagccuggccaguaauguggcauacaaggccgacuauaaacacgauauaguagacuacaacuacccugcuacucuuacccccucuuaucagacagccaugaaguuggugccacugaaagaugcaaauuaccgccaguccauugacaagcuaaaauauagcucggucacugauaccccucaaaucgugcaggcgaagauuaacgcucagcagcucucucauguuaauuacagagccgacuaugaaaagaacaaacugaauuacacacuuccccaagaugugccacagcuggucaaggcaaaaaccaacgccaaguuguucuccgaggugaaauauaaggaggggugggaaaagacgaaaggaaagggcuuugagaugaaacucgacgcuaugucacuguuagccgcaaaggcuaguggugaacuggccagcaauaucaaauacaaggaggaguacgagaagacuaaggggaaggcgaugggcacagccgauuccaggcuccuucacucucugcagaucgcuaaaaugagcucagagguagaauauaagaaaggauucgaggaaaguaagacccgguuucacuugcccauggacaugguuaacauucgccaugccaagaaagcccaaacucuagcuuccgaccuggauuacagaaagaaacuccacgaguauacagugcugccugaggacaugaaaacccagugggccaaaaaggcauacggccuucagagcgaacugcaguauaaagcggauuuggccuggaugaagggggucggauggcucacggaggguucucugaauuuagaacaagcuaagaaagccggccagcuggugucagagaagaacuacaggcagcgugucgacgaacuaaaauucaccagugugacagauagcucccagauggagcaugcaaagaaaucucaagagcuccagucggggguugcuuauaaggccggaaaugaacagagcgugcaccaguacacuauauccaaggacgagccacuguuccuucaagcacgggccaacgcugcgaacuugucagaaaaacuguacaagaguucuugggagaaucagaaagccaagggcuuugaacuccgacuggauagccuuaccuuccuggcagcuaaagccaagagagacuuggccuccgagguaaaauauaaggaggauuacgaaaggucacgcgguaagcucaucggggcuaaagacguccagggcgauagccaaaugucucacucccugcagaugaguaaguuacagagcgagcuggaauauaaaaagggauuugaggacacaaaaucucagugccaugugucccuagauaugguucaccucgugcaugcacggaaggcccaacaccuggcgacugacgucggcuacaagaccgcugagcaucacuucacagcccuuccgaccgacaugaaaguggaaugggcaaagaaagccuauggguugcagucagauaaccaguacagagcugacguaaaguggaugaaaggaauggguuggguggcaacuggcagucugaauguugagcaggccaagaaggcgggggaacucauuagcgagaaaaaguauaggcaacaccccgaugcucugaaauuuacgucgaucaaggacacaccugaaaugguccaggcccgcauauccuacacccaggcaguggaucgauuauaccgggagcagggagagaacauuaaacaucacuauacuccaaccgccgaccugcccgaagugcuuuuggcuaagcucaaugccaugaacaucucugagacacguuacaaggaaagcuggucaaaacugagagauggcgguuauaagcuaaggcuggacgcacucccuuuccaagcugccaaagcgaguggggagaucauuuccgauuacaaguauaaagaagccuuugagaagaugaagggccagaugcugggaucucgcagccuugaggacgauaucuccuuggcacauucagucuacgcuaccagccugcagagugacguuaauuauaaaaagggcuucgaacacucuaaagcccaguuucauuuaccacucgauauggcugcacuggugcacgccaagaaagcccaaacucuugcuuccaaccaggacuacaagcacccccugccgcaguacaccagcuuggcggaggaccuccggcugucgugugccaaaaaggcccauaagcuacaaucagaaaaucuguauagaucugaucucaacuucaugagagggguggcuugcguaauuccuggaacgcuggagauagaaggccgcaaaaaggccagugagcuuaucuccgagagcaaauacagacagcacccacauucuuuuaaguauaccgcagucacugacacacccaauuugcugcacgccaaauucagcaaccagauuaccaaugaacgguuauacaaggcugcgggugaggaugccagacacgaauauacaaugacucucgggcugccugaguuuaucagggcaaagaccaacgcugccaaucuuuccgacgcacguuacaaagagucauggcgcaaccugcgggcccagggauauaagcuaacgaucgaagcucuccccuuccaagccgcgagagcaaguggcgauauugccagcgacuuccuguacaggcaugauuuugugaaagagcgagguaaguugauaggcccacagucuguucgggacgauccucgcauccagcacugcagaaggauggggcagcugcaauccgaauuacaguaccggcgaggagcuaccucaagucaggcccaguuccaucuccccauggacauggugcaccugguccaugcuaaaaacgcacaagcccuugcuagcgaucacgacuauagaacacaguaccacaaguuuacugcccugccagaggacuugaagauggcaugggcgaaaaaggcccaugcucuccaguccgaacugcgcuauaaaucugaucuaauuggcaugaaggggaucggauggcuggcccuuaggucgccgcaaauggagagcgccaaaaaggcuggcgagcucauuucagaaaccaaguaccguaaaaagccugacuccaucaaauucacaacugugguugauagucccgaccuggugcacgccaaaaauucuuauaugcauuguaacgagcggauguacagaagcggugaugcagaauccuugcacagguauacccugauaccagaccaccccgauuuuacgcgcgcccgauuaaaugcucuccaucugucagacaaaguauacagaaacucuugggagcagacacgggcggggagcuacgauuucaggcuugacgccaucccuuuucagaccgcacgcgcuagucgugaaauugccuccgauuucagauauaaggaggccuuucugcgggacaggggauugcagaucggcuaccgcagcgucgaugacgacccacgaaugaaacacuuccucaauguggguagacugcaaucugauaacgaguauaagaaggacuuugcaaaaucacggucccaguuccauaguagcacugaucagcccggccuacugcaggcuaagaggucgcaacagcuugccucugacgugcacuaccgccagccucucccgcagccaacaugcgaucccgaacaacugggguugagacaugcgcagaaagcucaccaguuacaguccgacgucaaguauaaaagcgaucugaaucucaccaggggaguuggcuggacuccuccagggucauacaagguggagauggcccggcgugcagccgaacuggcuaacgcacgcggacuuggccugcaaggugccuaucgaggggcggaggcuguagaagccggagaccaccagaguggcgaggugaaucccgaugcaaccgagauuuugcaugucaagaaaaagaaagcccuacugcucuga

SEQ ID NO: 59902 - RNA, 345 nt, Artificial Sequence
  derived and/or modified sequence opt3 from NRARP__Homo_sapiens__NP_001004354
augagccaggccgagcugucuaccugcuccgcuccccaaacacagagaaucuuccaggaagcagugaggaagggcaacacucaggagcuccaaucacuucugcagaauaugacgaacugugaauuuaaugucaacaguuucgggccugagggacagaccgccuugcaccagagcguuauugacgguaauuuagaacuggugaaacuacucguaaaguuuggcgcggauauacggcuggcuaaccgcgacgggugguccgcccuucauaucgcagccuucggaggccaccaagauauugugcuguacuugaucacaaaagcuaaguaugcagccucuggucgauga

SEQ ID NO: 59903 - RNA, 1608 nt, Artificial Sequence
  derived and/or modified sequence opt3 from NRBP1__Homo_sapiens__XP_005264331
augagcgagggcgaaucccagaccgugcugucuucagggagugaccccaaggucgagagcuccucuucggccccuggacucacaucaguuagcccaccggugacuuccacgaccuccgcugcaucucccgaagaggaagaggagagcgaagaugaguccgaaauccuugaggagucaccuugcgguagauggcagaaaaggcgggaagagguaaaccaacgcaaugugccaggcauugacagugccuaccuggcgauggauacagaagagggggucgaagugguuuggaacgaggugcaguucagcgagcgaaagaauuauaaauugcaggaagagaagguccgugcuguguuugacaacuuaauacaacuggaacaccuaaauaucguaaaauuccauaaguacugggccgauauuaaggagaacaaagcaagaguuaucuuuauuacugaauauaugucuuccggaucacucaagcaguuccugaaaaagaccaaaaagaaucacaagacaaugaacgagaaagccuggaagaggugguguacccagauccuuagcgcucugaguuacuugcauucuugcgaucccccuauaauccacggcaaucucacuugugacacaauuuuuauccagcauaacggucugauuaaaaucggguccguggcaccagacaccauaaauaaccacgucaagacgugccgggaggaacagaaaaaucugcacuucuuugcccccgaguauggagaagugacuaacgugaccacagcugucgauauuuacagcuucggcaugugugcccucgagauggcgguuuuagaaauccaaggcaauggggagucgucuuaugugccucaggaggcaauuuccucagccauccagcugcuugaagacccauugcaacgcgaguuuauccagaagugccugcagagugaaccggcuagaaggcccacugcccgggagcuacucuuccauccugcacuguuugagguaccaagccuuaaacuguuggcugcccacuguauugugggacaucaacacaugauacccgaaaacgcgcucgaggaaaucaccaagaacauggauacauccgccguccuggcagagauuccugcugguccaggccgcgaacccgugcagaccuuauacucucagagcccggcccuggagcucgacaaguuccuugaggauguucgaaaugggaucuacccucugacggcuuuuggauugcccagaccacagcaaccucagcaggaagaggugacuucacccgucgugccacccaguguaaaaacaccuaccccagaaccggccgagguugaaacuaggaaggugguccuaaugcagugcaacauagaguccguggaggaaggcgucaaacaccaucugacacuccugcuuaagcuggaggacaaauugaaucggcaccucagcugugaccugaugcccaacgaaaauauuccugaguuagcagccgaacuggugcaacuagguuucaucucugaggcugaucagucacgucucaccagucugcuugaggaaacguugaacaaguucaauuuugcgcgcaacagcacccugaauagugcagccguuacagugucuucguga

SEQ ID NO: 59904 - RNA, 1506 nt, Artificial Sequence
  derived and/or modified sequence opt3 from NRBP2__Homo_sapiens__NP_848659
auggccgcucccgagccugcaccaagaagggcccgggaacgcgagcgagaacgugaggacgaaagcgaggaugaguccgacauccuggaagagucuccgugcggcagauggcagaagaggcgggaacaagugaaccaggggaauaugcccggacuccagucaaccuuccuugcgauggauacagaggagggugucgaaguuguguggaacgagcugcacuuuggcgaccgcaaagccuucgccgcacaugaagagaagauucagacuguauuugaacaauugguguuagucgaucacccuaauauagugaaacugcauaaguacuggcuagacacgagugaggccugugcuagaguuaucuucauuaccgaguaugugagcuccgggucucucaaacaguuucugaagaagacuaaaaagaaccacaaagcaaugaaugccagggcuuggaagcgguggugcacacagauccuuucggcccugucauucuugcaugcguguagcccacccauuauccacggaaaccucaccagugauacaauauuuauccagcacaauggccugauuaaaaucgguuccgucuggcaucgcauuuucucuaacgcacugccugacgaucuccgaagcccaaucagagccgaaagggaggaauuacggaaucugcacuuuuucccucccgaguacggggaaguggcugacggaaccgccguagauauauuuuccuucggcaugugcgcacuugagauggcuguuuuggagauucaaacuaacggcgacacacgugugaccgaagaggccaucgcgcgcgccagacauucacugagugauccaaauaugagggaauuuauucuauguugccucgcacgggacccggcucgacgccccagcgcccacucucugcuuuuccacagaguccuguucgaggugcauuccuugaagcuccuggcugcccacuguuuuauccagcaucaguauuuaaugccugaaaacguggucgaggagaagacgaaagcaauggaccugcacgccguucucgcugaacuuccaaggccccggcgcccuccacugcaguggagauacucagaggugagcuucauggaauuggauaaguuucuagaggacguaaggaaugggaucuauccccugaugaacuucgcggcaacucguccgcucggacugccucgggugcuugcucccccaccugaggaaguccaaaaagcuaagacccccacaccagagcccuuugauagugaaacucgaaaagugauucagaugcagugcaaucuggagagaucugaagacaaggccagguggcauuugacccuccuguuaguucuggaggaucgccuacaccggcaacucacauacgaccugcuuccuaccgauuccgcacaggacuuggccagcgagcuggugcacuaugguuuccuccaugaagaugacagaaugaaacuggcugccuuucuugagucgacguuccugaaguacaggggcacucaggcauga

SEQ ID NO: 59905 - RNA, 3915 nt, Artificial Sequence
  derived and/or modified sequence opt3 from NRCAM__Homo_sapiens__NP_001032209
augcagcugaagaucaugcccaaaaagaaaagacucagcgccggcagggugccucuuauucuguucuugugccaaaugauauccgcuuuagaggucccacuggacccgaagcuacucgaagaucugguucagcccccuaccaucacacagcagucuccaaaagacuacauuaucgauccccgggagaauauugugauccaaugugaagcaaaggggaagccuccacccucauuuaguuggacucgcaauggaacgcacuucgacauagauaaagacccucuuguaaccaugaagccagguacaggcacucugaucauuaacaucaugagcgaggggaaagccgaaaccuaugagggaguguaccagugcacagcgcgaaaugagcguggcgcugccgucuccaacaauauugugguuagaccgucuaggucgcccuuguggaccaaggaaaaacucgagccuaucacucugcagucaggucagagccuggugcucccaugucggcccccuauaggguuaccacccccgauuaucuuuuggauggauaacaguuuccaacgccugccucaguccgaaagagucucucagggacuuaauggcgacuuguauuuuagcaacgugcugcccgaggauacaagggaggacuacauuugcuaugcacgguucaaucauacccagacgauccaacagaagcagccaaucuccguaaagguuauuucaguggaugaacuaaacgacacuauagccgcuaaucucagugauaccgaguuuuacggcgcaaaaagcucucgcgaacgaccucccacauuccugacuccagaggggaacgccuccaauaaggaggaacuuagaggaaacguccugucauuggaguguaucgcugaaggucuccccaccccuauuaucuauugggccaaagaggacggcaugcugccaaagaauaggacaguguacaaaaacuuugaaaagaccuuacaaauaauucacgugagcgaggcggacagugggaacuaccagugcaucgcuaaaaaugcccugggagcuauccaucacacgauuucuguccggguuaaggccgcaccguauuggaucacugcuccccagaaccucgugcuuuccccuggcgaagaugguacacugauuugucgugccaaugggaacccaaagccccgcauaagcugguugaccaauggaguaccuaucgagauugcgccagacgaucccucgagaaaaaucgacggcgauacuaucauuuucucuaacgugcaggagagguccucagccgucuaccaaugcaaugcaaguaacgaauauggcuaccuacuggcuaaugccuuugugaacguucucgcugagccgccucggauacugacaccagccaauacccuuuaucaggugaucgcaaaccgacccgcccuguuggacugugcuuucuuugggagcccucuccccacgauugaaugguucaagggagcgaaagguuccgcacugcaugaggauaucuacgucuuacacgaaaauggcacccuggagauuccaguggcccagaaggacucuacagggacuuauaccugcguagcucgcaacaaacuaggaauggccaagaaugagguucaccucgaaaucaaggauccuacauggauagugaaacagcccgaguacgcagucgugcaaagaggcagcauggucucauucgaauguaaggugaaacaugaccacacucugagucuuaccguuuuguggcugaaggauaacagggagcucccauccgacgagcgguuuacaguggacaaagaucaucugguagucgccgacgugagcgaugacgauucugguaccuacacuugcguugcuaacacgacacuugacucagugagugccagcgcaguccuguccgugguagcgccgaccccuacucccgcuccaguguaugauguucccaauccuccauucgacuuggaacucaccgaucagcuggacaagucuguccaguuaucguggacacccggggaugacaacaauagcccuaucaccaaguuuauuaucgaguacgaagaugccaugcacaaaccgggccuguggcaccaucagacugagguguccggaacacaaacgaccgcacagcuaaagcucucaccauaugugaacuacaguuuccgcgucauggccguuaauucuauuggcaaaagccugcccuccgaagcaucagagcaguaucuuacuaaggccagcgagccugacaaaaacccaacagcaguggaaggguugggaucugagcccgacaaucuggugaucaccuggaagccucucaacgguuuugaauccaauggcccggggcugcaguacaagguaaguuggagacaaaaagauggagacgaugaguggacaagcgucgugguugcuaacgugucuaaguauauagucuccggcacucccaccuucgugccauacuuaauuaaaguucaggcccugaaugacauggguuuugcgccugaacccgccgugguaauggggcacucaggcgaggaucuuccaauggucgcuccuggaaacgugagggugaaugucguuaacaguacguuggcagaggugcauugggaccccguaccacucaagagcauccguggccaucugcagggguaccggauuuauuacuggaaaacccaaucguccucuaagcgaaauagaaggcacaucgaaaagaagauacuaacauuccagggaagcaagacucacgguaugcugccgggccucgagccuuuuucacacuauacccugaacgugcgcgucgugaacgggaaaggagaaggccccgccaguccagaucggguuuucaauacacccgagggugugccuuccgcuccaucuagccuuaagaucgucaaccccacuuuggacucccugaccuuagaaugggauccuccgucacauccaaaugggauucucacggaguacacacugaaauaucagcccaucaacagcacccacgagcuuggcccucugguggacuugaagauucccgccaauaaaacuagauggacacucaagaaccugaauuuuaguaccagguacaaguucuauuuuuacgcacagacuucugcgggauccggcagccaaaucaccgaagaggccguuacaacgguggaugaagcugggauacuaccaccugacgucggagccggcaaaguacaggcagugaacccccgcauuucgaaucugaccgcugccgcagccgagacuuacgcuaacaucucaugggaguaugaagguccagagcauguuaauuucuacguggaauauggggucgcgggaucuaaggaggaauggcgaaaagagaucgugaacggcagucgguccuucuuuggucucaagggccugaugccugggacagccuacaaaguacgugugggagcagucggcgauagcggguucguuucuagcgaggacguguuugaaaccggaccggcuauggccuccagacagguggacauugccacacagggcugguucaucggucuuaugugcgcugucgcauugcugauuuuaauacuccugaucguguguuuuauuaggcgcaauaaagggggaaaguaucccguuaaagagaaggaagaugcccacgcggacccagagauccaaccuaugaaagaagaugacggcacuuucggugaguacucagaugcugaggaccacaagccccuuaaaaagggcagucggaccccaagcgauagaacgguaaagaaagaagacucugaugacucccugguggauuauggggagggagucaacggccaguuuaaugaagacgggucauucauuggacaguacaguggcaagaaagagaaggaaccugccgaggguaacgagagcuccgaagcacccucuccggugaacgccaugaacucguuuguuuga

SEQ ID NO: 59906 - RNA, 3564 nt, Artificial Sequence
  derived and/or modified sequence opt3 from NRD1__Homo_sapiens__XP_011539823
augcugagaagggugaccgucgccgcuguuugcgcaacacggcgcaagcucugugaggccggccgagaacuugcggcucugugggggaucgagacucguggaagaugcgaagacagcgccgcagccaggcccuucccuauuuuggcuaugccaggucggaacaaagcaaaguccacguguucuugcccggauuuacagcccaauggccaagaccugggggagaacucacgcguggccagacuaggagcugaugaaagugaggaggaaggcaggcgggguagccucuccaaugccggggacccugagauaguaaaaucuccaucggaucccaagcaguaccgcuauaucaaacugcagaacggacuucaggcgcuguugauuucagaccucagcaauauggaaggcaagaccggcaacacaacugaugacgaggaggaagaggaaguggaggaagaggaggaagaugacgaugaggacaguggggcagaaaucgaggaugacgacgaagagggauuugaugacgaggaugaguucgacgaugaacacgacgaugaccuggauaccgaagacaaugagcuggaggaacucgaggaacgagccgaggcuagaaagaaaacaaccgaaaagcaacaguuacagucccuguuucuuuuguggucuaaacugacugauaggcuaugguucaagagcacauacuccaaaaugucaaguacccuccuggucgagacgcggaaccuuuauggugugguuggcgccgagagccguucugcaccugugcagcaucuggcuggguggcaagccgaggaacagcagggagaaacugacaccgucuuguccgcggccgcacucugugugggcguagguucauuugcugacccagaugaccugcccggguuagcccacuuccuggagcauaugguuuuuaugggaagccucaaguacccugaugaaaauggcuucgacgcuuuucuuaagaaacacggcgggagugauaacgccucuacagacugcgagcgcacuguguuccaguuugauguccaaagaaaguauuucaaagaggcacuggacaggugggcccaguuuuucauucauccauugaugauccgggaugcuauagaccgagaaguggaggcgguggauuccggaaaugcagaaacccuaaagcacgagccgcgcaaaaacaauaucgacacacacgccagacugagggaguucuggaugcgguacuauagcucgcauuacaugacccucgucguucagucuaaggaaacgcuggauacucuugagaaaugggugacagaaauuuuuagucaaauccccaacaauggucugccucgcccaaacuucggccacuugaccgaccccuuugacacuccugcuuucaacaagcucuacagaguagugccaauuaggaagauccaugcccugacaauaaccugggcauuacccccgcagcagcagcacuaucgugucaaaccucugcacuacauuucauggcuaguggggcaugagggaaagggcaguauccucagcuuucugcggaaaaaguguugggcccuugcuuuguucggugggaauggcgaaacgggauuugagcaaaacuccaccuauucuguuuucagcauuucaaucacacugacugaugaaggcuacgagcacuuuuaugagguggccuacaccgucuuccaguaucucaaaaugcugcagaagcuagggcccgaaaagcgaaucuuugaggaaauuagaaaaauagaggacaaugaguuccauuaccaggaacaaacagauccaguggaguacguagaaaacaugugcgagaauaugcagcuguauccuuugcaggacauccucacuggagaucagcuguuauuugaauacaagcccgagguuauuggugaggcacugaaccaacuugugccacagaaagcgaaucucguccugcuuaguggcgcuaacgaagggaagugugacuugaaagagaagugguucggaacccaguauuccaucgaagauauagagaauagcugggccgaacuguggaacucuaauuucgagcucaaccccgaccugcacuuaccugcagagaauaaguacauugccacagauuuuacccugaaagcauucgacugcccagaaacugaguauccggugaagaucgucaacacgccccagggcugucuuugguacaaaaaggauaauaaauuuaagaucccuaaggccuauauuagguuccauuugaucucaccacucauucaaaaauccgcagcuaacgugguucuguuugacauauucgugaacauccuaacacacaaucuggccgaacccgcguacgaggccgauguagcucagcucgaauacaagcuggucgcuggugagcacgggcuuauuauccgcgugaaaggcuuuaaccauaaguugccucuguuauuccagcucaucauugacuaucuggccgaguuuaauagcaccccagcuguuuucacuaugauaaccgaacaacuuaaaaagacauacuuuaacauccugauuaaacccgagaccuuggccaaggacgugcggcuccugauccuagaauaugcaagaugguccaugauugauaaguaccaggcgcugauggacggacucucucuggagucgcuuuugagcuucgucaaagaguuuaagucccagcuguucguggaaggcuuaguacaggggaaugugacuucaacagagaguauggauuuccucaaauauguugucgacaagcugaacuuuaaaccgcuugaacaagagaugccugugcaguuccagguggucgaacugccaucuggacaccaucuaugcaagguuaaggcccucaauaaaggugaugcuaacagcgaggugacgguguacuaucaguccggcaccaggucacugcgcgaguacacuuugauggaacuguuaguaaugcacauggaggaacccugcuuugacuuccuccgaacaaagcaaacccugggguaccacgucuauccuacaugucggaauacuagcggaauccuuggcuuuucugugaccguugguacgcaggccaccaaauacaacuccgagguggucgauaagaaaauagaagaguuccugaguagcuuugaggaaaagaucgagaauuugacagaagaggcauucaacacucaggugaccgcucucauuaagcugaaagaaugcgaggacacacaucuaggggaggaaguugaucguaauuggaacgaggugguaacucagcaauaucuguuugacagacuugcccacgaaaucgaggcacucaagucuuucuccaaaucagaucuggucaauugguuuaaggcccauaggggccccggaaguaaaauguugagcgugcacguggucggcuacgggaaguaugagcuggaagaggacggaaccccaucguccgaagacucuaacagcucaugugagguuaugcaguuaacguaccucccuacaaguccccugcuugcugauugcauuaucccaauaaccgacauucgcgcguucacuacaacccugaacuugcucccguaucauaagaucgugaaauga

SEQ ID NO: 59907 - RNA, 3495 nt, Artificial Sequence
  derived and/or modified sequence opt3 from NRDE2__Homo_sapiens__NP_060440
auggcccuguuccccgcuuuugcaggccucagcgaggccccugacgggggauccucuagaaaggaacuugauuggcugucaaacccaaguuucugcguggguagcaucaccuccuugucucagcaaacagaggcggcuccggcccacgucucggaaggcuuaccccugacuaggucacaucuaaaaagcgagaguuccgacgaaucugauacgaauaagaaacucaagcagaccagccggaaaaagaagaaagagaagaaaaagaaacgcaagcaccagcaucacaagaaaacaaagcgaaaacaugggccuuccucaaguagccguucugagacugacaccgauuccgaaaaggacaaaccaucaagaggaguuggcgguagcaagaaagagagugaggaacccaaccaggggaauaacgcagccgcugauacaggacacagguuuguguggcuggaggacauucaagcaguaaccggcgaaacuuuccggacagauaagaagccugacccagccaauugggaguacaaaucucuuuaucgcggcgauauagcuagauacaagaggaaaggggacuccugucugggaaucaaccccaagaaacagugcauuagcugggaagguaccucgacggagaagaagcacucucggaaacagguggaacgcuauuuuacuaagaaauccgucggcuugaugaauaucgaugggguggccauuucaaguaagaccgagccuccaagcuccgagccgaucucuuucauacccguuaaagaccucgaagacgcggcaccugugacaacuuggcugaacccacugggaaucuacgaucagagcaccacacauuggcuccaaggccagggucccccugagcaggaaucaaagcagccagacgcccaacccgauagugaguccgcugccuuaaaggcaaaagucgaagaguuuaaucgaagagugagggagaacccgcgggacacccagcuguggauggcuuucguagccuuucaggaugaaguuaugaaaagcccugggcuuuaugcgauugaggaaggagagcaagaaaagcguaagcgcucuuugaaacugauccuagagaagaagcucgccauucuggagagagcaaucgaaucaaaucagaguagcguggaccuuaaacuggcuaaguugaaacucuguacggaguucugggaacccuccacucuggucaaggaguggcagaaauuaauauuucugcacccaaacaauacagcccucuggcagaaguaccuucuguucugccaaucucaguuuucgaccuucagcauuuccaaaauccauucauuguauggcaagugucuaaguacucugucugcugugaaggauggcagcauucucucccacccugcccugcccgggacagaggaagcaauguucgcccuuuuucugcagcagugccacuucuugaggcaagcuggacauucagagaaagcgaucagccucuuucaggcaaugguggacuucaccuuuuucaagccagauucugucaaagaccugcccacgaagggucagguugaauuuuucgagccuuuuugggauuccggcgaaccacgggccggggagaaaggagcucgaggcuggaaggccuggaugcaccagcaagagcgcggugggugggugguaaucaacccggacgaagacgaugacgagcccgaagaggaugaccaggaaauuaaggauaaaaccuuaccuagauggcagauauggcuggcagccgagaggagucgggaccagcgccauuggagaccauggaggcccgauaagaccaaaaagcaaacugaggaagacugugaggauccugaacgucaggugcuauucgacgauaucggccagagccucauucggcugucuucccacgaccuucaauuucaguuggucgaggcuuuccugcaguuucucggagugccaucaggcuucacacccccggccaguugccuguaccuugcaauggaugaaaauagcaucuucgacaacgggcuguacgacgagaaaccuuugacauuuuucaacccacucuuuucgggagcguccuguguuggucgaauggauagacugggcuaucccagguggacucgcgggcagaaucgggagggagaagaguucauaagaaacguguuucauuuagucaugccucuguucucuggcaaggaaaagagccaacuaugcuuuucauggcuccaguacgagauugcuaaagugaucuggugucugcacaccaagaauaaaaagaggcuuaaaagucaggguaagaacugcaagaaauuggccaagaaucugcucaaagagcccgaaaacugcaauaacuucugucuguggaagcaguaugcacacuuagaguggcugcuugggaauacagaagacgcccgcaaaguauuugauaccgcuuugggcauggccggaucccgagagcucaaggacucugaucugugcgaacuaagccugcucuacgcagagcuggagguugaacuuuccccagaggugcggcgugcugccacugcgagagccguccauaucuugacgaaacugacagaaucaagcccuuauggccccuacaccgggcaaguguuagcuguccacauucucaaggcaaggaaggccuaugagcaugcucugcaggacugucuuggagauaguugcgugucuaacccagccccgacugacuccuguagccgccugaucucguuggcaaaaugcuucaugcucuuucaguaccugaccauugguauagaugcggccguucagaucuacgaacaaguguucgcuaagcuaaauucaucuguauuuccugagggcaguggggagggagacuccgccagcucucagagcuggacauccguccuggaagcaauuacccucaugcacacuucacugcuucgguuccacaugaaagugaguguuuaucccuuggcuccacugagagaggccuuaagccaggcacucaagcuguaccccggcaaccaagugcuuuggaggucuuauguccagauccagaauaaaucccauucagccaguaagacacgacgcuucuuugauacgaucacccggagcgcuaagccucuggaaccauggcuauucgcgauugaggccgaaaaacucagaaagaggcugguggagacuguacagcguuuggacggucgcgagauacacgcaacaauccccgaaaccgggcugaugcaucggauucaggcuuuauuugagaacgccaugagauccgauucuggcucgcaauguccucuccuguggaggauguaccuuaauuuccuggugagcuugggaaacaaagaacgaucaaagggcgucuuuuauaaagcccuccagaacugcccgugggcuaagguucuguaccuagacgcaguggaguauuucccagacgagaugcaggaaauccuggaucuuaugacagagaaggaacuccgggugcgccugcccuuggaggaacuggaguuacuccuggaggacuga

SEQ ID NO: 59908 - RNA, 339 nt, Artificial Sequence
  derived and/or modified sequence opt3 from NREP__Homo_sapiens__NP_001135947
augaagggcguguggaacuacagcgcccuguccagaagggaggacgaaacccggacccagcgcucucgaaugacugaucguguccccugcucaaaauguuuccaaguucauugccagaucagugugcucaauuguguauauuacccugagcuuuuugugugggucagccaggaaccauucccgaacaaggacauggaggggagacugcccaaaggaagguugccugugccaaaggaaguuaaucggaaaaagaacgaugagacgaaugcugcauccuuaacaccccuggguucuucggagcuacgcucaccuagaauuagcuaucuccacuuuuucuga

SEQ ID NO: 59909 - RNA, 1569 nt, Artificial Sequence
  derived and/or modified sequence opt3 from NRF1__Homo_sapiens__NP_001280092
auggaggaacacggcgugacccagacagagcauauggccacuaucgaagcucacgcagucgcccaacagguucagcagguacauguagcgacguacaccgagcacagcaugcuguccgcugacgaagauucucccucaaguccugaggacacaagcuaugaugacuccgauauucucaacucuacugccgcagacgaggugaccgcccaucuugcugcagccgggccagucggaauggcugccgcggcagccguggcuacagguaagaaaagaaagaggccgcacguuuucgaaucgaaucccucaauacggaaacgccaacagacccgacuguugcguaaguuaagagccacucuggaugaguacacaaccagggugggccagcaggcaaucguccuaugcauuagcccuaguaaaccaaaccccguguuuaagguauucggggcugccccucucgaaaauguugugcggaaguauaaauccaugauccuggaggaccuugagucugcgcuggccgaacacgcaccagcuccccaagaggucaacagcgaauugccuccacucacgauugauggaaucccgguguccguggacaagaugacucaggcccagcugcgcgcuuuuauacccgagaugcugaaauacucaaccggcagagguaagccuggguggggaaaagaaaguuguaagccaaucugguggcccgaggauauuccuugggccaaugucaggagcgacguucggacagaggaacagaagcaacgcgugucuuggacucaggcacuccgaaccaucgugaaaaacugcuauaagcagcauggcagagaggauuuacuguacgccuucgaagaccaacagacacagacccaggcuacggcgacucacuccauugcacaucuugugccaucacaaacagucgugcagaccuuuagcaaucccgacggcacuguuaguuugauccagguggggacaggagccaccgucgcuacgcuggccgaugcaucugagcuaccgaccacagugacuguagcccagguuaacuauuccgcuguggccgacggugaagucgagcaaaauugggcaacccuccagggcggggagaugacaauacagacuacccaggcgagcgaagcuacacaagccguggcaucgcuggccgaggcugccgucgcagcuucucaggaaaugcagcagggagccaccgugacuauggcgcuuaacuccgaggccgcugcacacgccguugcuacgcuggccgaagcaacauugcaaggcggugggcagauugugcucucaggagagaccgcggccgcuguaggcgcccugacuggcguccaggaugcaaauggguuauucauggcugacagggccggacggaaauggauccugaccgauaaggcaacaggucucgugcaaauuccuguuaguauguaccagaccguggucacuagccuugcccagggcaacgggcccgugcagguagcuauggcgccagugacaacgcguaucuccgacucugccguuaccauggauggacaagcagucgagguggugacucuggaacaguga

SEQ ID NO: 59910 - RNA, 1824 nt, Artificial Sequence
  derived and/or modified sequence opt3 from NRG1__Homo_sapiens__NP_001153467
augggcaaggggagagccggaaggguggguaccacagcucugcccccucggcucaaagagaugaagagucaggaauccgcagccggcucuaaacuuguccugcgcugcgagacuucaagugaauacagcuccuugcgauucaagugguuuaaaaacgggaaugaguuaaaccguaagaauaagccacaaaacaucaaaauucagaagaaaccgggaaagucugaacugagaauaaauaaagcgucgcuagcugacucaggcgaguauauguguaagguuaucagcaagcucgguaacgauagugccuccgcaaauauuacgaucguggagucuaacgaaauuaucaccgggaugcccgccagcacagagggagcuuacguauccucagcaacuagcaccagcacaaccggcacuucucaccuggugaaaugcgccgaaaaggagaaaacauucugugucaauggcggggagugcuuuauggugaaggaccuuuccaacccuucaagguaucuguguaaaugcccaaaugaauuuaccggagaucggugucagaacuacguuauggcuagcuucuauaagcauuuggguauagaguucauggaagccgaggaacucuaccagaaacgcgugcugacgaucacuggcauuugcaucgcgcugcucgucguggggauuauguguguaguugcauauugcaagaccaagaaacaaagaaagaaauuacacgacaggcugcggcagagucuucgcucugagcgaaauaacaugaugaauaucgccaacggaccccaucacccuaacccacccccugagaaugugcaguuggucaaccaguacguguccaagaaugugauaagcucggaacauauugucgagagagaagcugagacaucuuuuuccacuucacacuacaccaguacagcccaccauagcaccacgguuacucaaacaccaucccacucuuggagcaacggccauaccgaaucaauccugagugagucccacagcgugauuguaaugucuucaguggagaauaguaggcacagcuccccgacuggugggccccggggacgucuaaacggcacaggcgggccucgcgaauguaauucuuuccucagacaugcaagggagaccccagauucguaucgggacagcccccacuccgaacgauacgucucagcuaugacgaccccugcccgcaugaguccaguggauuuucauacacccucuagcccgaaauccccucccucagagaugagcccaccuguuucuuccaugacugugaguaugcccagcauggcggucucuccauucauggaagaggagagaccccugcuucuggugaccccuccaagguugcgggaaaagaaguuugaccaccauccgcagcaguucuccucauuucaccacaaccccgcccaugauaguaauagccucccugcaucgccacugcgcaucguagaggacgaagaguaugagacaacucaggaauacgagcccgcucaagaaccuguuaaaaaguuagccaacuccagaagggcuaaacguaccaagccaaauggacacaucgccaaccggcuggagguggauucuaauacaagcucacagaguuccaacucugaaagcgagaccgaggacgaacgagucggugaggauacucccuuccucggcauucagaauccgcuugcagccucccuggaagcuacgccugcguucagauuggcagacucaaggacaaacccagccgggcgcuuuagcacccaagaggaaauacaggcucggcuaaguucugugaucgccaaccaggaccccauugcagucuga

SEQ ID NO: 59911 - RNA, 2355 nt, Artificial Sequence
  derived and/or modified sequence opt3 from NRG2__Homo_sapiens__NP_001171864
augagacaggugugcuguagcgcccugcccccuccaccgcucgagaaggggaggugcuccucuuacucagacaguagcuccucuucgucagaacggagcaguuccucuagcuccucaaguagcgagucuggguccucaagccgcaguucuuccaacaauagcucgaucucucgacccgcugcaccuccagaaccccguccucaacagcagccacagcccagauccccugccgcgaggcgggcugccgcacgcucaagagccgcugcagccggagguaugaggcgggauccagcuccgggcuucaguaugcuucuguuuggggucagcuuggccuguuauucccccucuuuaaaaagcguucaagaccaggcguacaaggcaccugugguaguggagggaaaaguccagggccuggugccagccggugggucaaguuccaacagcacccgcgaacccccugcuucuggacgaguugcccuagugaagguccucgauaaauggccacugagaucaggcggccuucagagggagcaagugauuaguguagggagcugcguuccccuggagcggaaucagcguuauauauucuuuuuggaaccgacagagcagccucucguguucaagacugcauuugcuccccuggacacgaacggaaagaaucugaaaaaggaagucgguaaaauccucuguaccgauugcgccacacgcccaaaguuaaagaagaugaagucccagacuggccaagugggggagaaacagucucugaagugugaggcggccgcaggaaacccucagcccucguacagaugguucaaagacggcaaggaacuuaauaggagccgggauauucgaaucaaauaugguaacgggcgcaaaaauuccagauugcaauuuaacaaagugaaggucgaggacgcuggagaauacguuugcgaggccgaaaauauucugggcaaggauaccgugaggggccggcuauauguaaacucagaggcugaggaacucuaccagaaacgcgugcugacaaucaccgggauaugugucgcccuucuggugguuggaaucgugugcgucguggcauacuguaagacuaaaaagcagagaaaacagaugcacaaucauuugaggcaaaacaugugcccagcccaccagaaucguagucucgcuaacggucccucucauccucggcuggacccagaggaaauucagauggcggauuauaucagcaagaacguaccggcaacagaccacguuauucgaagagagaccgaaacgacuuucuccggcucacauagcugcucucccucccaccacuguaguaccgccacaccuacuagcucucauaggcacgagucccauaccuggucauuagagcgcagugaaagccugacaucggauucccagucugggaucaugcucagcucagugggaaccaguaagugcaauuccccagcuugugucgaggcccgggcaagaagggccgcugccuacaaccuugaggaacgccgacgggcaacggcgcccccuuaucacgacucuguggacagccugcgugauuccccacacucagaaagauacgucagcgcuuugacuacacccgccaggcuaaguccgguggacuuucauuauucucuggcaacccaaguuccuacuuucgagauaacauccccaaauagcgcccacgcugugucguugcccccugccgcacccauuucauaccgccuggcugagcagcagccacuucugcggcauccugcgcccccaggcccggguccugggcccggcccaggacccggcccuggggccgauaugcagagaucuuaugacaguuacuacuauccagccgcuggacccgguccuaggcgagggaccugcgcacucggcggaucccucggcagccugccggccucuccauuucgcauccccgaagaugacgaguacgaaacgacccaagagugugcuccuccacccccuccgcggcccagagccaggggugcaagccgucgcacauccgcggggccacggagauggaggcgaucacgguuaaacggccuggccgcucagcgcgccagagcagcuagggauagucuaagccucucuuccggaucaggcgggggaagugccagcgcauccgacgaugacgccgaugacgcugacggugcgcuggccgcagagucuacuccuuuccuuggcuugcggggcgcucacgaugcccugcgaucggacucacccccacucugcccugccgcugauagcagaaccuauuacucccuggacagucauucuacacgcgcaagcuccaggcacucacguggacccccaccgcgggccaaacaggauucugcgccucuuuga

SEQ ID NO: 59912 - RNA, 2091 nt, Artificial Sequence
  derived and/or modified sequence opt3 from NRG3__Homo_sapiens__NP_001010848
augagcgagggcgccgcugcagccucacccccuggggcggcuucugccgcagccgcuucagcagaagagggaaccgccgcugccgcggcagccgcugccgcugguggcgggccagacggaggcggugaaggggcagccgagccgcccagagaacugaggugcagugauuguaucguguggaaccggcagcaaacauggcucugcgucguuccucuuuucauuggauuuauaggccugggcuugagcuuaaugcugcuaaaguggaucgugguaggguccgugaaagaguacgucccaacugaccucguggauucuaagggaaugggucaggaccccuucuuucugucgaaaccuuccagcuucccaaaggcgauggagacgaccacaacuaccacaaguaccacuucccccgccacaccuucugcaggcggggcugccagcucccgcaccccaaaucgaauuucaacgcgucuuacuaccaucacaagagcuccgacuagguuucccggacaccggguuccuauucgcgccaguccaagaagcaccacagcaaggaacaccgccgcucccgcgacggugccuucuacuacagcaccauucuuuuccucaagcacccugggcagucggcccccggucccugguacucccucuacacaggccaugccauccuggccuaccgcugccuaugcaacgagcucguacuugcaugauucuacccccuccuggacacucucaccauuccaggacgccgcuaguagcuccucuagcucaaguuccagcgccacuaccacaacucccgaaaccucuacaucaccuaaauuucacaccacuacguauaguacagagcgcagcgaacauuucaagccaugucgagauaaggaccuggcauacugccugaaugauggggaguguuuugugaucgagacccucacuggaucccacaaacauugcagauguaaggaaggcuaucaaggcguaaggugcgaccaguucuuaccgaaaaccgauucuauacugucggaccccacagaucaccuugggaucgaguuuauggaaagcgaggaaguuuaccagcgucagguguuguccauuucauguaucauuuucggaaucgucauaguggguauguucugcgcggcuuuuuauuucaagaguaaaaagcaagccaagcagauucaggagcagcugaaagugccucaaaacggcaagucuuacagccuaaaagcauccucaaccauggccaagagcgagaaucucgucaaaucucacguucagcugcagaacuacuccaagguggaacggcauccaguaacugcucuugagaaaaugauggaaaguagcuuuguggggccccaaucuuucccugaggucccaucccccgaccgcggaucacagagugugaagcaccauagaagccugucguccuguugcucuccgggccagaggagcgguauguugcaccggaaugccuuucgacgcacaccuccaucacccagaaguaggcucgggggcaucguuggaccugcauaucagcaacuggaagagucccggauucccgaccaggauacgaucccaugccagggcuacucuagcuccggguuaaagacccagcgcaacacuucaaucaauaugcaacugccuagcagagagacaaaccccuauuucaauagucucgaacagaaagaccuugugggauacucuuccaccagggcuagcucggucccaauuauaccgucagugggucuggaggaaacauguuugcagaugccuggcaucucugagguaaagaguauuaaauggugcaagaacuccuauagcgccgauguugugaaugucucuauccccgugagcgacugucuaauagcggaacagcaagaggucaaaauucugcucgagacugugcaggaacagauccguauccugaccgaugcccggcgauccgaggacuacgaacuugcuucaguugagacggaggauagugcaagcgaaaacaccgccuuucugccauugucucccacagcuaaguccgagagagaagcccaguucgugcucaggaaugagauucaacgcgacucagcacugacuaaguga

SEQ ID NO: 59913 - RNA, 348 nt, Artificial Sequence
  derived and/or modified sequence opt3 from NRG4__Homo_sapiens__NP_612640
augcccaccgaccacgaggaaccuugcggcccaagccauaaguccuucugucugaacgggggacucugcuacgugaucccgacaauucccucuccuuuuuguagaugcgucgagaauuauacuggugccaggugugaagagguuuuccuuccaggcucaaguauacagacgaaaagcaaccuguuugaggcuuucguggcauuggccguauuagugacccugaucauuggggcguuuuacuuccuaugccggaagggacacuuucaacgcgcuuccucuguccaguaugauaucaaucucguggaaacaucgucaacuagcgcccaucacagucaugagcagcacuga

SEQ ID NO: 59914 - RNA, 237 nt, Artificial Sequence
  derived and/or modified sequence opt3 from NRGN__Homo_sapiens__NP_001119653
auggacugcuguaccgagaacgccugcagcaagcccgaugacgauauccuggacauuccucucgaugacccaggcgcuaaugcagccgcggcuaaaauacaggccuccuucagagggcacauggcaaggaagaaaaucaagucuggagaacggggucgcaaaggcccggggcccggaggcccugguggggccggaguggcucgaggcggcgcagggggagguccaucaggcgauuga

SEQ ID NO: 59915 - RNA, 3477 nt, Artificial Sequence
  derived and/or modified sequence opt3 from NRIP1__Homo_sapiens__XP_005261122
augacccacggcgaggaacuggggagcgacgugcaucaggauuccaucguccucacauaccuugagggacuguugaugcaccaagccgcugguggcucugggacugcaguugacaagaaaucagccggacauaacgaagaggaucagaauuucaacauuaguggcagcgcguuucccacgugccaguccaaugguccuguguuaaacacccacacauaucaggggucuggaaugcugcaucuaaagaaagcuagacuccugcaaucgucagaagacuggaaugccgcaaagaggaaacggcuuagcgauaguauaaugaaccugaauguaaagaaggaggccuugcucgcuggcaugguggacuccgucccaaaaggcaagcaggauucuacucugcuggcaagccucuuacaguccuucucaagucgccugcagaccguggcccuuagccaacagauccgacagucuuugaaagagcagggguacgcucugucccacgacucacuaaagguugaaaaagaucuccguuguuauggaguggccagcagucaccugaagacacuucugaagaaaucuaaggucaaagaccaaaagccggauaccaacuugcccgacgugacuaaaaaucucauuagagauagguuugcggaguccccucaucacguaggucagagcggcacaaagguuaugucggaaccacugucuugcgcagcccgguuacaggcuguggccuccauggucgagaaacgcgcaucacccgcuaccaguccuaagccaagcguggccuguucccaacuggcgcuccuucugucuagcgaggcccauuugcagcaguacucaagagaacacgcacuaaagacgcagaacgcuaaucaagccgcuagugagaggcuggccgcaauggcccggcuccaggaaaacgggcagaaagacgugggauccuaucagcugcccaagggcaugagcucucaccuuaauggucaagcucgcacuucaaguagcaaacugauggcguccaagucuucggcaaccgucuuccagaacccuauggggaucauuccaagcuccccgaaaaaugccggauacaagaacucauuggagcgaaacaauaucaagcaggcugccaacaauagucuccuguuacaucugcuaaaaucucagacaauacccaagccuaugaacggccacagccauuccgaaagaggcucaaucuuugaggagagcucuacuccaaccacaauugacgaauauuccgauaauaaccccaguuucaccgacgauagcucuggggacgaguccucauacaguaauugcguuccuaucgaucucagcuguaaacacaggacggaaaagucggaguccgaccaaccagugucucuggauaacuuuacucagagccuuuugaauacaugggaccccaaaguaccggauguggacauuaaggaagaucaggacaccucaaagaacaguaaacucaauucccaucagaaggucacucugcugcaacuucuguugggacacaaaaacgaggagaauguggaaaagaacacaucuccucaggguguucacaaugacgugagcaaauucaacacccagaacuacgcacggacguccgucaucgagucacccagcaccaaucguacaacuccagugaguaccccuccccuccugacaucuuccaaggccggcagcccaauaaacuuaucgcaacauucacugguaauuaaguggaacucucccccuuauguuugcaguacucaguccgaaaaacuaaccaauacagcuagcaaucacucuauggaucucaccaagagcaaagacccaccgggggagaagcccgcccagaacgaaggagcacaaaauuccgcgacuuuuucagcuaguaaacugcuucagaacuuggcccaguguggcaugcagagcucuauguccguggaggagcagcgcccuucaaagcaacugcucacggguaauacagauaaaccaaucgggaugauugacagacugaacagucccuuacugagcaauaagaccaacgcagucgaagagaauaaggccuucuccucucagccuacuggcccagaacccggacuuucgggcagcgagaucgagaacuugcucgaaaggcggaccgugcugcagcuacugcucgggaauccgaacaaaggaaagucagagaaaaaggagaaaacaccucugcgagaugaauccacccaggaacauagugagcgcgcucuuucugagcaaaucuugauggucaagauuaagagcgaaccaugcgacgaucugcagauacccaacacuaaugugcacuuaucccacgacgccaaaucagcaccuuuucucgguauggcucccgccguucagagaucugcgccagcccugccugugagcgaggauuucaagagugaacccguauccccacaagacuuuagcuucucuaaaaacggccuucugucaagguugcuccggcagaaucaggauuccuaccuggcugacgauagugaccgcagccauagaaacaaugagauggcacuacuggaaucgaagaaccucuguauggucccgaaaaagaggaagcuguauacagagccucuugagaaucccuucaaaaagaugaaaaacaauaucguggacgccgcuaacaaucacucugccccagaaguuuuguacgggucccuguuaaaccaggaggaacucaaguuuagccguaaugaucuggaguucaaauaucccgcaggacauggcucagcgagugaaucugagcaccgguccugggcccgagagagcaagucauuuaacgugcuuaagcaacugcuacucagugaaaauugcgucagagaccugagcccucauagguccaacucuguggcugauagcaaaaagaaaggucacaagaacaauguaacgaacuccaaaccagaguucucaauuucuaguuugaaugggcugauguacucgagcacccagcccuccucuuguauggacaaccgcacuuuuucauauccuggcgugguuaagacaccggucagcccaaccuuccccgaacacuuaggaugcgccggcucccggccugagagugggcuccugaauggaugcucuaugccaagcgagaaaggucccaucaagugggugauaacagaugcagaaaagaacgaguacgaaaaagacucaccuagacuuacuaagaccaauccgauucuguacuauauguugcagaaaggcgggaacuccgugacgaguagggagacccaggauaaggacaucuggcgcgaagcuagcucugccgaguccgucucacaaguuacagcaaaagaggaacuccugcccacugccgagaccaaggcuagcuuuuucaaucuacgaucgccauacaacucucauaugggaaauaacgcgagucggccucacuccgccaauggcgaaguguauggucugcuugggagcgugcucacaaucaagaaagagucagaauga

SEQ ID NO: 59916 - RNA, 846 nt, Artificial Sequence
  derived and/or modified sequence opt3 from NRIP2__Homo_sapiens__NP_113662
augcuguucaucuuuccccucagccuuccuuggagaccauccugcuggaaggagucuuguucaaccggccagaggcaagccgggcggagucgcgaagacagcgugacaccgcccccuuccucuccauggcccacuccuccagcuggagcaaugucgacgaaacaggaggcccgacgugaugaaggugaggcgagaaccaggggccaggaagcucagcugcgggaccgcgcccacuugucacaacagagaagguuaaagcaggcaacacaguuccugcauaaagauagcgccgaccuacucccccuggauagucuuaagcggcuggggacuuccaaagacuugcaaccucgcucugucauucagcgaagacucguugagggaaacccaaauuggcugcagggcgagccgcccaggaugcaggaucugauacacggucaagaaagccggcguaagaccucccgcacagagaucccugcucucuuagugaacugcaagugucaggaccagcugcuuagaguagcaguggauaccgggacucaauacaauaggauuucagccggaugcuugagucggcugggccuagaaaaacgaguccucaaggcuagcgccggcgaccuggcgccagggcccccuacacagguggagcagcuugagcugcaguugggacaagaaaccguuguguguucugcacaggucguggaugccgaguccccagaauuuugccucggucugcagacguuacugucacucaaauguugcaucgaccuugagcauggcguacugcgcuugaaggcucccuucagcgaacuaccguuucugccucucuaucaggagcccgggcaauga

SEQ ID NO: 59917 - RNA, 4749 nt, Artificial Sequence
  derived and/or modified sequence opt3 from NRK__Homo_sapiens__NP_940867
auggccggccccgggggauggagagacagggaggugaccgaucugggucaccucccugacccaacaggcauauucagccuugauaagacuauugggcugggaacguacggccggauauauuuggguuuacaugaaaagaccggggcuuuuacagcagucaagguuaugaacgcccgcaaaacuccgcugcccgagaucggacgacgugugagaguaaauaaguaccagaaauccgugggcuggagguauucugacgaagaggaagaucuacggaccgagcucaaccugcuucgcaaguacucauuccacaagaauauugucaguuuuuauggcgcguucuuuaaacugagcccuccagggcaaagacaucaguuguggauggugauggagcucugcgcugccggauccguuacagacguggucaggaugaccucuaaccagucgcugaaggaagauuggaucgcauacauuugucgggagauccugcagggucucgcccacuuacaugcucaccgcgugauacaccgagacaucaaaggccaaaauguacugcuuacucauaacgcagaaguuaaguugguggauuucggggucucagcccaggugagcagaacaaauggaaggcggaacaguuuuauuggcacccccuauuggauggcuccugaggugaucgacugcgaugaggacccacgucgcuccuacgauuacagaucugacgucuggagcguugguauuacggccaucgaaauggcggagggggcacccccucuguguaaucuacagccacucgaagcccuguucgugauacuuagggaguccgcuccgacuguaaaaucaaguggauggagccggaaguuucacaacuucauggaaaagugcaccauuaaaaauuuucuguuccgacccacaucugccaacauguugcagcauccuuuugugcgcgacaucaagaaugagagacacgucguggagucccucacuaggcaccugaccggcauuaucaaaaagcggcaaaagaagggcaucccauuaauuuucgaacgcgaggaagcaauaaaagagcaguauacaguuagaagguuccgugggcccucauguacccaugaacugcuccggcuuccuacgagcagucgaugcagaccacugaggguguugcacggagagcccucucagccgcgcuggcuaccugaucgggaggaaccccagguccaagcucugcagcagcuccaaggugccgcgagaguguuuaugccacugcaggcccuugacuccgcaccuaagccccugaagggccaggcucaggccccacaaagguugcagggggcugcccgcguauucaugccccuccaggcacagguuaaagccaaggcuagcaaaccucugcaaaugcagaucaaggcgccaccgcgauuacggcgugcagccagagugcugaugccccuacaggcucaggucagggccccucgccuccugcaagugcagucgcaggucucuaaaaagcagcaagcacagacucagacauccgagccacaagaucuugaccaggugcccgaagaguuucagggacaggaucaaguuccugaacagcagcggcagggccaagccccagagcagcagcagagacauaaccaagugcccgagcaggaauuggagcagaaucaagcuccggaacagccugagguacaggagcaggccgcagaaccagcgcaagcugagaccgaagccgaggaacccgagucacugagggucaacgcacagguguuccucccucugcuuagucaggaccaccauguucuguugccccuccaccuggauacucagguguuaauuccagucgagggucaaacagaagggagcccucaggcccaggcuuggacccuggagcccccacaggccaucggcuccgugcaagcacuaauagaaggacucucucgagaccugcuucgcgcuccgaacagcaauaacucaaagccuuugggcccccugcagacgcucauggagaaucugaguuccaaccgguuuuacagccagccagaacaggccagagagaaaaagucuaaaguaucaaccuuaaggcaagcgcuggccaagcgucuuagucccaaacgcuuccgggcuaagagcuccuggagaccugagaaguuggaacucucugaucuggaggcaaggcgacagcggcgccagagaaggugggaagacauuuuuaaucaacacgaggaggaacuacgacagguggauaaagacaaggaggacgaaucgagcgauaacgacgagguuuuccauuccauccaggccgaaguccagaucgagccacugaaacccuauauuucaaauccuaagaaaaucgaggugcaagaacggaguccgucugugccaaacaaucaggaucacgcucaucacgucaaguuuagcuccucaguuccccagagaagccuccuggagcaggcccaaaagccuauugacauacgccagaggucuucccagaaccgucagaauuggcuugcagcgagugaaucuagcuccgaggaagagucaccagugacagggcggagaagucaaagcucgcccccuuacuccacuaucgaucagaaauugcugguggacauucacguaccggauggauucaaggucgguaaaaucucucccccaguguauuuaaccaacgaguggguuggcuacaaugcccucagcgaaaucuuuaggaacgacuggcugacuccugcucccgugauucagccaccugaggaagauggggacuaugucgagcuuuacgaugccucagcagacacugauggagacgacgaugacgaaaguaaugauaccuucgaggacacauacgaucaugcuaacggcaacgacgaucuggacaaucaaguggaucaggccaacgacguuuguaaggaucacgacgaugacaauaacaaauuuguggacgauguaaauaacaauuauuacgaggcacccuccugcccacgcgccucuuauggucgagacgggagcuguaagcaggauggcuacgacggauccagaggcaaagaagaggcuuaucggggguacggaucacauaccgcgaacaggagccacgguggcagugccgcaucugaagauaaugcugccauaggggaccaggaggaacaugccgcuaacaucggauccgagcgccguggcagcgagggugaugggggcaagggagucgugagaacuucggaagagucaggcgcauuggggcucaauggagaagagaacugcucugagacggacggcccgggucugaagcggccugccagucaagauuucgaauaucuacaggaggaacccgggggaggcaaugaggcguccaacgcuauugacagcggugccgcaccaucugcccccgaucacgaaagcgacaauaaagacaucuccgagucaaguacacagagcgauuucucugcuaaccacuccucaccuaguaagggcagcgggauguccgcagacgccaacuuugcgucugcuauucuguacgccggauucguggaggucccagaagagucgcccaaacagccuagcgaaguuaaugugaacccgcucuacguaucaccagcauguaagaaaccccugauccauauguaugagaaggaauuuaccuccgagauaugcugcggcagucuuuggggagugaauuugcuguuagggacuaggucuaaccucuaccugauggaucgcagcggcaaggccgacaucaccaaacuuauucgaagacggccuuucaggcaaauccagguccuggagccccuaaaucuccugauuacaaucuccggucacaagaaccgcuugagaguguaucaucugaccugguuaaggaauaaaauacucaacaaugauccagaaucaaagcggcgucaggaggaaaugcugaaaacugaggaggcuuguaaggccauugacaaacuuacagggugcgaacacuuuucuguucugcagcaugaggaaacgaccuacaucgcaauugcuuugaaaagcaguauccaccucuaugccugggcgccuaaguccuucgaugagagcacugccauaaaaguguguaucgaccaaucugcagauucagaaggagacuacauguccuaucaggcuuacauucgcauccuggccaagauucaggcugcagaucccgucaaccgauuuaaaagaccagacgagcuacugcaccuucucaagcugaagguguucccuacauuggaucauaaaccgguuaccguggaccuggccaucggcagugagaagagguuaaaaauauuuuucagcucggccgacgguuaccaccucauugaugcugaaucugaggucauguccgacguaacacugcccaagaauccacuugaaaucaucauuccucagaacaucauuauacugcccgauugcuugggcaucgggaugaugcucacuuuuaaugcggaggcacugagcguggaagccaacgagcaacuauucaaaaagauucuggagauguggaaagacaucccaucaaguauugcuuuugaauguacccagcggacgaccggauggggccagaaggccaucgagguucgcucucuucaauccagagugcucgaaagcgagcugaagaggcggucaaucaaaaaguugcgauucuuaugcacaagaggggauaaacuguucuuuacaaguacccuccgcaaucaucacagcagggucuauuucaugacacugggaaaacuugaggaacugcaguccaacuacgacguguga

SEQ ID NO: 59918 - RNA, 813 nt, Artificial Sequence
  derived and/or modified sequence opt3 from NRL__Homo_sapiens__XP_011535103
augggcaaccuggccgaggcugaaagcagaagggcaccccucgccgcgccucgggggcgcgcucagcgaaaggugcacuccucucaaccaucaagucguauggcccuuccgcccagcccucuggcaauggaguacgucaaugacuucgauuugaugaaauuugaaguuaagagagagccauccgaaggaaggcccgguccuccaaccgccucuuuaggcucgacacccuauucaagcgugccuccaaguccgacuuucuccgagcccgggaugguaggagcuacggagggcacccggccuggucuggaggaacuauacuggcucgcaacacugcagcagcagcuuggggccggagaagcucugggcuugucuccagaggaggccauggaacuccugcaaggccaggggcccgugccugucgacggaccacaugguuauuaccccggcagcccggaggaaacuggggcgcagcacgugcagcuggcagagcgcuuuuccgaugccgcucucguuucaaugagugugagagaauuaaacaggcaacugcggggaugcggccgcgacgaggcccuucgauugaaacagagaaggcggacccugaagaaucgugguuaugcacaggcuugucgcagcaaaagacuacagcaaaggcgggggcucgaggccgaacgagcgcgccuggccgcacagcuugaugcucugagagccgaggucgcuagguuggcccgggaacgcgaccucuacaaggcaagaugcgauaggcugacaucuuccggaccuggcucaggcgaccccagccauuuauuccuguga

SEQ ID NO: 59919 - RNA, 612 nt, Artificial Sequence
  derived and/or modified sequence opt3 from NRM__Homo_sapiens__NP_001257638
auggcccccgcucugcuccuuaucccugcagcccuggcgagcuucauuuuggcuuuuggcaccgggguggaguucgucagauuuacauccuuaaggccacugcuaggagguauaccggaaucuggcgggcccgacgcccggcagggauggcucgcagcccugcaagaucgcucaauccuugcuccucuggcaugggacuugggccuccugcuccuguucguuggucagcacaguuuaauggccgcugagcgagugaaggccuggacuagccguuacuuugggguacugcagagaucccuuuauguggcgugcacggcauuggcccugcaggucuacuaucaugugcuaggacucggcgaaccacuggcucuuaaaucucccagggcccugcgguuguucucgcaccuccgccauccuguuuguguggagcuguuaaccguccugugggugguaccaacacucggcacugauagacuucuguuggcauuucuacugacccucuaccuggggcuugcucacggacuggaccaacaggauuugagguaucuccgggcccagcugcagcgcaaguuacaucugcuaucacgaccccaagacggugaagcggaguga

SEQ ID NO: 59920 - RNA, 429 nt, Artificial Sequence
  derived and/or modified sequence opt3 from NRN1__Homo_sapiens__NP_001265639
augggccugaagcucaacgggagauacaucagccuuauucuggccgugcagauagcuuauuugguccaagcaguuagggccgcgggaaaaugcgacgcuguguucaaggguuuuuccgauuguuuacugaaacuaggcgacucuauggccaauuacccccaggggcucgaugacaagaccaacaucaaaacaguaugcacuuauugggaggauuuccacucauguacggugaccgcacugacagacugccaggaaggagccaaggauaugugggacaaacuucggaaggagaguaagaaucugaacauucagggcagcuuguuugaacucugugguuccgggaauggagcugcaggcucucugcugccugccuucccaguccucuuagugucgcugucagcugcccuugcgacuugguugagcuuuuga

SEQ ID NO: 59921 - RNA, 1935 nt, Artificial Sequence
  derived and/or modified sequence opt3 from NRP1__Homo_sapiens__NP_001019799
auggagagaggccugccccuccuuugcgccgugcuggcuuuggucuuagccccugcaggggcguucaggaacgacaaguguggagauaccaucaaaauugaaagcccagguuaccugacauccccgggcuauccccacucuuaccauccuucagagaagugcgaauggcuaauacaggcuccagaccccuaucaacggaucaugauuaauuuuaacccucacuucgaucucgaggaccgcgauuguaaauacgacuauguugaaguguuugauggggagaaugagaacggacauuuccgaggcaaguuuugcgguaaaaucgccccacccccuguagugaguagcgggccauuccuguuuauuaaguucgucuccgacuacgaaacucacggagcaggcuuuucuauccguuaugagauauucaagagaggcccggaauguucgcagaauuacacgacccccucaggggugaucaaaagcccuggauuuccagagaaguaccccaacagucuugagugcacauauauuguuuucgccccuaaaauguccgaaaucauucuggaguuugaaucuuucgauuuggagccagacagcaaucccccggguggcauguucuguagguacgaucggcucgaaaucugggacggguuuccugaugugggaccccauauaggccgcuauugcggucagaagacuccagggagaauuagguccucaaguggaauccugagcauggucuucuacaccgacucugcuauugcaaaagagggcuuuuccgccaacuauucagugcugcagagcaguguaucugaggacuucaaguguauggaagcucucggcauggaguccggggaaauccacagcgaucaaaucacagccucgucucaguacuccaccaauuggucagcggagcggagucgcuuaaacuauccugaaaauggauggacucccggugaggacagcuaccgagaguggauucagguugaucugggccuuuugagauuugugacagcagucgggacccagggagccauauccaaggaaacgaaaaagaaauacuaugugaagacuuacaaaaucgacgugucuagcaacggcgaggauuggauuaccaucaaggaagguaauaaaccaguccuguuccaagggaacacaaaucccacugacguugugguagcuguguuuccuaagccacuaauaaccagguucguccggauuaagccggccacaugggagaccggcaucucaaugcguuuugaaguguauggaugcaaaaucacggauuaccccuguaguggcaugcucgggaugguuuccggacugauuagcgacucucagaucacuucaaguaaccagggugaucgcaacuggaugccugagaauauuagacuugugacaagcagguccggcugggcacugccacccgcuccucacucuuauauaaacgagugguugcagaucgaccucggggaagagaagauuguccggggaaucaucauucaaggcgguaaacaucgagaaaauaagguguucaugcgcaaauuuaagauaggguacucgaacaauggcagcgauuggaagaugaucauggacgacuccaaaagaaaggccaaaucauucgagggaaacaauaacuaugauaccccagagcugaggacuuuucccgcguuaaguacacgguucauucgcaucuacccggaaagagccacccacggcgggcugggacucaggauggagcuucuggguugcgaaguagaggcaccuacggcuggcccaaccacacccaaugggaacuugguugacgaaugcgaugacgaucaggccaauugucauucuggaacuggcgacgauuuccagcuaaccggugggacaacugugcuggcuaccgagaagccuacagucauugacagcaccauccaauccggcauaaaauga

SEQ ID NO: 59922 - RNA, 2781 nt, Artificial Sequence
  derived and/or modified sequence opt3 from NRP2__Homo_sapiens__NP_003863
auggacauguucccccugaccuggguguuucucgcccuuuacuucagcagacaccaggucaggggccaaccugauccaccgugcgggggacggcugaacuccaaggacgcugguuauaucacaucucccggcuacccucaggauuauccaucacaucagaauugugaguggauuguuuacgcacccgaaccuaaccagaaaauaguguugaauuuuaacccacacuucgagaucgaaaagcaugacugcaaauaugauuuuauugagauccgcgacggggauagugaaagcgccgacuuacugggaaagcacuguggcaauauugcgcccccuacuaucauauccucugguucgaugcuauacaucaaauucacgucagauuaugcucgacaaggggccggauuuagccuccguuacgagauuuucaagaccggcagugaggacugcuccaagaacuuuacaucuccaaauggcacuaucgaaagcccgggguuccccgagaaauacccucauaaccuggauuguaccuuuacaauucuugcaaagccaaaaauggaaaucauacugcaguucuugauuuuugaccucgagcacgauccccugcagguaggagagggugacugcaaguaugacuggcuggauaucugggacggcauuccucacguggggccacucaucggaaaauacuguggcaccaagacucccuccgaauuaagaucaaguacagguauccugagccuuaccuuccauacggauauggccgucgcuaaggacggguucucugcaagguauuacuuggugcaccaggagccgcuggaaaauuuucaaugcaacguuccucuaggaauggaguccggccggauugccaaugaacagauaucagcuagcaguacuuauucugauggccgcuggacaccccagcaguccagacuccauggggacgauaacggauggaccccaaaucuggacagcaacaaagaguaccuucaaguggaucugagguucuugacuaugcucaccgccaucgcgacacagggugcaauuucgcgggagacccagaauggcuauuacgucaagucuuacaaacuggaaguguccacgaacggggaggacuggaugguauaucgccacggaaagaaccacaaaguuuuucaagccaauaacgaugcuacugaaguggucuuaaauaagcugcaugccccucuccuuacacgauucgugagaaucaggccccagaccuggcacucaggcauagcacugcgguuggagcuauuugguugucgugugacugacgcuccaugcaguaacaugcuggggaugcucagcggccugauugccgacucccagaucucugcgagcucaacacaggaauaccuuuggagucccuccgccgcacgccuggucagcucuagaucaggaugguucccuaggaucccacaagcucagccgggcgaggagugguugcagguugaucucgggacccccaaaacggugaagggaguaauuauccagggugcccggggcggggacaguauuaccgcuguggaagcccgagcauuuguccgcaaguucaaagugagcuauucccugaauggaaaggauugggaguacauacaagacccuagaacacagcagccaaaauuauuugaaggcaacaugcauuaugauacucccgacaucaggcgguucgauccuauuccagcccaguacguucgcguguaucccgagagauggucuccggcugguaucgggaugaggcuggaaguccuaggcugugacuggaccgauucgaagccuacaguggagacucucggaccaaccguaaaaagcgaggaaacaaccacucccuacccuacggaggaagaggcgacagagugcggcgaaaauugcuccuuugaggacgauaaggaccugcaacuucccucaggguucaacuguaauuuugauuucuuggaggaaccaugcggauggauguacgaccacgcaaaguggcugcguaccacuugggccaguucuagcuccccuaacgaccggaccuuccccgaugaccgaaauuuucucagacugcagucagauagccagagggaaggucaguaugcucgccuuaucucuccaccgguucaucugccucggucccccguguguauggaguuccaauaccaggccacaggcgggagaggagucgcacuccagguggucagggaggccagucaagaaagcaaauugcugugggugauucgcgaggaccagggcggugaauggaagcacgggcgaauaaucuuaccaucuuaugauauggaguaccagauuguuuuugaaggcgugaucggaaaaggccgguccggggagauugcuaucgacgauauacguaucucaaccgacguaccccuggagaacugcauggaaccuauuagugccuucgcagucgauaucccagagauucacgaaagagagggauaugaagacgagaucgaugacgaguacgaaguggauuggagcaauucguccucugcgacuagcggcucaggugcucccaguacagacaaggagaaauccuggcuauauacgcucgacccuauacugauuaccaucauugccaugucuagccuugggguuuugcugggagcaacuugugccggccuccuguuauacugcacauguuccuacucaggucugagcaguaggucuugcaccacacuugaaaacuauaauuuugaguuguacgauggccucaagcauaaggugaaaaugaaccaccagaaguguugcuccgaggcuuga

SEQ ID NO: 59923 - RNA, 588 nt, Artificial Sequence
  derived and/or modified sequence opt3 from NRSN1__Homo_sapiens__NP_542454
augagcuccugcucuaacguguguggcucaagacaggcccaagcugcagccgaagggggauaccagagguaugguguccggaguuaccugcaccaguucuaugaggacugcaccgcgagcaucugggaguacgaagaugacuuucagauucaacgcucccccaaucgauggucuucgguuuucuggaaggugggccucauaucagggacaguauuugugauccuuggacugacugucuuggcugugggcuucuuaguuccuccaaaaauugaggccuuuggugaagcagauuucguggucguggacacgcaugccguacaguuuaacagcgcucuggauauguauaagcuagcaggggccguucucuucuguaucggaggcaccaguauggcuggcugccugcuuauguccguguuugucaaaucuuacagcaaggaggagaaauuccugcagcagaaguuuaaggaacguauugccgacaucaaagcgcacacacaaccggugacuaaggcacccgggccuggagagaccaaaauaccagugacauuguccagaguccagaauguucagccccuccuggccaccuga

SEQ ID NO: 59924 - RNA, 615 nt, Artificial Sequence
  derived and/or modified sequence opt3 from NRSN2__Homo_sapiens__NP_079234
augaugcccagcugcaacagauccuguucuugcucaaggggcccuaguguggaggacgggaagugguacggaguccggagcuaucugcaccucuucuacgaagauugugccgguaccgcucuuuccgacgauccagagggcccgcccguucugugcccucgccgaccauggcccucuuuguguuggaaaaucucguuaucaagcgggacacugcuacuccugcuuggaguggcagcccugacuacgggcuaugcgguaccuccaaaguuggaagguauuggggagggagaauuucucgugcuggaccagcgugcugccgauuacaaucaagcacuggggaccugcagacucgccggcacagcuuuaugugucgcagccggcgugcugcuugcuauaugcuuguucugggccaugaucggauggcugagucaggacacuaaagcggagccccuagauccugaggcagacucccauguugaaguguuuggugaugagccagaacagcagcucucuccgauuuucaggaacgccagcggccaauccugguuuucacccccugcuaguccauucgggcagagcucuguccagaccauccagcccaagcgggacuccuga

SEQ ID NO: 59925 - RNA, 594 nt, Artificial Sequence
  derived and/or modified sequence opt3 from NRTN__Homo_sapiens__XP_011526343
augcagagauggaaggccgcugcacuggccagcgugcucugcuccucuguccuuucaaucuggauguguagggagggccuguuguuaagucaccggcuggggcccgcgcuaguuccucuccaucgccugccacgaacccuugacgcucguauugccagacuggcacaauacagggccuugcuccagggagcuccggaugcaauggaacugcgggagcugacacccugggccggucgcccuccaggccccagaaggcgggcugggccucgccgaagaagggcccgggcgcgucucggagcacgcccaugcggcuuaagagaacuggaggugaggguaagcgaacuugguuugggguaugccuccgacgagacugugcuguuccgguacugugcuggagccugcgaggcagcugcccgagucuaugaucuaggccuccgcagacugaggcagcggcgcagacuuaggcgugaacgggugcgagcgcagcccuguugcagaccuacggccuacgaggacgaaguuucuuuucuggaugcacacucgagguaucauaccgugcacgaguugucagcucgcgagugugccugcgucuga

SEQ ID NO: 59926 - RNA, 4644 nt, Artificial Sequence
  derived and/or modified sequence opt3 from NRXN1__Homo_sapiens__NP_001129131
augggcaccgcccugcuccagagagggggaugcuuccuucuguguuugagcuuacugcuacucgguugcugggcugagcugggcuccgggcuugaauuucccggagcagagggccaauggacaagguucccuaaguggaacgccuguugcgaaucugagaugucauuucagcugaaaacucggagugcgcgcgguuuggugcucuacuucgacgaugaaggguuuugugacuuccuggagcugauccucacgcgaggaggccguuuacagcugagcuuuuccauuuucugcgcugagccagccacccuuuuggcagauacaccggucaaugacggcgccuggcacucuguuagaauaaggcggcaguuucgcaacacuacccuguucaucgaucaaguggaagcuaaguggguagaggugaaaucgaagagaagggacaugacagucuuuucagggcuauucgugggaggucugcccccugaacugcgggcagccgcucuuaaacugaccuuggccagcguucgcgagcgagagccauuuaagggcuggauuagagaugugagggucaauaguucccaggugcuccccguagacucuggggaaguuaagcuggaugacgagccuccaaacagcggaggcgguucccccugugaagcgggggaggaaggagagggcggcgugugcuuaaaugggggagucuguucagugguggaugaccaggcagucugcgauuguagucggacugguuuccguggcaaagacugcagccaggagaucaaguucgggcugcaaugcguucucccugugcuucugcaugacaacgaucagggaaaauauuguugcauuaauacagccaagccauugaccgaaaaagacaacaauguagagggccuagcucaccugaugaugggugaucaggggaagucuaagggcaaagaagaguacaucgccacguuuaagggauccgaauauuucuguuacgaccucucacagaacccgauacaaagcaguucugaugagaucacucuguccuuuaaaacccuucagcgcaauggccugauguugcauacaggaaagagcgcagacuaugugaaccucgcucugaaaaauggggccgucucguuagugauuaaccuggguucuggcgcguucgaggcccuaguugaacccgugaaugggaaguuuaacgauaacgcauggcacgacgucaaagugacuagaaaucucaggcagcauuccggaaucggccacgcuaugguaaacaagcugcacugcucaguuaccauuaguguggaugguauccuuacaaccacgggguacacucaagaggacuauacaauguugggcagcgaugacuucuuuuacgucggaggcuccccuucuaccgccgaccugccagggagccccgugucaaauaacuucaugggaugucucaaggaagucguguacaaaaauaacgauguucggcuggagcuuagucgacuggcuaagcagggugacccuaaaaugaagauacauggcgugguagccuuuaaaugcgaaaaugucgcaacuuuggauccaauuacauucgagacccccgaguccuuuaucagccucccgaaguggaacgccaagaaaacggggucuauuucauucgacuuucgcaccacagaaccuaauggacugaucuuauucagucacggcaagcccagacaucagaaagaugcuaagcacccacagaugaucaaaguggacuucuuugcgauugagaugcuggauggucaccuauaucuccugcuugacauggggagcggcacuauaaagaucaaggcauugcugaaaaagguuaacgauggagaaugguaccauguggacuuccaaagggauggccgguccgggaccauuucugucaauacacuccgcacuccuuauaccgcccccggagagucggagauccuggacuuagaugacgaacuguaccuuggcgguuugccagagaacaaagcugggcucguguuucccacagaaguauggaccgcccugcuaaauuauggauacgugggcuguauaagagaccuguucauugauggucagagcaaggacaucaggcagauggcagagguucaguccacugccggcgucaaaccuucaugcaguaaggaaacggcuaagccaugucucucuaacccgugcaaaaauaacgggaugugucgugauggauggaaccgguaugugugcgacugcagcggcacaggguaccugggacgauccugugagagagaggccaccgugcuuucauacgauggcagcauguuuaugaagauccaauugcccgucguuaugcacacugaagcagaggacgugucucugagguuccgcucccagcgggcguaugguauuuuaauggcuaccacaaguagagauagcgccgacacccucaggcuggaacuugaugcagggcgcgugaaacugacuguaaauuuggacugcauccgaauuaacuguaauucuuccaagggaccugagacacucuuugccggcuacaaccugaaugauaacgaauggcauacgguccgggugguucguagagguaaaucacuaaagcugaccguggacgaucagcaggcuaugacuggccaaauggccggggaccacacaaggcucgaguuccauaauauagagaccggaaucauuacagaacgccgguaucugaguagcgucccaucgaacuuuaucggccaccuucaguccuugacuuucaaugggauggcauacaucgaccugugcaaaaacggagauauugacuauugugaguuaaaugcuagauuuggcuucaggaacauaaucgccgaucccgugaccuuuaagacgaagucuagcuacguugcgcucgccacccugcaggcuuauacaucaaugcaccuuuucuuccaguuuaaaacuaccagucuggacggucuaauucucuacaauuccggggauggaaacgacuucaucgugguagaacuggucaagggcuacuugcauuauguguuugaucuggguaauggcgcaaacuuaauuaaagggucuagcaacaagccucucaaugacaaccaauggcacaaugugaugaucucccgagauacaucaaaccugcauacugucaaaauagacaccaagaucacgacacagauuaccgccggagcucgcaaucuugaucucaagagcgacuuguacaucggcgggguugccaaagagacuuauaagagucucccaaaacuggugcacgcaaaggaaggauuccagggcugccuagcgucuguagaccugaacggucggcuucccgaucucauuuccgacgcccuguuuuguaaugggcaaaucgagagaggaugcgagggcccgagcacaaccugucaggaagauucgugcucaaaccagggcguguguuugcagcaaugggacggguucucuugcgauugcaguaugacuuccuuuagcggaccucuguguaaugacccagguaccacauacauauucucuaaaggcgggggacagauuacguauaaguggcccccuaacgauaggcccagcacccgugcugaccgcuuagccaucggcuuuuccacuguccagaaggaggcagugcucguucggguggauucaaguagcggucugggggacuaccuugaacugcacauucaucagggaaaaaucggcgucaaguucaaugugggcacagaugacauagcuaucgaggagucuaacgccauuaucaaugaugggaaauaucacguugugagauuuaccagguccggagguaacgcaacauugcaagucgacucauggccaguaauugaacgauacccugccggcaauaacgacaacgagcggcucgcuaucgcgcgccagagaauacccuacaggcuggggcgggugguugaugaauggcuacuggacaagggacgacagcuuacuauuuucaauagucaggccaccaucaucauuggcgguaaagagcaagggcagccauuccagggacaacucagcggccuguauuacaacggcuugaagguguuaaauauggcagcugaaaacgaugccaauaucgccauugucgggaacgugagacugguaggagaggugccguccucuaugacgacagagucgaccgcuacugcaaugcagagcgaaaugucaaccuccauaauggagacaacuaccacacucgccacgaguaccgcgcgcagggguaagccucccacuaaagaaccaaucucucagacaaccgacgauauucuggucgcuagcgccgagugccccuccgacgaugaagacaucgauccuugugagccaucaucuggcgggcuugcaaaucccacucgugccggaggccgggagccuuauccggguagcgcugaaguuauuagagagaguuccagcacaaccgggaugguggugggaaucgucgcagccgcggcucugugcauauugauccuacuguacgccauguauaaguacaggaaccgcgacgaaggcucuuaucauguggaugagucacgaaauuacauuuccaacagugcacagagcaauggcgccguuguaaaagaaaagcaaccaucgucugcuaaauccagcaacaagaauaaaaagaacaaggacaaagaguacuauguguga

SEQ ID NO: 59927 - RNA, 5139 nt, Artificial Sequence
  derived and/or modified sequence opt3 from NRXN2__Homo_sapiens__NP_055895
auggcaagcggcucccgcuggaggcccaccccuccaccgcugcuccuucuguuguuacuggcucuggcagcccgggcggacgggcucgaguucggagguggccccgggcagugggcucgcuacgcccgaugggcaggagccgcuucuucaggcgaacugaguuuuagccuucguacaaacgcaacucgagcccuguugcucuaucuggaugacgguggggauugcgacuuccuggaacucuuacugguggauggaaggcuucgguugcgcuuuacgcuguccugugcugaaccugccacccuacagcucgacacaccagucgcggaugacagauggcacaugguucugcuuacuagggaugcacggcgcaccgcccuggcuguggacggcgaggcccgagcagcugaaguaagaucuaagaggcgggagaugcaaguggccucggauuuguucgucggcgggauacccccugacgugcgucucucagcgcugacauuaagcaccguuaaguacgagccacccuuucgcggacugcucgccaaucuuaagcugggugaaagaccuccagcauugcuaggcagucaggggcugaggggagcuacugccgauccgcucugcgcucccgcccggaacccuugugcaaauggcggucugugcacagugcuugccccaggggaggucggaugugacugcucccauaccggcuucggcgggaaauuuuguucugaagaggagcaccccauggaaggaccugcucaucugacguugaacagcgagguggguucccuccuguucucagaaggcggggcgggacgaggcggugcaggggacguacaccagccaacuaagggcaaagaggaauuuguugccaccuucaagggaaaugaguuuuucugcuaugauuuaagucauaaccccauucaaagcucuacagacgagaucacucuggcuuuucgcacccuacagagaaauggccucaugcugcacacagggaaguccgccgauuacgugaaccuuucauugaaaagcggagcagucuggcuggugaucaaucucgguaguggcgccuucgaagcucugguggagccggucaacgggaaguucaaugacaacgccuggcacgauguuagggugacccggaaucuucgccagcaugcaggaauuggccacgcgaugguaaacaaacugcauuauuuggugacgaucucugucgacgguauucucacuacaaccggguacacucaggaagauuauacaaugcugggcuccgacgacuuuuucuacaucggaggcagcccuaauaccgcugacuuacccgggucgccagugucuaacaacuuuaugggaugucugaaggauguuguguacaaaaauaacgacuucaagcuagagcucuccagacuggccaaggaaggugacccuaaaaugaaacuucaaggcgauuugucauuuaggugcgaggacgucgcagcccuggaucccgugacguucgagaguccagaggcuuuuguagcccucccccguuggagcgcaaaacggaccggguccauaucucuggacuuccgaacaacugagccuaauggauuacugcuuuuuagccagggcagaagggcuggugggggcgccggaucacacaguuccgcgcagcgcgccgauuauuucgcuauggaauugcucgacggccaccuguaccuacugcucgauauggggagcggaggcaucaagcugcgggcaucuucaagaaaaguuaacgacggugaguggugucauguggauuuucagagggacgggcgcaagggaaguauuagcgucaauucccgaucuaccccauuccuugccacaggcgauucggaaaucuuggaccuggagagcgaguuauaucucgguggccugccggaagggggacggguggaucuuccccugccuccagaggucuggacugcugccuugcgugcaggcuacguggggugcguuagagaccucuuuauugacggaaggucccgcgaucugcggggccuagcggaagcccaaggugcuguggggguagcccccuucugcucaagagagacccugaaacagugugcaagugcuccuugcaggaacggaggcgucugucgagaggguuggaaucgcuucaucugcgacuguauaggcacaggguuucucggacgggugugcgaaagagaggccaccguucugucuuaugauggcagcauguacaugaagauuaugcuuccaaacgcaaugcacacugaagccgaggacguguccuugagguucaugucacagcgugcuuaugggcugaugauggcgacgacaagccgcgaaucugccgauaccuuacggcucgagcuggacggaggccaaaugaaacuuacugucaaucuggauugucuaagaguggguugcgcacccuccaaagggccggagacccucuuugcuggacauaagcugaacgacaaugaauggcacacaguaagggugguucgacggggcaaaaguuugcagcugagcgucgauaacgugaccguggagggucagauggccggcgcccauaugcgcuuagaguuccacaauaucgagacugggauuaugacagaaagaagguuuaucucugucguuccuuccaacuucaucggacaccucucaggccugguguuuaaugggcagccauacauggaccaauguaaggauggagacauuacguacugcgagcuuaacgcucgguucggccugcgagcaauaguggccgaucccguaaccuuuaaaaguagaagcucguauuuggcgcucgcuacucugcaggccuacgcauccaugcaucuauucuuucaguucaagacaaccgccccugacggucugcuucucuuuaacucugggaauggaaacgacuucaucgucauugagcuggugaagggcuauauccacuacguuuucgauuugggcaaugggcccagccugaugaaaggaaacucagacaagccagugaaugauaaccaguggcauaaugucgugguuagucgcgacccugguaacgugcacacauuaaaaauagauuccaggacuguaacccaacacucuaauggcgcucguaaccucgaccugaagggggaacuuuauauuggaggccugagcaaaaauauguuuuccaacuugcccaagcucgucgcaucacgggaugguuuccaggggugucuggccagcguggaccuaaauggaagacugccagaucuuaucgcggacgcucuccauaggaucggccagguggagcgcggcugcgaugggccgaguacgaccugcacagaagagucuugugccaaccagggagucugccugcaacagugggacgguuuuacuugugacugcaccaugacauccuacggcgggccuguuuguaaugaucccggaacuaccuauauuuucggcaaggguggggcauugaucacguacacauggccacccaacgaccgaccuagcaccagaauggaucgguuagccgugggauuuucgacucaccagaggucagcuguacuggugcgcgucgacucugccaguggccucggcgauuaccugcagcuucauauugaccaagggacagugggaguuauauucaacguggguaccgaugacaucacuauugaugaaccaaaugcaaucgucuccgacggcaaauaucacgugguucguuuuaccagaagcgggggaaacgcuacacuacagguggauucuuggcccgucaaugagcgguacccugccggcaacuucgacaaugagagguuggcgaucgcccgccagcggauuccguauagacuagguagaguaguggaugaauggcugcucgacaaggggaggcaacugacgauauuuaacagccaggcagcuaucaaaauuggaggccgcgaccagggcagaccauuccaggggcaaguuuccggacuuuacuauaaugguuuaaaggugcuggcccucgcugcagagucagaucccaacgucaggaccgaaggccauuugcggcuggugggggagggaccuaguguacuccugagcgccgagacuacagccaccacacuucuggcugacauggcgacuaccaucauggaaacgacaaccacuauggcaaccacaacuacccgucgcggccgaucuccaacauugagagauuccacgacccagaauacugacgaucuacugguggccucagcugagugccccagugacgaugaagaccucgaggaaugugagccuagcacagguggggaguuaauucugccgaucauaaccgaagauucccuugaucccccaccugucgccacuaggucucccuuuguuccaccucccccaacauucuacccguuccugaccggagugggcgcaacgcaggauacucucccucccccagccgcucggagacccccuucgggcgggccaugccaggcggagagagacgauagcgacugugaagaacccaucgaagccucaggauuugcauccggugagguguucgacaguucuuugccuccgaccgaugacgaggauuuuuauacaaccuucccacuggucacugacaggacaacccuccugagcccccggaaaccugcuccccgaccaaaccuuagaacagauggcgccacuggggcaccuggagugcuauuugcccccuccgcuccagccccuaaucugccggcgggcaagaugaaccaccgcgaccccuugcaaccauuacuggaaaauccuccccucgguccaggggcaccuaccucauucgagcccaggcggccgccaccucugcgucccggcguuacgucugccccaggauuuccccaccuuccuacagcuaacccgaccggccccggggaaagaggaccaccuggugccguagaggugauuagggaaagcaguuccacuaccggcauggucguggggaucguugcugcagccgcucugugcauucucaucuugcuguacgccauguacaaguaucgcaaucgggaugagggaagcuaccagguggaccagucucgaaacuauauaucaaacuccgcacagaguaauggcgcggucgugaaagagaaggcccccgcugccccuaaaacaccaagcaaggccaagaagaacaaagauaaggaauacuauguauga

SEQ ID NO: 59928 - RNA, 1380 nt, Artificial Sequence
  derived and/or modified sequence opt3 from NRXN3__Homo_sapiens__NP_001098720
augcaccugagaauccaugccaggcggagcccuccccgccgaccagcuuggacccucggcauuugguuccuguuuugggggugcauaguguccucugucuggucaaguagcaacguugcauccucuucgucaacaagcaguuccccgggaucucacagccagcaugagcaccauuuccacgguuccaagcaccauucagugcccaucaguauuuaccguagcccuguaucucugagaggcgggcacgccggagcgacuuauaucuuuggcaaauccgguggguugauuuuauacacguggccagcuaaugacaggcccucaacccggagcgaucgccuggccgugggauucaguacaacugucaaggacggcauccuagugagaauagauucugcaccuggccucggggacuuucugcaacuucauaucgaacagggaaaaauugguguuguguucaacaucggcaccgucgauauuuccaucaaggaggaaaggacaccagugaaugacgggaaauaucacguaguucgguuuacccgcaacggaggcaaugccacucuucagguggauaacuggcccgucaaugagcacuacccuacagguaacaccgacaaugaacgauuccagauggugaagcaaaagauaccauuuaaauauaacagaccgguggaggagugguugcaggaaaaggggaggcagcucacgauuuucaauacucaggcucaaaucgcaauuggaggcaaagauaagggccggcuguuucaggggcagcugagcggacucuacuaugacgguuuaaaaguccugaacauggccgcugagaauaaccccaauaucaagaucaacggcucgguucgucuugugggggaaguaccuucuauuuugggaaccacacagacuaccuccaugccacccgagaugucaacaaccgugauggagacgacuacaaccauggccacuacaaccacgcgcaagaacagaaguaccgcgagcauacaaccuacauccgaugaccuggucucuagcgcagaauguucaagugaugacgaggacuucguggaaugcgagccauccacugccaaucccaccgaaccgggcaucaggcggguuccuggugcuagcgaggugauucgagagucuucaaguacaacugggauggucgugggcaucguagccgcagcugcccuauguauacucauucugcuuuacgcgauguacaaauaucgcaacagagaugaaggaagcuaccagguugacgagaccaggaauuauaucuccaacucugcccagucgaauggcacacugaugaaggaaaaacaacagagcuccaagucagggcauaaaaagcagaaaaacaaggaucgggaguacuauguguga

SEQ ID NO: 59929 - RNA, 783 nt, Artificial Sequence
  derived and/or modified sequence opt3 from NSA2__Homo_sapiens__NP_055701
augccccagaacgaguacaucgaacugcacagaaagagguauggcuaccggcucgacuaucaugagaaaaagcgcaaaaaggaaagccgagaggcccacgaacguuccaaaaaggcuaagaaaaugauugggcuuaaggcaaaacuguaccauaagcaaagacacgccgagaaaauacagaugaagaagaccaucaaaaugcaugagaagaggaauacaaaacagaagaacgaugagaaaacuccucagggagcggugccagcuuauuuguuagaccgggaaggucaaucucgcgccaagguccugucaaauaugauuaaacagaagagaaaggaaaaagcaggcaagugggagguuccgcuacccaaagugagggcccagggggagacggaaguacucaaggugauccggaccggaaaacgcaagaagaaggcuuggaaacgaauggucacaaaagugugcuucguuggcgaugguuuuacuagaaagccuccaaaauacgagagguucauucggcccauggggcugcguuuuaagaaggcacacgugacccacccugaacuuaaagccacauucugucugccaaucuugggagucaagaaaaaccccaguagcccucucuauaccacucugggcgugauaacaaagggcaccguaaucgagguuaauguguccgaacuggggcucgucacgcagggagguaaagugauuuggggcaaguacgcucaagugacuaacaauccagagaacgacgggugcaucaaugccgucuuacugguuuga

SEQ ID NO: 59930 - RNA, 7284 nt, Artificial Sequence
  derived and/or modified sequence opt3 from NSD1__Homo_sapiens__XP_005266018
augccccugaagaccagaacagcccucagcgacgauccugacuccucuacuucaacgcuuggcaacaugcuggaguugccagggaccaguagcuccucuacaucgcaggaauuaccguucugccaacccaaaaagaaaucaacuccucugaaguacgaggugggagaucuaaucugggcuaaauuuaagaggcggccaugguggcccugucgcauuugcagcgacccucucauaaauacccacaguaagaugaaagucuccaaccgacguccauauagacaguacuauguugaagcauucggugaucccucugagagggccuggguggcgggcaaggcuaucguaauguuugaagggcggcaucaguucgaggagcugccugugcuucgcagaaggggaaaacagaaggaaaaaggcuaccggcacaaggucccacaaaagauucugagcaaaugggaggccuccguggguuuggcagaacaguaugacguuccgaaggggucaaaaaaucgcaaguguauccccggaaguauuaaacucgauagcgaggaggacaugccuuuugaagauugcacaaacgacccagagucugaacaugaucugcugcucaauggcuguuuaaagucccuggccuucgacucagagcacagcgcugaugaaaaagagaagcccugcgcaaagagucgagccagaaaaucuuccgacaacccuaagaggaccagcgugaaaaagggccauauccaguuugaggcucacaaagacgaacggcgugggaagauaccagagaaucuuggauugaacuucaucucgggugauauuucugacacucaggccuccaaugaacugucacgcaucgcgaacagucuaacaggcagcaauaccgcacccggguccuuucucuucucuagcuguggaaagaacacggccaaaaaggaguuugaaacuucaaauggcgauagucugcuuggucugccggagggggcuuugauuuccaaaugcagcagagagaagaacaaaccucaaaggucucucgucuguggaucaaaggugaagcugugcuacaucggcgccggcgacgaagagaaacggagugauagcauauccauuuguaccacaucugacgaugggucgagcgacuuagaucccaucgaacacuccucagagagugacaauucuguacuggaaauuccagaugcauucgaccgaacugagaacaugcucagcaugcagaagaacgagaaaaucaaguauucccgcuuugcugccaccaauacaagaguuaaagcgaagcagaagccucuuaucucaaacagccauaccgaccaccugaugggaugcacgaaaucugccgaacccgguacugagacaucccaggugaauuugagugaucuaaaggcaagcacccugguccauaaaccacaaucugacuucacuaacgaugcucucucccccaaguucaaucugucaaguagcauuucguccgaaaacucucuuauaaaaggcggggccgcuaaucaggcccuguugcacagcaagucaaaacagccuaaguuuaggaguaucaagugcaaacacaaggagaacccagugauggcagagccgcccgugauuaaugaagaguguucccucaaaugcuguucuagcgacacaaagggauccccucuggccucaaucagcaaaaguggcaaggucgaugguuuaaagcugcuaaacaauaugcaugaaaaaacccgggacucuuccgauauagagacggcuguugugaagcacguacucagcgaacugaaagagcuuucguaccgcucauugggggaggacgugucugauaguggcaccuccaagccaagcaaaccccugcucuucucuagcgcguccucacaaaaccauauuccuaucgaaccagacuacaaguuuaguacacugcuuaugaugcugaaggauaugcacgacagcaaaacuaaggagcagagauugaugaccgcacagaaucucgucucuuauaggucccccggacguggcgauugcucaacaaacaguccgguggggguuagcaaagugcuggucuccggagguucuacucauaauucggaaaagaaaggcgacgggacccagaacagcgccaacccuucaccauccggaggcgacagugcuuuaucuggugagcugagcgccucccuacccgggcuccugucagauaagcgggaccuuccugcaucuggcaagagccgaagugauugugugacaagaaggaauugcggacgcuccaaacccagcucuaaguugcgggacgccuucucagcucaaaugguaaaaaacaccguuaauagaaaggcccugaaaacugaaaggaagcgcaaacucaaccagcugccauccgugacguuagaugcaguccugcagggcgaccgagagcgggggggaagucuucgugguggcgcggaggauccuagcaaggaagaccccuugcagaucauggggcaccucacaucggaggauggagaccacuuuucugaugugcauuucgacuccaaggucaaacaaagcgauccaggcaagauuucagaaaaaggucugaguuuugagaaugggaagggcccggaacuagacucugugaugaacuccgagaaugacgagcugaacggaguuaaucaggugguaccuaaaaagagauggcagaggcucaaccagcgccggaccaagcccagaaaaaggaugaaucgauucaaggaaaaagagaacagcgaaugugcuuuucgcguccugcuuccaucagaucccgugcaagagggccgggacgaguucccugaacacagaacuccaagugccagcaucuuggaggaaccccugaccgagcagaaucaugcagauugcuuagacuccgccgggccuaggcucaacguuugugauaagucuagcgcuuccauuggagacauggaaaaagagccgggcauaccaucacugacaccccaggccgagcuuccugaaccagcagugcguucugagaagaagcgccugcggaaacccaguaagugguugcucgaauacaccgaggaauaugaucagaucuuugcuccuaaaaagaaacaaaagaagguccaggagcaggugcacaaaguaucgagcagaugcgaggaagagucccugcuagccaggggucgaucuucagcgcaaaauaagcagguggacgaaaacagccugauuuccacuaaagaggaaccgcccguucucgagcgggaggccccauuccuggaagggccucuugcucagagugaguugggaggcggucacgcagaacugccccaguuaacacucucugucccaguggccccugaggugagcccccgcccagcucuggagucagaagagcuucuggucaagacgccgggcaacuacgaauccaaaagacaaaggaagccuaccaagaaacuacucgagaguaaugaucuggaccccggguuuaugccaaagaaaggagauuugggccugagcaagaaauguuaugaagccgggcauuuagagaacggaaucacugagucuugcgcaacauccuacucaaaggacuucggcggugggaccacaaaaaucuucgacaagccccggaagcgaaaaagacagcgccacgcggccgcuaagaugcagugcaaaaagguuaaaaaugaugacagcucgaaggaaauuccuggaucugagggcgaacucaugccacauaggacugccaccagucccaaggagacgguggaagaggguguggagcacgauccuggcaugccggcauccaaaaagaugcagggggaacguggaggcggggcugcccugaaagagaacguaugucaaaauugcgaaaagcuuggagagcuguugcucugugaagcacagugcuguggcgccuuucaucuggagugccuaggucugaccgagaugccacgggggaaauucauauguaacgaaugcagaacaggaauccacacuuguuuugucugcaagcagagcggcgaggacgugaagaggugucuucucccccugugcgguaaauucuaucacgaagagugcguucagaaguacccucccaccgugaugcaaaauaaaggcuuucgcuguucauugcauauuugcaucacaugucacgcugcgaacccagccaaugucuccgcaucuaaggggcgacugaugagaugcgugcgguguccuguugcuuaccaugccaacgauuucugcuuagccgcuggaagcaaaauucucgcaaguaauuccaucauaugucccaaccacuuuacuccaaggcgcggcugccguaaucaugagcacgugaacguaagcugguguuucgucugcucugaagggggaucacugcuuuguugcgacaguugcccugccgcguuucacagagagugucugaauaucgauauuccggaaggcaacugguauugcaacgacuguaaggcugguaagaaaccccauuaccgggagaucgugugggugaaggucgggagguaucgcugguggccagccgaaauuugccacccucgagcaguucccuccaauaucgauaaaaugagacaugacgugggagaguucccaguauuguuuuucggcagcaacgauuaccucuggacccaccaggcccggguguuuccuuauauggagggcgacgucucuucgaaggauaaaauggggaagggaguggacgguacguacaaaaaggcucugcaggaagcagccgcgagguucgaggaacuaaaggcucaaaaagagcugcgccagcuucaggaagacagaaagaaugauaaaaagcccccgccauauaaacacauaaagguuaacaggccuauuggccgggugcagaucuucacagccgaccucucagagauuccccguuguaauugcaaggcaaccgaugagaacccaugugggaucgacagcgaaugcauaaaucgcaugcuguuguacgagugucaucccacugucugcccugccggaggccgaugucaaaaccagugcuuuuccaaaagacaguacccggaaguggagaucuucaggacauuacagcgggguugggggcugcgcaccaagacugauauuaaaaagggagaauuuguuaaugaguaugugggcgagcucaucgacgaagaggaaugcagagcuaggauucgguacgcccaagagcacgauaucaccaacuucuauaugcugacacuugacaaagaucgaauaauugacgcaggccccaaggggaauuacgcuagauuuaugaaccauuguugccagccaaauugugagacgcagaaguggagugucaacggagauacccgcguaggucuguucgccuugucugacaucaaagcgggcacugaacuaacauuuaauuauaaccuggagugccucgggaauggaaagaccguguguaaaugcggcgccccuaacuguagcgguuuccuggggguuaggcccaagaaccagccuaucgcaacagaagagaaauccaagaaguuuaaaaagaaacaacagggaaagcggcguacucagggcgaaauuaccaaagagagagaggaugaaugcuucucauguggcgacgcugggcagcuugugaguugcaagaaaccaggaugucccaaggucuaccacgccgacugcuuaaaucugacgaagaggccugcugguaaaugggagugcccauggcaucaaugugauaucugcggcaaggaagcagccucuuuuugugagaugugccccagcuccuucuguaaacagcaccgcgaagggaugcucuucauuucaaaguuggacggacggcugagcugcacagagcacgauccguguggcccuaacccacucgagcccggugaaauacgagaguaugugccuccacccguaccgcugccucccgggccaucuacccaucuugccgaacaguccacuggaauggcugcgcaagcaccuaaaaugagugacaagcccccagccgauaccaaucagaugcugagcuugucgaagaaagcucuagccggcacaugccagagaccccugcucccugagaggccauuagaacgcacugacucccggccgcagccccuggauaaggugagagaccuugcaggcucugggaccaaaucacaaagccuggucaguucccagcguccucucgauaggccacccgccguugcuggaccucggccacaguugucugacaagcccagcccugugacaucaccguccaguagcccaucugugcgcucacagccccuggagcgaccucucgguacggcggaucccagacuggacaaauccaucggcgccgcaagcccaaggccucaaucucuugagaagaccaguguccccacugggcuacggcugccaccgccugaccgcuuguuaauuacaucgucccccaagccacagaccagcgauagacccacugacaaaccucacgcuucacugucucagaggcucccacccccugaaaaggugcugagcgccguuguacagacacuuguggcaaaagagaaggcccugcgaccggucgaucaaaacacccaguccaaaaaucgggcugcccucgugauggacuugaucgaucugacgccacgucagaaggaaagagcggcaaguccccaucaaguuacuccucaggccgacgagaagaugccagugcuagagucaucuagcuggcccgcuuccaaaggacugggccacaugccucgcgccgucgaaaaggguugugugagugauccccuccagaccagcgggaaagcugcagccccauccgaggacccguggcaggcuguaaagucucuuacacaagccaggcuguuaucacagccucccgcaaaagcguuuuuguacgaaccaaccacucaggccagcggacgggcuucggccggcgcagagcagacaccuggcccccugucccaaaguccagggcucgucaagcaggcuaagcagauggugggaggucagcaacugccugcccuugcagccaaaucuggccagagcuucagaucacuggggaaggcucccgcgucccucccgaccgaagagaaaaaguugguuacaacugagcagucuccaugggcccugggaaaagcaaguagccgcgcuggcuuauggccuauuguggccggucagacccuagcccaauccugcuggucagcagggagcacgcagacacuggcucagaccuguuggucucucggcaggggacaagaucccaagccagaacagaacacucuucccgcccugaaucaggcgccuaguucccacaaaugcgcugagagcgaacagaaguga

SEQ ID NO: 59931 - RNA, 1122 nt, Artificial Sequence
  derived and/or modified sequence opt3 from NSDHL__Homo_sapiens__XP_011529480
auggagcccgccgugagcgaaccuaugagagaccaggucgcuaggacccaccugacagaggauacuccaaagguuaacgcagacaucgaaaaagugaaucaaaaccaggccaagcggugcacgguaauuggcggguccggauuccucggucagcauaugguggagcagcuucuggcgcgcggcuacgcugucaauguguuugauauacaacagggguucgacaacccgcagguucgauuuuucuugggagauuuauguucucgucaggaccuguaucccgcccuaaaaggcgugaauaccgucuuucacugcgcaucaccuccacccaguagcaacaauaaggaacucuucuacagagugaacuauaucgguacuaaaaauguaauugagacauguaaggaggccgggguucaaaagcugauccuuaccuccucugcuucggugauuuuugaaggagucgauaucaaaaacggcacagaggaccugccuuacgcaaugaagccaauagauuauuacaccgaaacuaaaaucuugcaggagagggccgugcucggcgcuaaugaccccgagaagaacuuccugacaaccgccauucggccucaugggaucuuuggaccacgcgauccgcagcuggugcccauucucaucgaagcggcaagaaaugguaaaaugaaguucgucauaggcaacgggaagaauuuaguugacuuuacguucguggagaacguagugcacggacauauucuggccgcugaacagcuuucaagggauagcacuuugggcgguaaagccuuucacaucaccaacgacgagccuauuccauucuggacauuccugagucggauccuaacugggcucaauuaugaagcacccaaguaccacaucccuuacugggucgcuuauuaccuggcccuucuguugucccuccuggugaugguuauuucuccagugauacaauuacagcccaccuuuacaccgaugcgcgucgcgcuggccggaaccuuccauuauuacagcugcgagcgagcuaaaaaggcaaugggcuaucagccucucgugacgauggacgaugccauggagagaacuguacaauccuuuaggcaccuucggcguguuaaauga

SEQ ID NO: 59932 - RNA, 2235 nt, Artificial Sequence
  derived and/or modified sequence opt3 from NSF__Homo_sapiens__NP_006169
auggccggcagaagcaugcaggcugcaaggugccccaccgacgagcugucccucacaaacugugccguggucaaugaaaaggauuuccaaucugggcagcacguuaucgugcggacuucaccuaaccaucgcuacacguuuacccuuaaaacacacccaaguguagugccgggaagcauugcguucucccugccccagcgaaagugggcugguuugucuauaggccaggagaucgaagucucguuauauacuuuugacaaagccaagcaaugcauugggaccaugacaaucgagauugauuuccugcagaaaaagucaaucgacagcaauccuuacgauaccgacaagauggcagccgaauuuauacagcaguucaacaaucaggcuuuuagugugggacaacagcuaguuuucuccuuuaacgagaaacucuucggccugcuugugaaggauaucgaggcaauggacccaucuauucugaaaggugaacccgccacugggaagcgucagaaaaucgaggucggauuggugguaggcaauagccaaguugcuuuugaaaaggccgagaacuccucacucaaucugauuggcaaggcgaaaacaaaggagaacagacagaguaucauaaauccugauuggaacuucgagaaaauggggauuggaggucuggacaaggaguuuagcgauaucuucaggcgggcauucgccucucgcguguuuccacccgaaauugucgagcagaugggcuguaaacaugugaaggggauccucuuauauggaccuccaggcugcgguaaaacccugcuugcuagacaaaucgggaagauguugaaugccagggaaccgaagguggucaacggacccgagauucugaauaaauacguuggcgaguccgaagcaaacauacggaagcuauucgcugacgccgaggaagaacagcgccgacucggcgcgaacucagggcugcacaucauuaucuuugaugaaauagacgccauuuguaaacagagaggaagcauggcagguaguacgggcgugcaugacacuguagugaaucagcuucugucuaagaucgauggggucgagcaauugaacaauauccucgugauuggaaugaccaacaggccugaccugaucgaugaggcuuuacugcggccaggccgucucgaaguuaaaauggagauuggucuucccgacgaaaaggggcgccugcagauauugcacauccacacagccagaaugaggggccaucagcuacuguccgcugauguggacauuaaggagcucgccgucgaaacuaaaaauuucagcggagcagagcuggagggccuugugcgggccgcucagucgaccgcgaugaaccgacacaucaaggcaucuacaaaaguagaaguugauauggagaaggccgaaucccugcaagugacccgcggggacuuuuuggcuucacucgagaaugauaucaaaccugccuucggaacgaaccaggaggacuaugcaaguuacauuaugaaugguauaaucaaguggggcgauccagucacuagagugcuggacgacggggaauuacugguccagcagacaaagaacagcgauaggacuccccuaguguccguucuccuggagggaccgccucauucuggcaaaaccgcccuugcugccaagauugcagaagagagcaauuuucccuucaucaaaauuugcucaccagacaagaugaucgguuuuagugaaacagcgaaaugucaagcuaugaagaagauauucgaugacgccuauaaaucccaguugagcugcgugguagucgaugacaucgagcggcugcucgauuacgugccuauugggccccgcuuuucuaaccugguucuucaggcacuguuggugcuccugaagaaagccccaccccagggcagaaaguuacugaucauuggaaccacgucaaggaaagacguccuacaagagauggaaaugcucaaugcuuucaguaccacaauccacgugccuaacauagccacuggcgagcagcugcuugaagcauuggagcugcucgggaauuuuaaggauaaagaacguaccacaauugcucagcaaguaaagggaaagaaaguguggaucgguauuaagaaacuguuaaugcugaucgagaugagccuucagauggacccagaguaccggguucgaaaguucuuggcccuccugagagaagagggcgcguccccgcuagauuucgacuga

SEQ ID NO: 59933 - RNA, 1119 nt, Artificial Sequence
  derived and/or modified sequence opt3 from NSFL1C__Homo_sapiens__NP_001193665
auggccgcugagagacaggaagcacugagggaguucguggccgucaccggcgcggaagaggaccgggcucgcuuuuuccucgaaagcgccgggugggaucuucaaaucgcacuggccuccuuuuacgaggacggaggugaugaggacauuguuacaauaucucaggcuacucccucaagugugagccgaggcacggcaccuuccgauaaccguguaaccucuuucagagacuugauccacgaucaggacgaagaugaggaagaggaggaagggcagaggucgcgguuuuaugccggaggcucagagcgcagcggucaacagauuguggggccaccgagaaagaaaagucccaaugaauuagucgacgaucuguucaagggagcuaaagagcauggcgccguggcgguugaaagggugacaaaguccccuggcgagacuucuaaaccacggcccuuugcagggggagguuaccgccuaggcgccgcuccugaggaagagagcgccuaugucgcaggggaaaagcgacagcacuccucacaggacgugcauguaguucucaagcuguggaaaaguggauucagccuugauaacggcgagcugagaucuuaccaagacccauccaaugcucaguuuuuggaaucaaucaggcggggugaggugcccgccgagcuccgucgccuggcgcacgggggacaggucaaccuggacauggaagaucauagagacgaggauuucgugaagccuaaaggcgccuuuaaggcauucaccggcgaagggcagaaacucggaagcacagcuccacaaguguuaaguaccucuuccccggcccagcaggcugagaaugaagccaaggcaagcucgucuauucugaucgacgaguccgagcccacuacaaacauacaaaucaggcuugccgaugguggccgguugguccagaaguuuaaucacucacaccgaauuagugacauccgccuguucauuguugaugcuagaccugcgauggcagccaccagcuucauccuaaugacgacuuuuccaaacaaagaacucgcugacgagucccagacccugaaggaagccaaucuucugaacgcagugauaguacagagguugacauga

SEQ ID NO: 59934 - RNA, 558 nt, Artificial Sequence
  derived and/or modified sequence opt3 from NSG1__Homo_sapiens__NP_001274692
auggugaagcugggcaacaauuucgccgagaaagggaccaagcagccccuccuugaagacggauuugauacaaucccucugaugacuccauuggacgucaaccaauuacaguucccgcccccugauaaaguugugguaaagacgaaaaccgaguacgaaccagacagaaagaaggguaaagcuaggcccccucagauugcagaguuuacagugagcauaacugaaggcgucaccgagcgguucaagguguccguucuggugcuauuugcccucgcguuccugacaugcgucguguuucuuguaguuuauaaaguguacaaguaugaucgcgcuuguccagacggguucguccugaaaaauacccagugcauccccgagggauuggaaucuuacuaugccgagcaagauucaagugcacgagaaaaguuuuacacugugauuaaccacuauaaucucgccaagcagagcaucacacguuccgugucuccuuggaugucgguccugucagaggagaaacugagcgaacaggagaccgaagcugcagagaagagugccuga

SEQ ID NO: 59935 - RNA, 2847 nt, Artificial Sequence
  derived and/or modified sequence opt3 from NSMAF__Homo_sapiens__NP_001138244
augaccggccaggccagauuccacaggggagcugaggcaugccgggccauccgccaaugucgaagccguagacccagggcggcucauccugaagggcgggccgguuccggccgcgggucuagacacgcaucaccaggagugaggcggggcgguuuuagucugcuccuucugaacuuggaggaauacuauuucgagcagcaucgcgccaaucacauuuuacauaaggggagccaccacgaacgaaaaauaagaggaucccugaagaucugcucuaaaucggucauuuuugagccggacucaaucagccagcccauuaucaagauaccucuaagggauuguaucaaaauuggcaagcauggcgagaacggggcuaaucggcacuucacaaaggcaaaaaguggagguaucucccucauuuuuagccagguuuacuucaucaaggaacauaacgugguagccccauauaaaauagagcguggcaagauggaauacguguuugagcuggacguccccgggaaaguggaggauguuguggaaacucuucugcaauugcaccgcgcuagcugccucgacaagcugggagaucagacggccaugauuaccgcgauccugcaguccagacucgcaaggacaucauucgacaagaaucgguuucagaacauuagugagaaauuacacauggaauguaaggccgagauggucacuccucuggugaccaauccaggccauguaugcaucacagauaccaaccuuuauuuccaacccuugaaugguuacccuaaaccaguugugcagaucacucugcaggacguccgacgcauuuauaagagaaggcacgggcuaaugccgcucggacuggaaguguuuuguacagaggaugaccuuugcagcgauauauaccugaaauucuacgagccccaggaccgggaugacuuguauuuuuacaucgcuaccuaucucgaacaucacguggccgagcauacggcagaaucuuacaugcugcaauggcagcgcggccacuuauccaacuaucaguaccugcuccaccuuaauaaccuggcugacagaucauguaaugauuugagccaauauccugucuucccauggauuauccaugacuacaguucuuccgagcuagaucugagcaaccccggcacuuucagggaccucucgaagccuguuggggcccugaauaaagaacgucuugagcggcuguugacccgauaccaggagaugccagaacccaaguuuauguauggaucucacuacuccucaccggguuauguacucuucuaccuggugagaauagcgccugaguauauguuaugccugcagaacggcagguuugauaacgccgaccgcauguucaauaguauugcagaaacauggaagaacugucuagauggggcuacugacuuuaaagagcucauccccgaguucuacggagaugacgugagcuuucuggucaauucccuuaaguuggaucugggcaaacggcagggugggcaaaugguggacgacguugagcucccaccuugggccucuagccccgaggauuuccugcagaagucaaaagacgcucuugaaaguaacuauguguccgagcaucugcacgaauggaucgauuugauuuuuggcuacaagcagaagggaagcgacgccgucggcgcacacaauguguuccauccacucaccuacgaagggggaguagaucugaacucuauccaggaccccgaugagaaaguugccauguuaacacaaauucuggaauuuggucagaccccuaagcagcuauucgugacgccacacccgagaaggauaacucccaaauuuaagucacucagucagacaagcuccuauaaugcuucuauggcggacucgccuggcgaggaaucuuucgaggaucugaccgaagaguccaaaacucuugcauggaacaauaucacaaaguugcaacugcaugagcacuacaagauucauaaagaagccgucaccgggaucacggugucacgcaacggaaguucugucuucaccacaagccaggacuccacucucaagauguuuucaaaagagagcaagaugcugcagcgaucuaucuccuucaguaauauggcuuuaagcucuugccugcuuuugccaggcgaugccaccgugauuacauccucaugggacaacaauguuuauuuuuacaguauagcauucggucggcgucaggauacucucauggggcacgacgacgccgugagcaaaaucugcuggcacgauaacagacuguauucggcuuccugggacucuaccguaaaggucuggagcggcgugcccgccgaaaugccuggaacaaagaggcaucacuuugaucuacuggcagagcucgaacaugacguuucaguggauaccauuagucugaaugcggcuuccacucuuuuggucucuggcacgaaagaggggacagugaacaucugggaccugaccacugccaccuuaaugcaccaaauuccaugucauagcggaaucguaugcgauacagcauucucccccgacucacgccacgugcucagcaccgguacugauggcugucugaacguuauagacguccagacagggaugcuuaucaguucuaugacguccgaugagccgcagcggugcuuugugugggacggaaauagcgugcugucgggcucacaaucuggugaauugcucgucugggaucugcuaggggccaagauuagugagagaauccagggccacaccggagcuguuacuuguauuuggaugaacgaacagugcuccagcaucauaacaggcggggaggacaggcagauuaucuucuggaaacugcaauacuga

SEQ ID NO: 59936 - RNA, 744 nt, Artificial Sequence
  derived and/or modified sequence opt3 from NSMCE2__Homo_sapiens__NP_775956
augcccggcagaagcuccucuaacucagggaguaccggauucaucagcuuuuccgguguggagucugcccugucgucacucaagaauuuccaggcuugcauuaacagcggcauggacacagcaaguuccgucgcccuugaucugguugaaucucaaacugaggugagcuccgaauacucaauggacaaagcgaugguagaguuugcuacguuggauaggcaguuaaaucacuaugugaaggccguccagaguaccauaaaccaugugaaagaagagagaccugagaagaucccagaccugaaacuacucguugaaaagaaguuccuggcacuucagagcaaaaauucugaugccgacuuucaaaacaaugagaaguucgugcaguuuaaacagcagcugaaggaauugaaaaagcaaugugggcuccaggcugaucgcgaggcagacggaacagagggcgucgaugaagacauuaucgugacucagucccagaccaacuucacaugcccgauuaccaaggaggaaaugaaaaagcccguuaaaaauaagguauguggucacacuuacgaggaagaugccaucgugcgaaugauagagucacgucaaaaacggaagaaaaaggcuuauugcccucagaucggguguagccauacagacauuaggaagagugaucugauccaggacgaggcccugcggcgcgcgauugaaaaccacaauaaaaagagacauaggcacucugaguga

SEQ ID NO: 59937 - RNA, 1593 nt, Artificial Sequence
  derived and/or modified sequence opt3 from NSMF__Homo_sapiens__NP_001124441
augggcgccgcugcaagcagaaggcgggcccugcgcuccgaggcgaugucuucaguggcugccaagguccgagcagcccgugcuuucggggaauaccucagucagagccaccccgagaacagaaauggagcagaccaucuucuggccgaugcuuauuccggucacgacggcucuccugaaaugcaaccagccccgcagaacaagaggcgguugucguuaguuucaaaugggugcuacgagggaagccugagugaggaacccuccauccgcaagccugcgggcgaggguccacagcccagaguguauaccauuucuggggaaccugcacuacucccaagccccgaggccgaagcuauagagcuggccguagugaaaggaaggcggcagcgccauccucaccaucacucccaaccacuucgagcaucaccgggcggcaguagagaggaugucagcaggcccugucagucuugggcugggucccggcagggaucaaaggaaugcccugguugugcccagcuggcgccaggccccacaccucgugccuuuggguuggaccaaccaccccucccggagacuagcggacgcagaaagaagcuggaaaggauguacaguguggaucggguuucugacgauaucccuauucgaacgugguuccccaaggagaaccuguuuuccuuccagaccgcaacaacuaccaugcaggcuaucagcguguuucgcggcuaugccgaaagaaaaaggcggaagcgcgagaaugacucggcuucugucauucagagaaacuucaggaaacaccuccguaugguggguucccggcgaguaaaggcccaaacauuugcagagagaagggaacgcucauucagucggagcugguccgauccaaccccuaugaaagccgacacuucucaugauagcagagacucaagugauuuacaguccagccacugcacacuggacgaggcuuuugaagaccuugauugggacaccgagaagggguuggaagcgguugcaugugauacggagggauucgugcccccaaaggucaugcugaucucuucaaaagugcccaaggccgaguacauaccuacuaucauuaggcgcgacgauccaaguaucauuccgauccuauaugaccaugaacacgcuaccuuugaggauauacucgaagagauugaacgaaaacugaauguguaccacaagggcgccaaaaucuggaagaugcuuauuuucugccagggcgggcccggacaucuguacuugcucaaaaacaaggucgcaacauuugccaagguugagaaagaggaagacaugauccacuucuggaagcggcugagccguuuaauguccaaagugaauccugagccaaacguaauccauauuauggguuguuauauacugggcaaucccaacggggaaaaacucuuccaaaaucuuagaacucugaugaccccuuacagggugacauuugagucuccauuggagcuaucggcucagggaaaacagaugaucgaaaccuauuucgauuuucgccuguaccggcucuggaaaagcagacagcacuccaagcugcuugacuucgaugacguccuguga

SEQ ID NO: 59938 - RNA, 1515 nt, Artificial Sequence
  derived and/or modified sequence opt3 from NSRP1__Homo_sapiens__NP_001248396
augaagcagaccaaacuggagauccaaaaggcccucgcugaagacgcaacaguguacgaguaugauagcauuuacgacgaaaugcagaaaaagaaagaggaaaacaaucccaaacuucuguugggcaaggauagaaaaccuaaguauauacacaacuuacugaaagccgucgagaucaggaagaaagagcaggaaaagcggauggagaagaaaauucagcgcgaacgagagauggagaagggggaguucgacgauaaagaagcguuuguuacuuccgcuuacaagaaaaagcuacaagaacgugccgaggaagaggagagagaaaagagggcagccgcucucgaggcaugccuggacgugacgaagcagaaggaucuuucuggauucuaucggcaucuguugaaucaggccguaggugaagaggaagugccaaaauguucauuucgcgaggcuagaaguggcaucaaggaggaaaagagcaggggguucuccaacgaggucucuucgaagaaucggauuccgcaggaaaaaugcauccuccaaaccgacgugaagguugaggaaaaccccgaugccgacucagauuuugacgcgaaaagcagugcagaugacgagauagaggaaacacgcgugaauugucgaagagagaaagucaucgaaacuccugagaacgacuucaagcaccauaggucccagaaucacucucggagcccauccgaggaacguggacauucaacccgccaccacacaaaaggcaguagaaccagcaggggucaugagaagcgggaagaucagcaccagcaaaaacagucucgagaccaggagaaccauuacacugaucgcgacuauagaaaggaaagggauucccaccggcaccgcgaggccucacauagagacagccacuggaagaggcaugagcaagaagauaaaccccgugcucgggaccagcgagagagaagugauaggguguggaagcgcgaaaaagaccgggagaaguacucucagagagaacaggagagggaucgccaacagaaugaccagaaccgaccuuccgagaaaggggaaaaggaggaaaagagcaaagccaaggaggaacacaugaaaguacggaaggagcguuacgagaauaacgacaaauauagagauagggaaaagcgcgagguuggagugcagucgucugaacggaaucaagacagaaaagaguccucaccaaacaguagggcaaaggauaaguuucuggaccaggagcgaagcaacaaaaugcgcaauauggcuaaggauaaagaacggaaccaggagaagcccuccaauucugaaagcucacugggcgccaaacauagacucacagaggaaggccaggagaaggggaaggagcaagaaaggccuccagaggcggucaguaaauucgccaagcguaacaaugaagagaccgugauguccgcacgcgaccgguacuuagcuagacagauggccagggugaacgcuaaaacguauauugaaaaggaggaugacuga

SEQ ID NO: 59939 - RNA, 2199 nt, Artificial Sequence
  derived and/or modified sequence opt3 from NSUN2__Homo_sapiens__NP_001180384
augggcagaaggagccgggggcgccgacugcagcaacagcagcgucccgaggacgcagaagauggagcugaggguggcgggaagagaggagaagcaggcugggaggguggguacccugaaaucgugaaagagaacaaacucuucgagcacuauuaccaggaacuuaaaauugucccagagggagaauggggccaauuuauggacgcccugagggagccguugcccgcgaccuuacggauaacaggcuauaagcgcuacccugaggaacuggcuuggcauacuaaucuauccagaaaaauccucaggaagucuccacaccuggagaaguuccaucaguuucuuguuucagaaacggagagugggaacauuagccggcaggaagccguguccaugauucccccucuguugcucaauguacgcccacaccauaaaauccuggauaugugcgcagcccccggaucuaagaccacacagcugaucgagaugcuccacgcugacaugaacgugccuuucccagaggguuuugucauagcaaaugauguggacaacaaacgauguuauuuacugguucaccaagccaagagacuuucgucaccgugcaucaugguggucaaucaugaugcuagcaguauucccagguugcagaucgacguggauggccggaaagaaauucuguucuacgaccguauccuaugugauguaccuugcuccggggacggaacuaugcgcaagaacauagauguuuggaagaaauggaccacacucaauucucugcagcuucacggccugcaguugagaauugccaccaggggugcggagcaacucgcagaagggggacggaugguguauagcacuuguucccugaacccaaucgaggacgaagccgucauugcuucauuacuggagaagagugagggcgcccucgaacuugcagacgugagcaaugagcugcccggcuugaaauggaugccugggaucacacaguggaaggugaugaccaaagauggacagugguuuacggacugggaugcugucccacauucucgacacacucaaauccgccccaccauguucccgccuaaggaccccgaaaaacuacaggccaugcaccuggagagaugccucaggauucugccacaucaccagaacacagguggcuuuuucguugcggugcuuguaaagaaguccucaaugccuuggaauaaacggcagcccaagcugcaagggaaaagcgccgaaacucgcgagaguacccaguugucuccagcagaucucacagagggaaagcccaccgacccuuccaaacuggaaagcccaucguuuacgggcacuggugauacagagauagcucaugccaccgaagacuuagagaacaaugggucuaagaaggauggcguguguggaccgcccccuuccaaaaagaugaaacuguucggcuuuaaggaggacccauucgucuucauccccgaagaugacccucuauuuccacccauugagaaauucuacgcucucgacccgucauuuccuagaaugaaccugcuuacuaggacaaccgaagggaagaagcgucaguuguacauggugaguaaagagcugcggaacguucuccugaauaacagcgaaaagaugaaagugaucaauacgggaauaaaggucuggugccgaaacaauuccggugaggaguucgauugugccuuuagacuugcacaggaaggcauuuauacccuguacccauucaucaacucuaggaucauuacagugagcauggaggacguaaaaaucuugcucacucaagaaaaucccuuuuuccgcaagcugucaagugagaccuauucccaggccaaggauuuagcuaaagggagcauuguucugaaguacgaaccugacucugcgaaccccgaugcacuacagugcccaauagugcucuguggauggcggggcaaagccucaaucagaacauuugucccuaagaaugagaggcugcacuaucuucgcaugauggguuuggaggugcugggggaaaagaagaaagagggcgucauucucacuaacgaaagugcugccagcaccggacagcccgacaaugaugugacagagggccaacgagcaggggaaccaaacuccccggacgccgaggaggcuaauucuccugauguuaccgccggaugcgaccccgccggugugcauccaccccgguga

SEQ ID NO: 59940 - RNA, 1023 nt, Artificial Sequence
  derived and/or modified sequence opt3 from NSUN3__Homo_sapiens__NP_071355
augcugacccagcucaaggccaaaagcgagggcaaacuugcuaagcaaaucugcaaggugguccuggaccacuucgaaaaacaguacuccaaggaguugggggaugcauggaacacaguuagagaaauuuuaacuucucccucauguuggcaguaugccgugcugcuaaauagguuuaacuacccuuucgagcucgaaaaggaccugcaucuuaaaggauaucacacgcugagucaggguagcuugccaaauuacccgaaguccguaaaaugcuaucucucucggacccccggccgcauaccuucggagcgacaucaaaucgggaaccugaagaaauacuaucugcucaaugcggcuucauuacugccagugcuugccuuggagcugcgugauggagaaaagguccuagaccucugugcagcccccggcgguaagagcauugcucugcuucagugcgcauguccuggguaccugcacugcaacgaguacgauaguuugagacucagguggcugcggcagacauuagaauccuuuaucccacagccccugauuaaugugaucaaaguuucugagcucgacggacgcaagaugggcgaugcccaaccugagauguucgacaaagugcuugucgaugcuccauguagcaacgacagauccuggcuguuuucaagugauagccagaaggccucuugcaggauaucccagcggcgcaauuugccgcuacugcagaucgaacuccugcgaucagcgauuaaagcacuuagacccggcgggauccugguguauagcacuuguaccuugaguaaggccgagaaccaagacguaauuucugaaauccucaauucccauggaaacauaaugccuauggauauuaaagguaucgcuaggacaugcagccacgacuucaccuuugccccaacuggccaggagugugggcuguuaguuauucccgacaagggaaaggcauggggcccuauguacguggcuaaacugaagaaaucguggucuacagguaagugguga

SEQ ID NO: 59941 - RNA, 1413 nt, Artificial Sequence
  derived and/or modified sequence opt3 from NSUN5__Homo_sapiens__NP_001161819
augggccuguacgccgcugcagccggggugcucgcgggagucgagagcagacaggguuccaucaagggccuuguuuauucuucaaacuuccaaaaugugaaacagcuguacgcuuugguaugcgaaacccagagguauagugccguguuagacgcagucauugccagcgcugggcugcuacgggcagagaagaaacuccgcccccaccuggccaaggugcuuguuuacgaacuguugcucggaaaaggcuuucgaggugggggaggccguuggaaggcucugcugggcagacaucaggccaggcucaaggcggaguuagcacggcugaaagugcaccgcggggucuccagaaacgaagaucuuuuggaggugggaucuaggccugguccagccucgcaacugccgcgguucguacgcguuaauacacuaaagacuuguucagacgauguggucgacuauuuuaaacgacagggcuucagcuaccaggggagagcuaguucccucgaugaccugagggcccuuaagggaaaacauuuucuguuggauccccucaugccugagcuguuaguguucccagcacagacggaccugcacgaacauccccucuaucgggcuggccaccuuauacugcaagaucgugccucuugcuugccugcgaugcuacuggacccacccccugguagccacgugaucgaugccugugcagcuccagggaacaagaccucccaucucgccgcucugcuuaagaaucagggaaaaauuuuugccuucgaccuggaugcaaagcgcuuggccucaauggcuacacuccuggcgagagcaggcgucaguugcugugaguuagccgaagaggacuuucuggcuguuagcccgucugaccccagguaccacgaggugcauuacauccuacucgauccuuccugcucaggcagcgggaugccaagucggcagcuggaggaacccggagccgguacuccuucuccaguacgacuucacgcauuggccggcuuccagcaacgcgcucugugucacgcccucaccuuucccucccugcagagacuuguguauagcacaugcucgcugugucaggaagagaacgaagacgucgugagggaugcauugcaacagaauccgggggcguuccggcucgcuccugcccugcccgcauggccacaucgcggauuaucuaccuuuccuggcgccgagcacugccugagagcuucccccgagacuacacuaucaagugguuucuucguugccgugauugaaagggucgaggugccaagccucaccgggcaguccaucucuacgcguacucauacccagcccagcccuaaagaaaaggaggaaacagcaaaaucacggagucgaugucugcacacugcccuucauauagcugaggcgccaggcuga

SEQ ID NO: 59942 - RNA, 2157 nt, Artificial Sequence
  derived and/or modified sequence opt3 from NSUN7__Homo_sapiens__NP_078953
augcugaacagcaccggcgagcucgaguucuccaaugaagaagaccccgagaucauuucucagcuuacaucacugccuuugagugggggaaagagcuccgccggugugccagagaaaacuggcuacccggauucugucuauguuauggcugcaaacauauuucaagggaucagaauugaaaagucggcccagaaaguguuaaucaaguacggaaaugagccccugaggucacuaagcgaaagugaggaccaguccuuccagcggcucucuuaugaacuggcguuuagcgcucuuaaauaccaagauauucuggagacgaucuugauagacuccugcaucuucccuucaaccacaauuccagaucaccucaguagccugaucauuguaaugcuguaugacuuucaggaucgcaaguuccagacucgagugcucucugacaacgaggaacccaucuccgagguccaggaaguggagaauuuacugaacucauuuaagauaaaacuugccgcagccuuggcucguugcagaauuaagcaugaugcacugagcaucuaccacauucuaccugaaaccguuaggaaacaagagcuccgggccaguacacugccacuuuaugcuuggaucaauaccugcaagaucucucccgaggaaguguacaacaaucugaaacgcagaggcuacaacaaggucaaguccguguugcauauugacgauaaaguauucgccguugaccagcacuguuaugaugugcucauauuuccuagccaucugaagaaugacuuaaucaacauugaccuguucaaagauuacaagcucaucuuucaggacaaaucgaggucucuugcgguccacuccgugaaggcacuguugaauauggaugacgaugugcuaauggucaacacugguucaugguauacaguuagucacaugagcauacugaccaauaacaacacguccaaaguguucguaugcggggugcagucucaagccaaggacccagaucucaagacucuguuuaccaaaauuggauguaagaauaucgagauccuucaugaaaaauucauuaacaucgagagcaaggaccaccggcugcagaaagucaaggugauuuugcuccugccgcgcugcucaggcuuaggcguuaguaaucccguggaguucauacugaacgaacaugaggauacagaauuucuaaaggaccacucccaagggggaaucagcgucgauaaacuccacgugcuggcucagcagcaguacgagcagcuuacucaugccaugaaguucaccaaagcacaagcuguaguuuauuguacaugcucuguguuuccugaagagaaugaagccgucgugaagaaagcguuggaguuccaggaccuggguaacaagggccagccauaccgacucucacccccuguccugccacuuuguagucugaaggagauucaguugagcaccgacaaauuuuucagaauggaacccuccgagaucacgaaugggugcuuucucucuauccugacuagggaacgggauccgucggagacagugagcguuaacgacguguuagcccgugcagcugccaagggacugcuagauggcauugagcucgguaaauccucaaagcgcgaaaagaaaaagaaaaagaguaaaaccucucugacuaagggggcuacaaccgacaauggaauacaaaugaaaaucgccgaguuccuuaacagagaaacgaaggcaagcgccaauuuguccgagaccguaacaaaaccuccccugccacagaagaacacugcucaggucggcgcgucaagccagaccaggaagccuaauaaacucgcaccccacccagccgugcccgcuuuuguuaagaacacauguccuucucggccacgagaacgccaaacucauuuccugagaccgaggcccgaggaucggaugguggccuuaaaaccuauugagaucguccugccacccguguuuaugccuuucuccaguccacagggcauucgcagcagaaugcccacccagcaccuuuauuguagguggguagcaccgaaggccuuggugccuacaugccucccaacccauucucugucccguaaagaagagaagcccaaggacgauacuccuucaagucuacugcggcccccacgaagauggcucuga

SEQ ID NO: 59943 - RNA, 1833 nt, Artificial Sequence
  derived and/or modified sequence opt3 from NT5C1B__Homo_sapiens__NP_001002006
augagccagaccucccugaagcaaaagaagaacgagcccggcaugagaucuucaaaagaaagucucgaggccgaaaagaggaaagagagcgacaagacaggggugcggcuuuccaaucagaugcgccgagcugucaacccuaaucacucucugcguugcuguccauuccagggacauucgucaugcagaagguguuugugcgcagccgaagguacugcguuaggcccgugucacacgauccggauuuacauacauaugugccugcuaugggagcaggggcaacagaucaccaugaugcgcggaagccaggagaguucccucagaaagacagauucuaggggcuaucugguucggagccaguggucccgcauuucacgaagucccagcacuaaagcuccuucuaucgacgaaccaagauccaggaacaccucagccaaacuucccagcaguucuacauccagccggaccccuucgacuucuccaucccugcacgauucaagucccccuccauugagcggucaaccgucccuccagcccccugcaucuccacagcugccccguagccuggacucacgcccuccaacacccccggagccugaucccgggaguagaagguccaccaaaaugcaggaaaauccagaggccugggcucaaggaauugugcgggagauccgacagacgcgcgacagccagccucucgaauacucuagaacuucacccaccgaguggaagaguagcucccaaaggcggggcauauauccagcaucuacacaguuagaucgcaacucgcugagcgaacagcagcaacagcagagagaggacgaagaugacuacgaggccgcuuauugggccuccaugaggucauuuuacgagaaaaaucccaguuguucucguccuuggccaccgaagcccaagaacgcgaucacuauugcacuuagcuccugcgccuuguucaauaugguagauggccggaaaaucuaugaacaggaggggcuggaaaaguacauggaguaccaacuaaccaacgaaaaugugauucucacaccuggaccagcuuuucgauucgucaaagcccugcaguaugugaacgcaagacuuagggaccuguaccccgaugagcaggacuuguuugacaucguucucaugaccaauaaccaugcucagguggguguccgccugauaaauucagugaaccacuauggcuuacugauugaucgguucugucucacugggggaaaggacccuaucggcuaccuuaaagccuaucugacgaacuuguacauugcggccgauagcgagaagguacaagaagcaauccaggaggguaucgcuucugccacaauguuugacggggcuaaagauauggccuauugcgacacccagcuaagaguugcauucgauggagacgccgugcuguuuuccgaugaaagugagcacuucacuaaggaacauggccucgacaaguuuuuccaguacgauacacugugugagagcaaaccacuugcucaaggcccccugaagggguuuuuggaggaccucggaaggcugcagaaaaaguucuacgcgaaaaaugaacgcuuacugugcccgauucgaaccuaucuagucacggcacggucugccgcuuccucaggugcccgugugcucaagacccugagaagguggggccuugagauagacgaagcauuguuccuggccggggcuccuaagaguccaauccucgugaaaauucgcccccacaucuuuuucgaugaccauauguuucacauagagggagcccagcggcugggcagcauugcagcguacgguuucaacaagaaauuuucguccuga

SEQ ID NO: 59944 - RNA, 1953 nt, Artificial Sequence
  derived and/or modified sequence opt3 from NT5C1B-RDH14__Homo_sapiens__NP_001186032
augagccagaccucccugaagcagaaaaagaacgagcccggcaugagaucuucaaaagaaagucucgaggccgaaaagaggaaagagagcgacaagacaggggugcggcuuuccaaucaaggaucucaggaaucgucacugcgcaagacugauagccgagguuacuugguccguagucagugguccagaaucucuaggagcccuuccacgaaagcuccaucaauugacgagccgcggagucgcaacaccagcgcaaagguugaguuacccucuuccucaacaagcaguagaacuccuucuaccuccccaagccugcacgauucgucucccccuccacuauccggccaacccucacuccagccuccagccaguccgcagcugcccaggagccuugacucccggccuccaacacccccugaaccagaucccgggucucgccgaagcaccaaaaugcaggagaauccggaagcgugggcucaaggaauagugagagagaucaggcagacucgggacucacagccucuggaguauagucguacaucccccaccgaauggaagucuagcucacagcgcagaggcauuuacccagccaguacgcaauuggauaggaacagccucuccgagcagcagcaacagcagcgggaagacgaggaugacuaugaagcagccuacugggcuucuaugcgaucguucuaugagaaaaauccuagcugcucccgccccuggccacccaagccuaagaacgcaaucacuauugcccugucaaguugugcucuguuuaauaugguagaugguagaaaaaucuacgagcaggaagggcucgagaaguauauggaauaccaauuaaccaacgagaaugugauacugacaccaggaccggccuucagguuugucaaagcgcuucaguacgugaacgcacgguugcgcgaccuguaucccgaugaacaggaccuauucgacaucguucucaugacuaauaaccaugcccaggugggcgucagacugauuaauucugugaaccacuacggccuucugaucgauagguuuugcuugaccgggggaaaggacccuauugguuaucucaaggcuuaccugacaaauuuauauaucgccgcagauagcgagaaaguacaagaggcuauacaggaaggcauugccuccgcgaccauguucgacggggccaaagauauggcauacugugacacgcagcugcguguugcuuuugauggagacgccguccucuucucagaugagagcgaacauuuuacuaaggagcacggccuugacaaguucuuucaguaugauacacugugcgaaucuaaaccauuggcucaagaggagccccggcuagacgugcugaucaacaacgccgguauuuuccaguguccuuacaugaagaccgaagacggguuugagaugcaguucggagugaaucaucucggccacuuccugcuuacuaaccuguugcucggccuguuaaaauccagugcaccaagccgaaucguggucguuucuuccaagcuguacaaauauggggauaucaauuuugacgaucuaaacucagaacagaguuacaauaagagcuucugcuauucgagauccaagcucgccaacauucuguuuacaagggagcuugcucgccgguuggagggaaccaaugugacgguaaacgugcugcaccccgguauagucagaaccaaucucggcaggcauauccacauuccgcugcuugugaaaccucuguucaacuugguuucuugggcguuuuucaagacaccaguggaaggggcacaaacuagcaucuaccucgccucaagucccgaggucgaaggaguguccggccgcuauuuuggugacuguaaagaggaggaacuguuaccuaaggcuauggaugagucuguagcccgaaaacugugggacauaagcgaaguuaugguggggcuacucaaguga

SEQ ID NO: 59945 - RNA, 1686 nt, Artificial Sequence
  derived and/or modified sequence opt3 from NT5C2__Homo_sapiens__NP_036361
augagcaccuccuggucugacagacugcagaacgccgcugauaugcccgcaaauauggacaagcacgcccucaaaaaguacaggcgggaggcguaucaucgcguguucgucaaccgaucacuugcuauggagaaaaucaagugcuuuggcuucgauauggacuacacacuggccguuuauaaaaguccugaauacgaaagccucggguuugaguuaacuguggaacgucugguauccauuggauauccacaagagcuacucucuuucgcauacgauucgacguuuccgaccagaggucugguguucgacacacuuuauggcaaucuguugaaggucgaugccuacgggaaccuccuggugugugcucacggauuuaauuucauaaggggccccgagacucgggaacaguacccuaacaaguuuauccagcgcgacgauaccgagagauucuauauucugaauacacucuuuaacuuaccagaaaccuaccugcuugcaugcuugguugacuucuuuacuaauugucccagguauacaucaugcgagaccgguuucaaagauggggaccuguucaugagcuaccggaguauguuucaggaugugcgcgacgccgucgacugggugcauuauaagggaucccuaaaagagaagacgguagaaaaccucgagaaauacguugugaaggauggcaagcugccucuucuguugucucgaaugaaagaagucggcaagguguuccucgcuacuaauagcgacuauaaauacaccgauaagaucaugacauaccuguuugacuucccacacgggcccaaaccuggauccucacauagaccauggcaaaguuauuuugauuuaauucugguggacgccaggaagccguuguucuuuggugagggcacuguccuucggcagguugauaccaaaacagggaagcugaagaucggaaccuacacgggccccuugcagcacgguauaguguauagcgggggaucuuccgacacuaucugugaucuacugggcgcgaaaggcaaggacauucucuacaucggggaucacauuuucggagacauccugaaaucaaagaaacgucaggguuggcgcacauuucuuguaauaccugaacuggcacaagaguugcauguguggaccgacaagagcagucucuucgaggaacugcagucuuuagauauuuuucuggccgagcuauauaagcaccucgacuccagcucgaacgaaagaccagauaucucuuccauucagaggcggaucaaaaaggucacucaugacauggauaugugcuacggcaugauggggucacuguuccgaaguggaagccgccagacacuuuuugcuucccaagugaugagauaugccgacuuguacgcagcuucuuucaucaaucugcucuacuaucccuucagcuaccuguuuagggccgcgcacguucuuaugccucacgagucaaccguggaacauacgcacgucgauauuaacgagauggagaguccacuggccacccggaaucgcacauccguggacuucaaagauacugacuauaagagacaucaguugaccaggagcauaucugaaaucaaacccccgaaccucuuuccucuggcaccccaggagauuacacacugucaugaugaagacgaugacgaggaagaggaggaagaggaagaguga

SEQ ID NO: 59946 - RNA, 1011 nt, Artificial Sequence
  derived and/or modified sequence opt3 from NT5C3A__Homo_sapiens__NP_001002010
augagagcccccagcauggacagggcugcaguggcccgggucggcgcgguugcuuccgccucugugugcgcacugguagccggggugguccucgcucaguacaucuucacccuuaagcgcaaaacaggacgaaagacuaaaauuauagagaugaugccugaauuucaaaagucaagugugcguaucaaaaacccaacgagaguugaggaaauuaucuguggucugauuaagggcggggcagccaaguugcagaucauaaccgauuucgacaugacauuaagcagguuuuccuauaaaggaaagcggugcccgacuugucacaauaucauugauaacugcaaacuggugaccgacgagugucgcaagaaacuacuccagcugaaggaaaaguacuaugcuaucgaggucgaucccgugcuuacaguagaggaaaaauacccuuauaugguugagugguacaccaagucucauggccuguuggugcagcaagcccucccaaaagcgaagcugaaagaaauugucgcagagucggacgugaugcugaaggaggguuaugaaaauuucuuugauaaacuccagcagcacucaauccccguguucauauuuagcgccgggauuggagacgucuuagaggaaguuaucagacaggcuggcguguaccauccuaacguaaagguggucaguaauuucauggauuuugacgagacuggcgugcugaagggguucaaaggagaacuuauucacguuuuuaacaagcaugauggugccuugaggaauacagaguacuucaaccaacugaaagacaauuccaacaucauccuacucggcgauucucagggggaccugcggauggcagacggaguggcuaaugucgagcacauucuuaagauaggcuaucugaacgaucgcguggacgaauugcucgagaaauacauggauagcuaugacaucguacugguucaggaugaauccuuagagguggccaauucaauucugcagaagauccucuga

SEQ ID NO: 59947 - RNA, 486 nt, Artificial Sequence
  derived and/or modified sequence opt3 from NT5C__Homo_sapiens__NP_001239306
auggccagaagcgugaggguccugguugacauggauggcgugcucgcugacuucgaggcagggcuucugcggggauuucgccgacguuuccccgaggaaccucacguaccauuggaacagagaagggguuuucucgcccgggagcaauaccgcgcgcugagaccggaucuagcugacaagguggccuccgucuaugaagcacccggcuucuuucucgaucuggagccuaucccaggggcccuugacgcugugagggagaugaacgaucugcccgacacccagguuuucauuugcacaucuccuuugcucaaauaccaucacugugugggagaaaaggaggaaacuccaucaugggagcauauacuguuuacgugcugucacaaucggcaucuggucuuacccccuacccgccgaagauuacugaguuggagcgauaacuggagggagauccuugacuccaaacggggcgcagcccagcgugaauga

SEQ ID NO: 59948 - RNA, 1368 nt, Artificial Sequence
  derived and/or modified sequence opt3 from NT5DC1__Homo_sapiens__NP_689942
auggcccagcacuucagccuggcugcaugcgacguggucggcuuugaucucgaccauacccuuuguagauacaaccugcccgaguccgccccuuugaucuauaauucuuucgcgcaauuuuuaguuaaggaaaaaggguacgauaaggagcugcuaaacgugacaccagaagacugggauuucugcuguaaaggacucgcucuggaccuugaggaugguaauuuucugaaguuggccaacaauggcacuguacucagggcaucacacgggacgaaaaugaugaccccggaagugcuggccgaggcuuauggaaagaaggaguggaaacauuuccugagugacacaggcauggcaugccggagcgguaaguacuauuuuuacgauaacuauuucgaccuccccggggccuuacugugugcucgcgucguggauuaccuuacuaaauugaauaacggacagaagaccuuugacuucuggaaagauauuguugccgcgauacagcacaauuacaagauguccgcauuuaaggaaaacugcggcaucuauuucccugagauuaaacgagacccaggccguuaccugcauucuugucccgaaucggugaagaaauggcuaagacagcucaagaaugccgggaaaauccugcuucugauuacaucaagccacagugacuauugcagguugcucugugaguacauccugggaaacgauuuuaccgacuuauucgauauagucaucacuaaugcucugaagccugguuucuuuucccaccucccaucucaacggcccuuccgcacacuugagaacgacgaggaacaggaagcccugccuagcuuggauaaaccaggcugguauucccaggggaaugcagugcaucuauacgagcugcucaagaagaugaccggaaaaccggaacccaagguaguuuauuuuggcgacucaaugcacagugauauuuucccugcuagacauuacagcaacugggagacggugcugauccuugaggaacugaggggugacgaggggacucggucucagcgcccagaagaguccgaacccuuggagaaaaagggaaaauacgagggcccuaaggccaagccacucaacaccucaagcaaaaaguggggcaguuucuuuauugauucuguccugggguuagaaaauacagaggacucccugguguauacuuggagcugcaaacgaaucucgaccuacucuacaauagcgauucccuccaucgaagccauugcagagcuaccgcucgauuauaaguuuaccagauucucaaguagcaacuccaaaacggcuggauacuauccuaaucccccacuggugcuuucuagcgacgaaacuuugaucucaaaguga

SEQ ID NO: 59949 - RNA, 1647 nt, Artificial Sequence
  derived and/or modified sequence opt3 from NT5DC3__Homo_sapiens__NP_001026871
augaccauggccgcugcagccguggucgcgagaggcgcuggggccagggcagccacagcugcagcccugcggggagguugcggcacugcugcccgcgggcgacccugugcgggaccugcacguccacucugcacggccccgggcaccgcucccgacaugaagagauaccuuugggagagguaucgggaagccaaacgcagcacagaggaacugguuccuuccaucaugucuaacuuguuaaauccagaugcaauuuucucaaacaaugagaugagucugagcgacauagaaaucuacgguuuugauuaugacuacacucuaguguucuauuccaagcaccuccauacccugauuuuuaacgcugccagagaucuucugaucaaugagcacagguaccccgcggagauucggaaauaugaauacgacccuaacuucgccauccgcggguugcauuacgauguacagcgagcagugcucaugaagauagacgcuuuucacuauauccaacugggaacagucuacagaggccugucugugguuccagaugaggaagugauugagauguaugagggcucgcaugucccccucgaacagaugucagacuucuacgggaaaagcagucacggaaauaccaugaagcaguuuauggauaucuucuccuuaccugagaugacucugcuuucuugugugaacgaauauuuucugaagaauaacauugacuacgagccaguacaccuguauaaagauguuaaggacagcaucagggacgugcauauaaaagguauuauguaccgggccaucgaagcugauauugagaaguacaucugcuaugccgagcagacacgugcaguccuagccaaacucgcugaccacggcaagaagauguuccugaucaccaauuccccgucaaguuuuguggauaaagggaugagcuacauugugggaaaggacuggcgcgaucuuuucgacgucguuauagugcaagcggaaaaacccaacuuuuucaaugauaagagaaggccuuuccggaaaaugaacgagaagggcguacuguugugggacaaaauccauaagcuccagaagggucagauuuauaaacaggggaaucuguacgaauuuuuaaagcugacgggauggcgaggcucucgcgugcucuauuucggcgaucacaucuacuccgaccuugcagaucugacuuugaaacacggguggagaaccggagccauaauuccagagcuaaggucagaacugaagaucaugaacacagagcaauauauccagacuaugaccuggcuccagacacugaccggucuucuggagcagaugcaaguccaucgggacgcugaaagccaguuggugcuccaggaguggaaaaaggaacgcaaggagaugagagaaaugacgaaaaguuucuuuaacgcccaauuuggcucucuguucaggacugaccagaaucccacauacuuuuuacgucggcugucccgauucgcagauauuuacauggccagccuaucgugucuccugaacuaugacguuucucacaccuuuuacccuagaaggacuccacuucagcaugaguugcccgcuugguccgagcgcccgccuacauucgggacccccuugcuccaggaagcccaagcaaaguga

SEQ ID NO: 59950 - RNA, 1575 nt, Artificial Sequence
  derived and/or modified sequence opt3 from NT5E__Homo_sapiens__NP_001191742
augugccccagagccgcuagggccccugcaacccugcuccuugcgcugggagcuguguuguggccagccgcaggggccugggaguuaacaauccugcacacuaacgacguccauagccggcuagaacagacguccgaggauucuucaaaguguguuaaugcuagucgcugcaugggagguguggcacgacucuucaccaaaguacaacagauucguagagccgaaccgaacgugcugcuucuggacgcuggcgaucaguaccaggggacaauaugguuuacugucuauaagggagccgagguggcgcacuucaugaaugcauugagguacgacgccauggcucucggcaaccaugaauuugauaaugguguugaggggcugaucgagccccugcucaaagaagccaaguucccuauuuuaagcgcaaacaucaaagcuaagggaccacuggccucccaaauuucuggccuuuauuugcccuacaaggugcugccugucggcgacgaggugguagggaucguuggauauaccucgaaagaaacaccauuucuaucaaaucccgguaccaaccucguguucgaggaugagauaacugcgcugcagccugaagucgacaaacuuaagacacugaaugugaacaagaucauugccuugggccacagcggguuugagauggauaaacucaucgcacagaaggugcggggagucgacguugugguaggcggucauaguaauaccuuccuguacacggggaacccaccguccaaggaagugcccgcuggaaaauauccuuuuauugucacuucugaugacggccgcaaggugccaguugugcaggccuacgcuuucggcaaauacuuaggguaucugaagaucgaguuugaugaaagaggaaaugucauaagcucccacgguaaccccauucuccuuaauucaaguaucccugaggacccaagcauuaaagccgacaucaacaaguggaggaucaaacuggauaacuacucuacccaagaguugggcaagacaauuguguaucuagacggguccucacagagcugucgguuccgcgaaugcaauaugggaaaccugauaugugaugcaaugaucaauaacaaucuccgacacacugacgagauguuuuggaaccauguaaguaugugcauucugaauggcggugggaucagaucucccauagaugaaaggaacaauggcauucacguuguguacgaccuuucccggaagccgggagaucgugucgugaaacuggacgucuuguguaccaagugccgcgugccuagcuaugauccccucaaaauggacgagguuuacaaggugauccugccaaacuucuuagccaauggcggggauggauuccagaugaucaaagacgaacugcuaagacaugacucgggugaucaggacauuaacguagucucuacauauaucuccaagaugaaggugauuuacccugcuguugagggcaggauaaaauuuucaaccgggagucacugucacggcagcuucucccucaucuuucugucucuuugggcggugauuuucgucuuguaccaauga

SEQ ID NO: 59951 - RNA, 687 nt, Artificial Sequence
  derived and/or modified sequence opt3 from NT5M__Homo_sapiens__NP_064586
augaucagacugggcggguggugcgccaggcggcucuguagcgcugcagugcccgccggacgccgaggugcggcuggcgggcuuggacuggccggcggucgugcauugagagucuuaguugacauggauggggugcuggccgacuucgagggaggcuuucuaaggaaguuccgggcucgcuuuccugaucagccauucauugcacucgaagacagaaggggcuuuuggguauccgagcaauacgggcggcugcgcccgggacuuucugaaaaagccauaucaaucugggagaguaagaacuucuuuuucgaacuggagcccuugccuggugcuguggaggccgucaaagaaauggcgagccuccagaauaccgauguguuuauuugcacauccccaaucaagauguucaaauauugucccuacgagaaguaugcauggguugaaaaguacuuuggcccugacuuccuggagcagauugugcugacucgagauaaaacggucgugucugccgaccucuuaaucgaugacagaccagauauaaccggggcugagcccacaccuucgugggaacacguacuguuuacugccugccauaaccagcaccuucaauugcagccaccgaggcggcgucugcauucaugggcagacgauuggaaggcuauccuagacagcaaacgccccuguuga

SEQ ID NO: 59952 - RNA, 933 nt, Artificial Sequence
  derived and/or modified sequence opt3 from NTAN1__Homo_sapiens__NP_775745
augccccugcucguggagggcagaaggguccggcuuccucagagcgcuggggaccugguucgcgcucacccaccguuggaagaacgagcacguuuacugagaggacaauccgugcagcagguagguccccagggccuacucuacgugcaacagagggaacuggccgucaccucuccuaaggaugggucaaucaguauucuuggaagcgacgaugcgacaacuugccauauagugguucugcggcacacgggcaacggugcuaccuguuugacacauugcgacgggacugauaccaaagccgaggugccacucaucaugaacuccauuaagucuuucucggaccacgcacaguguggacgccuggaaguccaucuggugggcggcuuuucagaugacagacagcucagccaaaaauuaacacaccagcugcuuagugaguucgauaggcaggaggacgauauccacuugguaacccugugcguuacugaacuaaaugaccgggaggaaaaugagaaccauuuucccgugauuuaugggaucgccgucaauauaaagacagcugagaucuaccgcgcauccuuccaggaucgaggaccugaggagcaacucagagccgcuaggacccuggccgguggcccaaugauuucuaucuaugacgcggaaacggagcagcuucggauugggcccuacagcuggacuccuuuuccacacguggacuucuggcugcaucaggaugacaaacaaaucuuggaaaaccucuccaccucaccgcuggcagagcccccucacuuuguggagcacauacguaguacauuaauguuccugaagaagcauccaagccccgcccacacucucuuuucuggaaauaaagcccuucuguauaagaaaaacgaagauggcuugugggagaagauuuccucaccugguagcuga

SEQ ID NO: 59953 - RNA, 813 nt, Artificial Sequence
  derived and/or modified sequence opt3 from NTF3__Homo_sapiens__NP_001096124
auggugaccuucgccacaauccugcaggucaacaagguuaugagcauucucuuuuacgugauauuccuugcuuaucugagaggcauccaagggaauaacauggaccagagguccuugcccgaggauucuuuaaauucacugauuaucaaacuaauucaggcagacauccucaagaacaaacugaguaagcagaugguagaugugaaagaaaauuaccaaagcacucuuccuaaggccgaggcgccacgggaaccggagcgcggaggucccgcuaaguccgccuuucagccugucauagcaauggacacggaacuguugcgacagcagcguagauauaacucuccaagggugcuccugucggauucaacaccccuggagccuccaccccucuacuuaauggaggacuauguuggcagcccuguggucgccaaucggaccagucgcagaaaaagguacgcugaacacaagucccaucgcggggaguauucugugugcgauagcgaaucccuguggguaacugacaaaucaagugcaaucgauauucggggacaccaaguuaccgugcuuggcgagaucaagacagguaacagcccagucaaacaguacuucuacgagacccgauguaaggaagccagaccggugaagaaugggugcaggggaauugacgauaaacauuggaacucucaguguaagacuucccagacauaugugcgggcuuugaccucagagaauaacaaacuggucggcuggcguuggauccgcauagacacgagcugcguuugugcccuaaguagaaagauuggcaggacuuga

SEQ ID NO: 59954 - RNA, 663 nt, Artificial Sequence
  derived and/or modified sequence opt3 from NTF4__Homo_sapiens__XP_011525310
augagacaccauaccagggugcugcgggagaugcucccccuuccuagcugcucccugccaaucuuguuacuguuccuacucccgucuguccccauugaaucacagccuccacccaguacacugccuccauuucuugcccccgagugggaccuguugagcccucgcguugugcucucccgaggcgcuccagcagggccgccccugcuguuccucuuagaagccggagcguuucgugagucugcuggugccccugcaaacagaucgaggcggggcguaucagaaacugccccagcuagccgcagaggggagcuggcagugugugaugccgucaguggaugggugacggacaggcggaccgcuguugaucuucgcggccgagagguggaagucuugggugaggugcccgccgcagggggauccccucugagacaauacuucuuugaaacaaggugcaaggcggacaaugccgaggagggcggcccaggggcuggagguggcgggugucggggaguagaucgucgccacuggguuucugaaugcaaagccaagcagagcuaugugagagcacuaacugcugacgcccagggcagggucgguuggcgguggauacgaaucgauaccgcgugugugugcacacuccugucccgcaccgggagagccuga

SEQ ID NO: 59955 - RNA, 939 nt, Artificial Sequence
  derived and/or modified sequence opt3 from NTHL1__Homo_sapiens__NP_002519
augugcagcccccaggaguccggcaugaccgcccugucugcuagaaugcucacaaggucacggagucuugggccuggagcagguccacgcggcugucgagaggaaccggggccccugcguagaagggaagccgcggcugaggcccgcaagagccacuccccugugaaacggccaagaaaggcacaaagguugcgggucgccuacgaaggaucugacucggagaaaggcgagggugcugaacccuuaaagguuccugugugggagccacaggauuggcagcagcaacugguaaacauccgcgcaaugcgaaauaaaaaggacgcccccguggaucaucuagggacugaacacugcuaugacucaagcgcuccuccaaaggucagaagguaccaggugcuccugagucuuaugcuguccucucagacgaaagaucagguuaccgccggagcgaugcaacgguugcgugcacgcggccucacaguggacagcauucugcagacugaugacgccacccugggcaagcucauauauccggucggguucuggagauccaaagugaaguacaucaaacagacaucagcuauuuuacagcaacauuauggaggugauauccccgccaguguagcagagcugguugcccuuccuggcguggggccaaagauggcucacuuggcgauggccgucgcauggggaaccgugagcggcauugcuguggacacucauguccacaggaucgccaaccggcugcgauggacaaagaaagcuaccaagucucccgaggaaacgcgcgccgcacuagaggaauggcucccuagagagcuguggcacgaaauaaauggucuucugguuggguuuggacagcagacuuguuugccagugcaucccaggugccacgccugucucaaccaagcucugugcccggcggcacagggcuuauga

SEQ ID NO: 59956 - RNA, 1035 nt, Artificial Sequence
  derived and/or modified sequence opt3 from NTM__Homo_sapiens__NP_001041674
augaagaccauccagcccaaaaugcacaacagcauuuccugggccauauucacaggccuggcugcacucugccuuuuucaaggggugccugucagaucuggagacgccacuuucccaaaggcgauggauaauguuacggugaggcagggugagucagcuacccugcgguguacaaucgacaaccgcguaacucgaguggccugguugaaucguaguaccauuuuauacgcaggcaacgauaaauggugccuggacccgagagucgugcuacucagcaauacacagacccaguauuccaucgaaauucaaaacguugauguguacgacgaggggcccuauacuuguucuguccagacagauaaucauccuaagaccucgagggugcaccugaucguacagguuucaccaaaaauaguggaaaucagcagugacauuuccaucaacgagggaaauaacauuucucuuacgugcaucgccacuggccggcccgaaccuaccgucacauggcgccauauaagcccaaaggcuguggguuuuguguccgaggaugaguaccuggaaauucaggggaucacuagagagcaaucaggagacuaugaauguagugcaagcaaugaugucgccgcucccguugugaggcggguaaaggugaccgucaacuacccuccauauauuucugaggccaaaggcacaggcgugccgguugggcagaagggaaccuugcagugcgaggcguccgcagugcccucagccgaguuccagugguacaaagacgauaagcgccucaucgaagguaaaaagggcgucaagguggaaaaucgaccuuuucugagcaaacugaucuucuuuaacguaagugagcacgacuacgggaauuauacguguguugcuucuaacaagcucggacauacuaacgccuccauuauguuauucggcccaggugcagugagcgaagucucgaaugggacaucuagaagggcuggaugcguguggcugcuucccuugcugguccuacaccuccugcuuaaauuuuga

SEQ ID NO: 59957 - RNA, 1815 nt, Artificial Sequence
  derived and/or modified sequence opt3 from NTN1__Homo_sapiens__XP_006721658
augaugagagccgugugggaggcucuggcagcccucgcggcugucgccugccuuguuggcgcagugaggggagggcccggucugagcauguucgccggccaggcugcacaaccugacccauguuccgaugaaaacgggcacccgcggcgcugcauccccgacuuuguaaaugccgcuuucggaaaggaugugcgagucucuucaaccuguggccguccuccagccagauacugcgugguuagugagaggggugaggaacgguugcgcagcugucauuuaugcaacgcguccgaccccaaaaaggcacacccuccagccuuucugacagaucuaaauaacccccauaaucucacuuguuggcagucugaaaacuaucugcaguucccucacaaugugacgcuuacccugucguuggggaaaaaguuugaggucacauacgugucacuccaguucugcagcccaagaccggagaguauggcuauuuauaaauccauggacuacggaaggacuuggguacccuuucaauucuauucuacccagugucggaagauguacaaccgcccucaucgagccccaauaacaaagcagaaugaacaggaggcaguuugcaccgauagccacacugacaugagaccccuguccggcggccugaucgcuuuuucaacacucgaugggaggccuagugcccacgacuucgauaacagcccaguguuacaagacugggucaccgcgacggauauucggguggccuuuucucgucugcauacuuucggagacgaaaaugaggacgauuccgagcuugcacgcgacucauauuuuuacgcugugagcgauuugcaggucgguggcagauguaaaugcaacgggcacgccgcuaggugcguucgggaccgagaugacagucuggugugugauugccgccauaauaccgccggacccgaaugugacagaugcaagccguuccacuacgauaggccuuggcagcgggcaacagcccgcgaggcuaacgaauguguagcgugcaauuguaaccuacacgcaagaaggugccguuucaacauggagcucuauaaacugucuggccggaaguccgguggggugugucuuaauugccgacauaacacugccggaagacacugucauuacugcaaagaaggcuauuacagggacaugggcaagcccaucacccaccgcaaggcuugcaaagccugugauugccauccagucggggcagccggaaagacauguaaucagaccacgggucaaugcccuuguaaagacggcgugacugggauuacaugcaaccggugugcuaagggauaucagcagagcagaucgcccaucgccccaugcauaaaaauccccguugcaccuccaaccacugcggcuucuuccguggaggagccggaagacugugauucauacugcaaggccaguaaaggcaagcugaagauuaauaugaaaaaguauuguaaaaaggacuacgcaguccaaauccacauuuugaaagccgauaaggcuggugacugguggaaguuuacagugaacaucauaagcguauacaaacaggggaccuccaggauucgccgaggcgaucagucucucuggauccggagccgugacauugccugcaagugccccaaaaucaagccucugaaaaaguauuuacugcucggaaaugcagaggauucaccagaccagaguggcaucguugcugauaaguccagccuugugauucaauggagagacacgugggccaggcgccugcggaaauuccagcagagagaaaagaaagggaaguguaaaaaggcguga

SEQ ID NO: 59958 - RNA, 1887 nt, Artificial Sequence
  derived and/or modified sequence opt3 from NTN4__Homo_sapiens__NP_067052
augggcagcugcgccagacugcuccuucuguggggguguaccguggucgcugcaggauuguccgguguugccggcgugucuucaaggugcgagaaggcguguaacccccggauggggaauuuagcucugggacgcaaacuaugggccgacacaacuugcggccagaacgcaacggaacucuacuguuucuauagugagaauaccgaucugacaugccgacaaccuaagugugacaaaugcaacgccgcuuacccacaccuugcacaucugccgagcgccauggcugauuccucuuuucguuuccccagaacuugguggcagucggccgaagacguacacagggagaagauccaguuggaucucgaagcggaguuuuauuucacccaucugauugugauguuuaaaucaccucggccagcagccaugguccuggaccgcagccaggauuucgguaagacauggaagcccuacaaauauuuugcuaccaauuguagugccacuuucgggcucgaggacgaugugguuaagaaaggagcaauaugcacauccaaguacucuagcccuuuuccauguaccggcggcgaagugaucuucaaagcucugucacccccuuaugacacggagaacccauacuccgccaagguccaagaacagcugaagauuacuaaucuuagagugcaguugcugaaaaggcagaguugcccgugccaacggaacgaucuaaaugaggagccccagcacuuuacccauuacgcgaucuaugacuucauuguaaaggggagcuguuuuugcaacggacacgccgaucaguguaucccuguucacgguuuccgcccagugaaagcacccggcacauuccauaugguccacgggaagugcauguguaaacauaauacugcuggaucucacugccagcacugugccccucucuacaacgaccgaccaugggaagcugccgacggcaagaccggugcacccaaugagugcagaacauguaaaugcaacgggcaugccgauaccugucacuuugacgugaaugugugggaggcuuccggaaacaggucaggcggcgucugcgaugacugccaacauaacacggaagggcaguauugucagcggugcaagccgggauucuaccgugaucugcgcagaccuuuuagcgcgcccgacgcauguaagccaugcaguugucacccuguugguucugccgugcuucccgcuaauuccguaacuuucugcgauccaagcaacggcgacugucccugcaaaccugggguggccggaaggcggugugaucgaugcauggucggcuauugggguuuuggggacuacggcugucgcccaugcgauugcgcaggaucgugugacccgauaacaggcgacugcaucucuucccauaccgauauugacugguaucacgaagugcccgauuucagaccuguucacaauaagucagagccagccugggagugggaagacgcucaaggguuuagugcccuguugcauagcggaaaaugugagugcaaggaacagacucucgguaacgcaaaagcguucuguggcaugaaguacuccuacgugcugaagaucaaaauuuuaucugcucacgauaaggggacacaugucgaggugaauguaaaaaucaagaaaguuuuaaagagcaccaagcucaaaauauuuaggggaaagcggacgcuuuaucccgaaucauggaccgaccgcggcugcacauguccuauucugaacccagguuuggaguaccuaguggccgggcacgaggauaucagaacuggcaaacugauugucaauaugaagaguuucgugcagcacuggaaacccucccucggaaggaaggucauggacauccugaagcgugaaugcaaauga

SEQ ID NO: 59959 - RNA, 1578 nt, Artificial Sequence
  derived and/or modified sequence opt3 from NTNG1__Homo_sapiens__XP_011539324
auguaccugagcagauuccucuccauccacgcccuuugggugaccgucucuucaguuaugcagcccuauccucugguguggggccauuacgacuugugcaagacacaaauuuauacugaggaagggaaaguaugggauuacauggcuugucagccagagaguacggacaugaccaaguauuuaaaagugaagcuggauccgcccgacauaacaugcggagauccuccagaaacuuuuugugcaauggguaaccccuacaugugcaauaacgagugugacgccagcaccccugaacuagcgcacccacccgagcucauguucgauuuugagggcaggcauccuuccacauucuggcagucugcuaccuggaaagaauauccaaagccgcugcaggucaauaucacucuuucguggucaaagacaauugagcugaccgacaacaucgugauuacguuugaaagcgggcggcccgaucaaaugaucuuggagaaaagucucgacuacggacgcacuuggcagccuuaccaguauuacgccaccgauugccuggacgcauuccacauggauccaaaguccguuaaagaccugucucagcauacagugcucgagauaaucuguacugaagaguauagcaccggcuacacaaccaauuccaagauuauccacuuugaaauuaaagaccgauucgccuuuuucgcugguccccguuuaagaaacauggcaucacuguaugggcaacuugauacgacuaagaaguugagggacuuuuucacagucaccgaucugcggauccgccuacucagaccugccgugggagagauauuuguagacgaacugcaccuugcuagguacuucuaugccauuagugauaucaaaguucggggccgcugcaaguguaaucugcaugcgacugugugcgucuacgacaacagcaaauugacaugugagugcgagcacaauaccacgggcccagauugcgggaaguguaaaaagaacuaccagggacgacccuggucuccggguuccuaucucccuauucccaaaggcaccgcaaauacaugcaucccaucaaucagcaguauugggaacccucccaaguucaauagaauauggccaaacaucucuucccuggaagugagcaaucccaaacagguggccccuaaguuagcucugucgacugucucuuccguucagguggccaaccauaagagggaguguuacugcaacccacucggaucaauucacgaccgguguaauggcagugguuuuugcgaauguaaaaccgggacaacuggaccgaagugcgaugagugucuucccggcaacagcuggcacuauggcugccaaccuaauguaugugacaacgaacuguugcauugccagaaugggggaaccugccacaacaaugugcguugucuaugcccagcagcuuacacagguauccugugugagaaacuccgcugcgaggaagccggcuccugugggucugauagcggacagggcgcgcccccucaugguucaccagcccugcuucuguugaccacucuccuggggacggcaagucccuuagucuucuga

SEQ ID NO: 59960 - RNA, 1593 nt, Artificial Sequence
  derived and/or modified sequence opt3 from NTNG2__Homo_sapiens__NP_115925
augcugcaccuccuugcccuguucuugcauugcuuaccccuggcuagcggcgacuacgauaucuguaaguccugggugaccacagacgaggggccuacuugggaauuuuaugcaugccagccaaaagucaugagacuaaaggauuacguuaaagugaagguagagccgucuggaauuacguguggugaucccccugaaagguucugcucacacgagaacccauaucucuguaguaaugaaugcgacgccagcaaccccgaccuggcgcauccuccacggcuuauguuugauaaagaggaggaaggccuggcuaccuacuggcaauccauaacauggucucgcuaucccucgccuuuggaggccaauaucacucucucauggaacaagaccguggaacugacagacgaugucgugaugaccuucgaguacgggcgaccaacuguuauggugcuggaaaagagccucgacaauggacguacauggcagccguaucaguuuuacgcagaagauuguauggaggccuucggcaugagugcuagaagggcacgggacauguccucuagcuccgcccaccgcgucuuaugcaccgaagaguacucaagaugggcugguaguaaaaaggaaaaacaugugagguuugagguacgggaucgcuucgccauuuuugcggggcccgaccugcgaaacauggacaaucuuuauacgagauuggagagcgcaaagggacugaaagaguucuuuacucuaaccgaucucaggaugcggcugcuucguccugcccugggcggcacauacguucagcgcgagaacuuguauaaguacuucuaugcuaucucuaauauugaagugaucgggagauguaagugcaaccuccacgccaaucuguguuccaugagggagggaucauuacaaugcgaaugcgagcacaacacuaccgguccagacuguggcaaaugcaagaaaaauuuucggacacgaagcuggcgcgcagggaguuaccugccccucccucauggaucuccaaacgcuugugccaccgcgggcuccuucgguaauugcgaguguuaugggcacagcaacagaugcucguacauagauuuccuuaacgucgugacgugugugucuugcaagcauaauacuaggggacagcacugucagcacugccggcugggcuacuaucgcaacggcuccgccgaauuggacgaugagaaugucuguaucgaaugcaacugcaaucagauugggucaguucaugacagauguaacgagacaggauuuugcgaauguagggagggugcagcuggccccaaaugcgaugacugucuaccgacccacuacuggcgucaagggugcuauccuaaugugugugaugacgaucagcugcucugccagaacggaggcacuugucugcagaaucaacggugcgccuguccccgagguuacacagggguaagaugcgagcagccaaggugcgacccugcugacgaugacggcggacuugauugugaccgcgcccccggcgcagccccacggcccgcuacccuguuggggugccuccuguuacugggacuagcggcaagacucgguagguga

SEQ ID NO: 59961 - RNA, 573 nt, Artificial Sequence
  derived and/or modified sequence opt3 from NTPCR__Homo_sapiens__NP_115700
auggccagacacguguuccugaccgggcccccuggggucggaaagacaacucucauccauaaagcuagcgagguucuuaaguccucuggugugccaguagacggcuuuuacacggaagaggugaggcagggcggacggcgcauuggcuucgaugucgugacccugucagguacacgagggccguugagucguguuggauuagaacccccuccaggcaaaagagagugcagggugggccaauaugucguggaccugacuagcuuugaacagcuagcacuccccguacugcggaacgccgauuguuccucugggccuggacagcgcguuugcgugauagacgagaucgguaagauggagcuuuucucgcagcuguuuauucaagcggucagacagaccuugucaacaccaggcaccaucauucucgggacuauccccgugccuaaaggaaagccacuggcucugguggaagagauaaggaaucggaaggaugucaaaguuuucaacgugacaaaggaaaaucgcaaccaccucuuaccggacaucguaaccugugugcagagcagucgaaaauga

SEQ ID NO: 59962 - RNA, 2283 nt, Artificial Sequence
  derived and/or modified sequence opt3 from NTRK1__Homo_sapiens__NP_001007793
augaaggaggccgcucugaucugccucgcacccagcgugccuccaauucuuaccgucaaauccugggacacaaugcagcugagagccgcgaggucucgguguacuaacuuguuagcugccucauacauagaaaaucaacagcaccuucagcaucuagagcuccgcgaucugcgaggccuuggggaacugcguaacuugacgaucguuaagaguggacucagauucguggcaccggacgccuuucacuucacccccaggcugagccggcugaaucucuccuuuaacgcuuuagagucucugucguggaaaacaguacagggucuuucauugcaagaacuggugcuaagcggcaauccucuccauugcaguugugcacugcgcuggcuucagagaugggaggaggaagggcugggaggcgucccagagcagaaguugcagugccacggucaagggccccucgcccauaugccuaacgcuuccuguggagugccaacucugaaaguucaggugcccaaugccucugucgaugugggcgacgauguauuacugaggugccagguugaaggccgggggcucgagcaggcgggauggauucuuaccgagcuggaacaaagcgcaacagugaugaaguccgguggcuugccuucacuagggcugacccucgccaacgucacaagugaccugaaucgcaagaacgugacuuguugggcugagaaugaugugggacgagccgaagucagcguucaggugaacguaucuuucccagcauccgugcagcuucacaccgcugucgagaugcaccauuggugcaucccguuuucaguggacggccaacccgccccuagccugagaugguuguucaaugguaguguucucaacgaaacgucuuuuauuuucacugaguuucuggagccagcggccaaugaaaccgugaggcacggguguuuacggcugaaccagcccacacaugucaacaauggaaacuauacucuacucgcagcuaauccuuucggccaggccuccgcuagcaucauggccgcauuuauggauaacccauucgaguuuaaucccgaagacccgauaccugauaccaacucgacaucuggcgaccccguggagaaaaaggaugaaaccccauucgggguauccguugccgugggacuggcugucuucgcgugccuguuuuugucaacgcugcuccuggugcuuaauaaauguggucgucgcaacaaguucggcaucaauagaccugcaguccuggcccccgaggacggguuggcuaugagucuccacuuuaugacucugggaggcagcuccuuaucuccaacagaggguaaagggagcggccugcagggacacauuaucgaaaacccccaauacuucucagacgccugcgugcaucacauuaagaggcgggauaucguucuaaagugggagcucggcgaaggggcauuuggaaaaguguuccuggccgagugccauaaucuuuugccugaacaggacaagaugcugguagcugucaaagcccucaaggaggcaagugaguccgcgcgacaggauuuucagcgcgaagcugagcuguuaaccaugcugcaacaccagcauauagugagauucuuugguguuuguacugaaggcaggccacuuuugaugguguucgaguauaugcggcacggggaccucaaccgcuuucugagaagccacggaccggaugccaaacuacuggcaggcggugaggacgucgcccccgggccucucggccugggacagcuuuuggcuguggccucucagguagcagcuggcaugguguaccuggccggguuacauuucguucacagggaucucgcgacacguaauugccuggucggacaaggucuuguggugaagauuggcgacuuugggaugucacgggauaucuauaguaccgacuacuaucgagucggaggcagaacgaugcugccaauuagguggaugcccccugaaagcaucuuguaccgcaaauucaccacagaguccgauguuuggucuuucgguguggugcucugggaaaucuuuacuuacgggaagcagccaugguaucagcugucgaacaccgaggccauugacuguauaacacagggccgggaacuagagagacccagggcuugcccgccugagguauacgcaaucaugcgcggauguuggcaacgagaaccacagcagcggcauagcauuaaggacguccacgcccgucugcaagcucucgcccaggcacccccuguguaucuggauguucuuggcuga

SEQ ID NO: 59963 - RNA, 1662 nt, Artificial Sequence
  derived and/or modified sequence opt3 from NTRK2__Homo_sapiens__NP_001018075
augagcuccuggaucagauggcacggccccgccauggcuaggcuguggggguucugcuggcucguggucggauuuuggcgggcagccuucgcguguccuaccucuugcaaguguucagcuagucgcauuuggugcagcgacccauccccggguauaguugccuuuccccgacuugagccuaacucuguggauccagaaaauaucacagagauuuucaucgcaaaccagaaacgucuggaaauuaucaaugaggacgauguagaagccuacgugggcuugagaaacuuaacuauagucgacucggggcugaaguuuguggcucauaaagcauuccuaaagaacucaaaucuccaacacaucaauuuuacgaggaacaaacugaccagccuuagucggaagcauuuccgccaccuggauuuguccgagcucauucugguuggaaaucccuuuacauguucuugcgacaucauguggauuaagacucugcaggaggccaaaagcuccccugauacccaggaccucuauuguuuaaacgaaucaaguaagaauaucccacuggcuaaccuucagauacccaauugcggcuugccuagcgccaaccuggcggcaccaaaucuaacaguggaggaagguaaaucuauuacccucuccuguucagucgccggggauccggugcccaacauguacugggacguaggaaaccugguuagcaagcauaugaaugagacuucccacacacaaggcucucuuagaaucaccaacauuuccagcgaugacucgggcaaacagaucucuugcguggcugagaaucuggucggggaagaucaggacuccgugaacuugacggugcacuucgccccuacuaucaccuuucucgagucaccaacaagugaccaucacugguguauucccuucacugucaagggaaauccuaagccagcacugcagugguuuuauaacggugcuauauuaaaugaaagcaaauacaucugcaccaagauucauguuacaaaccacaccgaguaucacggcugccugcaacucgauaaucccacgcauaugaacaauggggacuacacucuuaucgccaaaaacgaauauggaaaggaugagaaacagauauccgcgcacuucaugggcuggccggguauugacgauggggccaauccuaacuaccccgacgugaucuacgaggauuauggaacagcagcuaaugacaucggcgauaccacuaacaggucuaacgaaauuccaagcacagacguaaccgauaagacgggccgggagcaucugucaguguacgccgucgugguuaucgcuaguguggucggguucuguuugcuagugaugcuguuucuccugaaacuugcccgccacuccaaguucggaaugaaggacuuuagcugguucgguuuuggcaaaguaaagucucgacaggggguuggaccugcaucagugauuaguaaugacgaugacagcgccaguccccugcaucacauaucuaacggcucgaauaccccaagcuccucagaaggugggcccgaugcugucaucauuggcaugacaaaaaucccugugaucgagaacccacaguauuucggaauuacuaauagucaauugaagccggacaccuggcccagaggcucuccuaaaacagcguga

SEQ ID NO: 59964 - RNA, 1839 nt, Artificial Sequence
  derived and/or modified sequence opt3 from NTRK3__Homo_sapiens__NP_001007157
auggacgugagccugugccccgccaaguguuccuucuggagaaucuuucuccuuggcucugucuggcuggauuacguugggucaguguuggcuugcccugcaaacuguguaugcaguaaaaccgagauuaauuguaggcggccagacgauggaaacuuauucccgcugcuagaaggucaggacagcggcaauuccaacgggaaugccucuauaaacaucacagauauuucgcgcaauaucacuucaauucacaucgagaacuggcgaagccuccauacgcugaaugcgguggacauggaacuuuauaccggacugcaaaaguugacaaucaaaaacaguggccuccguuccauacagcccagagcuuuugccaagaauccucaccugagguacauuaaccugucuagcaaucggcucacuaccuuauccuggcagcuguuccagacacuuucauugcgcgagcugcaacuagaacagaacuuuuucaauugcaguugugauaucagauggaugcagcucuggcaggagcaaggugaggcaaaacugaacagccagaaccuuuauugcauuaaugccgacgggucucagcugccauuguuuaggaugaacaucucccagugugaucuccccgaaauaucagucagccaugugaaucugaccguucgggagggagacaacgcugugauuacuugcaauggcaguggcucuccuuuaccagaugucgacuggaucgugacagggcugcaauccauuaacacccaccagacgaaucucaacuggacuaauguacaugcaaucaaccuuacccugguuaaugugacaagcgaagauaacggauucacuuugaccuguaucgccgagaaugucguggguaugucgaacgcuucuguggcccuaacagucuacuaucccccucgcguugugucccuggaggaaccagagcuccgacuggaacacugcauugaguuuguagugagaggcaauccgcccccuacccuucacuggcugcauaacgggcagccauugagggaaucaaagauaauccacgucgaguacuaucaagagggagaaauuagugagggcugccuccuguucaacaagcccacgcauuacaauaacgguaauuacacuuuaaucgcgaaaaacccucuggggacagcaaaucagaccauaaacggacacuuucuaaaggaaccauuccccgagagcacugacaauuuuauucucuucgacgaaguguccccgacaccucccaucaccguuacgcacaaaccagaggaggauaccuucggcgugucuaucgccgucggccuggcugccuuugcaugugugcuuuugguaguucuguucgugaugauuaacaaguaugggcggcguagcaaauuuggaaugaaggguccugucgcugugaucucaggcgaagaggacagugccagcccccuccaucacauuaaucaugggauaacaacuccauccucucuggaugcgggacccgacaccgucgugaucggcaugacacgcauuccuguuaucgaaaacccacaguacuucagacagggucacaauugccauaagccggauacuuggguguuuucaaacaucgacaaucacgggauucuuaaccugaaagauaauagggaccacuugguacccaguacccauuauauauacgaggaaccugagguccaaagcggcgagguguccuauccacggucucacggauuccgagaaaucaugcucaaccccauuucgcugccuggccauagcaagccauuaaaccacgggaucuacguugaggaugugaaugucuauuuuuccaaaggacgccacgguuucuga

SEQ ID NO: 59965 - RNA, 513 nt, Artificial Sequence
  derived and/or modified sequence opt3 from NTS__Homo_sapiens__NP_006174
augauggccggcaugaagauccagcuggugugcaugcuccuucuggcuuucagcuccuggucuuuguguucagacagugaggaagagaugaaagcauuagaagccgauuuucugaccaacaugcacacaagcaagauuuccaaagcgcauguccccucuuggaagaugacucuacucaauguuugcucgcuggugaacaaucuuaacagcccugcugaggaaacgggggagguacacgaggaggaacugguggccagaaggaaauugccaaccgcacucgacggauucucacuggaagccaugcugacaauauaccaacuccauaagaucugucacagucgggcuuuucagcauugggaguuaauucaggaggauauccuggacacugguaaugauaagaacggcaaagaagaggucauuaagcgcaaaaucccguauauacuuaagcgacaguuguacgaaaauaaaccccguagaccuuauauccugaagagggacuccuacuauuacuga

SEQ ID NO: 59966 - RNA, 1257 nt, Artificial Sequence
  derived and/or modified sequence opt3 from NTSR1__Homo_sapiens__NP_002522
augagacugaacagcuccgcccccggcaccccugggacaccagcugcagacccguuccagagggcccaagcgggacucgaggaagcccuucuggcucccgguuuuggcaaugcaucugggaacgccucagagcggguguuggcugcaccuaguagcgaauuagaugucaauacugacaucuacuccaagguucuggugacggccguauaucuagcucucuucguggucggaaccgugggcaacacaguuacugccuuuacccuggcgcgcaaaaagucucuucagucgcugcagucaacagugcacuaccauuuggguagccucgcacugagugaucugcucaccuuacugcuugccaugccagucgaguuguauaauuucauuugggugcaccaucccugggcuuuuggggacgccggaugccgaggcuacuauuuccugcgugaugcauguacuuacgcuacagcccuaaacguagcgucccucucuguugaaagauaucuggccauaugccacccuuuuaaagcaaagacccuuaugagcaggucccggacgaaaaaguucaucucagcuauuuggcuggccagugcuuugcucgccgugccaaugcuguuuacuaugggcgagcagaaucgcagcgcagacgggcaacaugccggagguuuagucuguacccccacaauccacacugcuaccgugaagguggucauucagguuaacacauucaugucuuuuaucuucccuauggugguaauauccgugcugaauaccaucauugcgaacaaacucacggucauggugagacaggcagccgagcagggccaaguuugcacugucgggggagaacacucaacauuuagcauggcuaucgagccaggcagggugcaggcccuucggcauggugugcgcguacugcgagcaguugugauugccuucgucguguguugguugccguaccacgucagaaggcuaauguucugcuacaucagugaugaacaguggacccccuuucuguaugacuucuaccauuauuuuuacauggugacuaaugcucucuucuauguuucuuccacaauaaacccuauucuguacaaucuugugagcgccaacuuucggcacaucuuccuggcaaccuuggcgugucucugcccaguauggcgucgcagaaggaagcggcccgcuuuuucgcgaaaagccgauucugucuccucaaaucacacgcugaguagcaacgcaacccgcgagacauuauauuga

SEQ ID NO: 59967 - RNA, 1233 nt, Artificial Sequence
  derived and/or modified sequence opt3 from NTSR2__Homo_sapiens__NP_036476
auggagaccagcucccccagaccuccaaggccgucuucaaaccccggccugagucucgacgcccggcuugggguggauacacgccugugggcuaaggucuuguucacugcauuauacgcccugaucugggcgcuaggagcugccgguaaugcacucagcguucacgugguacugaaagcccgagcuggccgugcagggagacuuaggcaucacgugcuguccuuggcccucgcuggacugcugcucuuacuggucggcgugccuguugaacuuuauucuuuugugugguuccauuacccaugggucuuuggugacuuggggugccggggauauuacuucgugcacgagcugugugccuaugcgacgguacuaucgguugcaggccucucagccgaacgcugccuggcugugugucagccccuuagagccaggagccuguugaccccucggcgcacacgauggcucgucgcacugaguugggcugccuccuuaggccuggcgcucccaauggccgugauuauggggcaaaagcaugagcuugaaacugcagauggagagcccgagccugcuucuagagugugcaccguccugguuagcaggacagcccuccagguguuuauacagguaaacgugcuagucuccuucgugcugccacucgcucugaccgccuuucuuaaugguguuacugugucacaccuguuggcacucuguagucaggucccgagcacaucuacccccggcuccucaacgccuagccggcuggaauuacugagugaggaagggcuacucucuuucaucguguggaaaaagacuuuuauucaaggaggccagguaucccugguucgucacaaagacgugcgcagaaucaggagccuucagcggucgguccagguguugcgagccauugucgugauguacguuaucugcuggcugccauaucaugcucgcagacucauguacuguuacgugcccgaugacgcguggaccgauccucuguauaacuucuaccacuauuuuuacaugguaacaaauacucuuuucuaugucucuuccgcagugaccccacuguuguacaacgccguuucaaguagcuuuaggaaguuguuccuggaggcuguguccucuuuaugcggugagcaucaccccaugaagcggcugccgccuaaaccccaaagcccaacacuaauggacaccgccucaggguucggagauccucccgaaacgcgcacuuga

SEQ ID NO: 59968 - RNA, 1986 nt, Artificial Sequence
  derived and/or modified sequence opt3 from NUAK1__Homo_sapiens__NP_055655
auggagggcgccgcugcacccguggccggggacagaccugaucugggacucggugcgccaggcagcccgagggaagcugucgccggggcaaccgccgcucuugagccccggaagccucacggaguuaaacgccaucaccauaagcacaaccugaaacaucgauacgaauugcaggagacauuaggcaaggguacuuaugggaaagugaagcgugcaacggaaagauucuccggaaggguaguggccaucaagucuauucggaaagacaagauaaaagaugagcaagacaugguccacauccgcagagagauugaaaucaugucaagucugaaucacccacauauuaucagcauauacgagguguuugaaaacaaggauaaaaucguuauuaucauggaguaugcuuccaagggcgagcuauacgacuauauuucugaaaggcggcgccucucggagcgagaaaccagacacuucuuuaggcagaucgugucagccguccauuacugccacaagaauggcgugguacaccgggaucugaaacuugagaacauacuguuggacgauaauuguaacauuaagaucgcggacuucgggcucagcaaucuguaucagaaagauaaguuucugcagacauucugcggaaguccccucuacgcauccccugaaauuguuaacggucguccauaccgcggccccgagguggacucuugggccuuagggguccugcuuuauacuuugguguacggaaccaugccuuuugauggcuucgaccauaaaaaucugaucagacaaaucagcuccggugaguauagggaaccaacacagccgucagacgcucgggggcuaauucgauggaugcucauggugaaccccgaucgcagagccaccauagaggacaucgcaaaucacuggugggucaacuggggauacaagaguagcguuugugauugcgacgcucugcaugauucugaauccccucuucuggccaggauuaucgacuggcaccaucggucaacuggcuugcaggcggauacagaggccaaaaugaagggccucgcaaagccaaccacgagcgaagugaugcuggagcgccagagaagucuuaaaaagucuaaaaaggagaaugacuuugcucaauccgggcaggaugccguacccgaaagcccuucgaaacugucuuccaagaggccaaagggaauacucaaaaagcguucaaacagugagcaccggagccacuccacugguuucauugaaggcguggucgggcccgcuuuaccgucuaccuuuaaaauggagcaggaccugugucgaacaggaguguugcuaccuagcucacccgaagccgagguuccaggcaagcugaguccuaaacaguccgcaacuaugcccaagaaggguauccucaaaaagacccaacagagagagagcggguauuacucuucaccagaaaggagugagagcuccgaacugcuugauucuaaugacgugaugggcucgagcauccccuccccuucaccaccggaccccgcccgcgucacaagucauucucugagcugccggagaaaaggaauuuugaagcacuccucaaaauauagcgcuggcaccauggauccugcgcucgugucuccagagaugcccacgcuggaguccuuaagugaaccugggguaccagcagagggacugagcaggucuuacucccgccccucaaguguuaucagcgacgauucggugcuauccucugacagcuucgaucuccuggaccuucaggaaaaccgaccggcccggcaacguauuagaucaugugucagugcugagaacuuuuugcagauacaggauuucgaaggucugcagaauaggccucgcccacaauaccucaagcgguauagaaacaggcuggccgacuccucuuucagccuucugacugauauggacgaugugacacaggucuacaagcaggcauuggagaucugcuccaaacucaauuga

SEQ ID NO: 59969 - RNA, 2019 nt, Artificial Sequence
  derived and/or modified sequence opt3 from NUAK2__Homo_sapiens__NP_112214
augcugugcuucaccgccagaagcggcacagcuguggcacccaggccuggggccggaccagucccgcgggcguccgcucuccccgcccagccuacugacucuccagcagcccuugcucaccuguuguuagcaauggagucacugguuuuugcccgccgaaguggucccacgccuagcgcugccgaacuagcgcguccacucgcagagggccugaucaagucccccaaaccucuuaugaagaaacaagccgugaagagacaucaccauaaacacaaccugaggcaucgguacgaguucuuggaaacccucgggaagggaacauauggcaaggugaaaaaggcucgcgaaucuucggguagacugguagccauuaaaucaauaaggaaggauaaaaucaaggacgagcaggaucugaugcacauucggcgcgagaucgaaauuaugagcagucucaaucacccacauaucauagcaauccacgaggucuuugaaaacuccucuaagauugugaucguuauggaguacgcuagccgaggggacuuauaugauuacauuuccgagagacagcagcugucagaaagggaggcccggcauuucuuucgucaaaucgugagugcgguccacuauugucaccagaaucgcgugguacauagagaccuuaaauuggaaaacauacugcuagaugccaauggaaacauuaagaucgcagacuucggccucagcaaucuguaccaccagggcaaauuucuucagacuuucugcgggucuccgcuguaugcuucccccgagauuguuaacggaaagccuuacaccgguccagaaguggauucauggagcuugggcguccuccuguacaucuuagugcaugggacaaugcccuuugacggacacgaucauaaaauccuggugaagcaaauuaguaauggcgccuauagggagccuccaaaacccucugacgcuuguggucucauacgguggcuucugauggucaacccgacccgacgcgccacuuuggaggauguugcaucccacuggugggugaauuggggguacgccacaagaguaggagaacaggaggcuccucacgaaggcggccaucccgggagcgacucggcgagggcaucuauggccgacuggcuacggcgcuccucaagaccacugcucgagaacggagcuaaggugugcaguuucuuuaagcagcacgccccugguggcgggagcaccacgcccggacuggaaaggcagcauucccuuaaaaagucucguaaagagaaugauauggcacaaagccugcacucagacacugccgaugacaccgcucaccggccaggcaagaguaacuugaaacuccccaaggguauccugaagaaaaaggucuccgccagcgcagagggggugcaggaagauccuccagaguuaucuccgauucccgcgucaccuggccaggcugccccacugcuacccaaaaagggaauccucaaaaagccucgacaaagagaaaguggcuauuacagcuccccagagcccucugaaucgggggagcugcuugacgcaggagauguuuucgugagcggugacccgaaggagcagaaaccuccacaggccuccggcuugcugcuccauaggaaggggauacugaaacuuaauggaaaguuuucacagacagcucuggaauuggccgcacccacuaccuucggcagucucgaugagcuggcuccuccccgcccauuagcccgggcgucuagaccuagcggugccgucuccgaagacucaauucugagcucugaguccuucgaucaacuagaccuccccgagaggcugccagaaccgccucuucgcgggugugugaguguagacaacuugacaggccuggaggaacccccaagcgagggacccggcucuugccuccgacgguggcgucaggauccucugggggacuccuguuuuucauuaaccgauugccaggaaguuacggcuacuuauagacaggcacugaggguguguaguaaacuuacauga

SEQ ID NO: 59970 - RNA, 1920 nt, Artificial Sequence
  derived and/or modified sequence opt3 from NUB1__Homo_sapiens__NP_001230280
augaagaccaacggcgggaggugcaggauccgggcccuguguuggagccgccgagaguggcguggagcugguauggcacagaaaaaguaccuccaagccaaacuuacacaguuccugagagaagacaggauucaguuguggaagcccccuuauacugaugagaauaaaaaggugggcuuagcgcugaaggaccuagcuaaacaguacuccgaucggcucgaaugcugugagaacgaagucgagaagguuauagaggaaauccgcugcaaagccauugagagagggacgggaaaugacaacuauaggaccacaggcaucgcaacuauugaaguguuucugccaccgcggcuuaagaaagaucgcaagaaucuguuggagacccgacuccacaucacagguagagagcugaggucuaagauagccgaaaccuucgggcugcaagagaacuacaucaaaauuguaaucaauaagaaacagcuccaguuaggaaagacucuggaagaacagggcguggcucauaacgucaaagcaauggugcuugaauugaagcaaucagaggaggacgcccggaaaaauuuucagcuggaagaggaagaacagaacgaagcuaagcuaaaggagaaacagauucaacguacaaagcgcggccucgagauccuggccaaaagagcggcagaaaccguuguggaucccgagaugacgccuuaucuugacauagccaaucagacugggaggaguauucggaucccacccagcgaacgaaaggcucugauguuggccaugggauaccacgagaaaggucgcgcauuccucaagagaaaggaauauggcauugcucugccuuguuuacuggaugccgacaaauacuuuugcgaguguugcagggagcuccuugauaccgucgacaacuacgcggugcugcaguuggauaucguaugguguuauuuccggcuagaacaacuggagugccucgacgacgccgaaaagaaacugaaucuugcacagaaguguuuuaaaaacugcuacggggagaaucaucagcgccugguucacaucaagggaaacugcggcaaggagaaaguguuguuccucagacuguauuuacugcaggguauuaggaacuaccauuccgggaaugaugucgaggcuuaugaguaccuaaacaaggcccgucaacucuuuaaagaacuguauauagacccaucuaagguggauaaucuuuugcagcugggauucacagcucaggaggcccggcucggccugcgagcaugugacggcaacguggaucacgccgcuacucacaucaccaauagaagggaggagcuugcgcagauucgcaaagaggaaaaggagaagaaacggagaaggcuggaaaacauccgcuuuuugaaggggaugggauacucgacacaugcagcccaacagguccuccacgcugccucagguaaucuggacgaggcauuaaaaauacugcuaagcaacccccagaugugguggcucaaugauaguaacccugaaaccgacaaucgacaggaguccccaucucaagagaacauugaucggcugguuuacaugggcuucgacgcccuuguggcugaagccgcauugcguguauuuagagggaaugugcagcuggcggcucagacgcucgcccauaacggaggcagccugccgcccgaguuaccucuguccccagaagauucacuuagucccccugcaacuagcccaucugacuccgccgguacaucaagcgcuaguaccgacgaggauauggaaacugaggccgucaaugagaucuuggaagacauccccgagcacgaagaggauuaucucgacucuacacuggaggaugaagagauuaucauugcagaauaccuauccuauguggagaacagaaagagcgcuaccaaaaagaacuga

SEQ ID NO: 59971 - RNA, 930 nt, Artificial Sequence
  derived and/or modified sequence opt3 from NUBP1__Homo_sapiens__NP_001265435
auggaggaagugccccacgacugcccuggcgccgauagcgcucaggcagggagaggagccuccugucaagguugcccaaaccagaggcugugugcgucuggcgcuggggccaccccggacacagcaaucgaggaaauuaaggagaaaaugaagacugucaaacauaagauacucguucuuucaggaaaaggcgguguggggaagaguacguucagcgcccaccuggcucauggauuggcagaagaugagaauacccagaucgccuuacuggacauugauaucugcggccccuccauuccuaagaucaugggccuagagggggaacaguacguagaggacaaccucggagugaugucugucgguuuucugcuuucgucaccagaugacgcugugauauggcggggccccaaaaagaaugggaugaucaaacaauuccugcgcgauguugacuggggagaaguggauuauuugauugucgacacaccuccaggcacuagcgaugagcaccucagugugguacgauaccuggccaccgcgcauaucgacggugcaguuauuaucacaacuccccaggaggugucccugcaggacguccguaaggaaauaaacuuuuguagaaaagugaagcucccuauuaucgggguggucgagaauaugucuggauucauuugcccaaaguguaaaaaggaaagccagaucuuuccgcccaccacaggcggcgccgaguuaaugugccaagaucuggaaguuccucuuuuggggagggugccacuggacccccuaaucgguaaaaacugugauaagggacaguccuucuuuauugacgcuccugauucaccagccacccucgcauaucggaguauaauccagcgcauucaggaguucugcaaucugcaccaaagcaaagaggaaaaccuuaucucuuccuga

SEQ ID NO: 59972 - RNA, 816 nt, Artificial Sequence
  derived and/or modified sequence opt3 from NUBP2__Homo_sapiens__NP_036357
auggaggccgcugcagaacccggcaaccuggccggggugagacacaucauucucguccuuagcggaaaggguggcguugggaaauccaccauaucuacagagcuggcguuggcuuuaaggcaugccggaaagaaagugggcauccuggacguagaucuaugcgguccuucaauuccacggaugcucggggcacagggacgcgccgugcaccaaugugaccgaggcugggcuccggucuuccuggaucgugaacagaguaucagccuuauguccgugggcuuucuguuggagaagcccgacgaagcaguuguguggagagggccuaaaaagaaugcccucauuaagcaguucgucucugauguggcuuggggagagcuggacuaccugguaguugauacuccacccgguacgucggacgagcauauggccaccaucgaagcgcucaggccuuaucagccauuaggcgcacugguggucacaacuccccaagccgugucagugggggauguccggcgcgagcuuaccuuuugcagaaaaacaggauugaggguuaugggcauaguggaaaacaugagcgguuucaccuguccucacugcacugaguguacaaguguauuuucccgcgggggaggcgaggaacuggcucagcuagccggcgugccauuccucgggucugucccgcuggaccccgcacuuaugcggacccuggaggaaggacaugauuuuauccaggaguucccugguagcccagcuuuugccgcguugacguccauugcccagaagauccucgacgcaacucccgcuugccugccuuga

SEQ ID NO: 59973 - RNA, 672 nt, Artificial Sequence
  derived and/or modified sequence opt3 from NUBPL__Homo_sapiens__NP_001188502
augagcaaggccaucggccugcucgacguggaugucuacgggcccuccguuccuaaaaugaugaaccuuaagggaaauccagagcugucucagucaaacuugaugagaccguuacugaauuaugguauugcuugcaugaguaugggcuuccuaguggaagagagcgaacccguaguguggagggggcucauggucauguccgcaauagagaaacugcuucggcaaguggacuggggacagcuggauuacuugguuguggacaugccuccaggcaccggugauguccagcucucugugucgcagaacauccccauuacaggggccguaaucguuucaacuccucaagacauugcgcugauggaugcucacaagggagccgaaauguuucgccgagugcaugucccagugcugggccucgugcagaauaugagcgucuuccagugucccaaaugcaagcacaagacgcauaucuuuggcgcagacggggcccguaaauuagcucagacccugggacuugagguuuugggugauauaccucugcaccuaaacaucagagaggcaagugacacaggccaaccaauuguguucucccagccggaaucugaugaggccaaggcuuaucucaggaucgccguagaagugguccggcgccugcccagcccuuccgaguga

SEQ ID NO: 59974 - RNA, 1386 nt, Artificial Sequence
  derived and/or modified sequence opt3 from NUCB1__Homo_sapiens__NP_006175
augcccccuagcggcccaagagggacccugcuccuucugccguuguuacugcuacuccugcuuagggccgugcuggcuguccccuuggagcggggagcaccuaacaaggaagagacaccagccacugaaucccccgacacgggucucuacuaucaccgcuaccugcaggagguuaucgaugugcuggaaaccgacggccauuuccgagagaaacuccaagcggcuaaugccgaggauauuaagucugggaaauuaucacgugaacuggacuuuguaagucaccaugugagaacaaaacuugaugaguugaagaggcaggaagucagccggcugcgcaugcuacucaaggcaaagauggacgccgagcaggauccuaacgugcagguugaccaccugaaucuucugaaacaauucgagcauuuggauccacagaaccagcacacuuuugaagcuagagaccucgagcuguuaauacagaccgcaacaagggaucuggcccaauaugacgcugcccaccaugaagaguucaagcgguacgaaaugcucaaagagcacgagcgccgaagauaucuugaaucccugggagaggaacagaggaaggaggcggaacggaaauuggaggagcagcagcgucgccauagagaacaccccaaggugaaugucccuggcucucaagcacagcuaaaggaggugugggaagaacuggauggucucgacccaaacagguuuaauccgaaaaccuucuuuauccugcacgacauuaacucggaugggguacuugacgaacaggagcuggaggccuuguucacuaaggaacucgagaaaguuuacgaucccaagaaugaagaggacgauaugcgggagauggaagaggaacgacugcgcaugagagagcaugugaugaaaaacgucgacacaaaucaagauagguuagugacccuggaagaguuucuagcuucaacgcagcggaaggaguucggagacacuggcgaaggcugggagaccguggaaaugcacccugccuauacagaggaggagcuccgcagauuugaggaggaacuggcagcuagggaagccgagcuuaacgcgaaagcccagcguuugagccaggaaacugaggcacuggggcggagucaaggacgacucgaggcucagaagagagaacugcagcaggccguccuucauauggagcaaaggaagcagcagcagcaacagcagcagggucacaaagcuccagccgcacaucccgaaggccaacugaaguuccacccugauaccgacgauguuccagugcccgccccggcuggggaccagaaagagguagacacauccgagaagaaauugcucgaacgccugccugagguggaagucccccagcacuuauga

SEQ ID NO: 59975 - RNA, 1263 nt, Artificial Sequence
  derived and/or modified sequence opt3 from NUCB2__Homo_sapiens__NP_005004
augagauggaggaccauccugcuccaguacugcuuccuucugauuacauguuuguuaacugcccuggaggcugugcccauagacaucgauaagacgaaaguccaaaacauucacccuguugaaagcgcaaagaucgagccaccggacaccggccuauauuacgaugaauaucucaaacaggugauugacguacuggagacagauaagcauuuucgggaaaaacuucagaaggccgacaucgaggagauaaaguccgggcgccugucuaaagaauuggaucucgugucacaccauguccgaacuaagcuggacgagcugaaacgucaggaagugggaagacucaggauguuaaucaaggcgaaacuggauagucuucaagacauugguauggaucaccaggcuuugcugaagcaguucgaccaucuaaaucaccucaaccccgauaaguuugagagcaccgaccuggacaugcuuaucaaagccgcaacauccgaucuggagcacuacgacaagacccggcaugaagaguucaaaaaguaugaaaugaugaaagagcacgaacgcagagaguacuugaagacucucaaugaggagaaaaggaaggaggaagagucuaaguuugaagagaugaaaaagaaacaugagaaccacccuaagguuaaucacccaggcucgaaagaucagcugaaggaagugugggaggaaacagacggguuagaucccaacgacuucgauccuaagaccuuuuucaaacugcaugacgucaauucagauggauuucucgacgagcaagaacuugaggcccuguucacgaaggaguuggaaaaaguguaugauccaaagaacgaggaagacgacaugguagagauggaggaagaacggcuacgcaugcgagaacacguuaugaaugagguggauacuaacaaagacagacuggucacccucgaagaguuucugaaggcuacagagaagaaagaguuccuugagcccgauagcugggaaacucuggaccagcagcaguuuuucaccgaggaagaguugaaggaguacgaaaauauuaucgcacuccaagagaacgaacugaaaaagaaagccgaugaguuacagaagcagaaggaagaacugcaaaggcagcaugaccagcuagaggcucagaaacucgaauaccaccaagugauacagcagauggagcagaagaaacugcaacagggcauuccuccaagugguccggccggggaacuuaaguucgagccccauaucuga

SEQ ID NO: 59976 - RNA, 732 nt, Artificial Sequence
  derived and/or modified sequence opt3 from NUCKS1__Homo_sapiens__NP_073568
augagcagacccgugaggaaccggaaggucguugacuacucccaguuccaagagucugaugacgccgaugaagacuauggccgcgauucagggccuccaaccaaaaagauccgaaguagcccgcgugaggcuaaaaauaagagaagguccgguaaaaacucucaggaagacucggaggauucagaagacaaggaugugaagacuaaaaaggacgauagccacagugcagaggacuccgaggaugaaaaagaggaccauaagaauguacggcagcagcgccaagccgcgucuaaagcugccagcaagcagagagaaaugcugauggaggacgugggauccgaggaagaacaggaagaggaagaugaggcacccuuucaggagaaggacucaggcagugaugaagacuuccucauggaggaugacgaugacagcgauuacgggucuuccaaaaagaaaaacaagaaaauggucaagaaaucaaagccugaaaggaaggagaaaaagaugccaaaaccccggcuuaaggccacagugacgccuagcccaguuaaaggaaagggcaaggugggucgccccaccgcuaguaaagcaucuaaggagaaaacaccuuccccaaaggaggaggacgaggaaccggaaucgcccccugagaaaaagacuagcaccucuccacccccugaaaaguccggggaugagggaucagaggacgaagccccaaguggcgaggacuga

SEQ ID NO: 59977 - RNA, 1665 nt, Artificial Sequence
  derived and/or modified sequence opt3 from NUDCD1__Homo_sapiens__NP_001121683
augcuguaccuccagggcuggagcaugcccgccguggcugaggucaagcuaagagacgaucaauauacccuggaacacaugcaugcauucgggauguacaacuauuugcacugcgacuccugguaccaggauucuguuuauuacaucgacacauuaggaaggauuaugaaucugacugugaugcuagauacggcccucgguaaaccucgggagguauuucgccugccaaccgaccuuacagcgugugauaaccgacugugcgcuucaauacauuucaguagcuccacuugggugaccuugucugacggcacagggcgucucuaugucaucggaaccggcgaaagagguaauucggccucagagaagugggaaauuauguuuaacgaggagcugggggauccguucaucauuauccacagcauaagucugcucaaugcagaggaacauuccaucgccacuuuacugcuuaggauugaaaaagaggaguuggacaugaagggaucuggcuuuuacgugagccuggaauggguuacaaucuccaaaaagaaccaggauaauaagaaauacgagauuaucaagcgggacauacuacgcggcaaaucagugccccacuaugcugcaauugaaccugaugggaacggacucaugaucgucaguuacaagagccugaccuucgugcaggccggucaagaccuugaggaaaauauggacgaggauauuucugagaaaaucaaggaaccacuguauuacuggcagcagacggaggacgauuugacuguaaccaucagacuccccgaagacuccacaaaggaggauauucagauacaauuucugccugaccacaucaacauuguuuuaaaagaucaucaguuccuggaaggcaagcucuauucaagcaucgaccacgagaguucuacuuggauaauuaaagaguccaauagccuugaaaucucgcugaucaagaaaaacgagggguugaccuggccagaacuugugauuggagauaagcagggcgagcugaucagggacucugcucagugugccgcgauugcagaacggcucaugcaucugacauccgaggagcuuaaucccaacccugauaaagaaaagccaccgugcaaugcccaagagcuggaagagugugacauauuuuucgaggaaucaaguagcuugugccgcuuugacgguaacacccucaagacgacucacgucgugaaccugggguccaaucaguacuuauucucugugaucgucgaucccaaagagaugccuuguuuuugccugcgacacgacguugaugcucuacucuggcagccacauagcucaaagcaagacgauaugugggaacacauugccacauucaacgcacugggauaugugcaggcuaguaaaagagacaagaaauucuuugccugugcgcccaauuacuccuacgccgcacuuugcgaguguuugaggcggguauucaucuaucgucagccugcuccaaugagcaccgugcuguacaaccgcaaggaaggcagacaggucggccaaguggccaagcagcagguugcuucucucgagacuaaugaucccauccugggguuucaggccacaaacgagaggcuuuucgugcugaccacgaaaaauuuguuucucauuaaggucaacaccgaaaauuga

SEQ ID NO: 59978 - RNA, 1086 nt, Artificial Sequence
  derived and/or modified sequence opt3 from NUDCD3__Homo_sapiens__NP_056147
auggagaccggcgccgcugaacuguacgaccaggcacuccuugggauccugcaacacgugggaaacguccaggauuucuugagaguuuuauuugguuuccuguauaggaagacagacuuuuaccggcuacuccgccaucccagcgaucgaaugggcuucccuccaggggccgcgcaggcucuggugcuucagguauuuaaaacuuucgaccacauggcccgucaagaugacgagaagagaaggcaggaacuggaggagaaaauucggcgcaaggaagaggaagaggcaaaaacgguguccgccgcugcagccgaaaaggagccgguccccgugccuguucaggagauagaaaucgauucuaccacagaguuggacggacaucaggaaguggagaagguccaaccacccggcccugugaaagaaauggcucacgguucacaggaggccgaggcgccaggggcaguagccggagcugccgaaguucccagagagccuccaauucucccgaggauccaggaacaguuucaaaagaaucccgauaguuauaacggcgcagugcgggagaauuacacuuggagccaggacuauaccgaucuggaaguccgcgugccugugccaaaacaugucguuaagggcaaacagguguccguagcucugucuucgucaagcauucgaguggccaugcucgaggagaacggggaaagagucuuaauggagggaaagcugacacacaagaucaauaccgaaaguucccuuuggucuuuggagcccgguaaaugcgugcugguuaaccuaagcaaggugggcgaauacugguggaaugcgauacucgagggggaggaaccuaucgacauugauaaaaucaacaaggagagguccauggccacugucgacgaagaggagcaagcagugcuggaccggcuuacauucgauuaucaccagaaacugcagggaaagccacagucacaugaauugaaaguacacgagaugcucaagaagggcugggacgcugaagguagucccuuucgugggcaacgcuucgauccggccauguuuaauauuagcccuggagcuguucaguucuga

SEQ ID NO: 59979 - RNA, 1008 nt, Artificial Sequence
  derived and/or modified sequence opt3 from NUDC__Homo_sapiens__XP_011538831
augaucagcaacuacagaaauggcuccgagcuggugugcuucaacucuggggucggauguuuucucauugguugcgacugggccuucaccguucuugugaauacauuuuucucauuucugaggcggaagacugauuucuuuauaggcggggaagagggaauggcugaaaaauugaucacgcagaccuucagucaccauaaccaauuagcacagaagacacgccgagagaaacgugccagacaggaagcggagaggcgggagaaggcugaacgcgccgcaagacuggccaaagaggcuaagagcgaaacuuccggcccccagauuaaggagcuaaccgacgaggaagcagagaggcuccaacuggaaaucgaucagaaaaaggacgccgagaaucacgaagcucagcuuaaaaacgguucucuggauucgccugggaagcaggacacagaggaggaugaagaggaagacgagaaagauaagggaaaguugaaaccaaaucucggcaacggcgccgaccugccgaauuaucgguggacccaaacucugucagaacucgauuuagcgguacccuuuugugugaacuuccgccugaaggggaaagacauggucguggauauucagcgaagacaucuuaggguuggauugaagggucagccugcaaucauagacggcgagcuguacaaugaggugaaagucgaagagagcaguuggcuaaucgaagacgggaaggugguaacaguucaccucgagaaaauuaacaagauggaaugguggucccggcuggugucuagcgauccagagaucaauaccaagaaaauuaaccccgaaaauuccaaacuuucagaccuggauagugagacgcguagcauggucgagaagaugauguaugaccagcgccaaaagucuaugggauugccuacuuccgaugaacagaaaaagcaggagauccucaagaaauuuauggaccaacauccagagauggauuucucaaaggccaaauuuaacuga

SEQ ID NO: 59980 - RNA, 495 nt, Artificial Sequence
  derived and/or modified sequence opt3 from NUDT10__Homo_sapiens__NP_001291892
augaagugcaaacccaaccagaccagaacauacgacccugagggguucaagaaaagggccgcuugucugugcuuucggagcgaacgcgaggaugaagugcuccuugucuccucuucacgauauccagaccguuggaucguucccgggggagguauggagccggaagaggagccuggcggggcagccgugagagaaguauacgaggaagcgggagugaagggcaaacuggguagguuguuaggggucuucgagcaaaaucaggauccaaagcaccggacuuauguguacguucugacggugaccgagcuacucgaagacugggaggauagugucagcauuggacgcaagagagaaugguuuaaaguggaggacgcuauaaagguacugcagugucauaaacccguucacgccgaauaucuugagaagcugaaauugggcggcuccccuacaaacggcaauucuauggcaccaucgucacccgauagcgacccuuga

SEQ ID NO: 59981 - RNA, 495 nt, Artificial Sequence
  derived and/or modified sequence opt3 from NUDT11__Homo_sapiens__NP_060629
augaagugcaaacccaaccagaccagaacauacgacccugagggguucaagaaaagggccgcuugucugugcuuucggagcgaacgcgaggaugaagugcuccuugucuccucuucacgauauccagaccguuggaucguucccgggggagguauggagccggaagaggagccuggcggggcagccgugagagaaguauacgaggaagcgggagugaagggcaaacuggguagguuguuaggggucuucgagcaaaaucaggaucggaagcaccgcacuuauguguacguucugacggugaccgagcuacucgaagacugggaggauagugucagcauuggaagaaagagggaaugguuuaaaguggaggacgcuauaaagguacugcagugucauaaaccaguucacgccgaauaucuugagaagcugaaauugggcggcucccccacaaacggcaauucuauggcaccuucgucaccagauagcgaccccuga

SEQ ID NO: 59982 - RNA, 495 nt, Artificial Sequence
  derived and/or modified sequence opt3 from NUDT15__Homo_sapiens__NP_060753
augaccgccagcgcucagcccagaggcaggcggccuggggugggagucgguguugugguaacauccugcaagcacccacgcugugugcugcucggcaaacgaaaggggucugucggagcaggcucauuccaacuuccgggugggcaucuggaguuuggagaaacuugggaggaaugcgcccagcgugagacgugggaagaggcggcuuugcaccugaaaaacgugcauuucgccaguguugugaauagcuuuaucgagaaggaaaacuaccacuaugucaccauuuuaaugaaaggcgagguggacguaacacaugauuccgaacccaagaauguugagccugagaagaacgaaucuugggagugggugccaugggaggaacuacccccucucgaccagcuguucuggggccuuagaugucugaaagaacagggguacgauccauuuaaggaggacuugaaucaccucgucggauauaaagguaaccaccuguga

SEQ ID NO: 59983 - RNA, 1128 nt, Artificial Sequence
  derived and/or modified sequence opt3 from NUDT19__Homo_sapiens__NP_001099040
augagcuccucucugagacccggcccuucaagguggcggcgcgccgcuaguaucgugcucgcagccggguggagccgaccagagaccgcgacaccgcccucccguccuccacccgcugaaggauucagacuucuguuguuacagaggucuccucaccaagguuuuaugccaggcgcccaugucuucagcgggggaguucuggacgcagccgaucggucagcugacuggcuaggccucuuugcaccccaccaugguccuccacgcuucgggcugggaccggcccccuuuagcagaacugcuuucccuagucuuccagauacggacgaucacaagaccgacaacacaggcacucugcccgaggauguggccuuuaggauuugcgcgguacgggaagcauucgaggaagccggcguguugcuccugcgcccucgaaccuccccacccgggccggcuccuggacccggucuggcccucgagccaccucccggcuuagcaucuuggagagacaggguccggcaggauccacgucauuuucugcgccuuugugcucacuuggacugcacacccgauauaugggcccugcacaauuggagcgcguggcuaaccccuuuccucagagggacuacaaggcgguuugacaccgccuucuuucuguguugccuucgagagccaccgcccguguacccugaucuggcagaaguugugggauaucagugguccucaccaagugaggcuacggaaucguucuugucuaaagagaucugguugcccccuccacaguucuacgagguccgcagacuggccaacuuugcuuccuuaucagaccugcauaaguucugucucggcagggcccuugaaggucuggagcggugguugcccauuauccuacugacugcagacgggauggugcaccuccugccgggagaugaacuuuaucuggaggacagcgauuuucucgaaaaucucaugaguaccgagaaaaagacagaggaaauuaugaaagagggcaagcaauuccaucgcaucguaacuuaccacagacaccuguaugacauacauguuaccgugcagccuaaguacaaacacgucuauccaaagaacucuguggugaggaaaucccauuuauga

SEQ ID NO: 59984 - RNA, 471 nt, Artificial Sequence
  derived and/or modified sequence opt3 from NUDT1__Homo_sapiens__NP_945191
augggcgccagcagacuguacacccucgugcuuguccugcagccccaaaggguuuuguuagggaugaagaaacggggauucggugcuggccgcuggaacggguuuggaggcaaggugcaggagggugaaacaaucgaggacggggcacgacgugaacugcaggaggaauccggacuaacuguagaugcccuccacaaagugggccagauugucuucgaguuugugggcgagccugaacugauggacguucauguguucugcacggauucuauacaagggaccccagucgagucagacgaaaugagaccguguugguuucagcuugaucagauccccuucaaggacauguggccugaugacaguuauugguuuccacuguugcuccagaaaaagaaguuccacggauacuuuaaauuccaaggucaggauacaauucuggacuauacucugagggagguggauaccguauga

SEQ ID NO: 59985 - RNA, 684 nt, Artificial Sequence
  derived and/or modified sequence opt3 from NUDT21__Homo_sapiens__NP_008937
augagcgugguucccccuaacagaucccagaccggcuggccaaggggagucacacaauucgggaauaaguacauccagcagacuaaaccgcugacgcucgagcggaccauuaaccuuuauccccugacaaauuacacuuuugguaccaaggaaccuuuguaugagaaagacucuucaguggccgcucgcuuccagcgaaugcgugaagaguuugauaagauaggcaugagaaggacaguagaagggguguuaaucguccacgagcaucggcugccacacgugcuacuccugcaacuuggaaccacuuucuuuaaacugcccggcggugaguugaacccuggggaagacgagguugaaggacucaagcgccugaugacagagauucugggcagacaggauggcgugcuccaggacugggucaucgaugacugcauugggaauugguggaggccaaacuucgagcccccucaguacccauauaucccggcacauauaaccaagcccaaagaacacaagaaauuauuucuggugcaacuucaggagaaggccuuguucgcgguaccuaaaaauuacaagcugguugcugccccacuauuugaacucuaugauaacgcacccggauacgguccuaucauuaguagccugccacagcuucugucccgguucaauuuuaucuacaacuga

SEQ ID NO: 59986 - RNA, 444 nt, Artificial Sequence
  derived and/or modified sequence opt3 from NUDT2__Homo_sapiens__NP_671702
auggcccugagagcuugcggccucaucauuuucaggcggugucuuauacccaagguggacaacaaugcaaucgaguuucuguuguuacaggccagcgaugggauucaccauuggaccccuccaaaaggacacgucgaaccgggugaggacgaucuggaaacagcgcuacgcgagacucaagaagaggcuggcaucgaggccgggcagcucacgauuaucgaaggauucaagcgagagcugaacuacguugcacguaauaaacccaagaccgugauauauuggcuugccgaaguaaaagacuacgauguggagaucagacugucccaugagcaccaggcuuauaggugguugggccucgaagaggcaugccagcuggcccaauuuaaggaaaugaaggcugcccugcaggagggucaucaguuccucuguucuauugaagcguga

SEQ ID NO: 59987 - RNA, 519 nt, Artificial Sequence
  derived and/or modified sequence opt3 from NUDT3__Homo_sapiens__NP_006694
augaugaagcugaaaagcaaccagaccagaacauacgacggcgauggguauaagaaaagggccgcuugccucuguuuccgguccgagucugaagaggaagugcuucuggucucaaguagccgccaccccgaccgauggaucguuccuggagguggcauggagccagaagaggagccguccguggcagccguacgugaagugugcgaggaagcgggggucaagggaacuuugggcagauuaguggguauuuuugagaaucaagagaggaaacaucggacguacguuuaugugcugauagucaccgaagugcuagaggauugggaagacucuguaaacaucgggcgcaagagagagugguucaagauugaagaugcuaucaaaguucuccaguaccacaagcccgugcaggccucguauuuugagacacugaggcagggauacucagcaaauaacggcacuccugucguggccaccacauauagcgugagugcucaauccucuaugagcggcauucgguga

SEQ ID NO: 59988 - RNA, 951 nt, Artificial Sequence
  derived and/or modified sequence opt3 from NUDT6__Homo_sapiens__NP_009014
augagacagccccugagcugggggagguggcgggccaugcucgcucgcaccuacggcccuggaccauccgcagguuaucgaugggccucuggcgcgcaaggguacgugcguaacccgcccgucggagcuugcgaccuucagggcgagcuggauagauucggugggaucucaguuagguuggcccgguuagacgcacuggaucgccuagacgccgcugcauuucagaagggacuccaggccgcugugcaacaguggagaagugaaggcaggacagccguauggcugcacauuccuauacuucagagccgguucaucgcgccagcagccucccugggcuuuuguuuccaucacgcugagucugauucgucaacuuugacgcucuggcugcgcgaagggcccagccgacugccuggauaugccagucaucaggugggugucgcaggcgcuguguuugacgaguccaccagaaaaauucucguugugcaagauaggaauaagcucaaaaacauguggaaguucccagggggacugucugaacccgaggaggacaucggcgauacagccguccgggaaguguuugaggaaacugguauuaaaagcgaguuccguuccguacuuucaauccgccagcagcacaccaauccuggggcguuuggaaagagugacauguacauaaucugcagauugaagccauauagcuucacaauuaacuuuugucaggaggaaugccugaggugugaguggauggaucuaaaugaccucgccaaaaccgaaaacacuacaccgaucaccucucggguugcacgacugcuucuguacggcuaucgcgagggcuucgauaagauugacuugacgguggaagaguuacccgcugucuacacugggcuguuuuacaaauuauaucauaaggagcugccugaaaauuacaaaaccaugaagggaaucgacuga

SEQ ID NO: 59989 - RNA, 717 nt, Artificial Sequence
  derived and/or modified sequence opt3 from NUDT7__Homo_sapiens__NP_001099133
augagcagacugggccuccccgaggaaccugugaggaacucccuucuggacgaugccaaggcucgguugcgcaaauacgacaucgggggaaaguauucucacuuaccauacaauaaauauucaguccugcuaccgcucguugcaaaggaggguaaacugcaucuucuguucaccgugcgaagugaaaaguugcguagagcccccggcgagguaugcuuuccugggggaaagagggauccaacagacauggaugacgcggcuacugcccuccgggaagcacaggaggaggugggccugcgcccccaccaagucgaagugguuuguugccuggugccuugucucauugauacggacaccuuaauaacaccauucgucggucugaucgaucauaacuuucaggcccagcccaauccugcugaggugaaagacguauuccuuguuccauuggcauacuuucugcacccccaggugcaugaucaacacuaugucacuagacuagggcacagguucauuaaccauaucuuugaauacaccaauccggaggacggagugacauaucagauuaagggcaugaccgccaaccucgcugugcuggucgccuucaucauacuugagaaaaagccuacuuuugaaguucaguucaaucugaacgauguguuggcgagcuccgaggaacucuuucugaaaguacacaagaaggcaacaucucgguuauga

SEQ ID NO: 59990 - RNA, 1395 nt, Artificial Sequence
  derived and/or modified sequence opt3 from NUF2__Homo_sapiens__NP_663735
auggagacccugagcuuccccagauacaacguggccgaaaucgucauucacauaaggaauaagauccucacaggcgcugacgggaaaaaccuuacuaagaaugaucuguauccuaacccaaaaccggagguuuugcauaugauuuacaugcgggcauuacagaucguguaugguauucgccuggaacacuuuuacaugaugcccguaaauuccgaggugauguauccucaucuaauggaaggauuccucccauuuucuaaccuggucacgcaccuugacucauuccugcccaucugccgagugaaugauuuugagaccgccgacauauuguguccuaaggcgaaacguacaaguagauuccucagcggcaucauuaacuuuauccauuucagggaggcuugccgggaaacuuacauggaguuucuguggcaauauaaguccucugccgauaagaugcagcagcugaaugcagcccaccaggaagcucucaugaaauuagagcgccuggacucgguuccaguggaggaacaagaggaguucaagcagcuuucagaugggauucaggaguugcagcaaagccugaaccaggacuuucaccagaaaaccaucguccuacaggaaggaaauagucaaaagaaauccaacauaucugagaagacaaagagacucaaugagcugaaacuuagcgugguaucccugaaggaaauucaggagucauugaaaaccaagaucguugauagucccgaaaaacucaagaacuacaaagagaagaugaaggacacugugcagaaacugaagaaugcaaggcaagaagucguggagaaauacgagauuuauggcgauagcguggacuguuuaccuucuugccagcuggaaguccagcucuaccagaagaaaauccaagaucuuuccgacaaccgggagaagcuggccucaaucuugaaggaaagccuaaaccuggaggaccagauugaaagugaugagucugagcucaaaaagcugaaaacagaagaaaauuccuucaagcgccuuaugauaguuaaaaaggaaaagcuggcuaccgcccaguuuaaaaucaacaagaaacaugaggacgugaagcaguauaaacgaacgguaauugaggauuguaauaaggugcaagaaaagagaggugcggucuacgagagggugacuaccaucaaccaggaaauacagaaaauuaaguuggggauccagcaacucaaagacgcagccgagcgggaaaagcugaaaagccaggagaucuucuuaaaucugaagacagcucuagagaaauaucacgauggaauugaaaaggccgcagaggacucguacgcuaagaucgaugagaaaacugccgaacucaagcguaaaauguucaagaugucuaccuga

SEQ ID NO: 59991 - RNA, 1488 nt, Artificial Sequence
  derived and/or modified sequence opt3 from NUFIP1__Homo_sapiens__NP_036477
auggccgagcccaccagcgacuucgaaacaccuaucggcuggcacgcuuccccagagcugacuccgacgcucgggccccuuucugauaccgcaccuccaagagacucauggauguuuugggccaugcugcccccuccacccccuccauugacaaguagcuuaccggcggcuggauccaagcccucuucggaaucacagccuccaauggaggcccaaagccugcccggugcaccuccacccuucgaugcccagauucuaccgggcgcucagccucccuuugacgcacagaguccacucgauucccaaccucagcccucugggcagccauggaacuuccaugccagcacuuccugguacuggaggcagucaagugaccgguuuccccgccaccaaaagagcuucaauccugcugugaaaaacucuuauuacccacgaaaauaugaugccaaguuuaccgacuucucccugccgcccucacguaaacagaagaagaaaaagagaaaagaaccugucuuucauuucuuuugcgauacaugugacaggggauucaagaaucaggagaaauacgauaagcacaugagcgagcauaccaagugcccagaacuugacuguaguuuuacugcgcacgagaaaauaguucaguuccacuggcggaacaugcaugcacccggcaugaagaaaaucaagcuggauacaccugaagagauugcccgcuggagagaggaaaggcggaaaaauuauccaaccuuggcuaacaucgagcgcaagaaaaagcucaagcuggaaaaagagaagcgaggugccgugcugacgacuacccaauacgggaaaaugaagggaaugucuagacacucccagauggcaaaaauuaggagccccggcaagaaucauaaguggaaaaacgacaauucgcggcagcgugcuguaacaggcucugggucccaccucugcgacuuaaagcuggaaggaccgccugaggccaacgcggauccacuugguguguugaucaauucagacagugagagcgauaaagaagagaagccccaacacuccgucauaccuaaagaagugacucccgcccuguguucucuaaugagcucauauggcagucucuccgggagcgagucugaaccagaggagaccccuaucaagacagaagcagacguucuggcugagaaccaggugcuugauucaagugcccccaagagcccaucccaggacgucaaagcuaccgugcgcaauuucucugaagccaagucggagaacaggaaaaagagcuuugagaaaacgaauccgaagagaaagaaagauuaccauaacuaccagacucuguucgaaccucggacacaccaucccuauuugcucgagaugcuguuagcaccagacauucgacacgaacgcaacguaauccugcaaugcguuagauacauuaucaagaaagacuuuuucggacucgauaccaauuccgccaagucaaaagauguguga

SEQ ID NO: 59992 - RNA, 2088 nt, Artificial Sequence
  derived and/or modified sequence opt3 from NUFIP2__Homo_sapiens__NP_065823
auggaggaaaagcccggccagccucaaccacagcaccaucacagccaucaccauccgcaccaccauccccagcagcaacagcagcagccucaccaucaccaccauuacuauuucuacaaccacucccauaaucaccaucaccaccaucaccaucaacagccacaccaguaucugcagcacggggccgagggaucucccaaagcucaaccuaagccacucaaacaugaacagaagcacacccuucagcaacaucaggagacacccaaaaagaagacugguuacggcgaacugaacgggaaugcaggagagagagagaucucauugaaaaacuuaaguagcgacgaagccacgaauccuauuuccagggugcugaacggcaaucagcaggucguugauaccucucuaaagcaaacagugaaagcgaacacuuuugguaaggcugggauaaaaaccaagaauuucauccagaagaacucgauggacaaaaagaauggaaaaucauaugagaacaagagcggcgaaaaucagaguguagauaaauccgacacaauuccaaucccgaacggcguggucaccaauaacucuggguacauuacuaacggauauauggguaagggcgccgauaaugacgggagcggauccgagucaggcuacacaacccccaaaaagcggaaggcacgccgaaacagugccaaagguugcgagaaucucaacaucgugcaggauaagauaaugcaacaggaaacgagcguuccuacucugaaacaggggcuugagaccuuuaagccagacuacucugaacagaaaggaaaucguguggauggcuccaagcccaucuggaaguaugagacaggcccugggggaacuucaagagguaaaccagcugucggcgacaugcugaggaagucuagugauucuaaacccgggguguccagcaagaaauucgacgaucggccgaagggaaagcacgcaucggccguagcuucuaaagaagacuccuggaccuuguuuaagccucccccaguuuucccuguggacaacucaagugccaaaauuguccccaagaucagcuacgcguccaaagugaaggagaaucucaacaagacaauucaaaauucuagcgugucaccaaccaguuccagcagcucaaguagcuccacgggcgagacucagacacagucuucgagccgccugucccagguccccaugucagcacugaaaaguguuaccucugccaacuuuagcaaugguccugugcucgcugggacugauggcaacguauauccaccgggaggccaacccuuacugacaaccgccgcaaauacgcuuaccccuaucuccucagggacagacagcguguugcaggauaugucucugacuuccgcugccgucgaacagauaaagaccagucuauucauuuacccaagcaacaugcaaacaaugcuccugucuacugcccagguggaccuucccucccagaccgaucagcaaaaucugggagacaucuuucagaaccagugggguuugucauucauuaacgagccuagugcgggcccagaaacaguuaccgggaaaagcucggagcauaaggugauggaagucacuuuucagggagaguaucccgcaacgcucgugucccaaggcgcugagaucaucccgucugguacagaacacccuguauucccaaaagccuacgagcuggaaaagagaaccagcccccagguuuuagggucaauucugaaaaguggcacuaccuccgagucuggagcucucagccuugaaccuucccacauaggcgaucugcagaaggccgacacaucaagccagggggcauugguguuucuaaguaaggauuaugagaucgagucucaaaauccccuggccuccccaaccaacacucuccugggaagcgcuaaagaacagagguaccagcggggucuugagcgcaaugacucguggggcucauucgaucugcgagcggcaauugucuaccauacaaaggaaauggagucuaucuggaacuugcaaaaacaggacccuaagagaauaauuacguauaaugaggccauggacagucccgaucaguga

SEQ ID NO: 59993 - RNA, 2391 nt, Artificial Sequence
  derived and/or modified sequence opt3 from NUGGC__Homo_sapiens__NP_001010906
auggccgagaccaaggacguguucggccaggaaccccacccugucgaggaugaccuguacaaagaaagaacaaggaagcggcgcaaaagcgaucgagaccaacguuuuagagcuuucccauccauggagcagucugcacucaaggaauaugagaaacuugagucaaggacucggcgcguucugaguaacacguaccagaaguugauccagagcguguuuuuagaugacuccauuccgaaugggguaaaguaucugauaaacagacuacucgcccugaucgaaaaacccaccguggauccuauuuacaucgcgcuuuucggaucuacaggugcuggcaagucgucacugauuaaugccaucauacaacaggcaauguuuuugccagucagcggggagaguaucugcacuuccuguauugugcagguuucuagcggaugcugugugcaguaugaagccaaaauccaucuccuguccgaccaagaguggagggaggaacugaagaaccucaccaaauuacugcaccggacagaggaacuuucacgcgaggaagcugaugcauggaaucgagacgaggccgucgaggaagcuaccuggaaguugcagaugauuuacggcaacggugccgagaguaagaauuaugaggaacugcuaagagcgaaacccaagaggaaaaucccuacuagccgggugauaacacucaaggcagaagaggccgaggaacugucuauuaaacuugauccauacauccguacccagcgcagagacugggauggggaggcugccgaaaugaggauuuggccccugaucaagcauguagagguuacguugccuaaauccgaccucaucccagaaggagugguccugguggacauuccgggcacuggcgauuucaacucaaagcgggacgagauguggaagaaaaccauagauaagugcagcgugaucugggucauuagugacaucgagcgaguuucugggggacaggcacacgaagauuuacugaaugaguccauaaaggcuugucaacgcgguuuuugcagagacguggcccucguagugacaaagauggauaaacuucaucugcccgaauacuugagggagcggaaggcgggcaaccaggccauucagagccaacgcgaggcaguccuagaaagaaaugagaugaucaagcugcagaggacucguauccucaaagaaaagcugaaacggaaacuuccugcugacuucaaagugcuggaggccucggauuugguuuauaccgugucugcucaggaauacuggcagcaagcccuccugacagaggaggaaaccgagauuccaaaguuacgagaauauaucagaaagucccugcuagacaaaaagaaaaggacggucacuaaguacgugacagaggcauuugggcuccugcuuuugaccgauucauucaacaguacucagaaucugcccaacgaacaccuccacaugagcguacugcgccgguuugccgaggagaaaguugaacuucuggagaaggcuauugcgcaguguuucgcaugcauggaacagccuuugcaagagggagugagaacagccaggaccuccuaucgcuguauacuccgagcuugccugguccggucuaagggcaaucaggguuuucaucagacguuaaaagccgugugucugaagaacgggaucuacgcaagccguacccuagccagaauugaccucaacgaagcucugacacagccagucuaugaccaaaucgaucccguguucggaucaaucuucaggacuggcaaaccgaccggcagugcccuuaugccucacauugacgcauuuaagcaguccuugcaggagaaaaugacagagauagggauccgcagcggauggaaguacgauucuugcaaaaagaauuuccugauucaggaaaucucagcgauucucgguggccuggaggaccauaucuuacggagaaagaggcgaauauacgaaagucugacugcuagcguucaauccgaucuuaaauugugcuaugaggaggccgcacagaucaccgggaagaaagccugugaacgcaugaaggacgcuauucggagaggaguggauaggcagguagccgagggcauguuugaacgugcacaagagcgcaugcagcaccaguuccagcaacucaaaacagguaucgucgaaaaggugaaggggucuauuaccacuaugcuggcucuagccucgagccagggcgacggacuguacaaagagcucgcggauguuggcuccgaguauaaggaaauggagaaacugcaccggucacuuagagaaguggccgagaacgcuagguugcgaaaggggaugcaggaauuucuguuacgggcaagucccucuaaagccggaccaccugguacgagccucuga

SEQ ID NO: 59994 - RNA, 6306 nt, Artificial Sequence
  derived and/or modified sequence opt3 from NUMA1__Homo_sapiens__NP_001273490
augacccugcacgccacaagaggcgcugcucuccuuagcugggugaacucccugcaugucgccgaccccguugaggcgguguugcaguuacaagauugcucuaucuucauuaagauaaucgacaggauucacgggacugaagagggacagcagauccugaagcagccuguaucagaacggcuagauuuuguguguaguuuccuccaaaagaaucgcaagcauccaagcuccccggagugccuggucucugcucagaaggugcuugaagguucggagcuggaguuggccaaaaugacgaugcuccugcuguaccacucaaccaugagcaguaagagcccccgagacugggaacaguuugaguauaagauucaggcagaacucgccguuaucuuaaaauucgugcuggaucaugaggacggccuuaacuugaaugaggaucuggaaaacuuucuacaaaaggcuccugucccaucuacauguagcuccacuuuccccgaggaacucucaccuccaagucaccaggcaaaacgugagauaagauuucuggaacuucagaagguggccuccucuuccucagggaauaacuuccugagcggaagucccgcuucuccuaugggcgacaucuugcagaccccacaauuucagaugaggcggcucaaaaagcagcuggccgaugagcgcuccaauagagacgaguuagaacuggagcucgcggaaaacaggaaacuucugacagagaaagaugcacaaauugccaugaugcagcagcggaucgaccgcuuggcucuacugaaugaaaagcaggccgcaagcccgcucgagcccaaagagcuggaggaacuucgagauaagaacgaaucgcugaccaugagauugcacgagacucucaaacaaugccaggaccugaagacagaaaaaucucagauggacaggaagauuaaucaguuauccgaggagaacggugaucugucauucaagcuacgggaauuugcuagucaucuccaacagcugcaggacgcccuuaaugaguugaccgaggaacacagcaaagcgacgcaggaguggcuggaaaagcaagcccagcucgagaaagaacuguccgcagcacuucaggauaagaaaugucuggaggaaaagaacgagaucuugcaggggaagcucucucaacuggaggaacauuuaagccagcugcaggacaauccuccacaagagaaaggagaaguacuaggcgauguucuccagcuggagacucuuaagcaggaagccgcuaccuuggccgcaaacaacacacagcugcaagcccguguggagaugcucgagacugaacgcggccagcaggaggcuaaacuguuagcggaaagagggcacuucgaggaagagaagcagcaacugucaagucuuauaaccgacuugcaguccagcauuucuaaucucucacaggcaaaagaggaacuggagcaggccagucaagcucacggagccaggcuaacagcacaggucgccagccugaccuccgaacucacgacucugaacgcuacaauccagcaacaggaucaggagcuugccgguuugaagcagcaagcaaaggagaaacaggcgcagcuggcucagaccuuacaacagcaggaacaggccucucaaggccuccggcaucagguggagcagcugucgagcucccuuaagcagaaagaacaacagcugaaggagguggcagaaaaacaggaggccacucgacaagaccacgcucagcaguuggccacagcagcugaggaacgcgaggccucacucagagaaagggaugcggcccugaagcagcuagaggcucuggaaaaggagaaagcagccaagcucgagauucugcaacagcagcuucaggucgcuaaugaagcccgggacagugcacaaaccucuguuacgcaggcgcagcgcgagaaagccgaauugagcagaaagguggaggaacugcaggcuugcguagagaccgccaggcaagagcagcaugaagcacaggcucaaguggccgaguuagaacuccagcugcguuccgagcagcagaaagcaacagagaaggaacgggucgcccaagagaaagaucagcuucaggaacagcugcaagcucuaaaggagucacucaaggugacuaaagggagccuggaagaggagaagagacgagcggccgacgcauuggaagaacagcagagguguaucucugaacugaaagcugagacccgcuccuuaguugaacagcacaagcgggagagaaaagagcucgaagaggaaagggccggacgcaagggccuggaggcccgacuucaacagcugggugaagcucaucaggcagagacagagguguugcggcgugaacucgccgaggcgauggcugcccagcacacugcagaaagugagugcgagcaacuggucaaggaaguggccgcuuggagagagagguacgaagacagccagcaggaggaagcacaauauggggccauguuucaggagcagcuaaugacccugaaagaggaaugugagaaggcgcgccaggaacuucaagaggcuaaagaaaagguagccggaaucgagucucacuccgagcuccagauuucacggcagcagaacgaacuggcagaguugcaugccaaucuggcuagagccuuacaacagguucaggaaaaagaggugagggcacagaagcucgcugaugaccugaguacacuucaagaaaagauggccgcgaccagcaaagaggucgcccgacuggagacuuuggugcgcaaggcaggcgaacagcaggagacggcuucgcgggaacucgucaaagagcccgccagagcuggcgauaggcaaccugaguggcuggaggaacagcaggggcgucaguucugcuccacacaagcagcccuacaggccauggaacgcgaggcugaacagaugggaaacgagcuggagcggcuuagagcggcacucauggaaucucagggucaacagcaggaggaaaggggccagcaagagcgagaaguggcccggcugacccaggagcgcgggagagcucaggccgacuuggcauuagagaaggccgcuagggcggaacuggagaugcggcuccaaaaugcccugaacgaacagcgaguugaguucgcaacucuucaggaagcucuggcccacgcauugaccgagaaagagggaaaggaucaggaacuagccaagcugagaggccucgaggcugcccaaauaaaagaacuggaggagcuucgccagacagugaagcaguuaaaagaacagcuggcgaagaaagagaaggaacaugcaagcgguucaggggcccaaagugaggcugccggcaggaccgaaccaacuggacccaaacucgaggcuuugcgugcagagguauccaagcuggaacagcagugucagaagcaacaggagcaggccgacucucucgaacggagccuggaggcugaaagagccuccagggcagagcgcgauucagcgcuugagacacugcagggccaauuggaagagaaagcccaggaacuagggcacagccagagugcucuggccucugcacaacgagagcucgcugccuuuagaacgaagguccaggaccacuccaaagcagaagaugaguggaaggcccagguggcucggggaaggcaggaggcggaacgcaaaaauagcuuaaucucgucacuggaggaagagguuucuauucuuaaccgucaagugcuggagaaggaaggugagaguaaggaacucaaaagauuggucauggccgaguccgaaaagagccagaaacuggaggagcggcucaggcugcuucaggcagaaaccgcuucuaauagcgcccgcgccgcagagcgauccucagcucuaagagaagaggugcagagucugcgggaagaggccgagaagcaaaggguagcgagcgaaaacuugcgccaggaguuaacuucucaggcugaaagagccgaggaacugggccaggagcucaaagcauggcaagagaaguucuuucagaaggaacaggcccuguccacacuucaacuggagcauaccucaacacaggcucucgugagugaauugcugccggcaaaacaccuaugccagcagcugcaagccgagcaggcggcugccgagaagaggcaucgggaggaacucgaacagagcaaacaggcagccgggggacuucgugcugagcuguuacgcgcccaacgagaauugggcgagcugaucccucucagacagaagguugcagagcaggaaaggacugcucagcaacugcgggccgagaaagcguccuacgccgaacagcuuucuaugcugaagaaggcacacggucucuuggcugaggaaaaucgcgggcugggcgagagagccaacuuaggaaggcaguuccuagaggucgaacuggaccaggcacgggagaaauaugugcaagaacucgcugccgugcgagccgaugcggagaccagacuugcugaaguccagcgcgaggcacagucgacggccagggagcuggaaguuaugaccgcuaaguacgagggcgccaaagugaagguguuggaggagcggcaacguuuucaggaggaaagacagaaacugacagcacagguagaggaacucagcaagaagcuggccgacucagaucaggcuuccaaaguccagcagcagaaacuuaaagcggugcaagcccaagggggagagagucagcaggaagcacaaaggcuccaggcucagcugaaugaguugcaagcccagcugucucagaaggagcaggcagccgaacauuauaaauuacaaauggagaaggcuaaaacucacuacgacgccaagaagcagcagaaccaggaacuacaagagcagcugcgcagccucgaacagcuucagaaagagaacaaggagcugcgggcggaagcagagcgauugggucacgaacugcaacaggccggccucaaaaccaaggaggcugaacagacaugcagacaucugacugcccaaguuaggucccuugaggcacagguggcucacgccgaccagcaguuacgcgaucuggggaaauuccaagucgcuaccgacgcccucaagucacgggagccccaggcaaagccacaguuggaucugucuauagacagccuagaucugaguugugaagagggaacgccucucuccauuacaagcaaacuucccagaacccagccagacggcacuucugugcccggugaaccugcgucaccaaucucccaacgucugccgcccaagguugagaguuuggagagccuguacuuuacaccuaucccagccaggucgcaggcuccccucgaaucuucccuggauagcuuaggggacguguuccuugauucaggccggaaaacccgcagugcccgaagaaggacuacccagauuaucaauauuacaaugacgaagaaacuggacguagaggaaccugauucugcaaacuccagcuuuuauucaacccggagugcuccagccagccaggcaucccuccgcgccacuucuagcacacaaucccuagcgagacugggaucacccgacuacggcaauucugcuuugcugagucucccgggguauaggccuaccacacgaucgagcgcccggcguucccaggcaggagucucuucaggcgccccacccgguagaaacagcuucuacauggggacuugccaggaugagccugaacagcuugacgacuggaaucgcauagcugagcugcaacagaggaaccgggugugucccccacauuugaagaccugcuauccucuggaguccagacccagucucucuuuaggaacgaucacagaugaagagaugaagaccggcgacccacaggaaacucugcgcagggccagcaugcaaccgauucagaucgcagaggguaccggcaucacaacucgacagcagcggaaaagagugucacuugaaccucaccaagggcccggaaccccagaguccaagaaagcuacaaguuguuuucccaggccuaugacgccacgcgaucgucaugagggccggaagcagagcaccacugaagcccagaaaaaggcggcucccgccucuacaaagcaggcagacagaaggcaauccauggccuucucaauucugaauaccccuaaaaagcuagggaacagccuccugcgccgaggagcuucgaaaaaggcauugucuaaagccaguccgaauacucgguccggcacaagaaggagcccacgcauagcgaccacgacugccucagcugcaaccgccgcugccaucggugcaacacccagagcuaaggggaaagccaagcacuga

SEQ ID NO: 59995 - RNA, 1779 nt, Artificial Sequence
  derived and/or modified sequence opt3 from NUMB__Homo_sapiens__NP_001005745
augaacaagcugagacagagcuucaggcggaaaaaggacguguacguccccgaggccucccgcccucaccaauggcagaccgaugaagagggcguucgaacagggaaaugcucuuuuccagugaaguaucucggacauguagaaguggacgagucacgugguaugcacaucugugaagaugcugucaaaagacuuaaggcaacuggcaagaaagccgugaaggcgguucugugggugagugcugacggguugagggucguggaugagaaaacgaaggacuuaauuguagaucagaccauagagaaaguuagcuucugcgccccggaccggaauuuugaucgcgcauucuccuacaucuguagagacggaacaacuaggcgguggauuugccauuguuuuauggccgugaaggauaccggcgaacgccugucucacgcugucgguugcgcauucgccgcuugucuagagcgaaagcagaaaagagaaaaggagugcggggugacagccaccuuugacgcgucgaggacuacauucacccgggagggaucauuucgugugacgacugcaaccgaacaagccgagcgcgaagagaucaugaaacagaugcaggaugcuaagaaagccgaaacagacaagauugucguuggcagcaguguggcacccggcaacacugcuccuuccccaucuagccccaccuccccuacaucagacgccaccacgagucucgagaugaauaacccacaugcgauccccagaaggcacgccccuauagagcagcuggcacggcaagggagcuuccgaggauuuccagcucuuucucagaaaauguccccguucaagcgccagcugucauugagaaucaaugaacuccccagcacuaugcagaggaagacagauuuuccuauuaaaaacgccguaccagagguggaaggugaggcugaaaguaucucuucccuguguagccaaauuaccaaugccuucucgacucccgaggacccuuucucuuccgcaccaaugacaaagcccgucaccgugguugccccgcagucaccuacguuucagggcaccgagugggggcaaaguagcggagcugcgucccccggccuguuccaggcaggucaccggcgcacaccaucugaagccgauagauggcucgaggaagugagcaaaucagucagggcucagcagccucaagccagugcagcccccuuacagccagugcugcagcccccuccaccgacugcuaucucccagcccgccagcccuuuucaagggaacgcauuccuuaccucucagccaguacccguuggaguggucccugcguugcagccagcuuuugugcccgcccagucauauccggucgcaaauggcaugccuuacccagcccccaacgugccuguugugggcauaacacccagucaaaugguagcuaaugucuucgggacugccggacauccacaggcagcucacccucaucagagccccucccuggugcgucagcaaaccuuuccacacuaugaggccucuucggcgacaaccagcccguucuuuaagccucccgcccagcaccuaaacgguuccgcugcauucaauggcguugacgaugggcggcucgccucagcugaccgacauacugaagugccaacgggaacaugccccgucgauccuuuugaggcccagugggcagcgcuggagaacaaaaguaagcaaagaaccaauccaucucccacuaacccuuucagcuccgaccuucagaagaccuuugaaauugagcuguga

SEQ ID NO: 59996 - RNA, 1707 nt, Artificial Sequence
  derived and/or modified sequence opt3 from NUMBL__Homo_sapiens__NP_001276909
augaacaagcugagacagagccucaggcggcgcaaacccgccuacgugccugaggcuucccgaccacaccaauggcaggcagacgaagaugccguccguaaggggaccugcucuuucccgguuagauaucuuggccauguggagguagaagagucaaggggaaugcacgugugugaagacgcggucaaaaagcugaaagcuaugggucggaagaguguuaagagcguguuguggguguccgccgauggcuuacgcgucguggacgauaaaacaaaggaccugcuaguagaucagacuaucgagaaaguuucuuuuugcgcacccgacagaaaucucgauaaggccuucucguacauuuguagggacgggacgacccggcgcuggauaugccauuguuuucuggcucuuaaagauucaggagagcgacugagccacgcagugggcugcgccuucgcugccuguuuggaaagaaagcagaggcgggagaaggaaugcggugucacagcggcauuugacgccagucguacuuccuucgcucgcgaggggucuuuuagacucagcggaggcggcaggccugccgagcgggaagcaccagauaaaaagaaagcugaggccgcggccgcacccaccguggcuccugggccagcccaacccggacauguguccccuacaccagcuaccacuucaccgggugaaaagggcgaggccgggacacccgucgcagccggaaccacggcugcggcaaucccucgacgccacgccccacuggaacagcugguuagacagggcaguuucagggguuuucccgcucucagccagaaaaacucuccuuucaagcggcaauuaucccugcgccuuaaugaguugccaucaacucugcagagaaggaccgacuuucaggugaaagggacaguacccgagauggaaccgccuggagccggcgacagcgauaguauuaacgcacuauguacucagaucucuuccagcuucgccucggcuggcgcccccgcaccagggccucccccagcgaccacaggaaccucugcuuggggugagcccuccgugccuccagccgcagccuuucaaccgggccacaagcguacgcccucagaagcugagcgguggcucgaagaggucagucagguggccaaggcacagcaacagcagcagcaacagcagcagcaacagcagcagcaacagcagcagcaacagcaggcugccagcguugcgccugugccaacuaugcccccugcccugcaaccauuccccgcuccggucgggccuuucgacgcagccccagcucagguggccguauuucuucccccuccccauaugcagccaccuuucguucccgcauauccaggacugggcuacccgccuaugccccgagugccagucguggguauuacacccucccagauggucgcgaaugccuuuugcucugcugcccaauugcagccucagccagcaacccuccuggggaaagcuggcgccuucccuccuccggcaaucccaagcgcccccggaucacaggcuagaccuaggccaaacggcgcgcccuggccuccggagcccgccccagcacccgcucccgaauuagauccauuugaggcccaaugggccgcucuggaagggaaggcaacuguggagaaaccuaguaaucccuucuccggagaccuccagaagacauuugaaauagagcuuuga

SEQ ID NO: 59997 - RNA, 4521 nt, Artificial Sequence
  derived and/or modified sequence opt3 from NUP153__Homo_sapiens__NP_001265138
auggccagcggcgcugggggaguggguggcgggggaggcgguaagaucagaaccaggcggugccaccaggggcccauuaaaccuuaccaacagggacgccagcagcaucaaggcauacugucccgagucacagagucuguuaagaacaucgugccaggcuggcuccagcguuauuucaauaaaaacgaagacguauguucaugcaguacugauacgagcgaggugccgagauggcccgaaaauaaggaggaccaccuugucuacgcagaugaagaguccucuaacauuaccgacgggaggaucacaccugagccagccgugucgaauacugaggaacccucaaccacaagcaccgcgaguaacuauccugauguucugacucggccauccuugcaucgcucucacuuaaauuuuagcaugcuggaaucccccgcucuacauugucagccuucaacaaguagcgccuucccaauuggaucuuccgguuuuucacucgugaaagagaucaaggacagcaccagucagcacgaugacgauaacauaucuacgacuuccggcuucagcucgagagcaucugacaaggauaucaccgucuccaaaaauacaucacugccgccccuuuggaguccugaggccgaaaggagccacucccugucucaacauacugcuaccagcucaaagaaaccagcauuuaacuugagugccuucgggacacucucccccagccugggaaauucuucaauucugaagaccagucagcucggcgacagcccuuuuuacccagguaaaacgacuuaugggggagcugccgcggcagugcggcaguccaaguuacgcaacacacccuaccaggccccgguacgaagacaaaugaaggcuaaacagcugucugcccagucguauggcguuaccagcuccacugcaaggcggauccuucaaucauuggagaagaugaguucuccucuggcugaugccaaacguauucccagcaucguguccucaccacuaaauagcccucucgaccgcucuggcauagacauuacagauuuccaggcgaagagagaaaaagucgacucccaguaucccccagugcagaggcugaugacccccaagccugugaguaucgccacgaaccggagcgucuacuuuaaaccaucucuuaccccguccggggaguuccgaaagacaaaucaacgcauugauaacaagugcucaacuggauacgaaaagaacaugacccccggucagaauagagagcagagggagaguggcuuuagcuacccuaacuucucgcugccagcagcuaauggguuguccucuggaguuggcggugggggcggaaagaugcggcgcgaaagaacaagguuuguggccagcaaaccccucgaggaggaacgucagggccugacuguauuaccuaagcugaucucaaguuccugugcucaagccaucauuccaucuuggccccucaaagugcuucggcugcaggaaauggaggucccgguguugccuaagauaagccuaccaaucaccuccucaagccugcccacauucaacuucaguucuccugagauuaccacuuccagccccucgccaaucaauucaucucaggcacucacgaacaagguucagaugacaaguccuuccagcaccgggucucccauguuuaaauucagcuccccaauagugaagucaacugaagccaauguccugccgccuaguagcauuggauuuaccuucucugugcccguagcuaaaacagcggagcuuuccgguucaaguagcacccuggaaccaaucaucuccucuucggcacaccauguuacuacagugaacagcacgaauugcaagaaaacacccccugaggacugugaaggcccauuucgacccgccgagauuuugaaggaggggucaguccucgauauccugaaguccccuggauucgcuaguccgaaaauugacucuguggccgcacaaccaacugccacaagccccgucguguauaccagaccugcuauauccucauuuucuagcaguggcaucgguuucggggaauccuuaaaggccggcagcucuuggcagugcgauacaugucugcuacagaacaaaguuacugacaauaagugcauugcaugucaggcggcuaaacucucaccaagggauaccgccaagcaaacgggaaucgagacccccaacaaguccggcaaaacaacucugagugcaagcgggaccggauuuggugacaaguucaaaccugugaucggcacaugggauugcgacacuugccuuguacagaauaagccggaagccauuaaaugugucgcuugcgagacccccaagccagggacgugugugaaacgcgccuugacacugaccguugugucggagucugcagaaacuaugacagcuuccagcucaaguugcaccgucacuaccggaacacucggcuuuggugacaaguucaagcggccuauagggucuugggaguguuccgugugcuguguaagcaacaaugccgaagauaacaaaugcgugucauguaugagugagaagcccggcagcuccguuccagcgucuagcuccucaacggucccugugucucugcccaguggaggcucgcuugggcuggaaaaauuuaagaaaccagagggaagcugggacugcgaguugugucucgugcagaacaaggccgauuccaccaagugccuggcuugcgaaucugcaaaaccgggcacuaagucagguuucaaaggguucgacacaagcuccaguucuagcaauucagccgcuuccaguagcuuuaaguucggagucucuuccucaagcucgggcccuucucaaaccuuaacaaguacugguaacuuuaaauucggcgaucaagggggauuuaagaucggcguuuccagcgacucaggguccauuaaucccaugucugagggauucaaguuuagcaaaccaaucggcgauuucaaguuuggugugaguuccgaaagcaaacccgaggaagugaagaaagacucuaagaacgauaauuucaaguuugggcugucaaguggacuauccaacccuguaagccucaccccauuccaguuuggcgucucuaaucugggucaggaggagaaaaaggaggaacuucccaaaucgucaagcgccggcuucuccuucgggacgggagugauuaacaguaccccugcaccggcgaauaccaucguuacuucugaaaacaagagcuccuuuaauuugggcaccauagagacaaaaucagccaguguggcuccauucacuuguaagaccucugaagccaaaaaggaggagaugcccgcaacaaaagggggauuuagcuucggcaacgucgaaccugcuucccugcccucagccagcguguuuguucucgguagaacggaggaaaaacagcaggagccagugaccucuacuucccugguauucgggaagaaagcagacaaugaggaaccuaagugccagcccgucuuuaguuucggaaacagcgagcagacaaaagaugaaaauucguccaagucuaccuuuucauucagcaugacuaagccaagugagaaagaauccgagcaaccugccaaggcuacauuugcguucggcgcccagaccucuacgacugcagaccagggugcugccaaaccgguguucagcuuuuuaaacaacucauccaguucuagcucaacccccgccacauccgcuggcgggggaaucuucggcagcucuaccaguucguccaauccaccuguggcaacuuuugucuucgggcagagcucaaaccccguuucuagcuccgccuuuggaaauacagcggagaguucaaccucucaaagccugcuuuucucccaggauaguaaguuggcuacaacuagcuccaccggcacggccgugacaccauuuguauucgguccuggggcaucuucaaacaauaccacuaccagcggauuuggcuucggcgccacaacuaccucguccagugcugggucuagcuuuguguucggaacgggucccucagcaccguccgccucuccagcguuuggcgcuaaccagacaccuaccuucgggcaaagucagggagccagccagcccaauccacccggcuucgguuccauuucaagcucuacugcacucuuuccuacagggagucagccggcucccccaaccuucggaacugucuccagcucaucucaaccucccguguuuggccagcagccuucccagucggccuucggcagcgggacaaccccaaacaguucuuccgccuuucaauucggaagcucaacgacuaauuuuaacuucaccaauaacagucccuccgguguuuuuacauucggcgcaaauagcucuaccccugcugccucagcgcagccaagcggguccggaggcuuucccuucaaccagucuccggccgcauuuacaguggguaguaaugggaaaaacgucuucucgagcuccggaacuucauucucuggcaggaagaucaagaccgcugugcgccgacggaaauga

SEQ ID NO: 59998 - RNA, 3984 nt, Artificial Sequence
  derived and/or modified sequence opt3 from NUP155__Homo_sapiens__NP_001265241
augcccagcucccugcucggcgccgcuaugccugcaucuaccucagccgcggcccuucaggaggcccuggaaaacgcagggagauugaucgacaggcaauuacaggaggaucggauguacccagaccugagugaacuacucauggugagcgccccgaauaaccccacagucuccggaaugucugauauggacuauccucugcaggguccaggccuucugucgguucccaauuugccugagauuucaagcauacgccgagugccacugcccccugaacucguagagcaguucgggcacaugcaaugcaacuguaugaugggaguguuuccaccgaucagucgugcuuggcugacuauugauuccgacaucuucauguggaauuacgaggauggcggugaccucgcauauuuugauggguuaucugaaacgauucuggccgucggacuugugaagcccaaagcuggcaucuuccagccucauguuagacacuugcuggugcuagccaccccagucgacauagugauccucggccugagcuacgcgaaccuucagacaggguccggaguacugaaugauucauugagugguggcaugcagcuccugcccgacccuuuauauagccugccaacugauaacaccuaccuccuuacaauuaccucuacugacaaugggaggaucuuucuggcaggaaaggacggcugcuuguaugagguugccuaccaagcugaagccgguugguucucccagcggugucgcaaaauuaaccauucaaagagcagucuaucuuuucuggugcccucccuccugcaguucacauuuagcgaggaugacccgauccuucagauagcaauugauaauucgagaaacauccuguacaccaggucugagaaaggggucauucaaguguaugacuugggacaggauggccagggcaugucccggguggcuucagucagucaaaaugccaucguuagcgcggccgggaacaucgcacgcacgauugaccgauccguguucaagccuauaguacagaucgcugugauugaaaauucugagagccucgauugccagcuguuagccgucacucacgcuggagugagacuguacuuuucaaccugucccuucaggcagccacuagcccggccuaacacacucacucugguucaugugcgucuucccccagguuuuagugcauccagcaccgucgaaaagcccucuaaagugcaccgcgccuuguauucaaagggcauccugcucauggcugcgagugagaacgaagacaaugauauacuguggugcguaaaccacgacacauucccuuuccaaaaaccaaugauggagacccagaugacggcagggguugauggacauagcugggcccuuuccgcuauugacgagcugaagguggacaaaaucaucacuccguugaauaaggaucacauucccaucacagacucuccugucgugguccagcagcauaugcucccacccaagaaauuugugcuguuaucggcccaaggcagccugauguuccacaagcuaagaccuguugaucagcucaggcaucugcuuguguccaacguagguggggacggcgaagagauugaacgguuuuucaaauugcaccaggaggaucaggcaugugcuaccugccugauacucgcuuguucaacugccgcaugcgaccgagaagucagugcgugggcuacacgcgccuuuuucagauacggaggcgaggcacaaaugagguuuccaaccacgcugcccccgccuucuaauguggggccaaucuuaggaagccccguuuauuccucaagcccugugcccucugguuccccauacccuaaccccaguuuccugggcaccccaagccacgggauucagccgccugccaugucuacacccgucugugcucuuggaaauccagccacucaggcaaccaacauguccugcgugacaggccccgagaucguauauucagguaagcauaaugggaucugcauuuacuuuagucggauaaugggcaacaucugggaugcuagcuuggugguugaacgcauuuucaaaucgggaaauagagagaucacugccauugaauccucugucccuugucagcuccuggagagcgugcuacaagaacugaagggccuccaggaguuucuggacaggaacucacaguucgccgggggaccacuugguaaucccaacaccacagcgaaagugcaacagcguuugaucggcuuuaugcggccugagaaugggaacccgcagcagaugcaacaggaacugcagcgaaaguuccacgaggcucaguuaagugaaaagauaucccuccaagcaauccagcagcuggucagaaaaucuuaccaggcccuugcucuguggaaguugcucugcgagcaucaauucaccauuaucguugccgagcugcagaaagcaaacgaacuacugcagaggagccgccaagugcagaauaagacugagaaagaacggaugcucagagagucccugaaggaauaucagaagauuucaaaccagguggaucuuagcaauguaugugcgcaauacaggcagguccgcuuuuaugagggagugguugaguugagucugacggccgcugagaaaaaggacccacagggcuuaggucuccacuucuacaaacacggggaacccgaagaggauaucgugggccugcaggccuuucaagaacgacuuaacucuuauaagugcauaacagacacccugcaggagcuagucaaucaguccaaagcagcuccucagagcccaucggugcccaagaagccuggaccgcccguucucucaucugauccaaacaugcugaguaaugaggaagccggccaucacuucgagcaaauguugaaacugucccagcggagcaaggacgaauuauuuucuauugcacucuacaacuggcugauccagguggaccuugccgauaaacuguugcagguagcuagcccuuuccucgagccccaucugguccguauggcgaagguggaccaaaauagagugagguauauggaucuacuguggcgcuacuacgagaaaaaccgguccuuuucaaaugccgcaagaguccuuaguaggcucgcugacaugcacagcacugaaauuucucugcagcagcgauuggaguauaucgcccgcgccauacuguccgcuaagucaaguaccgcaaucagcuccauugccgcggauggggaauuuuuacacgagcucgaagagaagauggagguugcucggauccaacugcagauucaggaaacacuucagagacaauacucucaucacucgagcgugcaggacgccguaucacagcuggauuccgaguugauggacaucaccaaacucuauggagaauuugcagauccauucaagcuggccgaguguaaacuagcuauaauucauugcgcaggcuacagugacccuauccuggugcagacucuuuggcaagauaucauugaaaaggagcucucugacagcgucacacuguccucaucugauaggaugcacgccuugagcuuaaaaaucgugcugcucgguaagauuuaugcggggacgccccguuucuucccacuggacuuuauaguucaguuccuugagcaacagguguguacccugaacugggacgucggauucgugauccagacuaugaaugaaauuggcguuccguugccucgccuacuggagguguacgaucagcucuuuaaaagucgggaccccuucuggaacagaaugaagaagccacugcaucuuuuagauugcauccacguccugcucauuagguauguagaaaaucccucccagguguugaacugugagcgacggcgcuuuacaaaccugugccucgacgcuguuugugguuaccugguggaacuucaaagcaugucuucauccgucgccgugcaggcaaucaccggcaauuucaaaagucugcaggccaaguuggagagacuacacuga

SEQ ID NO: 59999 - RNA, 6039 nt, Artificial Sequence
  derived and/or modified sequence opt3 from NUP205__Homo_sapiens__NP_055950
auggccacaccccuggcugugaacagcgcagccucccucuggggcccuuacaaggauaucuggcacaaagucgggaacgcgcuuuggagaaggcagccagaagcuguucaccuguuggauaagauucuaaagaagcacaaaccggacuucaucucucuguuuaagaaucccccuaagaaugugcaacagcaugaaaaaguacagaaggccucaaccgaaggaguggcaauccagggucaacagggcacucgguuacucccagaacagcugauuaaagaggccuucauccuuagugaucuguuugacauuggggaauuggcugcagucgagcuccugcuggccggagagcaccagcaaccccauuucccuggccucacgcgcgguuuaguggcuguucugcuuuauugggaugggaagcgaugcaucgccaacuccuugaaagcgcugauacagucccguagaggaaagaccuggacacuagaacucucuccagagcuggcaucgaugacuaccagguuuacagacgaacuuauggagcagggccugaccuacaagguguugacucucgucucacagaucgaugugaauaacgaguucgaaaaacugcaacgggagcgcggcuuagggagcgaaaagcacagaaaagagguaagugaccugauuaaggaauguaggcagucccucgccgagucucuuuuugcuugggccugccagagcccccugggaaaagaggauacauugcuacugaucggucaccucgaacggguuaccguggaggcaaauggcucccuggacgcugucaaccuugcccuguugauggcgcuccuguauuguuucgauauuucauuuaucgaacaaaguacggaggaacgcgacgauaugauacaucaguuaccucugcuaacugagaagcaguacauugccaccauccacagccgacuccaggacucucaacuguggaaacuuccaggguugcaggcaacagugagacuggcuugggcccucgcucugaggggaauuucccagcuuccggacgugacugcccuggcagaguucaccgaagccgaugaggcuauggcggaauuggcaaucgccgacaaugucuuucucuuccugauggagucaguugugguaagcgaauauuuuuaccaggaggaguucuauauccggcgugugcauaacuuaauuacagauuuccuggcucuaaugcccaugaaggucaagcaacuccgcaauagagccgacgaagaugcaaggaugauacacaugaguaugcagaugggcaacgagccuccaaucucucugcggcgagaccuugaacacuugaugcugcucauuggugagcuguacaaaaagaaucccuuucauuuagagcuggcccuugaauacuggugcccuaccgagccauugcagacgcccacuaucaugggguccuaucucggaguggcucaccagcgcccgccucaaagacagguugugcugagcaaauucgucaggcagaugggcgaucuacugcccccaacaauauacauuccuuaucucaagaugcugcagggccuugccaacgggccccaaugugcacauuacugcuuuucguugcugaaagugaauggaucuucccacguagaaaacauccagggugcgggcgggucaccaguuaguugggagcauuucuuucacagcuuaaugcucuaucacgaacaucugcggaaggaccuucccuccgcugauucugugcaguaccgccaucugccuagcagaggaaucacccaaaaggagcaggacggcuugauugccuuccuccagcugacuucaacaaucauuaccuggagugagaacgcaaggcuagcccugugugaacauccacaguggacgccggucguggucauacucggucugcuucaaugcuccauacccccuguguugaaagcugagcuguuaaagacccucgccgcauuugggaaaagcccagaaauugcugccucucuguggcagucacuugaguauacacagauccugcagacuguucguauccccagucaacggcaggcgauuggcauagaaguggagcuaaaugagaucgaaagccgaugugaggaauacccucucaccagagccuucugccagcugauuuccacauugguagagucuucguuuccaagcaaccugggagcuggcuuaaggcccccgggguucgauccuuaccuccaguuucugcgcgacuccgucuuccuucgguuuagaacuagggcauaucgccgagccgcugaaaagugggagguggccgagguugugcuggaagucuucuacaaauugcuccgggacuaugagccacaacuggaagauuucguggaccaguuuguagagcuacagggagaggaaaucauugcauacaagcccccugguuucucacugauguaucaccuucucaaugagagucccaugcuggaauuggcgcugucuuuacucgaggaaggcgugaagcaacuggauaccuacgccccauuuccugggaaaaagcaccuugagaaagcuguucagcauugucuggccuugcucaaccugacacuacagaaggagaaucuguucauggaccuucuccgugaaagccagcuggcauugaucgucugccccuuagagcaacugcuccagggaauaaacccaagaaccaaaaaggcugauaauguggugaacaucgccagguaucuguaccacggcaauacuaacccggaacuugcauuugaguccgccaagauucugugcuguaucucaugcaauagcaacauucagaucaaauuggucggugacuucacgcaugaucagucuauaucccaaaagcuaauggcuggguuuguugaaugucuggacugcgaggaugcggaggaguucgugcgccucgaggaaggcagugagcuggagaagaaacuuguggccauucggcacgagacaagaauccauauuuuaaaucugcucaucaccagcuuggaguguaacccucccaaucuggcacucuaccugcuuggauuugaacugaagaaaccaguaucuacuaccaacuugcaggaccccggcguccuagggugcccuaggacaugucugcacgcuauacucaacaucuuagagaaaggaaccgaaggucgaacuggcccaguggccguucgcgagagcccccagcuggccgagcuuugcuaucaggugauuuaccaacugugugcuugcucagauacaagugggccuacgaugcgguaucucagaaccagccaggacuucuuguuuucgcagcugcaguaccucccguucuccaauaaagaauaugagaucucuaugcugaaccaaaugagcuggcuuaugaagacugcaucaauugaacuaagggucacaagucugaaucgucagcgcucccacacccagcgguuguuacaucugcuccuggaugacaugccagugaaacccuacucugacggagagggcgguaucgaagaugagaacagaagcguuuccggguuucuucacuucgacacagccacuaaggugaggcgaaaaauacugaauauucucgauucaaucgacuucagccaagagaucccugaaccauugcagcuggacuuuuucgaccgggcgcagauugagcagguaaucgcuaacugugaacauaagaaucuacgcggccaaaccgucugcaacgugaaacugcuccacagagugcuugucgccgagguuaaugcacugcagggaauggccgcuauuggccagaggcccuuauugauggaagagauaaguacggugcugcaguauguaguggggcggaacaagcuccugcaaugccuucaugcaaagcgacacgcccuggagucuuggagacagcucgucgaaaucauuuugaccgcguguccucaggaucugauccaggcugaggaccgccaauuaauuaucagggauauacuacaggacgugcacgauaaaauccuggacgaugaagccgcacaggagcucaugccgguuguggccggagcugucuuuacacuuacugcccaucugucccaagcaguguugaccgaacagaagcagacaagcguucugggccccgcugaggcccacuacgcguucaugcucgacucgugcuuuacuucaccaccucccgaggaaaauccacugguggguuucgccucuauuggggacaguucccuuuacaucauucucaaaaagcuguuggauuuuauccugaaaaccggaggcgguuuccagcguguccggacgcauuuauauggcagccuacuguacuaucuccaaauagcacagagaccugacgagcccgauacacuugaagcugccaagaagaccaugugggagaggcugacugcuccagaggacguauuuucuaaauugcagcgcgaaaacauugcaaucaucgagagcuacggggccgcccugauggaagugguuugucgagaugcuugcgacggacacgagauuggcagaaugcucgcgcuggcacuuuuagaucggauaguguccgucgacaagcagcaacaguggcugcucuauuugucaaauaguggguaccugaaagugcuaguagauagccugguggaagacgauaggacacuccagucucuucugaccccgcagccucccuugcugaaggcccucuauacuuacgaguccaaaauggcuuuccugacccgcgucgccaagauccaacagggagcauuagagcuucugcguucaggcguuauugugagacucgcccagugucagguguacgacaugcggccagaaacagacccccaaaguauguuugguaugagggauccuccaauguucauccccacgccugucgaccgcuaucgacagauucuacugccggcuuugcagcugugccaagugauccucaccagcuccauggcgcagcaccuucaggccgcagggcagguucugcaauucuugauaucucauucggauacuauccaggcuauucugagaugucaggacguaagcgccggaucacuccaggaguuagcacugcuuacaggcaucauuuccaaggccgcucugccagguauccuaagugaacucgauguggacgucaacgagggcucucugauggaauugcaagggcacauaggacgguuucagaggcagugccugggccuccuuagccgcuucgggggauccgauagacugaggcaguuuaaauuccaagacgauaauguggagggcgacaagguuucuaaaaaggaugagauugaauuagccaugcagcagaucugugcgaacgugauggaguacugccaaucacugauguugcagagcagucccaccuuucagcaugcagucugucucuucacaccuucccugagcgaaacugugaaccgggacgguccccgucaggauacccaagccccaguagucccuuauuggcgccuacccgggcuuggaaucauuaucuaccugcucaaacagucugcuaaugacuuuuucucauauuacgacucccaccgacagagugugagcaagcugcagaacguugagcaauugccaccugaugaaauaaaagagcugugccagucggugaugccggccggcgucgacaagauuucuacggcucagaaguaugugcucgcaagaaggcggcuuguuaaagugaucaauaaccgcgccaagcuguuaucccugugcagcuuuauuaucgagacauguuuguucauacucuggagacaucuggaauacuaccuacuucacugcaugcccaccgauucacaggacagucuguuugcuucuaggacucucuucaaaucccggcgacugcaagauagcuuugccucagagaccaauuuggacuucagaagugguuuagcaauugucagccagcacgaucuggaccagcuccaagcggaugccaucaacgcuuucggcgaaucccuucagaagaaacugcuagacaucgaggggcuguauucuaaggugcgcagcagguacuccuuuauucaggcccucguacggcguaucagaggauugcugaggauuucacgcaauuga

SEQ ID NO: 60000 - RNA, 5664 nt, Artificial Sequence
  derived and/or modified sequence opt3 from NUP210__Homo_sapiens__NP_079199
auggccgcuagaggcagggggcugcuccuucugaccuugagcguguuacuggcagccggacccuccgcggcugccgcaaagcuaaacaucccuaaaguccuccugccauucacacgggccacucgcguuaauuuuacgcuugaggcuucugaggguugcuaccgauggcugucaacccguccggagguggcaaguauugaacccuugggccucgacgagcagcaauguagccagaaggccguagugcaggcuagacugacacagccugccaggcugacuuccauaaucuucgcggaagauauuaccacagggcaaguccuccggugcgacgcaaucguggauuuaauucacgacauccagauaguuucuaccacucgcgagcuguaucuugaggauucgccauuggaacugaaaauccaggcccuagacucagagggaaacacauuuagcacccucgcuggccugguguucgaauggacgauugucaaggauagugaggccgacagauuuuccgauucucauaaugcacuuaggauccugacuuucuuggagagcaccuacauucccccuuccuauaucucagaaauggagaaagcugccaagcagggugacacaauacucgugagugggaugaagacuggaagcucuaaacugaaggcgcggauucaagaagccguauacaaaaacguucgcccagcagaggugcgauuacugauccucgaaaauauucuucugaaccccgcuuaugaugucuacuugauggugggcaccuccauccacuauaaggugcagaaaaucagacagggcaagauuacagagcuaucaaugccuagcgaccaguacgagcugcaacuccagaauaguauaccagggccggaaggagaucccgccaggccugucgcuguucuggcccaggacaccucuauggugacggcacuucaacugggucaguccagcuugguacucggccaucggucgauccguaugcagggggccucucgccugccaaacuccacuauuuacguggucgagcccggauauuuaggcuuuacagugcacccuggugacagauggguucuggaaaccgggaggcuauacgagaucacuauagaaguguucgauaaguuuucaaauaaagucuaugugagugacaacauucggaucgagacaguacucccagcugaguucuuugaaguucugagcuccucucagaauggaagcuaccaucgaauccgcgcgcuuaagagaggccaaaccgcaauugaugccgcuuugacgucaguggucgaccaggauggcggggugcacauccugcagguccccguguggaaccagcaagagguugaaauucacauaccgaucacccucuauccuaguauucugacauuccccuggcagccaaaaacuggagccuaccaguauaccaucagggcacaugguggcuccgggaauuuuagcuggucuucaaguagccaccuuguggccacaguaacugucaagggagugaugaccacaggcuccgacaucgguuucucuguuauucaggcucaugaugugcaaaacccucugcacuucggggagaugaaagucuacgugauagaaccccacucgauggaguuugccccaugucagguagaggcacgggugggccaggcguuggaacucccccugcgcaucagcggauuaaugccuggcggggcuuccgagguugucacccugucagacugcagucauuucgaucuagccguggaaguggagaaucagggagucuuucaaccacucccggguagacugcccccuggcucugagcacuguagcgggauuaggguuaaggcagaagcccagggauccacuacgcuuuuggugucauaccgucauggccacgugcaucugagcgcuaaaaucacaauugccgcauaucucccacugaaggcuguagaccccucuuccgucgccuuagugacccuggguaguagcaaggagaugcuuuucgaagggggcccucggccauggaucuuggagcccucuaaauuuuuccagaacguuacugcggaagauaccgacuccauaggacucgcccuguuugcuccgcacucaagucgaaacuaccaacagcacuggauccuagugacaugccaggcacugggcgagcaggucauugcccucagcguggggaauaagccuucgcugaccaacccauuccccgcuguugagccugccgugguaaaauuugucugugcacccccauccagacuuacuuuggcgccuguguauacaucuccccaacuggacaugagcugcccauuacuccagcagaauaaacagguggucccgguuucaagucauaggaacccucgccuggaucuugccgcuuacgaccaagaaggacggagauucgauaauuuuuccucucugagcauccagugggaguccacgaggcccguguuggccucaauugaaccagagcuccccaugcagcugguaagccaggacgaugaaaguggucagaaaaagcuacacggccugcaggcaauccucgugcaugaggcuucugggaccacugccauaacagcaaccgccacaggauaucaggagucccaccugagcucggcucgcacuaagcaaccucacgacccacuuguccccuugucagcgucuauugaacugaucuuaguggaggauguucgagugaguccugaagaggucaccauuuacaaccauccgggcauccaggccgaacuccggauacgugaggguuccggguauuucuuucugaauacgagcaccgcagacgugguuaaaguggcuuaccaggaggccagaggcgucgccaugguacacccacuucugcccggaucuagcacaaucaugauucaugaucuaugucucguguucccugcuccagcaaaggccguuguguacgucuccgacauccaggaacuguauauuagggugguagauaaaguggagaucggcaagacugucaaagcguacguucgcguguuggaccugcacaagaagcccuucuuagcuaaauauuuuccuuucauggaucucaagcugcgggccgcaucaccgauaauuacccuuguggcccuggacgaggcuuuggacaacuacacaaucacuuuucucaucagaggggucgcaauuggacaaaccagucugacggccagcgugacaaauaaagcgggccagaggaucaacucugcuccccagcagauugagguuuucccaccuuuucgacuaaugccccgcaagguaacccugcuuauaggugccacuaugcaagugacauccgaagggggaccacagccucagucaaauauccucuucaguauuagcaacgaauccgucgcacuggugucugccgcuggcuugguucagggucuggccaucggcaaugggaccgugucgggauuaguccaagcaguggaugcugagacuggcaaaguagucauuaucagccaggaccucgugcagguugaagugcugcuucugcgggccgucagaauaagggcgcccaucaugcguaugcgcaccgggacacagaugccaauuuaugugacgggaaucaccaaccaucaaaauccguuuucauucggcaacgccguuccugguuugacuuuucacugguccgugacaaagcgggauguccucgaccugagagggaggcaccaugaggcaaguauucgacuacccucucaguacaacuucgcuaugaaugugcugggacggguaaagggccgcaccggucuuagagugguugucaaagccguggauccaacaagcggccagcucuaugggcuggcuagggaauuguccgacgagauccaagugcaggucuuugagaaguuacagcugcucaaccccgaaauagaggcagaacagauucugaugucaccuaauucuuacaucaaacuucaaacuaaccgggauggagccgccagccugaguuaccgaguauuggacggcccagagaaggugcccguugugcacgucgaugaaaaaggguuccuagcuuccggaagcaugaucggcaccucuacgauugaggugauagcgcaggagccuuuuggugcaaaucagacaaucauuguugccgugaaggucucaccgguguccuaucugagaguaaguaugagcccagugcuccauacccagaacaaagaagcucugguugccgucccccuugggaugacugugaccuucacagugcacuuccaugacaauucgggagaugucuuucacgcacacucuuccguuuuaaacuucgccacuaaucgcgacgauuuugugcaaaucggcaaggguccuaccaacaauacaugcguagugaggacggucagcgugggccugacccucuugcguguuugggacgcugagcaucccgggcugucagacuucaugccacucccugugcugcaggcgauuagucccgaacuuucuggagccauggucguaggcgaugugcuguguuuggcaacuguucuaacaucccuggaggggcucagcggaaccuggucaaguagcgcuaacuccaucuuacacauagacccaaagacuggcguggccgucgcacgggccguggguucugucacaguguacuaugaaguugcugggcaucugagaaccuacaaagaggugguagugagcgucccucagaggaucauggcccgccaccuucacccgauucagacguccuuucaagaggcgacugcaucaaagguuaucguggccgucggagaucgaucuaguaaucugagaggcgaaugcacccccacacagcgggaggugauucaggcucuccauccagaaaccuugaucucgugccaaagccaguucaaaccugccguauuugacuuccccucccaggauguguuuacuguugagccacaguucgacacagcucugggccaauauuuuuguucuauaaccaugcacaggcucacagauaagcagcgcaaacaucugucaaugaagaagacugcacuuguggucagcgccucccuaaguucuagccacuucucaaccgagcaagugggggcugaagucccuuucucccccggacuguuugccgaccaggcagagauuuuguuaaguaaccauuacacgagcucugaaauccguguguucggugcgccggagguucuggaaaaucucgagguaaaauccggcucaccagccgugcuggcuuuugccaaggaaaagagcuucggguggccuucguuuaucacauauaccgucggagugcuugaucccgcagcuggcucucaagguccacugaguacuacccucacauucuccagccccguuacuaaccaggccauugcaaucccugugaccgucgccuuugugguagacagacgggggccgggacccuacggcgcuucauuguuccagcacuuucuggauuccuaccaggugauguucuuuacgcuauucgcgcugcucgccggcacagcaguuaugauaauugcuuaucacaccgucugcacuccaagggaccuugccgugccugccgcacugacaccccgcgcuucuccugggcauagcccacacuacuuugccgcgaguucccccaccagcccuaacgcuuuaccacccgcccgaaaggcaucuccgccuucaggauuguggaguccagccuaugcuucccauuga

SEQ ID NO: 60001 - RNA, 6273 nt, Artificial Sequence
  derived and/or modified sequence opt3 from NUP214__Homo_sapiens__NP_005076
augggcgacgagauggaugccaugauccccgaaagagagaugaaggacuuccaguuuagggcucugaaaaaggugcggauuuucgauagcccugaggaacucccaaaagaacgcuccucucuucuggcagucucaaacaaguacggguugguuuuugccggaggugcgaguggcuuacaaauauucccgaccaaaaaucuguuaauccagaacaagcccggggacgauccuaauaagauuguggacaaaguccagggacuccuggugccaaugaaguuucccauccaccaucuugcucugagcugcgauaacuugacucucuccgccuguaugaugucuucggaguauggcucaauuaucgccuucuuugacguccgaacuuucagcaaugaggccaaacagcaaaagcguccuuuugcuuaccacaaacugcugaaggaugccggugggauggugauagacaugaaguggaacccaacgguucccaguaugguggccgucugccucgcugauggauccaucgccguguuacagguaaccgaaacuguuaaagugugugcgacucugccuucuaccgucgcagugacaagcgugugcugguccccaaagggcaaacagcuugccgucggcaagcagaaugggaccguugugcaauauuugccgacucugcaggagaaaaagguaauucccuguccuccauucuacgaaucagaccaccccgugagaguccuagaugugcucuggaucggaacauauguuuuugcuauuguguacgccgcagcugacgguacccuggagacgaguccugacgucgugauggcccuucugcccaagaaagaggaaaagcaccccgagaucuucguaaacuuuauggaaccgugcuauggcagcuguacugagaggcagcaucacuacuacuugucuuauauagaagagugggaucucguucuggcggccuccgcagcuucaaccgaggugagcauuuuagcccggcagagugaccaaaucaauugggaaucuuggcugcucgaggauuccagccgcgcugaacuuccugucacagacaaaucggaugacucucugcccauggggguggucguggauuacacuaaccagguugagauuaccaucuccgacgaaaagacauugcccccugcccccgugcuaaugcugcucucaaccgauggaguacugugcccauucuauaugaucaaucagaaccccggcgucaaaagucuuauuaagacgccugagagacugagcuuggagggugaaaggcaaccaaaauccccggggucuacucccacaaccccuacuagcucacaggcaccacagaagcucgacgccagugcugcggcagcccccgcuucccugccuccaagcucucccgccgcaccgauagccacauucucauuacugccugcuggaggcgccccaaccguguuuaguuucggcagcuccucucuaaagucgagcgcaacgguuaccggggagcccccuuccuacucaaguggaucugauagcuccaaagcggcucccgguccaggcccuucaacauuuagcuucgugcccccaucuaaggccucccucgcaccgacuccugccgcuagucccgucgccccaagcgcagcuucuuuuuccuucgggucaaguggauuuaaacccacccuggaaagcacaccugugccaucgguauccgcccccaauaucgcgaugaagccuucuuucccgccaagcacuucagccgugaaaguuaaccuuagugagaaguuuaccgcugcagccacauccacccccgucucuagcucccagucagcuccuccaaugagccccuucaguucugccuccaagccugcagcgagcggcccguugucgcaccccacuccacugucagccccucccucuagugugccacucaaauccagcgugcugccuucucccagcggucgguccgcucaagggucaaguagcccagucccgucuaugguucagaaguccccucgcauuacgcccccagccgcaaaacccggcucaccucaggcuaagagucuucagccagccguggcagaaaaacaaggacaucaguggaaggacagcgaccccgugauggccggcaucggggaggagauagcucacuuucagaaggaacuggaggaauugaaagcgcgaacauccaaggccuguuuccagguaggaaccucugaggagaugaaaaugcucagaacugaaucggaugaccugcauaccuuuuuacuggagauuaaggaaacaaccgagagccuacacggugauaucucaucccucaaaacuacacugcuugaaggcuucgcaggggucgaggaggcuagggaacaaaaugagcggaaccgugacaguggauauuugcaucugcucuacaagcgcccucuggauccgaaaucugaagcccaguuacaggagaucagaaggcugcaucaguaugugaaguucgccguucaagacgugaacgauguccuugacuuggaaugggaucagcaccucgagcagaagaaaaagcaacggcaucugcuagugccagagcgagaaacgcuguuuaauacccucgcuaacaaucgcgagauuaucaaccagcagagaaaaaggcugaaucaccuuguugacagcuugcagcaacugcgguuauacaagcagacuucccucuggucacugucuagcgcagugcccagucaguccagcauucauucuuucgauucagaccuugaaucccugugcaacgccuugcucaaaacaaccauagagagucacacaaagagccugccuaagguacccgcgaaacuaucgccaaugaagcaggcucaacugcgcaauuuucucgccaaaagaaagacuccucccgucaggucuaccgcaccagccucccugagccguucagcuuuccuuagucagcgguacuaugaagauuuggacgaggugucuuccacgagcucagugagucagagccuggaguccgaagacgcacgaaccucuuguaaagaugacgaggccgucguucaggcgccuagacacgcuccggugguaaggacacccagcauccaaccauccuuacucccucaugccgcacccuuugccaagucacaccuggugcauggcucuaguccaggugucauggggacuucgguggcuaccagcgccuccaagauuaucccucagggcgcagauucuacaaugcuugcuacuaaaaccguuaagcacggagcccccucaccgagccacccaaucuccgcgccucaggccgcagcugccgcugcacugcgccggcaaauggccagucaggcccccgcugugaacacgcuaacagaaucuacccucaaaaaugucccacaggugguuaacgugcaggagcugaagaauaaccccgcgacuccuagcacagcaaugggcucauccgucccguacaguaccgccaaaacuccccauccaguauugaccccuguggcugccaaucaagcaaagcaggggagccugauuaacucuuuaaagcccuccggaccuacaccagccucaggucagcucagcucgggcgacaaggcuucugggacggcgaagauagagaccgccguuacaagcacacccuccgcaagcggacaguucucaaaaccuuuuuccuucucuccaagcggcaccgguuuuaauuucgggaucauuacacccacuccgaguuccaacuuuaccgcugcccaaggcgcaacgccuagcacaaaggaaucuucacagccagaugccuucaguuccggaggcgggagcaaacccucuuaugaggcuaucccugaaucgucaccacccagcggaauuaccuccgccaguaacacuaccccgggcgagccugcggcaucuagcuccagacccguggccccaucagguacagcucugaguacuaccucuagcaaacuugaaacaccucccuccaaacugggggaguugcucuuuccaucaagccuggccggagagacgcuaggcucuuucuccggucugagggucggccaggcugacgauaguaccaagcccacuaauaaggcaagcucgacaucccuuaccucuacucagccuacaaaaaccucaggggugccaagcggauucaacuuuacggccccgcccguacucggcaagcacacugaaccuccagugaccaguuccgcuacaaccacuucugucgcaccuccagcagcgacaagcaccucauccacagccguuuucgggagucugccagugacuagcgcuggaucuucaggcgugaucuccuuuggugggaccagcuugucugccggaaaaacgaguuucucguuuggcucccaacagacaaauagcaccguaccaccuucagcaccgccacccacuaccgcugccacaccucugcccacuucuuucccaacccucagcuuugguucccuacugaguucagcaacgacaccuucucuucccaugagcgccggccgcuccaccgaggaagcuacaaguagcgcgcugccagagaagccgggggacuccgaagugucugccucagcagcuagcuugcucgaggagcagcagucggcccaacugccucaggcacccccacagacauccgauaguguuaaaaaggaacccguacuagcacaaccugcugugucuaacagcggaaccgccgcgucauccacuucucuggucgcucuuagugccgaggcaacaccagccaccacgggcgugcccgacgcucgaacugaagcaguuccuccggccagcuccuucucagugccagggcagaccgcggucacagcugccgcaauaagcucugccggacccguggcuguagagaccaguuccacaccuaucgccagcucaacuaccucuauugucgcaccaggccccuccgcugaagccgcggccuuugguacggugacaucggggagcaguguuuucgcacagccucccgcugccucuuccagcucagcauuuaaucagcucacuaacaauaccgcuacagccccaagugccaccccgguguucggacaagucgcggcuuccacugcaccuagccuguucggccagcagaccgguucuacagccucaacggcugccgcaacuccccaggugagcuccucuggcuuuaguucgccagccuucgggaccacagcuccuggaguuuuuggccaaaccacuuucgggcaggcgagcguguuuggacaguccgccucaucugcagcuagcgucuucaguuuuucccagcccggcuucucaucugugccagccuuuggucaaccugcaagcuccacacccaccaguacgagcgggucuguauucggagccgcuucauccacuagcaguucuuccucguuuagcuucggccagucauccccgaacacaggcgggggauuguuuggucagucuaaugccccagcguucggccaaaguccuggguucggacagggcgguagcguguuugggggaaccucagcagccaccacuacagcugccaccuccggcuucagcuuuugccaggcaucuggcuucgggaguuccaacacaggaagcguuuuuggucaggcugccucaacuggcgggaucgucuucggacaacagucuucgagcuccaguggcucuguguuugguucagggaauacgggacggggcggcggguucuuuagcggauuagguggcaagcccucccaggaugcugccaacaaaaauccauucaguucugcaagcgggggauuuggcuccaccgcgacaucaaacacuagcaaucuguucgguaacucuggggccaagaccuuuggaggcuucgcuuccaguucauucggcgagcagaaacccacagggaccuuuagcucgggagguggcuccguggccucucaaggguucggauuuaguagcccuaacaagacuggcgguuucggggcagcuccggucuuuggaucaccacccacguucggcggcuccccuggguuuggagguguacccgccuucggcucugcaccagccuuuaccagcccucucgggaguacaggaggcaaaguguucggugaggggacugcggcugccuccgcaggcggauuuggcuucgggaguucuucaaauaccacauccuuuggaacccuggccagccagaacgcucccacuuucgguagucuuucucagcagacaucaggcuucgggacgcaauccagcggauuuucgggcuucgguucugggaccggcggauuuaguuucggcuccaauaacagcucaguucagggguuuggagguuggcguucuuga

SEQ ID NO: 60002 - RNA, 930 nt, Artificial Sequence
  derived and/or modified sequence opt3 from NUP35__Homo_sapiens__NP_001274513
augaugcugggcagccccaccuccccuaagccaggggugaacgcccaguuccucccgggauuucuuaugggugaccugcccgcuccugucacaccacaacccagaucuaucucaggcccuaguguuggggugauggagaugaggagcccauuguuagcaggaggcuccccaccucagccaguagugccggcccacaaagauaagucuggugcgcccccuguccggucgauuuacgacgauauaucaagcccagggcugggaaguacuccccuaacgucccgccgacagccuaauaucucugugaugcagagcccacucguuggcgugaccuccacacccggcacugggcaaucaauguucaguccggcuagcauuggacagccucguaaaaccacacugucucccgcccagcuugacccauuuuauacccagggugauucccugacuucagaagaccauuuggaugacagcugggucacaguguucggcuuuccucaagcaagugccucuuacauccuccugcaguucgcucaguaugggaacauucugaagcacguaauguccaauaccggaaacuggaugcauaucagauaccagagcaaacuccaagcaaggaaggccuuaucgaaggauggccggauauuuggugagucuaucaugauugggguuaaacccugcaucgacaaguccgugauggaaucaagugaucgcugugcucugagcuccccaucucuugccuucacgcccccuauuaaaacuuugggaaccccaacacagccgggcagcacucccagaaucucaaccaugaggccucuggcgacagcauauaaggccaguaccuccgacuaccaggucauaagcgaucggcaaacgcccaaaaaggacgagucucuagugucaaaggcuauggaauauauguuuggcugguga

SEQ ID NO: 60003 - RNA, 981 nt, Artificial Sequence
  derived and/or modified sequence opt3 from NUP37__Homo_sapiens__NP_076962
augaagcaggacgccagcagaaacgcugcauacaccguggauugcgaggacuauguccacguuguggaguucaaucccuuugaaaacggcgauuccgggaaucugaucgccuacggagguaacaauuauguagugauuggcacauguacuuuccaagaagaggaagcggacgucgaggggauacaguacaagacgcucaggaccuuucaucacggagugcggguugauggcaucgcuuggucuccugagacacgccuugacucacugccaccggugauuaaguucugcaccagugccgcagauaugaaaauccgauuguuuacuagcgacuuacaggauaagaacgaauauaaaguccuggagggucauacagacuucauuaaugggcuaguguuugaucccaaggaaggacaggagaucgccuccguaucugacgaucacaccugucguauauggaaccucgagggcguucaaacugcucauuucgugcugcacucgccuggcaugucagucugcuggcacccagaagagacauuuaaacuuaugguggcagaaaagaaugggaccaucagauucuacgaccuguuggcccagcaggcuauucucagccuggagagugaacaggugccccugauguccgcccauuggugucucaagaacacguuuaaagucggagcgguugcagguaaugacugguuaaucugggauauuacuaggucuagcuauccucaaaacaagcggccagugcacauggaccgcgccugccuguucagaugguccaccaucucagagaaucuuuuugcuacaacuggcuaccccgggaaaauggccagucaguuccagauacaucacuugggacacccucagccaauucugaugggcagcguagcaguggguucugggcuauccuggcauaggacccucccgcugugugucaucggaggcgaucacaaacuucuguucugggugacagagguuuga

SEQ ID NO: 60004 - RNA, 1143 nt, Artificial Sequence
  derived and/or modified sequence opt3 from NUP43__Homo_sapiens__NP_942590
auggaggaaaucuacgccaaguucgugagccagaaaauuuccaagaccagauggaggccccugccuccaggcucucuccaaacagcugagacuuuugcaacggggucaugggacaacgaagagaauuauauaagucuuuggagcaucggagauuucgguaaccuggacuccgauggcggguuugaaggagaccaccaguuguuaugcgauauucggcaucacggcgacgucauggaucugcaguucuuugaccaggagcgcaucguugccgcgucuucgaccgguugugugacaguauuccuacaucacccgaauaaccaaacucucucagugaaucagcaguggaccacagcucauuaccacaccgggcccggaagcccuaguuauuccucugccccaugcacuggcgucguguguaacaaucccgagauuguuacagugggcgaagaugggcgaaucaaccuguuucgugcagaccacaaagaggccgucagaaccauagauaaugcugacagcuccacgcuucaugcagugacuuuccugaggaccccugaaaucuugacaguaaacucaauuggacagcucaagaucugggauuuucggcaacaggguaaugagccaagucagauucugagccugacuggcgaccgcguuccccuccacugcguggacagacauccuaaccagcaacacgucguggccaccgggggacaggauggcauguuaucuaucugggacgugaggcaggguacaaugccagucucccugcuuaaagcucacgaggccgaaaugugggagguucauuuccacccgucaaaucccgaacauuuguuuaccuguagcgaggaugggagucuguggcacugggacgcgucuacggaugugccugaaaaguccagccuauuccaucaaggaggccggucgucuacuuuucucucccacucaauaaguaaccaggcaaauguacaccagagcgugauuuccucuuggcugagcacagacccagccaaggaucgcaucgagauuaccucacuucugcccagucgauccuugagcgucaacacucucgacgugcugggcccuugcuuaguuugugggacagaugcugaggccaucuacgugaccagacaucuguucucuuga

SEQ ID NO: 60005 - RNA, 1323 nt, Artificial Sequence
  derived and/or modified sequence opt3 from NUP50__Homo_sapiens__XP_005261370
auggccagcgaggaagugcugaagaacagagcuaucaaaaaggcaaaaaggcggaaugucggauucgaguccgacaccgggggagccuuuaaggguuucaaaggccucguugugcccucugggggaggccgcuuuucagguuucgggaguggagcgggcggcaagccucuugaagggcugagcaacggaaauaacauuacauccgcuccaccguuugccucugcaaaggccgcugcagaucccaaaguagccuucgguucguuggcugccaauggcccuacuacguuaguggacaaggucucaaacccaaaaaccaauggggauagccagcaacccaguuccucuggacuggcgagcuccaaggcaugcgugggcaacgccuaccacaaacagcuagcugcccucaauuguucaguucgagacuggauagugaagcaugucaacacaaauccucugugcgaucuuacuccaaucuuuaaggacuaugagaaauaccuggcaaacauugaacagcagcacgguaauagugggcguaacagcgagucugaguccaauaagguggcugccgaaacccaaucacccagcuuguucggaaguacaaaacuccagcaggagucuaccuuucuguuccauggcaacaagacugaagauacaccugacaaaaagauggagguagcguccgagaaaaagaccgauccaagcucgcugggcgccacgucugcauccuuuaacuucgggaagaaaguugacucaagugugcucgguagcuuauccucugucccgcugacuggauuuagcuucucacccggcaauaguucccuuuucgggaaggauaccacacagagcaaaccugugucuucaccauuucccacuaagccuuuggaaggacaagcugagggcgacaguggugaauguaaagggggcgaugaggaagagaacgacgagccacccaagguggucguuaccgaagugaaggaggaagacgccuucuauagcaaaaagugcaaacuguuuuacaagaaagauaaugaguucaaggaaaagggaaucggcacacuacaccucaaaccgaccgcuaaccagaagacgcagcugcuuguaagagccgacacuaaucuggggaacauuuugcucaaugugcugaucccucccaacaugccauguacaaggaccggcaaaaauaacgucuuaauagugugcguuccuaaucccccaaucgaugagaagaacgcaacuaugcccgugacaaugcugauucgggucaaaaccuccgaggacgccgaugaacuccauaagauccuucuggagaagaaagacgcuuga

SEQ ID NO: 60006 - RNA, 1569 nt, Artificial Sequence
  derived and/or modified sequence opt3 from NUP62__Homo_sapiens__NP_001180286
augagcggcuucaacuuugggggaaccggugcccccacaggcggguucacuuuuggaacggcuaagaccgcaacaacuaccccugccacaggcuucuccuuuucuaccucagguacugggggauucaauuuuggcgcgccauuccagccggcuacaaguacccccagcacgggccuguuuucccucgccacucaaaccccugcaacacagacuaccggguucacauuuggaaccgccacgcuugcuucugguggcacuggguucucgcugggaaucggcgcaucaaaauugaacuuaagcaauacagccgcuaccccagccauggcgaaccccagugguuuugggcugggauccucuaaucuaacuaacgcaauuagcuccacagugaccucaagucagggcacggccccuaccggcuucgucuucgggccaagcacaacuucuguugcucccgccaccacauccggagguuuuucauucacuggcgggagcaccgcacagccuaguggauuuaauauaggcucugcugguaacuccgcccaaccaacagcgccggccacccuccccuucacuccugcaacgccagcugccacaaccgcuggggccacucagcccgcagccccuaccccaacagcuaccaucacuagcacaggccccucgcuguuugcgucuauugcaacggccccgaccuccucagcuacuacaggacuuagucugugcaccccugugacaacugccggcgcacccaccgccgggacgcagggauucagcuugaaggcuccaggugccgcauccggcaccucuacaacuaccagcacagcggcuacugccaccgcaacgacaaccucaaguuccagcacuacaggguuugcccucaaucugaaaccucuggcucccgccggaaucccaucuaacaccgcagcugccguaacugcgcccccuggcccaggugccgcugcaggggccgcugccucaagugcaaugaccuacgcgcagcucgagagcuuaauuaauaaguggucccuggaacuugaggaccaagaaagacacuucuugcagcaggccacacaggugaacgcuugggauaggacgcugaucgagaauggcgagaaaauaaccucucuacaucgggaagucgagaaggugaagcucgaccaaaaacgccuggaucaggaacuugacuuuauccugucgcagcaaaaggaguuggaagaucuccugagcccguuagaggagcugguuaaagaacaguccggaacuauuuaucuccagcacgccgacgaggaacgagagaagacauacaaacuugcagaaaacaucgaugcucagcugaagcguauggcccaagacuugaaggauauuaucgagcaucuaaauaccucaggcgcacccgccgacacaagugauccucugcagcagauauguaaaauucucaacgcucacauggacucucugcaguggaucgaucaaaacagcgcgcuucugcagagaaagguggaggaagucacuaaagugugcgaggggaggcggaaggaacaggagcgcuccuucagaauuaccuuugacuga

SEQ ID NO: 60007 - RNA, 1833 nt, Artificial Sequence
  derived and/or modified sequence opt3 from NUP85__Homo_sapiens__NP_001290205
auggugcccagcugcccuuucaucuacauuauaagaaaggacgucgauguuuauucccagauccugaggaaacucuuuaacgagucucacggcauuuuccuugggcugcaacggaucgacgaagaguugaccggaaagucacgcaaaagucaguuagugcgaguaagcaagaauuaccguuccgugauuagagccuguauggaagagaugcaucaggucgcuaucgcagccaaagauccagcgaacgguaggcaguuuucuucgcaagugucaauacugagcgcuauggaacuaaucuggaaucucugcgagauucuguucaucgagguugccccggcaggcccccuucuguugcaccuccuggacugggugcggcugcaugucugugaaguggauagucucuccgccgacguauuagggucugagaacccuagcaagcacgauuccuuuuggaaucugguuacaauucuuguguugcagggacgccuggacgaagcuagacagaugcuaucaaaggaggcagaugccaguccagcuagcgccggcaucugcaggauaaugggugaccucaugcggacuaugcccauucugucuccugggaacacgcagacccuuacagagcuggaauugaaauggcaacauuggcacgaggaaugugagcgcuaucuccaggauuccacuuucgcgaccucaccacaccuggagagcuuacugaagaucaugcucggagacgaggcagcccuucuggagcagaaagaauugcuaaguaauugguaccauuuucuggucacacgacuccuguauucuaaccccaccgugaagccuauugaucuucacuacuaugcucaguccagccuggacuuguuccucggcggcgagucgucuccagaaccgcuggacaauaucuuacuggccgcauuugaguucgauauccaucaagugauuaaagaaugcuccauagcucuaucaaacuggugguuugucgcccaccucacugaccugcuugaucacuguaaguugcugcagagucauaaucucuacuucgggagcaacaugagagaguuucugcuucuggaguacgcguccggauuguucgcccaccccucucucuggcagcuggguguugacuauuucgauuacugcccugaauuaggcagggugagccuggagcuacauaucgaacggauuccacucaauacagagcaaaaggcacugaaaguacuucguaucugugaacagcgccagaugaccgaacaggugagaucaauaugcaagauuuuggcuaugaaagccgucaggaacaaucggcuggggagugcucucuccuggagcauccgagccaaggacgcagccuuugcuacgcuggugucugaucgcuucuuaagagacuauugugagaggggaugcuuuucagaucuggaccuuaucgauaacuugggccccgcgaugaugcucagugaccggcugacuuuccuagguaaauaccgcgaauuucacagaauguauggggagaagagguucgcagacgccgcuagccugcuccugucccuuaugaccucucguauugccccucggucguuuuggaugacauugcugacugaugcauuaccacuccuggaacaaaaacagguuaucuucagcgccgagcagaccuacgagcuuaugcgaugccuggaagacuugacauccagaaggcccgugcauggagagucagauaccgaacagcuccaagacgaugacauugagacgacuaaggucgaaaugcugcgccuaagucuggcucggaaccucgccagagcaauaaucagggagggcucucuggagggcagcuga

SEQ ID NO: 60008 - RNA, 2226 nt, Artificial Sequence
  derived and/or modified sequence opt3 from NUP88__Homo_sapiens__NP_002523
auggccgcugcagagggccccgugggggacggagaacuguggcagaccuggcucccuaaccacgucguuuuccuuagacugagggaggguuugaagaaucaaagcccaacagaagccgagaaaccggcguccucuucauuacccaguagcccuccaccccagcugcuaacucggaacgugguauuuggccucgggggagaacuguuccuuugggauggcgaggacuccucuuuucuggugguccgcuugcgagguccuucagggggaggcgaggaaccagcucucucgcaguaccagcgucugcugugcaucaaucccccucucuucgagauuuaucaaguguuacugagcccaacgcagcaucacguugcccuuauaggcaucaagggguugauggugcuggaacuaccgaaaagauggggaaagaacagugaguuugaggguggcaaauccaccgucaauuguucuacaacucccguggcagaaagguucuuuaccagcuccacaucacucacccugaagcaugccgcuugguacccuagugagauucuugauccacacguaguucuguugacuagcgacaacgugauccggauuuauucucuccgcgaaccccagacaccuaccaaugucaucauacuguccgaggcagaagaggagucauuagugcugaacaaggggagagccuacacggcuagccucggagaaacugccguggcguucgauuuuggcccacuugcagccguccccaaaacccuguucggucagaaugggaaggacgagguuguggcuuauccguuguacauccuauaugaaaacggagagacauuucugacuuacauuagucuccugcauucuccuggcaauaucggcaaacuucuggggcccuugccaaugcacccugccgcagaagauaacuacggauaugacgcuugcgccguacucugucugcccugcgugccaaauauuuuagucaucgcgaccgaguccgguaugcuguaccacugugugguucuagagggcgaagaggaagaugaccauacaagcgagaagucgugggauucuaggauagaccucauucccucccuguauguguucgaaugcgucgagcuugaguuggcccugaaacucgcaucaggggaagaugacccuuuugacagugauuucagcuguccagugaagcugcaccgggacccgaagugccccucccgcuaccauuguacccacgaggcuggaguacacucuguuggccuuacguggauccauaaacugcacaaguucuuggguagcgaugaagaggacaaagauucacuccaagagcugaguacugaacagaagugcuuuguggagcauauuuuauguacaaaaccucugccaugccgacagcccgccccuaucagaggguucuggaucgucccagacauucuaggccccaccaugauaugcaucacuuccacauaugaaugucucauuuggccgcugcuuagcaccgugcacccugcuucuccacccuugcugugcacgagggaggaugucgaaguggccgagucaccucuccggguucuggcagagacccccgacaguuuugaaaagcauauccguagcauauuacagcgcuccguggccaacccagcuuuccugaaagcgucugagaaggauauugcaccucccccagaagagugucuucaauugcucucgagagccacacagguauuuagggaacaguacauccugaagcaagaccuagcuaaagaggagauccagcggcgagucaagcugcucugcgaucagaaaaagaaacagcuggaagaccuuagcuauugucgcgaggaaagaaaguccuugagggagauggccgaacggcuggcagacaaguacgaggaggccaaagaaaagcaagaggauauuaugaaucgcaugaaaaaguuacuccacucauuccacagugaacugccggugcuuucugacagcgagagagauaugaaaaaggagcugcaguugaucccugaccagcucaggcaucugggaaacgcuauuaagcagguuacuaugaaaaaggauuaccaacagcagaaaauggaaaaggugcuaucccugcccaaaccaaccauaauccucucagccuaucagcguaagugcauucaaagcauccugaaggaggaaggcgagcacauccgggaaauggucaaacagauuaacgacauacgaaaucaugugaacuuuuga

SEQ ID NO: 60009 - RNA, 2460 nt, Artificial Sequence
  derived and/or modified sequence opt3 from NUP93__Homo_sapiens__XP_005256320
auggacaccgagggcuucggggaacugcuccagcaagccgagcagcuugcugcagaaacagagggaaucagcgaacugccccacguggagagaaacuugcaggagauucagcaagccggugaaagguuacggucccgcacucugacgcgaaccucucaggagacagcggaugucaaggcuucaguucuacucggcagucgugggcuggacauaagccauaucucccagagacuugaaucucugucggccgcaacuaccuuugagccuuuggagccagugaaagauacagacauucagggauuccucaagaaugaaaaagauaacgcccugcugucagcuaucgaggaaagcaggaagcggaccuuuggcauggcagaggaauaccaccgcgagaguaugcucguagagugggaacaagugaaacagagaauuuuacauacucugcuugccuccggugaggacgcuuuggauuucacacaggaaucugagccgagcuauaucuccgacgucgggcccccuggaaggucaagucuggauaauauagaaauggccuacgcgcggcagaucuauauuuacaacgagaagaucgugaauggccaccuacaaccaaaccucguugaccugugcgcaagcguggccgagcuugaugacaagucuauuuccgauauguggaccauggucaaacagaugacggacgugcuguugacucccgcuaccgacgcccucaagaaucgcucaagcguagaaguucgaauggaguuugugagacaggcacuggcuuauuuagaacaaaguuacaaaaacuauacacuggucacuguguucggcaaucuccaucaggcccagcuugggggagugccugguaccuaccagcuggucaggagcuuuuugaacaucaagcuaccagcgccccugccuggccuccaagauggggagguugaaggacacccagugugggcccugauauacuauuguaugcggugcggcgaccuucuggcagcuucccagguagugaaucgugcccagcaccaguugggugaguucaaaacaugguuucaagaguacaugaacagcaaggaucgcagacucucgccggcuaccgaaaauaagcugagguuacauuaucggcgagcccugcgcaacaauacggaccccuacaaaagagcagucuauuguauuaucgggaggugcgaugugacugacaaccagucugagguugccgauaagacagaagacuaccuauggcucaaacugaaccagguguguuucgaugacgauggaaccuccucaccucaggaccggcuuacuuugagucaauuucagaagcagcugcucgaggacuauggcgagagccacuucacagucaaucagcaaccauuucuguacuuccaggugcuuuuccugaccgcucaguuugaagcggcaguagccuucuuguuucgcauggagagacucaggugccaugcuguucacguggcccuggucuuauucgaacugaaacuacuccugaaguccucuggccaaagcgcacagcuuuugucacacgagcccggggauccuccaugucugcgucggcucaacuuugugcgacuguuaaugcuguacacgagaaaauucgaaaguaccgaccccagggaggcccuucaguauuuuuacuucuugcgcgaugagaaggacucccagggagaaaauauguuucuccggugcgucagcgagcuggugauugaaucuagagaguucgauaugauccuagguaagcuggaaaacgacggcucaaggaaaccggggguuaucgauaaguuuacaagugacacuaaaccuauuauaaauaagguggcuagcguagccgagaacaaaggacucuucgaggaagcagcgaagcuguaugaucuugcuaagaaugccgacaaagucuuggagcugaugaacaaguuacucucccccgugguuccacaaaucucugcaccucagucgaauaaagaacgccugaagaacauggcccuuagcauugcugagcgauaccgggcccagggcaucuccgcaaauaaauuuguggauucaaccuucuaucuguugcucgaccugauaacauucuuugaugaauaccauaguggucacauugaccgugcuuucgacaucaucgagagacuaaagcuggucccccucaaccaggagucuguggaagagaggguagccgcguuucgcaauuucagcgaugaaauucggcauaaccuguccgaggugcuuuuggccacuaugaauauccuguuuacccaauucaagagauuaaaagggacaucaccaucuucuuccaguaggccccagcgaguuauugaggaccgcgauagccagcuccggucucaggcuagaacccugauaacuuuugcaggcaugaucccuuauaggacguccggagacacaaacgcccgucuuguccaaauggaagugcugaugaacuga

SEQ ID NO: 60010 - RNA, 2814 nt, Artificial Sequence
  derived and/or modified sequence opt3 from NUP98__Homo_sapiens__NP_005378
auguucaacaagagcuuuggcacccccuucgggggagguaccggcggguuuggaacuacguccaccuucggccagaauacagguuuugggacuaccucuggaggcgccuucggcacaucagcuuuugggaguagcaacaauaccggaggucuguucggcaacucccaaacuaaaccugggggacucuuuggcacaucuucguucucacagccagcaaccagcacgaguacugguuuuggguucggaaccuccacaggcacugccaauacccuuuuuggcacagcgucuaccgggacgagccuguucuccucacagaacaaugcuuucgcccagaacaagccgacuggauuugguaauuucggcacaaguaccagcucugggggauuguuuggcacuacaaacaccacguccaaucccuucgguucaaccagcgggaguuuauuuggcccuucuuccuucacagcagccccaacuggaaccacaaucaaauuuaaucccccuacuggcaccgacacaauggugaaggcuggggucagcaccaacauuucgacuaaacaccaaugcauaacggcaaugaaggaguacgaaucuaagucccuggaggaacuaagacucgaggauuaucaggccaacaggaaaggaccacagaaucagguuggugcuggcacaaccacugggcuguucggaucaagucccgccaccagcuccgcgacaggccuuuuuagcagcucaaccacuaacagugguuucgcauacgggcaaaacaagacagccuuuggcacguccaccacuggauucggcacaaauccugggggacuguuuggucagcagaaccagcaaaccaccagcuuguucucuaaaccauucggccaggcuacuaccacgcagaauaccggguuuucauucggaaacacaaguacuaucggccaaccgagcaccaauacaaugggucucuuuggggugacucaggccucccagcccggcggacuguucggcaccgcaacgaacacaucuaccgggacugcuuuuggaacaggcaccggucuguucgggcagacuaauaccggauuuggcgccguagguucgacacucuucggcaacaauaaguuaacgaccuuugggagcuccacuacaucagcgccuaguuucggaaccacaucuggcgggcuguuuggaaacaaaccaacucuuaccuugggcacgaauacaaacaccagcaauuucgguuuugggacuaacaccuccggaaauucaauuuucggcagcaagcccgccccugguacacugggcacugggcuaggagcaggcuucgggaccgcucucggagccggccaggcuucucuguuugguaacaaccaaccaaagaucgggggaccccuuggcacaggugccuucggcgcaccgggguuuaauacgaccacugccacacugggauucggcgcuccucaggcgcccguggcauugaccgacccaaacgccuccgcugcccagcaagcaguccuccagcagcauauuaauagucugacuuauagcccuuuuggggauucucccuuauuccggaacccaauguccgaccccaaaaagaaagaggaacgccugaagccuacaaauccagccgcucagaaagcccucaccacgccgacucacuacaaacuuacaccccgaccugcaacacgugugagaccaaaggcgcugcaaaccacuggaacagcuaagucacauuuguuugauggccuagacgaugacgagcccagucuggccaacggugcauucaugccuaagaaaagcaucaagaaacucguucugaagaaucuuaacaauucgaaccuguuuuccccagugaauagggauucugaaaacuuggccagccccucagaguauccggaaaauggggagcgguucaguuuucucuccaaaccugucgacgagaaccaccagcaggauggagacgaagauucucuggugagccauuucuacaccaauccaauagcuaagcccaucccucagacacccgaguccgccggcaacaagcacucaaacagcaauaguguagacgacacuauuguugcauuaaacaugcgcgcugcccugagaaauggccuagaagggucuuccgaggaaaccagcuuccacgaugagucgcuccaagacgauagggaggaaaucgagaacaauucauaucauaugcacccagcgggaauuauccugacgaaaguggguuacuacacaauaccuucuauggacgaucuugccaagauuaccaacgaaaaaggcgaguguaucgucagugacuuuacuauugggcggaagggauauggcuccaucuacuucgaaggugaugugaauuugaccaaccugaaucucgacgauaucgugcauauucgccgaaaagaggucguuguguaucuggacgauaaccagaagcccccaguaggggagggacuuaauagaaaggcugaagugacacuggacggcgucuggccgacugacaaaaccucuaggugcuugauaaagucuccugaucggcucgcagacaucaacuacgagggccgucuggaagccgugagccgcaaacagggggcucaauuuaaggaguauagacccgaaacgggauccuggguuuucaaagugucacacuuuaguaaguacgguuuacaggauagcgacgaggaggaagaggaacacccaucuaagacauccaccaaaaagcugaaaacugcaccccuaccuccagccucacagacaacaccccuccagauggcgcugaauggcaagccugccccgccaccccaagucgagaaaaaggggcaguga

SEQ ID NO: 60011 - RNA, 1272 nt, Artificial Sequence
  derived and/or modified sequence opt3 from NUPL2__Homo_sapiens__NP_031368
auggccaucugccaguucuuucugcaaggcagauguagguucggggaccggugcuggaacgagcaccccggagcucgcggugcaggcgggggacgacagcagccucagcaacagccaagcggcaauaaccguagagguuggaauaccacaucccagagguacucuaacgugauucagccgucaaguuuuagcaaguccacucccuggggagggucucgggaucaagaaaaaccuuauuucucgucauuugacagcggcgccaguacgaaucgcaaggagggcuucgggcucuccgaaaacccauuugcgucucuuagccccgaugagcagaaagacgaaaagaaacuguuggagggaauagucaaggauauggagguuugggaauccucaggucaguggauguucaguguguacagcccuguaaagaaaaagccaaauaucucuggcuuuaccgacauuucccccgaggaauuaagacuggaguaucauaacuuccuaacaucaaauaaccuccagagcuaccugaauagugugcaaaggcuuaucaaccaguggcggaaucgcgucaacgagcugaaaucuuugaauauuuccacuaagguggcucuccugagcgauguuaaagacggggugaaccaggccgccccugcauuuggauucggcucgucucaagcugcaaccuuuauguccccagguuucccggucaacaauucaaguagcgauaacgcccagaauuucuccuuuaagacaaacucuggguucgcugccgcgagcucaggaagucccgcaggcuuuggcuccagcccugccuucggggcugccgcaucuaccucaaguggaaucagcacuuccgcuccagccuuugguuucggcaagcccgaagugacaucugcggccucguuuagcuucaaauccccugcagcuucaaguuuugggucuccaggauucagcggccugcccgccucccucgcuaccgguccgguacgagccccuguugcacccgccuuugggggcggaucaagcguggcuggcuucgggucuccaggaucccacagucauacggcguuuagcaagccuucuuccgacacuuucgguaauucaaguauaagcaccucguuauccgcaucuagcucaaucauugccacagauaacguccuguucacucccagagacaaacuuaccguggaggaauuggagcaguuucagaguaagaaauucacacugggcaagaucccacuaaaacccccuccacucgaacugcuuaauguguga

SEQ ID NO: 60012 - RNA, 303 nt, Artificial Sequence
  derived and/or modified sequence opt3 from NUPR1__Homo_sapiens__NP_001035948
auggccaccuucccucccgcuacaagcgcaccacagcaaccgcccggcccugaggacgaagauuccucucuggacgagucagaucucuacagucuugcccacagcuaucuggggccauugaucaugcccaugccuacuuccccauuaacgcccgcgcuggugaccggagguggcgggagaaagggaaggacaaaacgggaagcugccgcaaacacuaaucgcccuucuccaggcggucaugagcgaaagcuagucaccaaacuccagaacucggaacguaagaaaagaggggccaggcgguga

SEQ ID NO: 60013 - RNA, 882 nt, Artificial Sequence
  derived and/or modified sequence opt3 from NUS1__Homo_sapiens__NP_612468
augaccggccuguacgagcucguguggagaguccuucacgcccuguugugcuuacauaggacacugacuagcuggcuacggguucgcuucgggacguggaacuggaucuggcgacguuguugcagagcugcauccgccgcggugcucgcuccccugggauuuacccuuaggaagccuccagccguaggucggaaucgcagacaccauaggcacccgcggggcgggucuugucuggcagccgcucaucaccgcaugcgauggagagcagacggaaggucauuggaaaaacuccccgugcacaugggccuggucauuacagagguggaacaggagccuaguuucagcgauauagccucccugguuguguggugcauggcugucgguaucucuuauauuucgguguacgaccaucaagggaucuuuaagcggaacaauucacgucucauggaugaaauuuuaaaacagcagcaggagcugcuuggauuggacuguagcaaguauaguccagaguucgccaacuccaaugauaaagacgaucaaguacugaacugccaccuagcgguuaaggugcucucucccgaagacggcaaggcagauaucguccgcgccgcucaggacuuuugucagcugguggcccagaaacaaaagagaccuacugaucuugacguggauacccuggcuagcuugcucuccucaaauggcugcccagaccccgaccuggucuuaaaauucgggccuguugauaguacacugggauuucucccauggcauauaaggcuuaccgagaucgugagccugccgucucacuugaacauuuccuacgaagacuucuuuucagcacuacggcaguaugccgcgugugagcagcgacuggguaaguga

SEQ ID NO: 60014 - RNA, 1320 nt, Artificial Sequence
  derived and/or modified sequence opt3 from NUSAP1__Homo_sapiens__NP_001230071
augaucauucccagccuggaggaacucgacucccuuaaguacucugaucugcagaacuuggccaaaucauuaggccugagagcuaaucuaagggcaaccaagcuccugaaagcccuuaagggguauauaaaacacgaggcgcggaagggaaacgaaaaucaagacgagagucagacaagcgcuuccucuugcgaugaaacugagauccagauuucgaaccaggaggaagccgagcgccaaccucugggucacgugacgaagacccgacguagauguaaaacagucaggguugacccagauucacagaaucacagcgaaaucaagauuaguaacccgacugaguuccagaaucaugagaaacaggaaucccaagacuugcgggcaaccgccaaggugcccucuccuccagaugagcaccaggaagcugagaacgcaguaagcuccggcaaucgcgacucaaaagugcccagugaagggaaaaagagccucuacacagaugagucuuccaagccuggaaagaacaaaagaaccgccaucacuacaccaaauuuuaagaaacugcaugaggcucacuucaaggaaauggagucaauagaccaguauaucgaaaggaaaaagaagcacuuugaggaacauaacagcaugaaugagcugaaacagcccauuaacaagggcgguguccggaccccugugccaccgcgcgggcgacucaguguugccucuacgcccaucucccaaagaaggagccagggacggucgugcggcccugcgucucaguccacuuuaggccugaaagggucacuuaagcguagugcaauuagcgccgcuaaaaccggagugcgcuucuccgccgcaacaaaggauaaugagcacaagagaucuuugacuaaaaccccagcuaggaaaagcgcccaugucacagugucagguggcacccccaagggggaagcgguacugggaacgcacaagcuaaaaacuaucacaggcaacagugccgcaguuauaaccccuuuuaagcucacuacagaggcuacccaaacgccaguguccaacaagaaacccgucuucgaccugaaggccagccuuucucggccgcugaauuacgaaccucacaaagguaaguugaaacccugggggcagucaaaggagaacaauuaucucaaccagcaugugaaucgaauuaacuuuuacaagaaaaccuauaagcagccacaucugcaaacaaaagaggaacagcgcaagaaaagagagcaggaaaggaaggagaaaaaggcuaagguguuaggaaugcggcgcggccugauccucgccgaagauuga

SEQ ID NO: 60015 - RNA, 384 nt, Artificial Sequence
  derived and/or modified sequence opt3 from NUTF2__Homo_sapiens__XP_005255828
augggcgacaagcccaucugggagcagauugggagcuccuucauacaacacuacuaucagcuguuugauaacgacagaacccagcucggagccaucuacauugaugcuucuugccuuacaugggaaggucagcaauuccagggcaaagcagccaucguggagaagcugucaaguuugccuuuucagaaaauucagcauagcaucacugcgcaagaccaccagccaacgccggauuccuguauaaucucuauggucguugggcaguuaaaggcugacgaagaucccauuaugggauuccaucagauguuucugcucaaaaauaucaacgacgccugggugugcaccaaugauauguucaggcuagcacugcacaacuuuggcuga

SEQ ID NO: 60016 - RNA, 3483 nt, Artificial Sequence
  derived and/or modified sequence opt3 from NUTM1__Homo_sapiens__NP_001271221
augguggucacccugggccccgggccugacugccucauccuugaggccagcagacagccacaacugguuccgaagcccgaaaggauggcuuccgauggagcaucugccuugccugguccagacaugucaaugaaacccagugcggcuuuaagcccuuccccagcccugcccuuccuaccuccaacaucugauccgcccgaccacccuccacgggagcccccuccacagcccauuaugccgucgguguuuucaccugauaacccccucaugcugagcgcauucccaaguucccuucugguaacuggcgacgggggaccuuguuugucuggcgccggugcugggaaggugauagucaaagugaagacggaaggaggcagcgcagagcccucccagacccagaauuuuauccucacacaaacugcccugaacucaaccgcuccaggcacacccugcgggggacuggaagguccugccccaccguucguuaccgcgaguaaugugaaaacuauucuccccagcaaggcagucggcgugucucaggaggggccuccaggauuacccccucagccacccccgccuguagcccagcugguuccaaucgugccccuugagaaggcuuggccuggcccccaugguacaaccggggaaggaggcccagucgccacguuguccaaaccuucacugggcgaucgcagcaagauuaguaaagacguguacgagaacuuucgacaauggcagcguuauaaggcacuagcuagaaggcaccucucucagucccccgauacugaagcccugagcuguuuccuuaucccagugcugcggucguuggcgcgccucaaaccgaccaugacacuggaggagggguuaccucuggccguccaggaaugggagcauacuucuaauuuugacagaaugauauucuacgaaauggcagagagguuuauggaguucgaagcugaggaaaugcaaauccagaacacccagcucaugaauggaucccaaggucuuucacccgccacaccacugaaguuggauccccuaggcccucuggcuagugagguuugccagcagccaguguauauucccaagaaagccgcaagcaagacccgggccccucgccgaagacagaggaaagcucaacggccgccagcgcccgaagcaccuaaggagaucccacccgaagccguaaaagaguacguggacauuauggaguggcucgucgggacgcaccuggcuacuggagaauccgauggcaagcaggaggaagagggucagcagcaagaagaggaggggauguauccugacccgggccuucugucuuacaucaacgaauuguguagccagaaaguguuuguuucaaagguggaggccgucauacauccccaguuccucgcagaccuguuaaguccagaaaagcagcgugauccucuggcccuaauugaggagcucgaacaagaggaaggacugacacuugcucaguuggugcagaaacgccugauggcccucgaggaagaggaggacgcagaagcgcccccauccuuuagcggcgcucagcuggauucuucaccuagugggagcguagaggacgaagauggagacgguagacuuaggcccuccccaggccugcaaggggccggaggcgcagccugcuuggguaagguuucuucgagcgggaaacgggcucgagaggugcacggcggacaggaacaggcccucgauuccccgcgcggcaugcacagagacgggaauacccugccuucacccaguucuugggauuuacaaccagagcuggcagcuccccagggaacuccugguccacuaggcgucgagaggcgggggagcggaaaggugaucaaccaggucucccuccaucaggacggccaccuggguggggccgggcccccuggacauugucuuguggcggaucgcacaucagaagccuugccgcugugcuggcaaggcggguuccagccagagagcacccccucucucgacgcuggacuggcagaauuagccccucugcagggccagggucuugagaaacaaguuuuggggcuccagaagggacagcagacgggcgguagaggcgugcugccccaagggaaggaaccacuagcuguaccuugggagggauccaguggcgccauguggggcgacgauaggggaacccccauggcacagagcuaugaccagaauccaucuccucgugcggccggcgagcgggaugacgucugucuguccccggguguguggcucucaagugaaauggaugcuguugggcuggagcuucccgugcaaauugaagaggucaucgagagcuuccagguggaaaaaugcguaacagaguaccaggaaggaugucagggcuuggguucgcgaggcaacaucucccuggggccaggagagacuuuagugccuggcgacaccgaaucuagcguuauucccugcgggggaacagucgccgcagcugcccucgagaagagaaauuacugcucacugccaggcccucuuagggcaaacagucccccgcugcgcuccaaagagaaucaagaacagucuugugagacugugggucacccaagcgauuugugggccgaagggugcuuuccucuccuggaguccggagacucaacccuaggcagcaguaaggaaacacugcccccaaccugucaggguaaccuccugauaaugggcacugaggaugcuucuucccuucccgaggcgagccaggaagccgggucgcggggaaacucauucucuccuuugcuggagacgaucgaaccggugaauauuuuagacgucaaagaugacugcggccuccaacugagaguuagugaggauacauguccccuuaacgugcacuccuaugacccacagggggaaggaaggguggacccugaucugagcaagcccaagaaucuagcaccucuccaggagucucaggagagcuacaccacuggcaccccaaaagcuacauccucacaucaaggucuggggaguaccuugccccgccgaggaacucggaacgccaucguaccucgugaaacaagcgucucuaagacgcacagauccgccgacagggcuaaaggcaaggagaaaaagaagaaagaagcagaggaggaagaugaggaacugucaaauuuugccuauuuacucgcgaguaagcugagccuuuccccacgcgagcauccccugucuccgcaccaugcuucgggcgggcagggaagccagcgggccucacacuugcucccugccggugcaaaaggcccauccaagcugcccuacccuguggcuaaaagugggaagagagcacuagccggaggcccagcgcccaccgagaaaacuccgcacucuggugcucagcuggggguuccuagggaaaagccccuugcccucggagugguccgaccaagccaaccucgcaagcggagaugcgacuccuucgugacaggcaggcguaaaaagcgccggagaucacaguga

SEQ ID NO: 60017 - RNA, 2637 nt, Artificial Sequence
  derived and/or modified sequence opt3 from NUTM2A__Homo_sapiens__XP_011538424
auggaggugaagggccccagcgggagauccuucugcugugaaucugagggacaguuuaaaucaugccugaagaggcacaccccuagucuccuucugccaagcuccuggaaagguaacucuggcucguguuugauggccaaggcuuuacaucggaugucaccgacacccaauagcugcccucugccacuaccccucugucgcaugagugggguccugugcucccgaaaccuuuucacuuuuaaauucucucuguuucaauuggacagcggagcauccggcgaaccuggucacucacucgggcugacgcugggauucagucauuguggcaauugccagaccgccguugugagcgcgcagccagagggcauggcuucuaacggggccuaccccgcacucggaccugguguaacagccaauccaggcacuuccuuaucaguguuuaccgcucugccguucacaacccccgcaccugggccagcccacggaccccuuuuggucacugcuggcgccccuccaggugggccccuggugcuaagcacacucccgaguaccccucugguuacggaacaggauggauguggccccucuggcgcgggggcauccaacguguuuguccaaaugcguacugaggugggaccaguaaaggccgcucaggcccagacccuuguucugacacaggcaccuuugguguggcaagcucccggugcccucugcggcggggucguguguccacccccucuguuacuggcggccgcaccaguggucccgguuauggcugcccaggugguaggaggcacucaggcuugcgaggguggguggagccagggccucccccuuccuccacccccuccacccgccgcacaacugccgccuaucgugucgcagggaaaugccggcccauggccccagggggcucauggagaagguucuuuggcguccucacaagcaaaggccccucccgacgauaguugcaacccaagaagcgucuaugagaauuucaggcuauggcagcacuacaaaccucuggcucggcgccaccucccccaguccccagacaccgaagcccugucuuguuuucuuauuccggugcugagaagccuugcaaggcggaagccuacaaugacccucgaggagggccuguggcgcgccaugcgagaauggcagcauacgucaaacuucgauagaaugauauuuuaugagauggcugaaaaauucuuagaguucgaagccgaggaggaaaugcaaauccagaagagucaguggaugaaagggccccagugccugccacccccugcaacuccaaggcuagagccccggggaccuccggcgccagaaguugugaagcaacccgucuaccucccuuccaaggcuggcccaaaagcccccacagcaugucugccuccgccccguccacagcgcccugugaccaaggccagaaggcccccaccucggccccaccgacgcgcugagacuaaagccagacuuccaccgccuaggccccagcggccagcagaaacaaagguacccgaggagauuccuccagaaguugugcaggaguaugucgacaucauggaagaguugcugggucccagccucggggcuaccggcgaaccugagaaacaacgcgaggaaggagaggugaagcagccgcaggaagaggauuggacgccacccgacccuggccugcuuucuuacaccgauaaacugugcucacagaaggacuuugucacaaagguggaggccguuauucauccccaauucuuggaggaacuccugaguccagauccucagauggacuuuuuagcgcugagccaggaacuagagcaagaagaggggcucacucuggcccagcuuguggagaaaagauugcugccccucaaggaaaaacagcacgcuagggcagccccaucccguggaaccgcucggcuggauucuucgagcuccaaguucgccgcaggucagggcgcggagcgagacguaccugucccgcaacagggggugggaauggaaacaugucccccacagacuaccgccagagacucacagggcaggggucgcgcucacacagggauggcccggaguaaagauucuguuguguuacugggcugccaagacagcccuggacuuagagcagcuaggcccaccuccccaccucaggaucaucgccccacuuguccgggcgucgggacgaaggacgccuuggaucucccaggaggcucaccugugcgagagagccacggucuggcacaggggucuuccgaagaggaggaacuacccagucuggccuuucuccugggaagccagcauaaguuguugccaugguggcugccccaaucuccuguaccggcuuccggcuuacucucacccgagaaaugggguccacagggcacacaccaguucccuagugcggaacggcgugggcugaaucuugcccccagcccugcaaacaaggcuaaaaagagaccacuguuuggaucguugucccccgccgagaaaaccccucauccaggccccgggcucagggugucuggagaacaaagccugacuuggggccuaggugggccgucacagagucagaagcgcaagggagacccucugguuucccggaaagagaagaaacagagaugcucucaauga

SEQ ID NO: 60018 - RNA, 2637 nt, Artificial Sequence
  derived and/or modified sequence opt3 from NUTM2B__Homo_sapiens__XP_005270192
auggaggugaagggccccagcgggagauccuucugcugugaaucugagggacaguuuaaaucaugccugaagaggcacaccccuagucuccuucugccaagcuccuggaaagguaacucuggcucguguuugauggccgaagcucugcaucggacaucaccgacucccaauagcugcccucugccacuaccccucugucgcaugagugggguccugugcucccgaaaccuuuucacguuuaaguucucucuguuucaauuggacagcggagcauccggcgagccuggucacucacucgggcugacccugggauucaguuacuguggcaauugccagacagccguugugagcgcgcagccagaaggcauggcuucuaacggggccuaucccguacucggaccuggugugacugcaaauccaggcaccuccuuaucagucuuuacagcccugccguucaccacucccgcuccugggccagcacauggaccccuuuuggugacagccggcgcuccuccaggugggccccugguucuaagcaccuuuccgaguacgccucucgugacugagcaggauggauguggccccucuggcgccggggcguccaacgucuucgugcaaaugcguaccgagguaggaccaguuaaagcagcccaggcucagacacuggugcuuacucaggccccucuggucuggcaagcacccggugcuuugugcggcggggugguguguccacccccucuccuguuagccgcggccccagucguuccggugauggcagcucagguagugggaggcacccaggccugcgaagguggguggagccagggccugccccucccuccacccccuccacccgcugcccaacuuccgccuaucgucucgcagggaaaugcaggcccauggccccagggggcccacggagagucuucccuggcuucaagucaagcgaaggcaccucccgacgauagcugcaacccaagauccguguacgaaaauuuuagguuguggcagcauuauaagccucuagcccggcgccacuuaccccagucuccagacacagaggcucucagcuguuuccugauuccgguucuuagaucacuggccaggcggaaaccuaccaugacguuggaggaaggucucuggcgcgcaaugcgagaguggcagcacacaaguaacuuugauagaaugauauucuacgaaauggccgagaaguuccuggaauuugaggcugaggaagagaugcaaauccagaaaucccaguggaugaagggcccccagugcuuaccacccccugccacuccaaggcuggaaccccgggggccuccggcaccagagguggucaaacaacccguguaucuaccuagcaaggcgggaccaaaggcucccaccgccugucucccuccgccccguccacagcgcccuguaacuaaagcaagaaggcccccaccucggccccaucgacgcgccgaaacaaaggcuagacugccaccgccuaggccccagcggccagccgagaccaaaguucccgaggaaauuccuccagaggugguccaggaauacguggacaucauggaggaacuuuugggccccucucugggugcaacgggggagccugagaagcaacgcgaagagggcaaagucaagcagccgcaggaagaggauuggaccccacccgacccuggacuccugucauauauugauaaacuuugcagucagaaggacuucgugacaaagguugaggcugugauccacccccaauuucuggaagaguugcucagcccagauccucagauggacuuccuggccuuaucccaggaucuggaacaagaggaaggccuaacucucgcgcagcugguagagaaaagacuucccccauugaaggagaaacagcaugccagggcugcaccuucucgugggaccgcccggcuggacucgagcuccucaaaguuugcugccggacagggugcagaacgagacgucccggauccccaacagggcguggggauggagacauguccaccucagaugacugcgagagacagucagggaaggggccgcgcccacaccgguauggcucggucugaagauagcguugugcuccuggggugccaagacucccccggcuuaagagccgcauggccaacaucaccuccccaggaucacaggccgaccuguccaggagucggcacuaaagacgcucuggaucuuccugggggaagccccgugcgcgagucucauggcuuggcccaggguuccagugaagaggaggaacucccaagccuggcauuccuacuggggucucagcacaagcuccugcccugguggcuuccucaauccccgguacccgccucaggauugcugaguccagagaaguggggcccucaggguacgcaucagagccccucggcugaacgacggggcuuaaaucucgcgccuuccccagccaacaaagcaaagaaacguccccuguuugggucucuuagcccugcugagaagacaccauaccccggaccgggccugagagugucaggggaacaaaguuugaccuggggacucggcgguccuucccagucucagaaaaggaagggggacccacugguuagccgcaaggagaaaaagcagcacugcucccaauga

SEQ ID NO: 60019 - RNA, 2004 nt, Artificial Sequence
  derived and/or modified sequence opt3 from NVL__Homo_sapiens__NP_001230075
augaagagaaaaggcaagcugaaaaacaaggggagcaaaaggaagaaggaggaccuccaggaaguggauggagagaucgaagccguccuucagaaaaaggcuaaagcacggggucuggaguuccaaauuagcaauguuaaguuugaagacgugggcgggaacgauaugaccuugaaagagguaugcaagauguuaauacacaugcgccaucccgagguguaccaccaucugggagucgugccuccacgaggcguucuacuccacgguccgcccggguguggaaagacacugcuugcccaugcgaucgcuggcgccgaaugcucuggcaugauuacugcacacuguucauucgacuuuagugggagcaaugauccuccagccuccgcuucucaggagcuggacuugcccauccucaaaguggcagccccugaaauugucucgggagugucaggugagagcgagcagaagcugcgugaacuguucgagcaagcuguaaguaacgccccaugcaucauauuuaucgaugaaauugacgcgaucacgcccaaaagagagguugcauccaaggauauggaaaggcggauuguggcccagcucuuaaccuguauggacgaucugaauaacgucgcugccacagcacgcgugcuugugaucggcgcuacuaauagaccugacucuuuggauccagcccugaggcgggcggggcgcuucgaccgagagauaugccuaggcauuccggacgaggccagcagagaaaggauccuccagacccugugucggaaacuucgucugccccaggcauuugauuucugccacuuggcucaucucacaccuggauuugucggugccgaccugauggcuuuaugucgcgaggccgcaaugugcgccguuaacagagugcugaugaagcuccaagaacagcagaaaaagaauccagagauggaagaucuucccuccaaggggguacaggaggagaggcugggaaccgaaccuacuucagagacacaagacgaauugcagcggcuacugggccuccugcgagaucaggacccacuuagugaggaacaaaugcagggccuguguauugaguugaacgauuucaucguggcucucagcucuguccagcccuccgcgaaacgcgagggguuugugaccguuccgaaugugacgugggcagacaucggagcccuggaagauauuagagaggaauuaacuauggcuauacuggccccugucaggaaccccgaccaguucaaggcacuaggucucgugaccccagccggcguacugcuugcugggccucccggaugcggcaaaacauugcuggccaaggcaguugcgaaugagucaggucucaacuuuaucagcgugaaagggccagagcugcuuaauauguaugucggcgaaagugagcgggcugugcgccaagucuuccagagagccaagaacucugcacccugcgugauuuucuuugaugaaguugacgcccuguguccuaggcguuccgaccgggagacuggagcuagcgugcgaguagucaaccaguugcucaccgaaauggauggccuggaggccagacagcaaguguucaucauggcagcuacaaauaggccagacauaauugauccggccaucuuacgccccgggcggcuggacaagacccuauuuguuggacucccuccacccgcggauagacuggccauccuuaaaacgauuacuaagaacgguacaaaaccuccauuggacgcugaugugaaucuggaggcaaucgccggcgaccucaggugcgauuguuacaccggggcugaccugucggccuuaguccgcgaagcaucuauuugcgcgcugcgacaggagauggcccggcagaaguccggaaacgaaaaaggcgagcuuaaggugucacacaagcauuucgaagaggcuuuuaaaaagguacguaguagcauauccaaaaaggaucagaucauguaugagagauugcaagaaucucucuccagguga

SEQ ID NO: 60020 - RNA, 4299 nt, Artificial Sequence
  derived and/or modified sequence opt3 from NWD1__Homo_sapiens__NP_001007526
augcagagaggcaagcccugcagggcccugccuacccucaaaugucaaacauucugccagcggcacgggcuuauguuugagguggucgaccugcgcuggggaauccgaaacauugaagcuacugaucauuugacgaccgaguuaugucuggaagagguugaccguugcuggaagacaagcauagguccagcauucguggcccuaaucggcgaucaguacgggccgugucucauucccuccagaaucgacgaaaaagagugggagguacugagggaucaccuuacugcgcggccuucugaccuggaauugguggcucgcuauuuucagagagaugagaaugccuucccacccaccuacguccuccaagcaccuggaacaggcgaagccugcgagccagaggaagcuacccugacuucagugcugaggaguggugcacaggaggcccggcgccucggguuaauuacacaggaacaguggcaacauuaucaccgaagcguuaucgagugggaaauagagagaucccugcuuucuucggaggacagggaacagggagcuaccguguuuuugcgggagauccaggaucugcauaagcacauucuagaagacugugcccuccguauggucgaucgccuggcggacggcugccuugaugcagacgcccagaaccuguugucaagccucaaaagucacaucacggacaugcaucccggcgugcugaagacucacagauuaccuugguccagggaucugguaaauccaaagaacaaaacccaugcuuguuaccucaaggagcuuggggaacaauucguugugcgggccaaucaccagguccugacacgauugcgcgagcuagacacugcaggacaggagcuggcuuggcucuaucaagaaauuagacaccaucuguggcagucuagcgaggugauccagaccuuuugcgguaggcaggaacuucuggcccgguugggccaacagcuccgccacgaugacuccaaacagcauacaccgcugguguuauucgggcccccuggaauaggcaagaccgcgcugauguguaaacuagccgagcagaugccaagacuccugggucacaagacggucacuguucuuagguugcuggggacaucacaaaugaguagcgaugcacguggacuccugaagucuauuugcuuucaggugugccuugcuuacggccugcccuugccuccagcccagguacucgacgcucauacccgggugguccaguucuuucacacucuguuacacacaguguccugucgaaacuucgaaucacugguucuacuccuggaugccauggacgaucuugacagcgugagacaugcaaggcgcguccccugguugccgcugaauugcccuccccgggugcaccucauccugagugccuguucuggcgcuuuagggguacuggauacccuucaaagaguuuugcucgacccagaggcguauugggaggugaaaccucuguccggaaaccagggucagcagaugauucaacuacugcucgcagccgcuaggcgcacgcugagccccguccauaccgaccuuuugugggccucgcugccagaaugcggcaaucccgggcgauuacggcucgcauuugaggaagcccguaagugggcuucuuucacagugccugucccacuggccacuaccgcagaggaggcgacacaccagcuuuguacuagacuggaacagacccacggacaauugcucguggcucauguucugggcuacaucguguccucaaggcacggucuaagugaggccgaacugaaagauguacucagccuggacgaugagguccuucaggacguguaccgcgauuggacaccgcccuccaaggaauugcugcgguucccuccauuacucuggguuagacugaggcgagaccuuggguauuaccuggcacgccggcccguggauggcuuuacccuacucgccaucgcucauagacagcuggucgaggugguaagggagcguuauuugucuggaagcgaacgcgccaaacggcacggcgugcuggcagacuucuuuucagggacuuggagucagggaacgaagaaauuaauuacacucccucugguugguaagccacuuaaccuggauagaaaggucgcuccccaaccguugugguucucccauaccguggccaaucucaggaaacugaaggagcuaccuuaccaucugcuucacagcggccgacucgaagaacugaaacaggaaguguuggggucuaugucauggauaaguugccggggaaucagcggcgguauugaggaccuguuagaugacuuugaucucugugcgccacaccuggacucccccgaggucgggcuuguucgcgaagcccugcaguugugcagaccugcuguggagcucaggggcauggaacggucucugcuauauacugagcugcuugcacgacuccacuucuuugccaccucgcaucccgcucuggugggacaguugugucaacaggcccagagcugguuccaguuaugcgcacacccaguacuggucccucucggcggguuucugcaacccccaggagguccgcuuagagcgacacuguccggcugucauaaggggaucaccgccauggcuuggggaguggaagagaaauugcuaguuauaggcacucaggacgguauuauggccgugugggauauggaggaacagcacgucauccacaugcugacagggcauacgggcgaggugcgcugcguuaagaucuucgcaaagggaacccucgcuaacucagccaguaaagacuacacucugcaccuuuggaauuuacugucuggccaagaaaaguuuacaauuugggaugggggaagcaaaaacccugcagagccccagaucuggaaucuccauguggacgaggcccacaagguagucuauuccgcuucaggcagcaaaauuaacgcguggaacuuggaaaccgccgagccaguguuccacauacugggugaugcaucugaccccuggaugugcauggcugugcucgccucccaggccacacugcuuacugucaguagggaugggguugugagccuguggucuuccgcuaccggaaaguugcagggcaagcaacauaugucaaguaucaaagaagagacgccuaccugugcaguaagcgugcagaagcaggguaaacuggucacaggcuuuucgaauggguccauuucucuggugagcucaaagggagaccgucucuuagaaaaacugccagaugccguucgguuccuuguggucagugaggacgagucccugcucgcggcuggcuucgggagaucugugaggaucuuuuuggccgauagccgcggauuccgaagauuuauggcaauggaccuggaacacgaggauaugguugaaacugccguguucggcaccgagaacaaucucaucauuacagguucccuggacgcucuuauacaggucuggucacuaagcgaacaagggacucuguuggacaucuuagagggaguaggcgcacccgugagucugcucgcccgggguggcgcgcugguugcuucugccuccccucagagcucgucauuuaaggugugggaucuuucugacgcacauaggagucgcgucccggccccauuccuggaucguaccgggcucacggcugugucccacaacggaagcuacguauacuuucccaagauuggcgacaaaaauaaggugacaaucugggauuuggccgagggggaggagcaggacucucuggauaccagcuccgaaauuagaugccuagaggucgcagaacagcggaaacuacucuucacuggacuuguuucaggcguggugcuggucuuuccuuuaaacaguaggcaagacgugaucuguauaccacccccugaggcucgcaaggccaucaauugcaugagcuugucuaaaugugaggaucgacuggcgauugccuaugacaacaucguucucguacuggauauuacauccggugacccgugccccgugaucgacgggccaagauacaccuucuauacucagcuuccugaaacccugucaagugucgcaauacucacagauuaccgggugguuuauagcaugacgaauggagacuuguuucuguacgagugugcuaccuccaaggccuuccccuuagaaacucauaggucucgcguggcuugcgucgaggugucgcacaaagagcagcuaguagucagcggcucagaagaugcacugcucugucuuugggaccugcaggccagaaaguggaaguuugagauguccuauacagccccaugcuga

SEQ ID NO: 60021 - RNA, 1071 nt, Artificial Sequence
  derived and/or modified sequence opt3 from NXF1__Homo_sapiens__NP_001074960
auggccgacgagggcaagagcuacuccgaacacgaugacgagagagugaacuucccccagaggaaaaagaaagggcggggaccuuuucgcuggaaguauggugaaggcaaucgacguucugggagaggaggcucagguaucaggaguagccggcuggaggaagaugacggggaugucgcuauguccgacgcacaagauggaccacgcguuagauacaacccguauaccacaaggcccaaucggcgcggcgacacuuggcaugaucgagacaggauucacgugacgguaagacgggaucgugccccuccagagcgcggcggggcgggaaccucucaggacgguacaucgaaaaacugguucaagauaacuauccccuacggcagaaaguaugauaaagccuggcuccuuucaaugauucagagcaagugcagugugccuuuuaccccaaucgaguuccauuacgaaaauacaagggcccaguuuuucgucgaggacgcauccaccgccucugcucugaaagcagugaacuauaagauuuuggaccgggaaaaucgacgcaucagcauaaucauuaacuccucagcucccccucacacuaucuuaaaugagcugaaaccagagcaaguugaacagcuaaagcucauuaugaguaagagauacgaugggagccagcaggcucuggaccuuaaaggacugaggucugauccggacuugguggcccaaaacaucgaugucgugcucaaucggcgcuccuguauggcggcaacacugagaauaauugaggaaaacauccccgagcugcucucauuaaaucugagcaacaauaggcuuuaccguuuggacgauaugaguucuauuguacagaaggccccuaaccugaaaauccuaaaccucuccggcaaugaacuuaagagcgagcgggagcuggacaaaaucaagggucugaaauuggaggaacucuggcuggaugggaacucguuaugcgacaccuuucgagaucagucuacguauauuagauccguuguggcuugugucucaccacccggagaccugcauccucucggcggcuga

SEQ ID NO: 60022 - RNA, 1881 nt, Artificial Sequence
  derived and/or modified sequence opt3 from NXF2B__Homo_sapiens__NP_001093156
augugcagcacccugaagaaauguggcacauacagaacugagguggccgaaugccacgaccauggguccacguuccagggaaggaagaaaggugggucuucauuucgggauaacuucgacaagcgcaguugucacuaugagcauggcggauacgaacgacccccuagccacugccaagagaaugauggcuccgucgaaaugcgugacguucauaaagaucagcagcucagacacaccccauauucuaucaggugugagcggcgcaugaaguggcacucggaggacgaaauuagaauaacaacuuggaggaaccggaagccgcccgagcgcaaaaugucacagaauacccaagaugguuacacacgaaacugguuuaaggugaccaucccuuaugggauuaaauacgacaaggcuuggcuuaugaauagcauccagagucauugcuccgauagauucacuccaguagacuuucacuaugugaggaaccgggcauguuucuuuguccaggaugccucugcggcuagcgcccugaaagacguguccuacaagauuuacgaugacgaaaaucagaagaucugcauauucguuaaccauucaacagcacccuauagugugaaaaauaaguugaaaccuggacaaauggagauguuaaagcugaccaugaacaaacguuacaaugucagccagcaggcccuagaccuccagaaccugcgcuuugauccagaccuuaugggcagagauaucgacauuauccugaauaggcggaacuguauggcugcaacguugaagauuaucgagcgaaauuuccccgaacuccugucucugaaccucugcaacaauaaauuauaucaacuggauggccuuuccgacauaacugagaaggccccuaaggugaaaaccuugaaccugucaaagaauaaacuagaaagcgcuugggagcucgggaagguaaaaggacugaaacuugaagaacugugguuggaggguaacccacucuguaguacauuuucugaucaguccgccuacguuagcgcgauucgcgacugcuucccgaagcuguuaagacuggauggcagggaacucucggcacccgugaucgucgacauugauucuuccgagacuaugaagccuugcaaggaaaauuuuaccgggucagagacacuuaaacaccugguguugcaguuccuacaacaguauuacaguaucuaugacagcggagaccggcagggccugcucggugccuaccacgaugaggcuuguuucucccuggccaucccauuugaccccaaggauucugcaccuagcucacuuugcaaauacuucgaggacagucgcaacaugaagacccugaaggauccauauuugaaaggggagcuccugagaaggacgaagcgugacauuguggauuccuuaagcgcucugcccaaaacucagcaugaccuaucuucaauacucgucgauguuuggugucaaacagaacggaugcugugcuuuagugugaauggaguauucaaggagguggaaggccagagccagggcuccguccuugccuuuacccgaacuuucaucgcgacaccggggucuucgagcuccuuguguauugugaacgacgagcuguuuguuagagaugccucaccucaggaaacccaaagugcauucucuauccccgugagcacgcucuccucaagcucugagccaucccugagucaggagcagcaggaaaugguccaggcuuuuagcgcccaaucuggaaugaaacuugaguggucccagaagugccugcaggacaaugaauggaacuacaccagggcuggucaagccuucacaauguugcagacugagggcaagauaccugcagaggccuuuaaacagauuucauga

SEQ ID NO: 60023 - RNA, 1596 nt, Artificial Sequence
  derived and/or modified sequence opt3 from NXF3__Homo_sapiens__NP_071335
augagccugcccuccggccacaccacagggcauacugaccaggugguccaaagaagggcccggugcugggauaucuaccagcgccgauucucuucacguagugagccuguuaacccaggaaugcacagcuccucucaucagcagcaagacggugaugcugcaaugcacggcgcccauauggacucgccggugagauauacgcccuacaccauuucaccuuauaauaggaaggggagcuuucggaaacaggaucagacacacguaaacauggaacgcgagcagaagccacccgaaagaaggauggagggaaauaugccugacggcacucucgguaguugguucaaaauaaccgugccauuugggaucaaguacaacgaaaaauggcuucugaauuugauucaaaacgaguguuccguccccuucgugccuguugaguuucacuaugaaaauaugcaugcgucuuucuuuguggagaacgcuagcaucgccuacgcauuaaagaaugucuccggaaagauuugggaugaagacaacgagaaaaucucaauauucgugaauccagccggcaucccgcacuuuguacaucgggagcugaagagugaaaaaguugagcagauuaagcuagcuaugaaccagcagugcgaugugagccaagaagcacucgacauccagcgccugcccuucuauccugauauggucaaucgagacacaaaaauggccucuaacccaagaaaguguauggcugccucccuugaugugcacgaggaaaauauucccaccgugaugucagcgggcgagauggacaaguggaaagggaucgagccuggagaaaagugcgcagacaggagcccagucuguacuacauuuagugauaccucuuccaacauaaacagcauucuggaguuguuccccaaacuccugugccuggacggucagcaaucgccgcgggccacgcucuguggcacugaagcucacaagcguuuaccuaccugcaaaggguccuuuuucggaucugagaugcugaagaaucuuguuuugcaguuccugcagcaguacuaccuaaucuaugauucaggcgaccgccaaggucuccugagugccuaccaugaugaagcauguuuuagccuuuccauucccuucaacccagaggacucugcuccuagcucauuuugcaaauucuuuaaggauaguagaaauaucaagauccugaaagaccccuauuugaggggagagcuccugaagcacacaaaauuagauauuguggacucccugagcgcccucccaaagacucagcaugaucuuucuucauuccugguagacaugugguaccagaccgaauggauguuguguuuuagugugaacggggucuucaaagagguggaaggccagagccaaggcuccguucuagcguuuacacggaccuucauagccacgcccgggucuucgagcucccugugcaucgugaaugacaagcucuuuguccgagauacuucacaccagggaacacagagugcacuguucacccuugugccuacugcuuuuucuagcuccguaccagccuucucacaggagcaacagaagaugcugccgagcuga

SEQ ID NO: 60024 - RNA, 1098 nt, Artificial Sequence
  derived and/or modified sequence opt3 from NXF5__Homo_sapiens__NP_116564
augagaaggaacacccaggacgagaauaugcggaagugguucaaagugacaauccccuacggcauuaaguaugauaaagccuggcugaugaacagcauacaauccaauugcucugucccuuuuacuccaguugacuuccacuacauccgcaaccgagcuugcuuuuucgugcagguagcaucagccgcgagugcucucaaggaugugagcuauaaaauuuacgacgaugaaaaucagaagaucuguauuuuugucucccauuucacggccccguauucugugaagaacaaacuuaagcccgggcagauggagaugcugaaauugaccaugaauaagcguuacaacguuucgcaacaggcauuagaccugcagaaucuaagauuugauccugaccucaugggaagggauaucgacauaauccugaaccggcgcaauuguauggccgcuacacuuaaaauuacugaaagaaacuucccagagcuguugucacucaaucugugcaacaauaagcuguaucagcucgaugguuuaagcgacaucaccgaaaaggcacccaaagugaagacacugaaccuuaguaaaaacaaguuggaguccgccugggagcugggcaaagucaaggggcuaaaacucgaggaacuguggcuugaaggaaauccucuguguucuaccuuuagcgaucaauccgcuuacgugucagccauuagggacugcuucccaaaguugcuccggcuggacggccgcgaguuaagugcgcccguaaucguugauauagacagcucugagacuaugaagccuuguaaagaaaacuuuacagguuccgagacccugaagcaccucgugcuucaguuccugcagcagucaaauuugugcaaauacuuuaaggauagccgaaacauuaaaauccuaaaggacccauaucugcaaagaaagcuccugaaacauacgaaguguccgaggaaugucgauagucuuucugcacugcccgaaacucagcacgacuucaccuccauuuugguggauaugugguaccagacagugaacacuugcuuccucccucgggccgggccagagagccaaucgcugcgucccuuauga

SEQ ID NO: 60025 - RNA, 984 nt, Artificial Sequence
  derived and/or modified sequence opt3 from NXN__Homo_sapiens__NP_001192248
auggccgacgugagccugcacagaaaccccgcuacccucaaacuuuggaauaaguacaggaucuccaacauuccuucucugauauucuuggaugcaacaacuggcaaggucguuugccggaauggguuacuggugauccgcgacgauccagagggacuagaauuuccguggggucccaaaccuuuccgagagguaauugccggcccacuccugcguaacaaugggcagucacuugaaaguagcucccuggagggaucucaugugggcgucuauuuuucggcgcacuggugucccccuugcagaucauugacgagggugcucguugaaagcuaccggaagaucaaagaggcuggucaaaacuucgagauuaucuuugugagugccgaccgcuccgaagagucuuucaagcaguauuuuagcgaaaugccauggcuggcaguccccuacaccgaugaggccagaaggucccggcugaaucgccucuaugggauacagggaaucccuacauuaauuaugcuggacccacagggcgaggugaucacucgacaaggcagaguagaaguucuuaacgaugaggacuguagggaguucccguggcaucccaagccuguguuggaacugucagauaguaaugcugcacagcuaaacgaagggccaugccucguccuguuuguggacagcgaggaugacggagagucugaagccgcuaaacagcuuauucagcccaucgccgagaagauaauugcgaaauacaaggcaaaagaagaggaagccccucuguuguucuuuguggcuggugaggaugacaugaccgacucccuccgggauuauacaaaucugccagaggccgcacccuuacugaccauccucgacaugucagcucgugccaaguacgucauggauguugaagagauuacuccggcgaucguggaagccuucguaaacgacuuucuugcagagaagcugaaaccugaacccaucuga

SEQ ID NO: 60026 - RNA, 639 nt, Artificial Sequence
  derived and/or modified sequence opt3 from NXNL1__Homo_sapiens__NP_612463
auggccagccuguucuccggcagaauccucauuaggaacaauucugaccaggaugagcuugacaccgaagcugaggugucacggcgccuggaaaaccgauuggucuuacuguuuuucggggcaggagccugcccccaaugucaggcguuuguuccuauacuaaaggauuucuuugugcgucucacagacgaguucuacguacugagagcugcccagcuugcacugguguaugucagucaggauagcacugaggaacaacaggacuuguuucucaaagauaugccaaagaaauggcuguuccugccguuugaggacgaucucaggcgggacuuaggucgccaguucuccguggaaagacugcccgccguugugguccuuaagccugauggcgacguguugacgagggauggggcugacgagauccagcggcugggaaccgcaugcuuugccaauuggcaagaagcugccgagguacuagaccgcaacuuccagcucccagaggaucuggaagaccaggagccccgaucucuuacagaaugucugagaaggcacaaauaccggguugagaaggcggcacguggcggucgcgauccugggggaggcggcggggaagagggaggugccggcggguuguuuuga

SEQ ID NO: 60027 - RNA, 471 nt, Artificial Sequence
  derived and/or modified sequence opt3 from NXNL2__Homo_sapiens__NP_001155097
augguggacauccugggcgagagacaccucguuaccugcaagggggccacagucgaagcugaggcagcccuucagaacaaagugguagcgcuguacuucgcugccgcaaggugugcccccagccgggauuuuacuccuuuguuaugcgacuucuauacggcucugguggcagaagcccgccgaccagcuccguuugaggucguguucguuuccgccgauggaucuucacaagaaaugcuagacuuuaugcgugagcuccauggugcguggcuggcacuucccuuccacgauccuuacagacaugagcugaggaagcgguauaaugugaccgccauuccaaaauuggucauagugaagcagaacggcgaaguaaucacaaauaaagggcgcaagcagauuagagagaggggacucgcuuguuuucaggacuggguugaagccgcagauaucuuccaaaacuuuaguguguga

SEQ ID NO: 60028 - RNA, 1218 nt, Artificial Sequence
  derived and/or modified sequence opt3 from NXPE1__Homo_sapiens__NP_689528
augagcucccccgcccugaccgcuggcgcaucugggaaggugauggacuucaacaauggaacauaccucgucucauuuacucuuuucugggagggucagguuagucugagcuuguuacugauccacccuuccgaaggcgccucugcgcuauggagagcuaggaaccaaggguaugauaaaauuauauuuaagggaaaauucgugaauggcacgucgcauguauuuaccgagugcggucucacacugaacucaaaugccgaacuuugugaguaccuggacgaucgggaccaggaagcauucuauugcaugaagccacagcacaugccgugugaggccuugacuuacaugaccacacgcaaccgagaggugagcuaucucaccgauaaagaaaauagucuguuucaucguuccaaggucgggguggagaugaugaaggacagaaaacacaucgauguuacuaacugcaauaagagggagaaaauugaagagacaugucaggugggaaugaagcccccugucccaggcggcuacacccugcaagggaaauggaucacgacuuucugcaaccaggugcagcucgacaccauuaagaucaauggauguuuaaaggguaaacugauauaucuuuugggcgauucuacacugcggcaguggaucuacuacuuucccaagguaguuaaaacucuaaaguucuuugaccuccaugaaaccgggauuuucaaaaagcaucugcuucuggaugcugagcgccacacacaaauccaguggaaaaagcacagcuauccuuuugugaccuuccaguuguacucccucauugaccacgauuauaucccaagagaaauagacaggcugucaggagacaagaacacggcaauugucaucacuuucggccagcauuuucggcccuucccuauugauaucuuuauccgccgagccauuggugugcaaaaagcuauagagagauuauuccugaggaguccagccacaaaggugaucauuaaaaccgaaaauauccgggagaugcacauagagacugaacguuuuggggacuuccacggauacauucauuaucucaucaugaaggauaucuuuaaagaccuuaacgucggcauuaucgaugcgugggacaugacaauugcauacggcaccgauacgauacacccgcccgaccauguuaucgggaaucagauuaacauguuccugaacuauaucugcuga

SEQ ID NO: 60029 - RNA, 1680 nt, Artificial Sequence
  derived and/or modified sequence opt3 from NXPE2__Homo_sapiens__NP_872301
augguggagaagauccugauucacagaauacucacccuuuuccccaacgccaucgcuaggaaacuguuguuaaugcugacauuuauucuaaucuucuggauuaucuaccucgcaagcaaggaccacacuaaauuuuccuucaaucuggaaaaccacauaauccuuaaucagggcaacauuuuuaagaaauauucucauucagagacgccucugugcccagccgucaguccgaaggaaaccgaguugcggaucaaggauauuauggaaaaacucgaccaacagauacccccucgcccauucacacacguuaauacuaccacaagcgcgacccauuccacugcuacaauccugaacccccaggauaccuacugucgaggggaccagcuggauauucucuuagaggugcgugaccaccugggacacagaaagcaauaugguggcgauuuucuuagggcccggauguacucuacggcauugauggccggggcuucgggaaaaguaacugacuucaauaacggcaccuaucuggugucauuuacacuauucugggagggucaggucagccucagucugcuucugauccauccuuccgaaggggugucugcauuguggcgcgccagaaaucagggaugcgauaggauuaucuuuacuggccucuucgcuaaccggagcuccaauguuuuuaccgaguguggccugacauuaaacaccaaugccgaacugugccaguacauggacgaucgcgaccaagaggcguucuauugugugcgaccacagcacaugcccugcgaggcacucacgcauaugacuacaagaaccaggaacaucucauaccuuaguaaggaagaguggcggcuguuccaccguagcaauauuggggucgaaaugaugaaaaacuuuacuccuauagaggugaucccauguaacaagucugaaaauauuaagaaaaacugccagaucggaaugaagacaccguuccccuccgguuacaccuugaaaaagauguggauaacggccuuuuguaaacagauuaaguucaaugagaccaaaaacaucaaugauugccuagagcgcaagcugaucuaucucaugggcgacucaacacugcaccaauggauuuacuaucuucagaaggcuguaaaaacucugaaguacuuugaccaucacggggccggaaucuucaaaacccauguuuugcucgauguggaaagacacauucugauacaguggaagaaacauggccacccuuuugucacaaagaaguuauucagcgugaaagacgagaacuauaucccaagggaaauugaucaaguggcuggugacaagaauacugcaaucgucaucacccuggggcagcacuuucggcccuucccuauuaacauauuuauccgacgcgccauuaauauccagaaagcgauugagagacuauuccucaggaguccagaaacaaagguuauccugaaaaccgagaacacucgggagauagaacagaaugccgagauguuuucugauuuccauggauacauccaaaaccuuauuauccgcgacauuuucguggauuugaauguaggcaucauagacgcaugggauaugacgauugcuuauuguacaaacaaugcccaucccccggacuacgugauccagaaccagauuggcauguuucugaacuacaucugcuga

SEQ ID NO: 60030 - RNA, 1635 nt, Artificial Sequence
  derived and/or modified sequence opt3 from NXPE4__Homo_sapiens__NP_001071107
augaagaucagcaugauuaacuacaaaucccugcucgcccuucuguucauauuggcuucuuggaucauuuuuaccguguuccaaaauucaacaaaggucuggagugcauuaaaccugagcaucucccuacacuauuggaauaacucuacuaaaucgcucuuucccaagacgccucugauuucacuuaaaccacugaccgagacagaauugagaaucaaggagauaaucgaaaagcucgaccagcagauuccgcccaggccuuucacucauguuaauaccacaaccagcgccacucacaguacagcgaccauccugaacccacgggauacguacugccgcggcgaccagcugcauauucucuuagaggugcgagaucaccuggggcguagaaaacaguauggaggugacuuucuuagggcucggauguccucucccgccuugauggcaggcgccagcgggaagguaacugauuucaauaacggaaccuaccugguguccuuuacacuauucugggaaggccaagucucacucagucugcuucugauccauccuagcgagggugugucugcuuugugguccgcacgcaaucagggguaugacagaguuauauuuacuggacaguucgugaacggcaccucacagguccacagcgaguguggccucauucugaauacaaacgccgaauuaugccaauaccuggauaauagggaccaggagggguuuuauugugugcggccacagcacaugcccugcgcugcccucacccauauguacaguaaaaacaagaaaguaucuuaccuuuccaagcaggaaaagagccuguucgagcgcucgaauguuggaguggagaucauggaaaaauuuaacacgauuucugucuccaaguguaacaaagagacuguggcgaugaaggaaaaaugcaaguucgguaugacaucaaccaucccuaguggccacguguggcgaaauacuuggaacccagucagcuguuccuuggcaacaguuaaaaugaaggagugccuaagagggaagcugaucuaucucaugggagauucuaccauuaggcaauggauggaauacuucaaagccagcauaaauacgcugaagucaguggaccuucaugagaguggcaaacugcagcaccaguuggcuguagaucucgaccggaacaucaauauucaauggcagaaguauuguuacccgcugaucgguuccaugaccuauagcgugaaagagauggaauacuuaacacgugccauagaucgcacugggggagagaagaacaccgucauugugaucucucugggccagcacuuuagacccuucccuaucgacguuuuuauuaggcgggcacuaaaugugcauaaggcuauccagcaccuccugcuucgaucaccagacacaauggucauuauaaaaacugaaaacauccgcgagauguauaaugaugccgaaagauucagugacuuucauggcuacauucaauacuugaucaucaaggauauuuuccaggaccugagcguguccauaaucgaugcgugggacauuaccaucgccuaugggacaaacaauguacaucccccucagcacguugugggaaaccagauuaauauccuccugaacuacauaugcuga

SEQ ID NO: 60031 - RNA, 816 nt, Artificial Sequence
  derived and/or modified sequence opt3 from NXPH1__Homo_sapiens__NP_689958
augcaggccgcuugcugguacgugcuguuccuccuucaacccaccgucuaucugguuacaugugcaaacuugacuaauggcgggaaaagcgaguuacugaaauccggaucuucaaagaguacgcuaaaacacaucuggaccgaaagcuccaaggaccucucuauuucgagacugcuuucacagacauuuagggguaaagagaacgauacugaccuggauuugcgguacgacaccccugaaccauauagcgagcaggaucucugggacuggcugcgcaauaguacagaucugcaggaaccgcgaccccgugccaagagaaggccuauagugaagaccggcaaauucaagaaaauguuuggguggggagacuuccauuccaacaucaagacuguaaaacucaauuuacugauuacaggcaagaucguggaucacgguaacgggaccuuuucugucuacuuccggcauaauagcacgggacaaggcaacguguccguuucacuugugccacccacuaagauugucgaguuugacuuggcgcagcagaccgugaucgaugcuaaagacaguaagagcuucaauugccgcauagaguaugaaaaaguagauaaggccacaaagaacacucuguguaauuacgacccuucuaagaccugcuaucaggagcaaacacagucccacguuucauggcuauguagcaaaccauuuaaggugaucugcauuuacaucaguuucuacucuaccgacuauaagcucguccagaaagugugucccgauuacaacuaucauuccgacacgccuuacuuuccaagcggcuga

SEQ ID NO: 60032 - RNA, 795 nt, Artificial Sequence
  derived and/or modified sequence opt3 from NXPH2__Homo_sapiens__NP_009157
augagacugaggccccucccucuuguggucguuccaggccuguugcaguuacuguucugcgacagcaaggaggugguacacgccaccgaagggcuagauugggaggacaaagaugcuccgggaacacucguggguaacgucgugcauucccggaucauuucuccccugcgccuuuuuguuaagcaaucaccugugccaaaacccggcccuauggcauacgccgacaguauggaaaauuucugggauuggcuggcgaacauaacugagauccaggaaccauuggcucgaacgaagcguagacccauugucaaaaccgggaaguuuaagaaaauguucggauggggcgacuuucacagcaauaucaagacagugaaacucaaccugcugauuacugguaagaucguagaucaugggaauggaaccuucuccguuuauuuuaggcacaacucuacaggccucggcaaugugucggucucauuagugccuccaagcaaaguggucgaguucgagguuaguccgcaguccacccuggaaacuaaggagucuaagagcuuuaacugucggauagaauacgagaaaacagaccgcgccaagaaaaccgcacuuugcaauuucgaucccuccaagaucuguuaucaggagcaaacgcagucacaugugaguugguugugcagcaaaccuuuuaagguaauuuguaucuacauugccuucuauucuguggacuacaaacugguccagaaggugugcccagauuauaacuaccacuccgaaacucccuaccuaucaagcggguga

SEQ ID NO: 60033 - RNA, 423 nt, Artificial Sequence
  derived and/or modified sequence opt3 from NXT1__Homo_sapiens__XP_011527532
auggccagcguggacuucaagaccuacgucgaucaggcuugcagagcagccgaggaauuuguuaacguguauuacacaacuauggacaaaaggcggcgccugcucucccgacuuuauaugggcacggcgacccugguauggaaugggaacgcugugucuggacaagagucauugagugaguucuuugaaauguuacccagcuccgaguuccagaucucugucguggauugucagccuguucacgacgaagccacaccaucgcagacuaccgugcuggucgugauuugcgguucaguaaaguuugagggcaauaaacaacgugauuucaaccagaauuuuauacuaacagcacaggccagcccgaguaacaccguuuggaagaucgcuuccgacuguuucagauuucaggauugggcaucuuga

SEQ ID NO: 60034 - RNA, 429 nt, Artificial Sequence
  derived and/or modified sequence opt3 from NXT2__Homo_sapiens__NP_001229546
auggccaccagccuggacuucaagacauacguggaucaggcuugcagagcagccgaggaauuugucaacaucuauuacgagacuauggacaaaaggcggcgcgcgcucacgcgacuuuaucuggauaaggcuaccuugauuuggaauggcaacgccguuuccggguuagacgcacugaauaacuucuuugauacacuacccucuucagaguuccaagugaauaugcucgacugucagccuguacacgaacaggccacucagagucaaaccacagugcuggucgugaccagcggaacuguuaaauuugaugguaacaagcagcauuucuuuaaucagaacuuccuucugacagcucaguccaccccaaauaacacgguguggaaaauagcaucugacugcuuucguuuccaagauuggucgucaagcuga

SEQ ID NO: 60035 - RNA, 1962 nt, Artificial Sequence
  derived and/or modified sequence opt3 from NYAP2__Homo_sapiens__NP_065915
augaucagcuccaagaugaugucuucaaaccccgaggaagacccucuggauaccuuccuccaguacauugaggacaugggcaugaaagccuaugaugggcuugugauacaaaaugcuagugacaucgcaagagaaaacgauaggcugcggaaugagacaaacuuggccuacuuaaaggagaaaaaugagaagcgccgacgucaggaggaagcgauuaaaagaaucggaggugaggucggcagggggcacgaaggaagcuauguuggcaagcauuuucggauggguuucaugacuaugccagcuccgcaggaccgccugccccacccuugcuccucuggguuuucggugagaucacagagccuacauaguguaggaggcacggaugacgauuccucuuguggcagcaggcggcaaccacccccuaagccaaaacgcgaccccuccaccaagcucucaacaaguagcgagacugugucuuccaccgccgcaucaaaaagcgggaagacaccugagcgaaccgaagccagugcuaaaccaagaccgcacucugaugaguacuccaagaagauucccccuccaaaacccaagaggaacccuaauacucagcugagcacaucguucgacgaaaccuauaucaaaaagcauggaccacggcguacgucucuuccccgcgauuccucacugagucagauggguagcccggcaggcgacccugaggaagaggagcccgucuacauagaaaugguggggaacaucuugagagacuuuaggaaagaggaugacgaucaguccgaagccguuuaugaggaaaugaaguacccaauuuucgacgaucucggacaagacgcuaaaugcgauuuugaccaccacucuuguagcucacagugcgccacuccuaccgugcccgaucuggacuucgcgaaggcaagugucccaugucccccuaagggccugcucugcgauaucccaccgcccuuuccuaauuuacugucccaucggccaccccuuuugguguucccuccagcccccguacacuguagcccgaacucugacgagucaccucugacaccacuagagguuacuaaacuccccgugcuggaaaaugucaguuacaugaagcagccugcuggugccagccccuccacccuuccaucucaugugccugggcacgcaaaacuggagaaggaacaggcugccgcguugggacccgccucggcaacaccagcucucagcuccucaccgccucccccaaguacccuguaucgaacgcaaucuccccacggcuacccuaaaagccauuccacuucaccaagccccgugucuaugggccgcuccuuaacaccucugagucucaagagaccgccacccuaugacgccguccacagcgggucucuuuccaggucaaguccuagcguuccacauucgacuccccggccugugucccaggauggagcuaagaugguaaacgccgcagugaauaccuacggugccgcuccgggcgggucucgcagcagaacacccaccucaccacuggaggaauugacgagucuauuuuccucuggaaggagccugcuccguaaauccucaagcggccggcgaaguaaggagccugcggagaaaucuaccgaagaacugaaggucagaucccacagcacagaaccccuuccaaaacuggacaacaaggagaggggucaucacggggcaucgucaucucgcgagccugugaaggcccaggaaugggauggcacucccggaaccccaguugugacaagucgguugggcagaugcuccgucagcccgacucuccuggcugggaaucacucuagcgagccuaaaguguccuguaaguuaggaaggucagccaguaccagcgguguacccccacccucuguuacaccucugcgccaauccucagaccuacagcagagucaggugccaagcucccucgcaaaccgagauuga

SEQ ID NO: 60036 - RNA, 1446 nt, Artificial Sequence
  derived and/or modified sequence opt3 from NYX__Homo_sapiens__NP_072089
augaagggcagagggaugcuggugcuccuucugcacgccgucguuuugggauuacccagcgcuugggcagugggugccugcgcgagggcuuguccugccgcaugcgccuguuccaccguagagcggggcugcucugugcgcugugaccgagcugggcugcuacgugucccagcagaacucccgugcgaggccgugucaaucgaucuggacagaaacggacuuagguuccugggcgaacgggcuuuugguacauugcccagucuccgcagacugagccugaggcauaauaaccucuccuucauuacuccuggggccuuuaaaggauuaccacggcuggcggagcuucgcuuggcacacaauggcgaucugcgauaccuacaugccagaacguucgcugcccucucuaggcugcggcgucuugaccuggcagcuugucgcuuguuuucgguucccgaaagacuccuggccgaguuaccugcgcugagggagcucgccgcauucgauaaccuuuuucggcgagugccaggcgcucugcgcggguuggccaaucuaacccacgcucaucuggaaagaggaaggauagaggccgucgcaucaagcagucuccagggucugcggcgccuuagaucccugucuuugcaagccaacagggugcgugcuguacacgcgggcgcauucggggacugcggaguucucgaacaccuguuacugaaugauaaccuacucgccgagcugcccgcugacgccuuucggggccuucgaagauugaggacacugaaucucggugggaacgcacuggaucgcguggcccgggcuugguucgccgaccuugcagagcuggaauugcucuaucuggauagaaauagcaucgcguuugucgaggaaggagcuuuccagaacuuauccggccugcuagcccuccaucugaauggcaacaggcuuacuguguuggcauggguggccuuucagccuggguucuuccugggacgccucuuucuguuccgaaauccaugguguugcgacugucgguuagaguggcugcgugauuggauggaagguucaggcagagucaccgacguuccgugcgcuagucccgggagcguggccggacuugacuugucucagguaacauuuggcagguccucagauggucucugcguggacccugaggagcugaaccuaaccacuagcaguccagggcccucuccugaaccagcagcuacaaccgucucccgcuucagcucgcugcucucuaagcugcuugcgccccgggugccgguugaggaagccgccaacacgacuggcggauuggcuaaugcaucccugucagauaguuuaagcuccagaggcgucgggggagccgguaggcaaccuugguuucuccuggcuucuugucuucugcccagcguggcccagcacgugguauucggcuugcagauggacuga

SEQ ID NO: 60037 - RNA, 459 nt, Artificial Sequence
  derived and/or modified sequence opt3 from OARD1__Homo_sapiens__NP_659500
auggccagcucccugaacgaggaccccgaaggcucuagaaucaccuacgugaagggggaucucuucgcuugcccuaaaacagacucacuugcacacuguauuagugaggauugcaggaugggagccgguauagcgguccuguuuaagaaaaaguucggcgggguucaggaauuguuaaaucaacagaaaaagagcggagagguggcuguacugaagcgggacggccgcuauaucuacuaucuaauuacuaaaaagcgagccucccauaaaccaacguacgaaaaccuccagaagucucuggaggcaaugaaaucgcacugucuuaagaauggugugaccgaucugucaaugccgcguaucgggugcggauuggacagacuccagugggagaacgucagcgccaugauugaagagguguuugaagcuacagauaucaagauaacuguuuauacccuguga

SEQ ID NO: 60038 - RNA, 1245 nt, Artificial Sequence
  derived and/or modified sequence opt3 from OAS1__Homo_sapiens__NP_001027581
augauggaccugagaaacacccccgccaagagccucgauaaauucaucgaggacuaccuucugccugauacaugcuuuaggaugcagauuaaucacgcuauagacaucauuuguggcuucuugaaggaacggugcuuucgcggguccucuuauccagugugugucucaaaaguugugaagggagguaguagcggcaaagggacuacguuacgaggacguuccgaugcagaccugguaguguuccuaucuccgcucaccacauuucaagaucagcugaacagaaggggcgaguucauccaggaaauucggcgccagcuugaggccugccaaagagaaagggcguuuucggucaaguucgaggugcaggcuccccggugggguaauccucgcgcccugucauuuguuuugagcagucuccagcugggggagggaguggaguucgacguccugccagcauuugaugcccucggccaguuaacuggcggguacaagcccaacccucaaaucuaugugaaacugauagaagaauguaccgaccuucagaaggagggagaguucuccacaugcuuuaccgaauugcagcgagauuuccugaaacagagaccaacuaagcuaaaaucucucaucaggcugguaaagcauugguaccaaaauuguaagaaaaagcuggguaaacuucccccucaguaugcuuuggagcuccugacaguuuacgcaugggaacggggcagcaugaagacccacuucaacacggcccagggguuucguacuguguuagagcuggucauuaauuaucaacagcucugcaucuacuggaccaaauacuaugacuucaagaacccaauuaucgaaaaauaccuucgcagacagcugacaaagccgaggcccgugauauuggauccugcugacccaacuggaaaucuaggcgguggggaccccaagggauggcggcagcuggcccaagaggcggaggcauggcucaacuauccuuguuuuaaaaauugggauggcuccccagugucaaguuggauucugcuuacccagcauacacccggcagcauccacccgaccgggcgacgcggacuggacuugcaucacccucucaacgccucugcuuccugggguaagggccugcagugcuacuuagaucaguuccugcacuuucaagucgggcuacucauucagagaggacagucaagcaguguuucuugguguaucauccaggacaggacgcaaguguccuga

SEQ ID NO: 60039 - RNA, 519 nt, Artificial Sequence
  derived and/or modified sequence opt3 from OAS2__Homo_sapiens__NP_001027903
augggcaacggggagagccagcuguccucugugcccgcccaaaagcucggaugguucauccaggaauaccuuaaaccuuaugaggaaugccagacccugauugacgagauggucaauacaauaugugauguuuugcaggaaccagagcaauuuccguuagugcaggguguagcuaucggcgggucauacggaagaaagacugugcugaggggcaacagugacgguacgcuaguccucuucuuuagcgaucugaaacaguuccaggaccaaaagcggucccagcgcgauauucuugacaaaaccggggauaagcugaaguuuugcuuguucacaaaauggcucaagaauaacuuugagauccagaaaucucuggacggauucacuauucagguguuuaccaagaaucaacgaaucucguucgaaguucuggcagccuuuaacgcgcucucaaaacacuguugggugagcggcgagaagagucagcguuccggcugccagacagcuuuauguaaucuguga

SEQ ID NO: 60040 - RNA, 3264 nt, Artificial Sequence
  derived and/or modified sequence opt3 from OAS3__Homo_sapiens__NP_006178
auggaccuguacagcacccccgccgcugcacucgauagauucguggccaggcggcuucagccucgcaaggaguuugucgaaaaagcgcgacgugcucugggcgccuuggcagccgcuuuaagagagaggggagggcggcugggugcagccgcuccacgcguucuaaagacagugaaaggcggguccucuggaagaggcacugcccucaagggugggugcgacucagaacugguaaucuuccuugauuguuuuaaaaguuauguggaccaaagggcgcggcgcgcagagauucugagcgaaaugcgagccuccuuggagucuugguggcagaacccgguccccggacucagacugacguucccugagcagucggugccaggcgcucugcaguuuaggcucaccucaguugauuuagaagacuggauggaugugagccugguccccgccuucaaugugcuuggccaagcagggaguggaguaaagccuaagccacagguuuacuccacauugcugaacucugguugccagggcggggagcacgcugccuguuuuacugaacuacggcguaauuucgugaacauacgccccgcgaaacucaagaaucugauccuucuggucaaacauugguaucaccaggugugcuugcaaggacucuggaaggagacccugccuccaguguacgccuuagagcugcucacaauuuuugcaugggaacagggcuguaaaaaggacgcuuucagccuugccgagggucugagaaccgucuuggggcuaauccagcagcaucaacaccugugcguguuuuggacuguuaacuauggauucgaagauccggcuguaggccaguuucuccagaggcaacugaagcggccccgaccugugauucuugacccagccgaucccacaugggaccugggcaauggggcagccuggcauugggauuugcucgcucaggaggcggcauccuguuacgaccacccuugcuuccugcgcggaaugggugacccaguccagucauggaaaggccccggguuaccgagagccggauguaguggccugggucacccuauccagcuagaucccaaccaaaagaccccagaaaauagcaaaucucucaacgcuguguauccuagggccggguccaagcccccaucaugccccgcaccuggcccaacgggagccgcuagcauaguuccgagugugcccggcauggcccuggaccuuucucagaucccuacuaaagaguuggaucgguucauucaggaccaucugaagccaagcccccaguuucaagagcaggucaaaaaggcaaucgauauuauccuccgcugucugcacgaaaauugcgugcauaaggcguccagaguaucgaaagggggaucuuucgguaggggcaccgaccuucgugaugggugcgacguugagcugauaaucuuuuugaacuguuucacagauuacaaggaccagggaccucggcgagcugaaauucucgaugagaugagagcccagcuggaauccugguggcaagaccaggugccaucauuaagucugcaguuucccgagcagaaugucccggaggcacuacaauuccagcucgugagcacugcccugaaauccuggaccgacgucucucuuuugccugcuuuugaugccgugggccagcugagcucagguacaaagccaaacccccaaguuuacaguaggcuccugaccuccgggugccaggaaggcgagcacaaagcauguuucgcugaauuacgccggaauuuuaugaacauuagaccugugaagcugaagaaccuuaucuugcucguaaaacacugguauaggcaggucgccgcgcagaauaagggaaaaggccccgccccagcuagccugccucccgcauacgcccuagagcugcucacgaucuucgcuugggaacaagggugccgccaggacuguuuuaacauggcccagggauuccgaacugugcugggucuuguucagcaacaucagcaguugugcguguauuggacagucaauuacucuaccgaggauccagcaaugcggaugcaccuguuaggccagcuccguaagccgagaccucuggugcuugaccccgcggauccaacuuggaacguagggcauggaucaugggagcuguuggcccaagaagcugccgcacucggcaugcaggcuuguuuucugaguagggacgguacaagcgugcagcccugggauguuaugccugcccuacuguaucaaaccccagcaggggaccucgauaaauucauuuccgaguuccugcagcccaaucgccaguuucuugcccaggucaacaaggcuguggacacgauaugcucuuucuugaaggaaaauuguuuucggaacucgccuaucaaagugauuaaggucguuaaaggcggaagcuccgcgaagggcaccgcccugagagggaggucagaugcagacuuagugguguuccucaguugcuuuucucaauucacagagcagggaaauaaacgagcugagaucauaagcgaaauucgcgcccagcuggaggccugucagcaagaacggcaguuugagguaaaguucgaagucuccaagugggagaacccgagagugcuuucauuuagccugacuucucagaccaugcuagaucaguccguugacuucgacgugcucccagcuuuugaugcacugggccaauuggucagugguagcaggcccucuucccagguguacguugaccugauccacucauauaguaaugccggggaguacagcacaugcuucacugaauuacagcgugauuuuaucauuucgcgcccuaccaaacucaagucccugauccggcuugugaaacauugguaccagcaaugcacaaagauuucuaaaggaagaggcagccugccaccccagcacgguuuggagcuccugaccguauaugcgugggaacagggcgggaaggacucacaauucaacauggcugagggauucaggacuguccuagaacuggugacgcaguaccgacagcuuuguauauauuggacaaucaauuacaacgccaaagauaagaccgugggcgacuuucucaagcagcaacugcagaaaccucggccgauuaucuuggaucccgcagacccaacugggaaucugggacacaacgcccgcugggauuuacucgcuaaggaggcagccgcgugcaccagugcucuguguugcaugggcagaaacgguaucccuauucagcccuggccagucaaagccgcaguuuga

SEQ ID NO: 60041 - RNA, 1545 nt, Artificial Sequence
  derived and/or modified sequence opt3 from OASL__Homo_sapiens__NP_003724
auggcccugaugcaggagcucuacagcacccccgcuuccagacuugacucuuucguggcacaauggcugcagccucacagggaauggaaggaggaagucuuggaugccguucggacaguggaggaauuuuuacgccaggagcauuuccagggcaaacgagggcuggaccaagauguacgugugcuaaaggucgugaaaguuggaucauuugguaacggcacugugcucagaaguacgagggaggucgaacugguggcguuccuuagcugcuuucacuccuuccaggaggcugccaagcaucacaaagacguacugcgguugaucuggaagaccauguggcagucucaggaucuccuggaccuggggcucgaagauuuacgcauggagcaaagaguuccagacgcacugguguuuacaauucagacuaggggaaccgccgagccgauaacagucaccaucgugcccgcuuaucgggcacuuggcccuucguugccaaauucacagcccccuccagaaguguacgucagccugauuaaggccuguggugggcccggaaacuucugcccuaguuuuuccgagcuacagcgcaauuucguuaaacaucgaccaacuaagcucaaaucucugcuuagacuggugaagcacugguaucaacaguacguaaaagcuaggagcccgcgggccaacuugcccccucucuaugcgcuggaauuacugacaaucuacgcaugggagaugggcaccgaagaggaugagaauuuuaugcucgacgaaggcuucacgacugugauggaucuucuguuggaguaugaagucauuuguaucuacuggaccaaguacuauacacuacacaacgccauaaucgaggacugcgugcguaagcagcugaaaaaggaacgcccaauuauccucgaucccgcugacccuacucugaauguugccgagggguacagaugggacauuguggcacaaagggcuucccagugucuuaaacaggauugcuguuaugacaaccgggagaauccaaucucaaguuggaacgucaagcgagcccgcgauauacaucugaccguggaacagagaggauaccccgacuuuaauuugauuguaaacccguaugagccuaucaggaaaguuaaggagaaaauucggcgcacaagagguuacagcggccuccaaaggcugucuuuccaggugcccggguccgaacgucaguuacugucaagccggugcagucuagcgaaguauggaaucuucucucacacccauaucuaccuccuggaaacgauuccauccgagauacaggucuuugugaagaauccugauggcgguagcuacgccuaugcaaucaaccccaauucguucauucuuggguugaaacaacagaucgaggaccagcagggacugccaaagaaacaacagcagcucgaauuucagggccaaguccugcaggauuggcuuggccuggggauauacgguauucaggacucugauacuuugauccucuccaagaaaaagggagaggcucuguuccccgccucauga

SEQ ID NO: 60042 - RNA, 906 nt, Artificial Sequence
  derived and/or modified sequence opt3 from OAT__Homo_sapiens__NP_001165285
augaacaccggcguggaggccggggaaacagcuugcaagcuggcaagaaaauggggauacacugucaaggguauccagaaauauaaggccaaaauuguuuucgcggcuggcaauuuuugggggaggacgcucagcgccauauccucuucaaccgaccccacaaguuacgauggauucggcccuuuuaugccagguuucgacaucauuccguauaacgaucuucccgcacuggagcgggccuugcaagacccuaauguggcugcauuuaugguagaaccaauccagggggaggccggaguggucgugcccgauccuggcuacuuaaugggcguucgcgaacuguguacucgacaccaggugcuauucauugcugacgagauccagaccgggcucgcccguacaggaagauggcuggcggucgauuaugagaacgugaggccagacauaguacuucuggguaaggcauugagcggcgggcucuaccccguuuccgccgugcugugcgaugacgauaucaugcugaccauuaagccuggagaacauggcucuacuuauggugggaauccacucggaugucgggucgcuaucgccgcauuagaggugcuggaagaggagaaccuugcugaaaaugccgacaaauugggcauuauccugcgcaacgagcuaaugaagcucccgucggauguggucacagcgguuagaggcaaagggcugcuuaaugccauagugauuaaggaaaccaaagacugggacgcauggaagguaugccugagguugcgggauaacggacuccuggcuaagcccacgcacggugacaucauucgcuuugccccuccauuagugaucaaagaggaugaacugcgagagucaaucgagauuauaaauaagacuauccucagcuucuga

SEQ ID NO: 60043 - RNA, 681 nt, Artificial Sequence
  derived and/or modified sequence opt3 from OAZ1__Homo_sapiens__NP_001287949
auggucaagagcucccugcagagaauccucaacucucacugcuucgccagggagaaagaaggcgacaagcccucagcuaccauucaugcaagucggacaaugccucuucugagcuugcacucccgcgggggaucuucgucagagcgagugagcuuacauuguugcaguaauccagguccgggcccccguugguguuccgaugccccucacccaccccugaaaauaccugggggaagaggcaacucucaaagggaccauaaucuaagcgcgaaccucuuuuacuccgaugaccggcugaauguuacugaagaacuuacgucaaacgauaagacccgcauccugaaugugcagaguagauugacagacgcuaaaaggauuaacuggcggacuguacucagcggugggucucuguauaucgaaauuccaggaggcgcccugcccgagggcuccaaggauucauucgcagugcucuuagaguuugccgaggagcagcugcgcgcugaccacgucuucaucugcuuucacaagaaucgagaagauagagcagcccuuuugaggaccuucagcuuucugggguucgagauagugcggccuggacauccgcuaguuccaaaacgucccgacgcuuguuuuauggccuacacauucgagcgcgaaaguucuggugaggaagaggaauga

SEQ ID NO: 60044 - RNA, 570 nt, Artificial Sequence
  derived and/or modified sequence opt3 from OAZ2__Homo_sapiens__NP_002528
augaucaacacccaggacagcuccauucugccccucucuaauugcccucaacuucaguguugcagacacauagugccaggcccgcugugguguucagaugcuccccauccuuugaguaagaucccagggggaagggguggcgggcgggaccccagcuuauccgcccugauuuacaaagaugagaagcuaacagucacucaggaccucccuguuaacgauggaaaaccacacaucgugcauuuccaguaugaaguaacggaggugaaggucucuucgugggacgcagugcugucaagccaaagucuuuuuguugaaauucccgauggccuguuggccgacgguuccaaagaggggcuccuggcgcugcucgaguucgcugaagagaagaugaaggugaauuacgucuuuaucugcuuccgcaaaggacgagaagaucgugccccuuuacugaagaccuuuucuuuccuuggcuuugagauagugagaccaggccacccguguguacccagcaggccugacguuauguucaugguguauccauuggaucagaaccuguccgacgaagauuga

SEQ ID NO: 60045 - RNA, 1107 nt, Artificial Sequence
  derived and/or modified sequence opt3 from OBFC1__Homo_sapiens__XP_006718039
augcagcccggcagcuccagaugcgaggaagagaccccuucucugcucugggggcuugacccaguguuccuggccuuugcuaaguuguacaucagggauauuuuagacaugaaagaaucacggcaagucccgggaguuuuccuguauaacggucaccccauaaaacagguggauguacuaggcacagugaucgggguccgcgagcgagacgcauuuuacaguuauggaguggaugacagcacuggcguuauuaauuguaucugcuggaagaagcucaacacggaauccgugucugccgcgccuucggcugcccgugagcugucacuuaccagccagcugaaaaaguugcaggagacaauugaacaaaagacuaaaaucgagauaggugauaccaucagagucagggggaguauucggacauaccgcgaagagagagagauccaugcaaccacuuauuacaagguggacgauccaguauggaauauucagaucgccaggaugcucgaacugcccacaauauaucggaaaguuuacgaccagccuuuccacuccucugcucuggagaaggaagaggcacucagcaacccaggagccuuagaucugcccucccuuaccucauugcugagugaaaaagcuaaggaguuucuaauggagaaucgcgugcagagcuucuaccaacaggaacucgagauggucgaaucucugcuuucccuggccaaccagccugugauucauucagcgagcagugaccaggugaauuuuaagaaagauacgacuucuaaggcaauccacuccauuuucaaaaacgccauccaauugcuccaggagaagggccuggucuuucagaaagacgacggcuucgauaauuuauauuacguuacccgagaagacaaggaucugcauagaaaaauccacaggauuauacaacaggacugucagaagccaaaccacauggagaaggggugccauuuucuccacauccuugcuugugcccggcugagcauucguccgggauugucggaggcagugcuacagcaaguacuggaacuccuggaggaucagucugacaucguguccacaauggaacauuauuacacugcuuucuga

SEQ ID NO: 60046 - RNA, 687 nt, Artificial Sequence
  derived and/or modified sequence opt3 from OBP2A__Homo_sapiens__NP_001280118
augaagacccuguuccucggcgugacacuugggcuggccgcugcauugagcuuuacuuuagaggaagaggacaucacgggaaccugguacgucaaagccaugguuguggauaaggacuuccccgaagauagaaggccucggaaaguauccccagugaaggucacagcgcuggguggcgggaaccuagaggcuacuuuuaccuucaugcgcgaagaccgaugcauucagaaaaagauacucaugcguaagacagaggagccgggaaaauuuucugccuauggcgguagaaagcugaucuaccuucaagaacugcccgggaccgaugacuauguguucuacuguaaagaucagaggcggggaggcuugcgcuauaugggcaagcucguugcaucagccccuugcagagcugugccacugagucccccuuggcugacuuggccaccccaccuccaggucgggauuuuaaucccuacauggaggccauggaaaaaucugcggaacugguguagcacccgcgacucccgaagaaggacguuuucuugcccgugucggcgugaggcagccuucucgaauacucgccagcccccuggacuucauuugcaaucaccacccuaccaccagacccagagcccugaucaucuggaccuaccaaguucccacgaucccucucuccugccgccuacauga

SEQ ID NO: 60047 - RNA, 23907 nt, Artificial Sequence
  derived and/or modified sequence opt3 from OBSCN__Homo_sapiens__NP_001092093
auggaccagccccaauucagcggcgccccuagauuucugaccaggccaaaggcuuucguggucuccguugggaaagaugcaacacucucuugccagaucgugggaaacccgacuccccagguaucaugggagaaggaccagcaaccuguggccgcgggugcucgguuucgccuugcccaggauggcgaccuguaccgauugacgauuuuagaucuggcacuaggggacaguggacaguaugucugucgugccagaaaugcuauaggcgaagcauucgccgcugugggucuccagguugaugccgaggcggcaugcgccgaacaagcuccacacuuucugcuuaggcccaccagcauccgggugcgcgagggguccgaagccacauucagauguagggucggaggcucuccucggccagcagugucguggucaaaagacggccgccgacugggggagcccgauggaccuagaguaaggguugaggaauugggugaggcuagcgcccuccggauucgugcggcccgcccaagagacggcgggacuuacgaagugagggcagagaacccgcugggagcugccagugcugccgcagcccuggucguggauuccgacgcugcggauaccgcaucucggcccggcacaagcaccgccgcucucuuagcccaucugcagcgacgcagagaggcaaugagggccgaaggugcuccugccuccccacccucaacugggacacggaccugcacggugacugagggaaagcacgcacgccuuaguuguuaugucaccggcgaaccuaaaccagagacaguuuggaagaaggacggccaguuggugacugaagggagaaggcauguaguguacgaggacgcgcaggagaauuuuguccugaaaauccuauucugcaagcaaagcgaucguggacucuauaccuguacagcuucuaaccuggugggucagaccuacuccucaguucuuguggucgugcgggaacccgccguaccguuuaaaaagcgacugcaggacuuggagguuagagaaaaagagagcgcaacguuccucugcgaagugccucaacccaguacugaggccgcuugguuuaaggaggaaacaaggcugugggccucugcaaaguauggcauugaggaagaggggaccgaacgccgguuaacugucagaaauguguccgcugaugacgaugccgucuacaucugugagacaccagagggaagcaggaccguggcggaacuggccguucagggcaaccuccuucgcaaacugccucgaaagacggcugugcggguaggugacaccgcaauguucugcgucgaguuggccgugcccguugggccagugcacuggcuacguaaucaggaagaggucguggcuggcggaagaguagccauaucggcagagggcacaaggcauacucugaccaucucucaguguugccucgaagauguggggcaaguugcguuuauggccggagacugccagacauccacucaguucugugucucagcuccccgcaaaccuccacugcagccgcccguggauccuguggucaaggcccggauggagaguagcguuauucuuuccuggucuccacccccucacggugaaagaccagugaccaucgacggcuaccugguggagaaaaagaaauuggggacauauaccuggauuaggugccacgaagcagaguggguagcuacucccgagcucacggucgccgauguggcagaagagggaaacuuccaauuucgaguuagcgcccugaauucauucggccagaguccguacuuagaauuuccugguacagugcaucuggcuccaaagcuagcgguccgcaccccccucaaggccgugcaggcaguugaggggggcgaagugacuuucuccguagaccugaccgucgcuagcgccggagagugguuucuugacggccaggccuugaaagcuucuucaguguaugagauccacugugaucggacaagacauacccugacuauaagggaagugccugcaagucuccacggggcccaacugaaguucgucgcgaacggaauugagagcuccauccguauggaaguucgcgcugcccccggucuuacagcaaauaaaccaccugccgcugcagcccgggaggugcuggcgagauugcacgaagaggcucagcuccuggccgaguuaucugaccaggcagccgcuguaacguggcugaaggauggcaggacccuaucgcccgggccaaaauacgaagugcaggccagcgcaggacgacggguccuccuggugcgcgacguugcuagagaugacgccggccuuuaugagugcguguccaggggugggcggauugcguaccaauugucaguccagggccuggcccgauuucuccauaaggauauggcaggaaguuguguggacgcuguugccggcgggccggcucaguucgaaugcgagacuucugaggcacacgugcauguccacugguauaaggauggaauggaacugggccauagcggugagagauuuuuacaagaagacguagggacacgccacaggcugguggccgccaccguuacacgucaggaugagggaacuuacuccugucgggugggcgaagacucagucgauuucagacuuagggugagcgagccuaaaguaguguuugcuaaggagcaguuggcgcgccgaaaacuccaggcagaagccggugcuucugccacccuguccugcgaggucgcacaagcccagacggaaguuaccugguacaaggacggcaaaaagcuaaguagcucuuccaagguguguauggaggcuacagggugcacuagacggcuggugguccagcaggcgggacaagccgacgcaggcgaauauucaugugaggcugggggacagaggcucaguuuccaccuggaugugaaagagcccaagguuguauuugccaaagaccagguggcacauagcgaaguccaggccgaggcuggcgccucggcgacccuuuccugcgaaguggcacaagcccagacagagguuaugugguacaaggaugguaaaaaguugucuagcucacugaaggugcacgucgaagcuaaagggugccgccguagauuagugguacagcaagccggaaagacugacgcuggcgauuauaguugugaggcacggggucagagggucuccuuccgccuccauaucaccgagccaaaaaugauguucgccaaggaacagucugugcacaacgagguucaggcugaagccggcgcaagcgcgaugcuguccugcgagguggcccaagcucagacggaggucacaugguacaaagacgggaagaaacuuucaagcaguucuaaggugggaauggaaguuaagggcuguacccgaagacugguguugccccaggccgggaaagcagaugcuggagaguauuccugcgaagccggcggucagcgggucagcuuucaccuccauaucacugagccuaaggggguguucgcaaaagaacaaucgguacacaaugaggugcaggccgaggcuggaacaaccgcgaugcugucaugugaaguugcccagccacagacugaggucaccugguacaaggacggcaaaaagcuaucuaguuccagcaaggugaggauggaagugaaagguugcacacgcagacuggucguacaacaggugggcaaggcagaugcuggggaguauucuugugaagccggaggccagaggguuagcuuucagcuccauauuacggagcccaaagccguguucgcaaaggagcaacugguccacaacgaagugcggaccgaggcuggggccuccgcgacucuuucaugcgaaguugcucaggcccagacagaggugaccugguacaaagacggaaagaaguugaguagcucuuccaaaguccguauagaagcagccggcuguaugcgccaacuggugguacagcaggcuggucaggcagaugccggggaguacacaugcgaggcgggaggccaacgauuaucauuucaucucgacgugagugaaccuaaggcuguuuucgccaaagagcagcuggcacacagaaagguccaggccgaagcuggcgccaucgcaacucuuagcugugagguggcucaggcccaaaccgaggugacgugguauaaagaugggaagaagcuguccucuucgagcaaagucaggauggaagcgguuggaugcacacggcgccuagugguacagcaggccugccaggcagacaccggugaguacucaugugaagcuggcgggcaaagacucuccuuuagucuggacguggccgagccgaaggucguguucgcaaaagaacagccaguucacagggaggugcaggcucaagccggagccucuacuaccuugagcugcgaggucgcgcaggcucagacagaaguaaugugguauaaggauggcaaaaagcuguccuuuucaucuaaagugcggauggaggcaguugguuguacucgaagauuagugguccagcaagccgggcaggcuguggccggagaauacagcugcgaggcaggcagucagcgccucuccuuccaucugcacgucgccgaacccaaggcuguguuugcgaaggagcagccugccagcagggagguucaagcagaagcuggcaccucugccacacuuucaugugagguggcacaggcccagacggaaguaaccugguauaaagacgggaagaaacuguccaguagcucgaaggugcggauggaggcugucggaugcacucguagauugguugugcaggaagccggucaagcggaugcaggcgaguacucuuguaaagccggggaccagaggcucuccuuccaucugcacgucgcugagccaaaggugguauuugccaaggaacagcccgcacaucgcgaggugcaggcugaagccggagcuagcgccacacuaucaugcgagguugcacaagcgcagaccgaggugacuugguauaaagauggcaagaaacugaguucuuccagcaagguccggguggaagccgucgguuguacacgaagacuugugguucagcaagcugggcaggccgaggcaggagaauacucaugcgaggcuggcggccagcagcucaguuucaggcugcaaguagccgaauuggagccucagauuagcgagcgcccgugucggagagaaccccugguggucaaagagcacgaagacaucauauuaaccgcaacgcucgccacuccauccgcggcuaccgugacauggcugaaggaugggguugagauucguaggucuaagcggcacgaaaccgccagccagggagacacucauacacuuaccgugcacggugcacagguccuggauuccgccaucuacucaugccgcgugggcgcugaggggcaagacuucccuguacagguggaggaaguugccgcaaaauuuugccgauugcucgagcccgucuguggagaacugggcgguacagugacucuagcuugcgagcugucuccagccugugcggaaguggucuggagaugcgggaauacccagcuuaggguuggaaagcgguuccagaugguggcugagggcccuguacgcagucucacggugcugggcuugagagccgaggaugcaggggaauaugucugugagucgagggacgaccauacaagcgcccaauuaaccguguccguuccccgaguggucaaauuuaugucuggacugucaacugugguagcugaagaggguggcgaggcaaccuuccagugcguugugagcccauccgaugucgccguggugugguuucgggacggggcgcuccugcagccgagugaaaaguucgccaucucucaaagcggagcuucacacucccuuacaauuagugaucuggucuuggaggacgcaggccagaucacuguugaagccgagggugcuagcucuuccgccgcacuacgugugagagaagcuccuguacuguuuaaaaagaagcucgagccccagaccguggaggaacgcucaagcgucacgcuggagguggaacuuacaaggccauggcccgaguuacgguggaccagaaacgccacugcgcuggccccugggaaaaacguugaaauucacgcagagggagcucgccauaggcucguguugcacaaugucggcuucgccgaucgaggcuuuuucgggugugagacaccagacgauaagacccaggcaaaacugacuguggaaaugcggcaaguaagacucguuaggggacugcaggccguggaggcucgcgaacaggguacagccaccauggagguccagcuuucgcaugcggacguggauggcucuuggacgcgugacgggcugcgguuucaacagggacccacuugccacuuggcuguuagaggcccuaugcauacccuaacacugaguggucucaggccggaagauuccggguuaaugguguucaaggcagagggcguccacaccagcgcccgccuggugguaacagagcuuccagugucauucucccgaccccugcaggacgucguuacuaccgaaaaagagaaggugacgcucgaaugugaguugucucggccuaacgucgaugugagauggcugaaggacggaguagagcucagggcuggcaaaacaauggccauagcagcccagggggcuugccgcagccugacuaucuacagaugugaauuugcggaccaaggaguguauguuugcgaugcccacgacgcacagaguuccgccagcgugaagguccagggucggaccuacacacuuauuuauaggcgugugcuagcugaggaugcaggcgaaauccaauucguugccgagaaugcugaaucucgagcccagcugcgcgucaaagaguugcccgugaccuuagugagaccacugcgggacaagaucgcgauggagaaacauagggggguacucgaaugccaggucucacgcgcaagugcccaggugagaugguuuaagggaucccaagagcugcagccuggccccaaauacgaacuuguuagcgauggucuguaucggaagcucauuauaucugacgugcacgcugaggaugaagacacuuacaccugugaugccggggacgucaagacaucggcacaguucuuuguggaggagcagucaaucacgauuguuaggggcuugcaagaugugacuguaauggaaccagcuccugccugguucgagugcgaaaccagcaucccguccguccgacccccaaaauggcugcuaggaaagacagugcugcaggcgggcgggaacgugggacucgagcaggaagguaccguucaucgucuuaugcugagacgcacuuguaguacaaugaccggcccuguccacuuuacgguggggaaaucucggagcuccgccagguuaguagugucagacauucccgucguguugacuagaccacuggagccuaagacaggacgcgagcuccagaguguugugcugucuugcgauuuccggcccgcuccgaaagcaguccaaugguacaaggacgacaccccacuuagcccuuccgaaaaguuuaaaaugucacuggagggccagauggccgaacucaggaucuugcgacugaugcccgcugaugcagguguguauagaugucaggccgggagcgcucacucuuccaccgagguuacuguggaggcccgggaaguaacagucaccggcccauuacaggacgcagaggccacagaagagggaugggcgaguuucagcugcgaacuaucgcaugaggaugaggaaguggaguggucccugaauggcaugccccucuacaacgacucuuuucacgaaauaucacauaaggggaggcgccacacucuuguucugaaaagcauccaacgugcugaugccggaauugugagagcaaguuccuugaaggucucuacgagcgcccgacuggaggugaggguaaaaccuguggucuuccucaaggcucuggacgaucuuucagccgaagagcggggcacccucgcacugcagugugagguuuccgacccggaagcucaugugguguggcgcaaggaugguguccaguuggggcccagugacaaauaugauuuucugcacacagccggaacuagaggcuuagugguucacgacguaagcccagaggacgcgggucuauacaccugccaugugggcucugaagagacaagggcacggguccgcgugcacgaucugcauguugggaucaccaagagacucaaaacuauggaagugcuugagggagagucauguuccuucgaaugcguccugagccacgagucugccagugacccugcuauguggacggugggcgggaagaccguaggaucguccagccgauuccaagccacaaggcagggccggaaauauauuuuggugguccgugaagcugcacccucagaugccggugagguuguguuuucuguccgcgggcugacuagcaaggcgucccucaucgugagagagaggccugccgcuauaauuaagccacuggaagaccaguggguugcacccggagaggauguggaacuucggugugaguuaaguagagccggcaccccuguacacuggcugaaagaccgcaaggcuauccgaaaaucacagaaguacgauguggucugcgaagguacaauggccaugcucgugauuaggggcgcaucuuugaaagacgccggggaguauaccugcgagguugaagcuagcaaguccacugcgagucugcaugucgaggaaaaagccaauuguuucacagaggaacuaacgaaccugcaaguggaggagaagggaaccgcaguguuuacuugcaagacagaacacccagcugccaccguaaccuggcggaaaggccuccuugagcugagagcaagcgggaagcaucagcccucccaggaaggauugacacugcgucucacuaucucugcccuggagaaagcugauucagacacguacaccugugauauaggccaggcgcaaagccgcgcccaguuacuuguccaggguaggcgggugcacaucauugaagaccuggaggauguugacgugcaggaggggucguccgcaacauucagaugccgaaucaguccggcuaauuacgaaccuguccauugguuucucgacaagacuccacuacacgccaacgagcugaaugaaauugaugcccaacccggaggcuaucacguguugacccugaggcagcucgcucuuaaagacucuggcacaaucuacuucgaggcaggggaucagcgcgccagcgcugcgcugcggguuaccgagaagccuucaguguuuuccagagaauugacugacgccacgauaacagagggagaagaucugacccucgucugugagacuucuaccugcgacauuccaguguguuggacaaaggaugguaaaacuuuaaggggcagugcacgcugccaacugagccaugaagggcaccgugcccagcuucugaucaccggagcuacacuacaggacuccggccgguauaagugugaggcagguggggccugcucaagcucuaucguaagagugcaugcucgacccguuagguuccaggaggcccucaaagaucuggaagucuuggagggaggcgcagcgacgcugcgcugugugcucaguuccguggccgcuccggucaaguggugcuacggcaacaauguucuucggccuggggacaaauauagccugagacaagaaggagccauguuagagcuggugguaaggaacuugcgcccccaggauucagguagauacucuuguuccuuuggcgaccagaccacuucggcaacacucaccgugacugcucugccagcccaguucauugggaagcuacggaauaaggaagcgacagagggagccaccgcuacgcuucgaugcgagcugagcaaagcagccccugucgaauggaggaagggcagugagacccuccgugacggugauagauauugccugcggcaagacggggcuaugugugaauugcagauccgcggacuggcaaugguggaugccgccgaguacucuugcguuuguggcgaagagaggacauccgcuagccucacuauucgacccaugccagcacacuuuauaggcagacuucggcaucaggagucaaucgaaggggccaccgcgacacugcgcugcgaguuaaguaaagcugcccccguggaauggaggaagggaagagagucccugcgggacggugaucgucacagcuugcgccaggacggcgcagucugugagcuccaaauuugcgggcuggccguagcugaugccggagaauacucuugugugugcggcgaggaaaggacuucagcaacccuaacaguuaaagcucuuccugccaaguucaccgagggucugcgaaacgaagaggcgguggagggggcaacugccaugcucuggugugaacugagcaaggucgcuccaguggaguggagaaaaggaccggaaaacuugcgggacggcgauagguauaucuuacgccaggagggcacgagaugcgaacugcagauuugugggcucgccauggcugacgcaggagaguaccuuugcgugugcggucaggagcggacauccgccacccugacuaucagggcgcuacccgcccgcuuuauagaagaugucaagaaucaagaggcucgagaaggcgcaaccgccguucugcagugugagcucaacucugcugccccuguggaauggagaaaagggagugagacauugcgugacggagaucgguauucgcugaggcaggacggcacgaagugcgagcuucaaauccgcggucuggcaauggccgacaccggggaauacagcuguguaugcggacaggagagaacuuccgcuaugcucacagugcgggcguuaccaauuaaauucaccgaaggccugaggaaugaggaggccacugaaggcgcaacagcugucuugcgaugugagcugucaaagauggcccccguugaaugguggaaagggcacgagacccucagagauggagaccgccauucucuucggcaggauggugcaaggugcgaacugcagauccguggccuaguggccgaggacgcuggggaguaucuguguaugugcggaaaggaaagaacaagcgcgaugcucacugugcgcgccaugccuaguaaguucauugagggcuugaggaacgaagaggcaaccgaaggugauacggcuacccuguggugugagcuuuccaaagccgccccagucgaguggcggaaggggcacgaaacacugcgagacggagauagacauucauuacgccaagacggcucuaggugcgagcuccagauccggggccuggcuguaguggaugcaggggaauacagcuguguuugcggacaggagagaacuuccgccaccuugacagugcgugcgcugcccgcucgcuuuauagaagacgucaaaaaucaggaggccagggagggugcaacugccgugcuccaaugcgaacuuaguaaggcugcaccuguugaguggcggaaaggcagcgaaacccugcgagggggagauagauauucucuaaggcaggacggcacgcgcugugagcugcagauucacggucucucaguggccgauacaggggaguacuccugcgucuguggccaggaacggaccagcgcuacuuugacaguaagagccccgcaaccaguguuccgagagccccugcagaguuuacaggcggaagagggaucuaccgcaacucuucaaugcgaacuguccgagccuaccgccacagucguguggucgaagggcgggcuccagcugcaggcuaacggaaggcgggagccccgcuugcaggguuguacggccgaacugguucuccaagaccuucagagagaggacaccggcgaauacacuugcacaugugggagccaggcaaccucagcuacucugacagugaccgccgcgccaguccguuuucuaagggagcugcagcaccaagaaguggaugagggaggcacggcccauuuaugcugugagcucucccgggcaggugcuucuguagaauggagaaaggggagucugcaguuguucccuugcgccaaauaucagauggugcaggacggcgcugcagccgagcuucugguucgcggaguggaacaagaggaugccggcgacuacacaugugauaccgggcacacucagagcauggcuucacucuccgucagggugccccgaccaaaguuuaaaacccggcugcagagcuuggaacaagagacaggagacaucgcaagacugugcugccagcuaucugaugccgagaguggugcgguuguccaguggcucaaggaaggcguggagcuucaugcugggccgaaauaugaaaugcgcucccagggagccacuagggagcuguuaauccaccaacuggaggcaaaggacaccggcgaauacgccuguguaacagguggccagaagacggcugccagccuccgugugacugagccugaagucaccauugugagagggcugguugaugcagaggugacagcugacgaagaugucgaguucucaugcgaggugucucgggccggagcgaccggcguacagugguguuugcaggggcuuccccugcaaucgaaugaaguuacugagguggcaguccgcgacggaaggauacauacacuccgacugaaaggcgugaccccagaagacgccgguacggugagcuuucaccuagggaaccacgcuuccagugcccaguugacuguuagagcacccgaggucaccauccuggaaccucuccaggaugugcagcuuucugagggacaagacgcuucauuccagugccggcugagccgcgccuccggccaggaggcgaggugggccuuagguggcguaccacugcaggcuaaugaaaugaacgauauuacaguggagcaagggacccuccaucuguugacucuucacaaggucacacuggaagacgcaggaaccgugaguuuucauguuggcacauguucuagcgaggcccagcucaaagugacugcuaagaauaccgucgugagagggcuggaaaacguagaggcccuagagggaggcgaagcauuauucgagugccagcugucccaacccgaaguugccgcucacacgugguugcucgaugacgagccugugcacacaucagagaaugcggaagucguguuuuucgagaacggucugcggcaucuucugcuccugaaaaauuugcguccgcaggauagcugucgaguuaccuuucuugccggggacauggugacuucugcauuccugaccgucaggggauggcgccuagaaauccucgagccacugaagaacgcugccgugagagcaggcgcccaggcuugcuucacauguacuuuauccgaagcgguacccgugggugaggccaguugguauauuaacggcgcagcuguccagccugaugacucagauuggacgguuaccgccgacgggagccaccaugcccuguugcuccggucggcacaaccacaccaugcuggagaggugacauuugccugcagggaugcgguggcuuccgcccgccugaccguccuuggccugcccgacccucccgaagacgcagaggugguugccagaucuagucacacuguaacacucagcugggcugcaccaaugucagaugggggaggcgguuuguguggguaccggguggaagucaaggagggagccaccggccaguggcgacugugccacgaacuugugccgggcccugagugcguuguggacgggcuggcucccggagagacuuauagguucagagucgccgcgguggguccaguaggcgcaggggaaccuguccauuuaccccagacagugcgccuagccgagccaccuaaacccguuccgccacagccuuccgcucccgaaucucgucaaguggccgcaggagaggaugucagccucgaacuggaggugguugcugaggccggcgaagugaucuggcacaaggguauggagcggauacagccagggggaagguuugaaguagugagucagggcagacagcaaaugcuggucaucaaaggcuucaccgcggaggaccagggggaguaccauuguggauuggcccaggguuccauuugccccgcagcugccacguuucaaguggcucucagcccugcaucuguugaugaagccccgcagccaucacugcccccugaggccgcucaggaaggcgaccuucaccuguuaugggaggcacucgcccgcaagcggcgaauguccagggaacccacucuggauagcaucagugaguugccagaggaagacgggagaucucagcgccuuccucaagaggcggaagaggucgcucccgaucugucagaaggauacuccaccgccgacgagcuagcacggacaggcgaugccgaccucagccauaccucgucugaugacgagaguagggcugguacuccaucccuggugacauaucugaaaaaggcagggcguccuggaaccagcccguuggccucaaaggugggcgcgcccgcugccccaucuguaaaaccucagcagcagcaagaaccccucgcagccgucagaccaccucugggcgaccuuagcacgaaggaucugggggaccccuccauggauaaagcugccgugaagauucaggcagcuuucaaaggauacaagguucgaaaagagaugaagcagcaggaagguccgauguuuagucacacauucggcgacacugaggcccaagugggggaugcguuacgccucgaaugugucguggccucaaaggcugacguucgggcaagguggcugaaagauggaguggagcuaaccgacggcagacaccaucacaucgaucaguugggugacgggacaugcagccugcuuauaaccggacucgaucgggccgacgcuggcuguuauacuugccagguauccaauaaguuuggccaggucacgcauucugccuguguggugguuagugggagcgaguccgaagcagagucaucuucgggaggugaacuggacgaugcguuccgcagggccgcuagacgacugcaccguuuguuucggaccaaaagcccagcagaggucuccgacgaggaacuuuuccucagugccgaugagggcccugcugaacccgaggaaccagccgacuggcaaacauacagggaggaugagcacuuuauuugcauccgcuucgaagcacugacugaggccagacaggcugugaccagguuccaggaaauguuugcgacauuagggaucggaguagagauuaagcugguggaacaaggcccccggagagucgagauguguaucucuaaagagaccccugcccccguugugccaccugaaccgcuacccagccuccugacuucagacgcagcuccaguguucuugacagagcugcagaaccaggaaguccaggaugguuauccuguguccuuugacugcguugugaccgggcaacccaugccaagcguacgcugguucaaggauggaaagcuucucgaggaagacgaucauuacaugauaaaugaggaccagcagggcggccaccagcugauuaucacggccgucgugccugccgauauggggguuuaucgauguuuagcagagaacucuaugggagugaguuccacuaaagcugaacugagggucgacuugacaucaaccgacuacgauacugccgcggacgcuaccgagagcucuucguacuuuuccgcccaagguuaucucaguagccgggaacaggagggcacagagucaaccacggaugaagggcagcugccccaggugguagaggaacuuagagaccugcaaguggcaccgggaacacgccuagccaaguuccagcucaaagucaagggcuacccugcuccacgucuguauugguuuaaagauggucagcccuugacugcaucugcccauauuaggaugaccgacaagaagauccugcacacacuugagauaauuuccguuacucgggaagauagcgggcaauacgcugccuauaucaguaaugcaaugggcgcggccuacucauccgcuagacuccuggugcgaggaccugacgagccagaggaaaaacccgccagcgaugugcaugagcaguuagucccuccacgcaugcuggaaagguucacccccaagaaaguuaagaaaggcucuaguaucacauuuagcgugaagguagaggggcggccggugccuaccguccacugguugagagaagaggcagagcgcggagugcucuggauuggucccgacacuccaggcuauacgguugcuuccucugcccagcagcacucacuggugcuucuggaugucgggaggcaacaucagggaaccuacacaugcaucgcgagcaacgccgcaggccaggcucuaugcuccgccucgcuccacgugucuggucugcccaagguagaagagcaggaaaaaguuaaggaggcauugauuaguacuuuccugcaagggaccacacaggcuauaagcgcccagggccuugagaccgccucauuugcugacuuaggaggccagcguaaagaagagccucuggcagccaaggaagcgcucgggcaucugucccuagcugaggugggaacugaagaguucuugcaaaaacugacaucucagaucacggagauggucagcgccaagauuacccaggcaaaacuccaggugccagguggcgauuccgacgaagacaguaagacucccucagccagcccuagacacgggcggucucgaccauccaguagcauccaagagucaucuuccgaaucggaggauggagacgcucgcggcgaaaucuuugauauuuacgucgugacagcagacuaucuuccgcugggugccgagcaggaugcgauaacccucagggaggggcaguacguugaagugcuggacgcugcccaccccuuaagaugguugguacggaccaagccuacuaaaagcaguccauccaggcaaggcugggugucucccgcauaucuggaucgcagacuuaagcugucaccugaguggggagccgcugaagccccagaguuccccggcgaagcagucagcgaggacgaguacaaagcucggcucuccucugugauccaggaacugcuaagcagugagcaggccuucguugaagagcuucaguuucugcaaucacaucaccuccagcauuuggagcgauguccgcacgucccuauugcgguggccgggcagaaggcagugaucuuccguaauguuagggauauuggacgcuuucauuccagcuuccugcaggaauuacaacagugcgacacagaugacgacgucgcuauguguuuuaucaaaaaccaggccgcuuucgagcaguaucuggaauuucucguggguagaguacaagccgagucuguggucgugaguacggcaauacaggaauucuacaagaaguaugcggaggaggcccuucuggcuggcgauccaucccagcccccucccccaccguugcaacacuaccuggaacagccuguugagcgggugcagagguaccaggcacuccuaaaagaacugaucagaaauaaggcccgaaaccgccaaaauugcgcucuucuggagcaggccuaugcagucguaagcgcccucccccagcgggcugaaaacaaauugcacgugucacugauggagaauuacccagggaccuuacaggcgcugggagagcccauuaggcaaggccauuuuaucguuugggaaggugccccuggcgcaagaaugccauggaaggggcacaaccgccauguguuccucuuucggaaucaccuugucauuuguaaaccccguagggacucgagaacagauacugugucuuauguguuccgaaacaugaugaagcugagcuccaucgacuugaacgaucagguugagggagacgaucgggcuuuugaagucuggcaggagcgcgaagacagugugaggaaguaccugcuccaggccagaaccgccauaauuaaaucaucuuggguaaaggagaucugcggcauucaacagcggcuagcacugccuguguggcgcccaccggauuucgaggaagaguuagcugacuguacagccgaacugggggagacugucaaacucgcgugcaggguuaccggaacgcccaagccugugaucagcugguauaaagauggcaaggcagugcaggucgacccacaccauauacuuaucgaggaucccgacgguuccugugccuugauucuggacagucugacagggguagauagcggacaauacaugugcuucgcugccucugcugcaggcaauuguuccacccucgguaagauccuugugcagguuccuccacgauuugugaacaaagucagagccucacccuucguggaaggcgaggacgcucaguuuacuugcaccauugaaggggccccuuauccgcagauccguugguacaaggauggagcacuguugacaacuggcaauaaauuccaaacccugagcgagccccggucggggcuccuaguucuggugauacgcgcggccuccaaggaagacuuaggacuuuacgagugcgagcuggucaacaggcucggcucugcuagagccagugcagaauugcggauucagucaccaaugcugcaggcucaggagcaaugucaccgagaacagcugguagccgcgguggaggauacaacgcucgaaagggccgaccaggaggugaccagcguccuuaaacgccuguuggguccuaaggcacccgggccauccacuggagaucuaacaggcccuggucccugcccaagaggcgcuccggcccugcaggagaccgggucucaaccucccguuacuggaacaagcgaagcaccagcugugcccccucgggucccacagccccucuuacaugagggcccugaacaggagccggaagccaucgcccgugcucaggaguggaccgugcccaucaggauggagggggcagccuggccaggagcgggcacgggugaacugcuuugggacguacacagucaugugguuagagagaccacacaacgcacuuauaccuaccaggcuauugauacacacacugcccggccucccucaaugcaggugaccaucgaagacguccaagcacagacagggggaacggcccaguuugaggcuauaauugagggcgauccacagccuuccgugaccugguauaaagacagcguucaacugguggauucuacucgacucucccagcagcaggaaggcacaaccuacaguuugguccugaggcacguagcaagcaaggacgccgggguguauacuugucuggcgcaaaauaccggaggucagguccucugcaaggcugagcuacuggugcuuggcggggacaacgaacccgauucagagaaacagucucauagacgcaaguugcacuccuucuacgaaguuaaagaggagaucggacggggcguguuugguuucgucaagagggugcagcauaaagggaauaagauucugugugccgcaaaguuuaucccacucagaagccgcacacgugcccaagcuuaucgagaacgggacauauuagccgcacugucgcacccgcuuguaacgggacugcucgaucaguucgagaccaggaaaacuuugauccugauucuagaacugugcaguucugaggaacucuuagacagacuguaccgcaagggcguugugacagaggcugaggucaaaguguacauccagcaacuuguggaaggccugcauuauuugcacucacacgggguucuccaucuggauauuaagccuuccaacauccuuaugguccaccccgccagggaggacauuaaaaucugugauuuuggauucgcgcagaauauaaccccagccgaacugcaguucagccaguacgguucuccugaguuugugagccccgaaauuauccaacagaacccaguauccgaggcaagugacaucugggcuaugggcgugauuucauaucucagcuugacuugcuccucuccuuucgccggggagagugaucgggcuacacuguuaaauguccuggaaggaagagugucauggagcucccccauggccgcacaucucucugaggacgcgaaggauuuuauaaaggccacccuacagcgagcuccgcaggcacgcccaucggccgcucaaugucugagccaccccugguuccuuaaauccaugccugccgaagaggcacacuuuaucaacacuaagcaguugaaauuccugcucgccaggagucgguggcagagaucacugaugucuuacaagagcauucuuguuaugcguuccaucccagagcugcuccgcggccccccugacaguccgucuuuggguguggcuaggcaucugugcagagacacagggggaagcucauccagcucuucaaguuccgauaaugaauuagcgcccuuugcccgggcaaaaagccuaccaccuucgcccgucacccacucuccacugcuccauccucgaggcuuccugaggcccuccgccagccuuccagaggaagcugaggccucagaaagaaguacggaggcaccugcucccccggccucuccugagggcgcggggccacccgcagcccagggaugugugccucggcacuccguuauucgcagcuuguuuuaucaucaagcuggugaaucaccagagcacggcgcccuggcucccgggagucguaggcacccggcaagacggcgccaucuccugaagggaggcuacaucgccggugcguuaccugggcugcgagaaccccuuauggagcacaggguacucgaagaggaggccgcuagagaagagcaggcaacccuguuggccaaggcuccauccuucgaaacagcccuacggcugcccgcaagcggaacucaucucgcuccuggccacucucacucgcuggagcaugacagcccauccaccccccgcccuucaucugaagccugcggcgaggcgcagaggcuuccaagugcaccgagcgggggagcccccauaagagauaugggucacccucagggcuccaaacaauugccaucuacagggggacaucccggcacugcucagccugagcggccaucacccgacagcccguggggucagccugccccauuuugccaccccaagcaagggagugcaccucaggaaggauguuccccccauccagccguggcuccuugccccccaggcucuuucccgcccggcagcuguaaagaggccccucuggucccauccucacccuuucucgggcagccucaggcaccacccgcuccugcgaaggccaguccgccacuggauagcaaaaugggacccggugacaucucuuuaccuggccgaccaaagcccgggccuugcuccucgcccggaagcgcuucacaagccaguuccucucaggugagcucacugcgcguuggcuccucucagguggguaccgaaccagggccgagccuugaugcagagggcuggacgcaggaggccgaagaccucagugauuccacaccuacccuacaacguccccaggagcaggcuacuaugaggaaguucagccugggaggcagagggggauacgcaggugucgccggcuaugggacauucgcguuuggaggcgacgccggugggauguugggccagggaccaaugugggcucggauugcaugggccgugucucaaucagaagaggaagagcaggaggaagcucgcgccgagagucaguccgaagagcaacaggaagcaagggcggagagcccucugccccagguaucugccagaccagugccggaggucggccgggcuccuacccgaucgucacccgaaccaacucccugggaggauaucgggcagguuagccucgugcaaauucgcgaccuguccggagaugccgaagcagcugacaccaucagucuugacauaucugagguggauccugccuacuugaaccugagcgaccucuaugauauuaaauacuuaccauucgaauuuaugaucuucaggaagguccccaaauccgcacagccugagccgccaucacccauggccgaggaagagcuggcugaauuuccugagcccacauggccauggccuggugagcuaggcccccacgcggggcuggaaaucacggaggaaagugaggacguggaugcccuucucgcugaagcagccguuggaagaaagcguaaauggagcucuccaucccggagccuguuccacuuuccuggcagacauuugccgcuggacgagcccgcugagcucggucugagggaacgcguaaaggccucaguggagcacauuucucgaauacuuaaagggcggccagaaggcuuagagaaggaaggaccucccagaaagaaaccaggccuggcauccuucagguugagugggcucaagagcugggaucgcgccccuaccuuucugcgggagcuaucggacgagacugucgugcugggacaguccguuacacuugcuugucaggugucugcgcaacccgccgcacaggccaccuggucaaaagauggcgcuccgcucgaaagcaguucccguguccugaucucugcaacuuugaagaauuuccagcugcucacaauuuuagugguaguggccgaggaccugggugucuauaccugcagcguuucaaacgcucuugggacggugacaaccacuggagugcugagaaaagccgaaaggccaaguuccagccccuguccugauaucggcgaggucuacgcggacgguguuuugcucguguggaagccaguagaaucuuauggccccgugaccuacauuguccagugcucccuggaggggggaucauggacaacucuagcaagcgacaucuuugauuguugcuaccugaccaguaagcuuucucgcggcgggacauauacguuccgaacugccugugugucgaaagcuggaaugggcccuuacuccagccccucagagcaaguucuccugggugggccaucucauuuggccagugaagaggaaagccagggacgguccgcucagccucugccgucaaccaagacauuugcauuccaaacccagauacagagaggcagguucagcgugguccgccagugcugggagaaagccuccggucgggcguuagccgcuaagaucauucccuaucacccaaaagacaagacugcagugcucagagaguacgaagcccugaagggccuuaggcauccucaccuggcucaacuacacgccgcauaucucucuccccgacauuugguacugauccuggagcuuugcagugggccagaacuccugccuuguuuagccgagcgcgcuagcuacuccgaaucugaggucaaagauuauuuguggcagaugcugucagcgacacaguaccuccacaaucagcauauucugcaccuugaccuacggucggagaacaugaucauuaccgaauacaaccugcucaaggugguugauuugggaaaugcacaaagccugagucaggagaaaguguuacccuccgacaaguuuaaagauuaucuggaaacgauggccccggagcuucucgaaggccagggggcugucccacagacugacauaugggccaucggagugaccgcauucauuaugcugucugccgaguacccuguuagcucagagggcgcuagagauuugcaaaggggucugcguaaggggcucgugcgccugucccggugcuaugccggacuuaguggcggugcaguagcuuuucuaagaucuacacugugugcgcagcccuggggcaggccaugcgccagcuccugucuccagugcccuugguugaccgaagaggggcccgccuguucacgaccggcuccugucacuuuccccacagcacggcugagaguguuugugaggaaccgcgaaaagcguagagccuuacuguacaaacggcacaaucuugcucagguuagguga

SEQ ID NO: 60048 - RNA, 3078 nt, Artificial Sequence
  derived and/or modified sequence opt3 from OBSL1__Homo_sapiens__NP_001166879
augaaggccagcuccggcgaccaggggucucccccuugcuuccugagauucccaaggccggugcgggucguuucaggagcugaggcagaacucaaaugugugguacuuggugagcccccuccaguggucgugugggaaaagggcgggcaacagcuggccgcgagugagcgcuugagcuuccccgcugauggagccgaacacggcuuacugcuaaccgcagcccucccuacagacgcugguguuuacgugugccgagcacguaacgccgcuggggaggccuaugcggcagccgcugucacugugcuggagccacccgccuccgauccugaacuucagccagcagagagaccgcugcccucuccuggaucgggcgaaggcgcuccaguauuuuugacggggcccaggucacaguggguucuccggggagccgaggugguccugaccugucgcgcggguggccugccugagccaacacucuacugggaaaaagacgggauggccuuagaugaggugugggacagcagucauuucgcacugcaacccggacgggcugaagauggcccgggugccucccuugcuuugaggauccuggccgcacggcuaccugacucugggguguaugucugccacgcccgcaaugcucauggacacgcgcaggcaggcgcccuccugcagguucaucagcccccagagagcccucccgcugauccagacgaagcccccgcaccugugguagagccacuuaagugugccccgaaaacuuuuugggugaacgagggcaagcacgcuaaguuccgaugcuacgucauggggaaacccgaaccugagauugaauggcacugggagggaagaccacuguugcccgauaggcggcgucucauguaucgcgacagagaugguggcuuugugcugaagguuuuauacugucaagccaaagacagggggcuguaugugugcgcagcgagaaauuccgcuggacagacccucucagccguccagcuucaugugaaggaaccucgacugcgcuucacaagaccauugcaggacguagagggcagggagcacgguauagcaguucuagaauguaaagugcccaacagucggaucccgaccgccugguuucgcgaggaucaaagacugcucccuugcaggaaguacgaacagauugaggaagggacuguccgucggcugaucauucaucgacuuaaggcugacgaugacggcaucuaccugugugagaugagaggaagggugcgcacagucgccaaugugaccguuaaaggcccaauauugaagcggcuccccagaaaacuggauguguuagagggggaaaacgcaguacugcuagucgagacgcucgaagcuggaguggaggguagguggagccgcgacggcgaggaacugccuguuaucugccagucuuccucagggcacaugcacgcccuuguguugcccggagucacucgagaggaugcgggcgaagugaccuucagccuggguaauagucggacaacuacccuccugcguguaaagugcgugaaacauucuccaccugggcccccaauucuugccgagauguuuaagggccacaaaaacacaguucuguugaccuggaagccgccugaacccgcuccagagacgcccuucaucuauagacucgagaggcaagaagucggauccgaggacuggauucaguguuuuagcaucgaaaaggcaggcgccguggaggugccuggggauugcgucccaucggaaggagacuaccgcuuccggauauguacuguuucuggucauggcagaucaccccacgugguguuccauggguccgcucaccugguaccuacagccagguuagucgcaggacuggaggaugugcagguuuaugacggcgaggacgcgguguuuagucuagaucucagcaccauuauccaggguacuugguuccugaauggggaggaacuuaaauccaacgaaccggagggccaagucgaaccaggagccuugcgauaccgcauugagcagaagggccugcagcaccggcucauccugcaugcugugaaacaccaggacucuggggccuuaguuggauuuagcugccccggcgugcaagauucagcagcucugacaauccaggagaguccuguacauauucuuuccccacaggacagagucagcuugaccuucacgaccucugaaaggguggugcucacaugugagcugucacgugucgauuuucccgccacuugguauaaggacggucagaaaguugaagagagugagcuacuggugguaaagauggaugggcgcaagcaccggcucauacugccugaagcaaaagugcaagacagcggagaguucgaaugcagaaccgagggcgucuccgccuuuuucggugugacaguucaggauccgcccgugcacaucgucgacccaagggaacauguguuuguucacgcuauuacuucugagugugugaugcuugcgugcgaggucgaucgagaagacgccccuguacggugguacaaggauggccaggagguggaagagucggacuucguuguguuggaaaaugaggggccccaucgcagacuggucuuaccagcaacccagccuagcgacggaggcgaguuucaauguguggcuggggaugaaugcgccuauuucacaguaaccaucacugacguguccucauggauagucuaccccaguggaaaaguuuacguggccgcugugaggcucgagcgggucgugcugacgugugaacuuugccgaccaugggcagagguuagauggacaaaggauggcgaagagguaguggagucuccggcccuguugcuccagaaagaagacaccguccgcaggcuggugcuaccugcgguucagcuggaggauagcggugaauaucucugcgagauugacgaugaguccgcuucauuuacugugaccgucacagaaagcuaccaaucucaggacuccaguaacaauaaccccgagcugugugugcuuuugaagaagccaaaaacccgucggcuguggagcagauuucccccuuggaggcgcacugccgggacagaauga

SEQ ID NO: 60049 - RNA, 1434 nt, Artificial Sequence
  derived and/or modified sequence opt3 from OC90__Homo_sapiens__NP_001073868
augaucgccuuccugcucaccagcgugcuuaugauuccccacgcuggcgggcauccucuggacacaccacacuugccgcaggaguuacccccuggacugccaaacaauauaaacaucaccuuuuucuccgguauguuuaagaaugucgaaucuguugcagagauuuucgauugccuaggcccccauuuuacguggcuccaagccguguucaccaacuuuccuguacugauccaguucgugaaugggaugaaaugugucgcgggacuuugcccaagagacuuugaagauuacggcuguacaugcagguucgagauggaaggucugcccguggacgagucagauaguuguugcuuucagcaccggcgcuguuaugaggaagcugccgagauggacugcuugcaggauccugcaaagcucagcacugaaguuaacuguguguccaaaaagauuaucugcgagucuaaagacaauugugagcaucugcugugcacuugcgauaaggccgcuauagaaugucucgcacgaucgucauuaaacagcagucugaaucuuuuggacacauccuucugccuggcccaaaccccagagacuacaaucaaggaagaucuaaccacgcuccugccgcgugucgugcccguagagccuacugacaccucucuuacagcucugagcggggaagaggccggacacgaucaggagggcguuggcgcggcaagagccacuuccccacccgggucagcugaaauuguggccaccagggucacagcaaaaaucgugaccuuggugccugcuggaauuaagagucucggucuggccgucagcucuguugagaacgacccagaagagacgacugaaaaagcgugugaccgguuuacauucuuacaccugggcuccggggauaauaugcaagugaugccccagcucggagagaugcuuuucugccugaccucacgcuguccggaggaauuugagagcuacggcugcuauuguggucaggaagggagaggagagccuagggacgauuuggaccggugcugucuaagucaucacugcugucuggaacagguacgccgacucggcugccugcuugagagacugcccuggucuccaguggucugcguggaucauacuccuaaguguggcgggcaguccuugugcgagaaacuccugugugccugcgaccagacagcagcugaauguaugaccagcgccucguucaaccaaucuuuaaagucccccucaaggcugggaugcccaggucagcccgcugccugugaggauagucuacacccuguuccagcagccccgacgcucggcagcuccucugaagaggacagcgaggaagaucccccucaggaggaccuggggcgggcuaagcguuuucuucgcaaaucauugggaccacugggcaucgguccccuccacgggagauga

SEQ ID NO: 60050 - RNA, 2517 nt, Artificial Sequence
  derived and/or modified sequence opt3 from OCA2__Homo_sapiens__NP_000266
augcaccuggagggcagagacgggaggcgguaccccggagccccugcuguggaacuccuucagaccagcgucccauccggucuggcagaguugguugccggcaagcgccgauuaccgcguggggcgggaggcgcugaucccucucauucaugcccuagaggugccgcagggcaaaguagcugggccccagcuggacaggaguucgcauccuuucugacaaaaggcaggucucacucgucacuaccccagaugagcaguucccggucuaaggacagcuguuucacugagaacacgccucuccugcgcaauucccuucaggaaaaaggcucaagaugcaucccaguguaucaucccgaguuuauuaccgccgaggaaaguugggaggauagcucugcugacugggaaaggcgguaccuguugucccgcgagguaucagggcucagcgccagugcgucuuccgagaagggagaucugcuggacagcccucacauacgacucagauuaucgaaacugaggcggugugugcaauggcuuaaggucauggguuuguucgcauuugugguucugugcucuauccuauucucccucuauccagaucagggcaagcuguggcagcuucuggccuugucaccgcucgaaaacuacagugugaaucugagcucccaugucgacucuacauuacuccagguggaucuggcuggggcccuuguagcaagcggacccucacguccuggccgcgaggaacacauuguuguggagcugacucaagcugacgccuuggguaguagauggaggcggccacagcaggucacccacaacuggacaguguaucuaaauccccgacgcuccgaacauagcgugaugucuagaaccuuugagguccugacuagggagacaguuucaaucaguauucgggcgagccuccagcaaacccaggccgugccucugcuuauggcacaccaguaccugcgcggguccguagaaacgcaagugacuaucgcuaccgccauauuggcuggagucuaugcccucaucauuuucgagaucgugcauagaacacuggcagccauguuaggcucucuggcugcgcuagcagcccucgcuguuauuggcgauaggccaucgcugacucacguggucgaauggaucgacuuugagacccuugccuugcuguucgggaugaugauacucguggcaauuuuuagcgaaacaggauucuuugauuacugugccguaaaggcuuaccgucugucccggggucgaguuugggccaugaucauuaugcuuugccugaucgcagcgguguugucagcuuuccucgacaacgucaccacgaugcuguuauucacucccgugacaaucagacugugugagguccuaaaucucgacccgcgccaggugcugauugccgagguuauauuuaccaacaucggcggggcagccacugcuauuggagauccucccaaugugaucauaguaaguaaccaggaacuuaggaaaaugggcuuggacuucgccgguuuuacagcacacauguucauugggaucugccugguccuccugguguguuuuccauuacugcggcuuuuguauuggaauagaaaacucuacaacaaggagccuucugaaaucguugagcugaaacaugaaauucacguguggaggcuaaccgcucagcgcaucagccccgccucccgagaggagacggcgguccggcgucugcuccugggcaaggugcuugccuuggaacaucuguuagcuagaaggcuccacaccuuccaucgccaaauuucacaggaggauaagaauugggaaacaaacauacaggagcugcagaaaaagcaccggaucagcgacggcauucuucuggcaaaaugcuugacuguacucggauuugugaucuucauguuuuuccuaaauucuuuuguuccagggauccaccuggaucugggauggauugccauacucggugcuaucuggcugcuuauuuuggccgacauccaugauuucgagauuauccugcacagagucgaaugggcaaccuuacucuuuuucgcggcccuguucgugcuuauggaggcucuggcccaucuacaccucauagaauaugugggcgagcaaacagcacuguugaucaagaugguccccgaagaacagaggcugauugcugccaucguuuuagugguguggguauccgcacucgccaguagccugauugacaacaucccuuuuacugcuaccaugauaccaguccuucugaacuugucucacgauccggagguggggcuccccgcgccuccacugauguacgcccuagcauucggagcuugucugggcgguaaugggacacuuauuggcgccuccgccaacguugugugcgcuggaaucgcagaacagcauggcuauggguuuucauucauggaguuuuuccgacucggauuucccaugauggucgugaguugcaccguugguauguguuaccuguugguggcccacguagucgugggcuggaauuga

SEQ ID NO: 60051 - RNA, 738 nt, Artificial Sequence
  derived and/or modified sequence opt3 from OCIAD1__Homo_sapiens__NP_001073308
augaacggcagagccgacuucagggagcccaaugcugaagugccucggccaaucccgcacauugggcccgauuacauaccuaccgaggaggaacgccgagucuuugcagaaugcaacgacgagagcuucugguuucguuccguuccacuggccgcgacaucuaugcucaucacucagggacuuauuucaaaggguauccugaguagccaucccaaauauggcuccauuccuaaguugaucuuagcuuguauaaugggguacuucgccggaaaacugucuuaugugaagacgugccaagagaaauuuaagaagcuagaaaauucgccacucggcgaggcacugagaucaggucaggccaggcggagcagucccccugggcacuacuaucagaaauccaaguacgauucuagcguauccggacagucaaguuucgugaccagcccagcugcagacaacaucgaaaugcuuccgcauuaugagcccauuccuuuuucuuccucaaugaaugagagcgccccaacaggcaucacugaucacauuguccaaggccccgacccuaaccuggaagagaguccaaaacgcaagaauaucaccuacgaagaguugagaaacaaaaauagggaaucuuacgaggugucccucacacagaagaccgaucccagcguucggccgaugcaugagcgcgugccuaagaaagaagucaaggugaacaaauauggggacacuugggaugaguga

SEQ ID NO: 60052 - RNA, 465 nt, Artificial Sequence
  derived and/or modified sequence opt3 from OCIAD2__Homo_sapiens__NP_001014446
auggccagcgcuuccgcaagaggcaaccaggacaaggaugcccacuuucccccuccaucuaaacaaucacugcucuuuugcccgaagaguaaacuucauauccacagggcggagauuagcaagauaaugcgggaaugucaggaggaauccuucuggaaacgcgcucugcccuuuucuuuggugucgauguuagucacccaggggcugguuuaccagggauaucuagccgcaaauucacgauucgguagccucccuaagguggcccuggcuggccuucugggguuuggauugggcaagguaaguuacaucggugugugccaauccaaauuccauuucuucgaggaccagcuccguggggcaggauuuggcccacagcacaacagacauugucugcugacaugcgaagaguguaagauuaaacacggccucucugagaagggggauagccagcccuccgccucauga

SEQ ID NO: 60053 - RNA, 135 nt, Artificial Sequence
  derived and/or modified sequence opt3 from OCLM__Homo_sapiens__NP_071770
augggcauguaucccccucugcuccuuaagaucuaccugagcagacacauuuccauauuguucuacuuaaaaauccuguauaagucugggauuaucuggcuaucaugguacaguuuuauucuccuggugcuuuga

SEQ ID NO: 60054 - RNA, 1569 nt, Artificial Sequence
  derived and/or modified sequence opt3 from OCLN__Homo_sapiens__NP_001192183
augagcuccagaccccuggagucuccuccaccguacaggcccgacgaguucaagccuaaccacuaugccccaucaaaugauaucuacggcggggaaaugcaugugcggcccaugcucagucagccugcuuauagcuuuuacccagaagacgagauucuucacuucuauaaauggaccucucccccuggagucauacgcauccuguccauguugauuaucguuaugugcauugcaaucuuugccuguguggcgucgacauuagcuugggaucgagguuacggcacuucacugcuagggggaagcguaggcuauccauacggugggaguggauucggcuccuacggcucuggguauggauacgguuauggcuacggguauggauacggcgguuauacggacccgcgugccgcaaagggguuuaugcucgccauggcugcauucugcuuuauagccgcucuggugaucuucgucaccagcgugauuagauccgaaaugucaaggacacggcgcuacuaccuuaguguuaucauugugagcgccauccugggaauaauggucuuuauugcgacuaucguguauauuaugggcguaaaccccaccgcacaaucuuccggcucauuguacgggagccagaucuaugcccucuguaaucaguucuacacacccgcugccaccggacuguauguugaucaguaccuguaucauuacugcguggucgacccacaagaggcaaucgcuauugugcucgguuuuaugauaaucguggccuucgcguuaauuaucuuuuucgccgucaaaacuagaaggaagauggaucgguacgacaaaaguaacauacugugggauaaggagcacauuuaugacgaacagcccccuaauguugaggaaugggugaagaacguaucugcaggcacacaggaugugccauccccuccgagcgacuacgucgagcgcguggauucgccuauggcuuauucuuccaaugggaaaguuaacgacaagcgauucuaccccgagucaaguuauaaaagcaccccagugccugaagucgugcaggagcuucccuugacguccccaguagacgauuuuagacaacccagguacucuagcggaggcaauuucgaaacuccuucaaagcgggccccagcuaaaggucgugccgggcgcaguaagagaaccgagcaggaccauuaugaaacagauuacacuaccggcggagaguccugugacgagcuggaagaggauuggaucagggaauacccgcccaucacaagcgaccagcagcggcaacuauauaagcgaaacuuugauaccggccuccaggaguacaaaucucugcagucagaacuugacgagauuaauaaggagcugagucgcuuggauaaagaacucgacgauuauagagaggaaagcgaggaauacauggcagccgcugacgaguauaacaggcugaagcaaguuaaaggguccgcggacuacaagucuaaaaagaaucacugcaagcaguuaaaaucgaagcugagccacaucaaaaagauggugggagauuaugaccggcagaaaacguga

SEQ ID NO: 60055 - RNA, 330 nt, Artificial Sequence
  derived and/or modified sequence opt3 from OCM2__Homo_sapiens__NP_006179
augagcaucaccgacgugcuguccgccgaugacauugcugcagcccuccaggagugccaagaucccgacacauucgaaccucagaaguuuuuccagacuucuggccuuucaaaaaugagugcgagccaggucaaggauguuuuuagauucauagacaacgaucaauccggguaccuggacgaggaagaguugaaauuuuucuuacagaaguuugaaucuggagcuagggagcugacggagucggaaaccaaaucacuaauggccgcagccgauaaugacggugauggcaagaucggggcugaggaguuccaggaaauggugcacagcuga

SEQ ID NO: 60056 - RNA, 330 nt, Artificial Sequence
  derived and/or modified sequence opt3 from OCM__Homo_sapiens__XP_011513787
augagcaucaccgacgugcuguccgccgaugacauugcugcagcccuccaggagugcagagaucccgacacauucgaaccucaaaaguuuuuccagacuucuggccuuucaaaaaugagugcgaaccaggucaaggauguuuuuagguucauagacaaugaucagagcggguaccuggacgaggaagaguugaaauuuuucuuacaaaaguuugaauccggagcucgggagcugacggagucugaaaccaaaucgcuaauggccgcagccgauaacgacggugauggcaagaucggggcugaggaguuccaggaaauggugcacucauga

SEQ ID NO: 60057 - RNA, 2706 nt, Artificial Sequence
  derived and/or modified sequence opt3 from OCRL__Homo_sapiens__NP_000267
auggagcccccucugccagugggcgcccagccgcucgcuaccgucgaagggauggagaugaagggaccccuuagagaaccuugcgcacugacauuggcccaaaggaacggucaguacgaguuaaucauucagcugcacgaaaaagagcagcauguucaagacauaaucccaauuaauagccacuuccggugugugcaggaggcggaagagacucuacucaucgauauugcuuccaacucuggcugcaagauccgcguacagggggacuggauacgagaacguagauuugagauccccgaugaggaacauugucugaaauuccuuucagccgugcuggcagcccagaaggcucaaagucaguugcucgucccugagcagaaagacagcuccucuugguaucagaagcuggauacgaaggacaaaccaucgguguuuucaggacugcucggcuucgaagauaauuuuagcaguaugaacuuagacaagaaaauuaauucccaaaaccagcccaccgguauccacagggagccuccaccgcccccuuucucuguuaauaagaugcugccacgggaaaaagaggcaagcaacaaggagcagcccaaggugacaaauacuaugcgcaaacuuuuugucccuaacacccaauccgggcagagagaaggauugauuaagcauauccuggccaaaagggagaaggaauacgugaauauacagacauuccgguuuuucguaggcaccuggaacguuaauggccagucaccagauagugggcuagagcccuggcucaacugcgacccgaauccucccgauauuuauuguaucggauuucaagaacuggaccuuagcacugaggcuuucuuuuacuucgagucugugaaagaacaggagugguccauggccgucgaacgcggucugcacucaaaggcgaaauauaagaaggugcaguuggugcgacucgucggcaugaugcuguuaauuuucgcaagaaaagaucagugcagguacauccgggacaucgccacagagaccguugggacgggaauuaugggcaagauggguaacaaagggggaguggcuguacguuuuguguuccacaacacuaccuuuuguauagucaauagccaucuggccgcacacguggaagacuucgagcgcagaaaccaagauuauaaggacaucugcgcuaggaugaguuuuguugugccaaaucagacacucccucagcuuaacauuaugaaacaugaggucgugaucuggcugggcgauuugaauuaccggcuauguaugcccgacgccaacgaaguaaagucucugauaaauaagaaagaucuccagcgacugcuuaaguucgaccaacugaacauucagcgcacucagaaaaaggcguuuguugauuucaaugagggcgaaaucaaauuuaucccaaccuacaaguaugacuccaagacagauagaugggacagcucggggaaaugcagggugcccgccuggugugaucggauuuuguggcgcggaaccaacgucaaucagcucaacuacagaucucacauggagcugaagacguccgaccacaaaccugugucagcauuauuccauaucggugucaaggugguugacgagaggcguuaucggaaaguguuugaagauaguguacgaauuauggacagaauggagaaugauuuccugccaagccuagaacucuccaggcgcgaguuugucuucgaaaacgugaaguuccggcaacugcagaaggagaaauuucagauaucuaauaacggccaaguuccgugccacuucagcuuuauccccaaacuuaacgacucacaguacugcaagccuugguugagagcugagccauucgaaggguaucuggagcccaaugaaacuguggauauuagucucgacgucuacguguccaaggauagcguaacaauccugaacucuggagaggacaaaaucgaagauauucuugugcugcauuuggacaggggcaaggauuauuuucucaccauaucagguaauuaccugccuaguuguuucgggacuagcuuagaggcccugugccgcaugaaacgaccaauccgggagguucccgucacaaagcuaauugaccucgaagaggauuccuuucuggaaaaggagaaaucucuuuugcagauggugccgcuggacgaaggcgcuucggagcguccucuccaggugccaaaggagaucuggcuguuagucgaccaccuguucaaauacgccugucaucaagaagaucuuuuucagacccccggaaugcaggaggaauugcagcaaauuaucgacugccucgauacgagcauaccugagaccauccccggcuccaaccacucaguugcagaggcccugcuaauuuuccuggaagcucucccagagccugugaucuguuaugaacuguaccagagaugccuugacagugcguaugaucccaggauuugucgccaggugaucucucaguugccacggugccacagaaauguauuuagguaccugauggcauucuuacgagagcuccugaaguuuagcgaauauaacuccgucaaugccaacaugauagcuacacuuuucacuucacuguugcuccgcccgccucccaaucugauggcccggcaaaccccaagcgacagacagagggcaauucaguuccuacugggguuucuccugggaucugaggaggauuga

SEQ ID NO: 60058 - RNA, 840 nt, Artificial Sequence
  derived and/or modified sequence opt3 from ODAM__Homo_sapiens__NP_060325
augaagaucauuauacugcucggcuuccuuggggccacccugagcgcucccuugaucccucagagauuaauguccgcaucuaacucaaaugagcugcuacucaaccugaauaacggacaacuucugccauugcagcuccaggguccgcugaauaguuggauucccccuuuuagcggcauccugcagcaacagcagcaggcccaaauuccagggcucucccaguucucuuuaucggcgcuggaccaguuugcuggacuuuugcccaaccagaucccucugacaggcgaagccucauucgcacaaggugcccaggcuggacagguggauccacuacaacuccagacucccccucagacgcagccagggccgagccacgucaugcccuacguuuuuaguuucaaaaugccucaagagcagggccagauguuucaguauuacccaguguauaugguacugcccugggaacaaccucagcagaccgugccaaggucuccccagcaaacacggcagcagcaguacgaggaacaaauaccguucuaugcacaguuuggcuacaucccucagcuugccgagcccgcuauuuccgggggacaacagcagcuggccuucgacccacaguuggguacugcgccugagaucgcagucaugagcaccggcgaagagauucccuaucuccaaaaggaagccaucaauuuucgccaugauuccgcugggguguucaugccaucaacaagucccaaaccuagcaccacuaacguuuuuacaucugccguggaccagaccauaacgccagagcugccggaggaaaaggauaaaacugacuccuuacgagagcccuga

SEQ ID NO: 60059 - RNA, 999 nt, Artificial Sequence
  derived and/or modified sequence opt3 from ODC1__Homo_sapiens__NP_001274117
augaugaccuucgacagcgagguggaacugaugaaggucgccagagcucaccccaaagcaaagcucguucuuaggaucgccacagaugacuccaaagcggugugccggcugucuguaaaguuuggcgcuacuuugcgcacgucacgauuacugcuagagcgugccaaagaacucaacauugauguggucggggugaguuuccauguuggaagcgguuguaccgacccugagacauuugugcaggcaauauccgaugccagaugcgucuucgacaugggcgcugaagugggguuuucuauguaccugcuugauaucggaggcgguuucccagggucggaggacguaaagcugaaguuugaggaaauuacuggaguuaucaauccggcauuggauaaauauuuccccucagacagcggcgugaggauuaucgccgagccuggccgguacuaugucgcuagugccuuuacccucgcggugaacauaaucgcaaagaaaauugugcugaaggaacaaacaggguccgaugacgaggaugagucuagcgaacagaccuucauguacuaugucaaugacggaguuuacgguuccuuuaacuguauccuguaugaccacgcccaugugaaaccacucuuacagaagcgccccaagccugaugagaaauacuacucaaguagcauuuggggcccaacuugcgacgggcuggauagaaucguagaaaggugugaccuucccgagaugcacgugggagauuggauguuguucgaaaauaugggcgcuuauacagucgccgcagcuucuaccuuuaacgguuuccagcggccuacgauauacuaugugauguccgggccagccuggcaacugaugcagcaguuccagaauccggacuuucccccugagguugaggaacaagaugcgucaacucuaccagugagcugcgccugggagaguggaaugaagcgccaucgagcagcuugugccucugcuuccauuaacgucuga

SEQ ID NO: 60060 - RNA, 753 nt, Artificial Sequence
  derived and/or modified sequence opt3 from ODF1__Homo_sapiens__NP_077721
auggccgcucugagcugccuccuugacuccgugagaagggauaucaagaaagucgaccgggagcugcgccaguugcgauguauugaugaguucucuacccguugcuuaugugaccuguacaugcaccccuauugcuguugcgaucuacauccuuacccauauugucucugcuacucaaagagaaguaggagcuguggccugugcgaccuuuauccguguugccugugcgauuacaaauuguauugucuccggcccucccugcgcucucuggaaagaaaggcaauaagggccaucgaagacgagaaacgggaacucgcgaaguuacgccgaacaacuaacaggauucuggcuucgucaugcuguagcaguaauauccuuggguccguuaacgugugcggauuugagccugaucaaguaaaggugagagucaaagacgguaagguguguguuucugccgagcgggaaaaucguuacgauugcuugggcagcaaaaaguacuccuauaugaacauuuguaaagaguucucacugccacccugcguggacgaaaaggaugucacguacaguuaugggcuaggaagcugugugaagaucgagucuccuugcuacccauguaccucccccugcucaccuugcagcccauguaguccgugcaaucccuguucuccuugcaacccauguucccccuaugacccuugcaauccauguuaccccugcggcagccgcuuuucguguagaaaaaugauacucuga

SEQ ID NO: 60061 - RNA, 762 nt, Artificial Sequence
  derived and/or modified sequence opt3 from ODF3B__Homo_sapiens__NP_001014440
augggcagcgacgccuggguggggcuguggagaccccacaggccucggggaccaaucgcugcacauuacgguggcccggggcccaaguauaaacucccuccaaacaccggauacgcccuucacgaucccucccgcccucgagcgccagcuuucacauuuggcgcccguuuccccacucagcaaacgaccugcgguccugggccaggacaucuggucccggcaagaaugacaguuaggggcacugacggcgcccccgcuuauucuauuuacgggcggccucgcagaucagcaccauuuuugacccccggaccugguagguauuucccagagcgggccggcaaugcuacauaccccagugccccgcgccacaccauagcgccucgaaacuggggagugcaggcagaacagcagagccccgggccagccgcuuauacuguaccuuccuuacugggccccagagugaucgguaaggucucugccccaacauguucgauuuacgggaggcgggcagcuggaucauuuuucgaggaucuaagcaaaacccccggcccuugcgccuaccaagugguuaguccaggcguguauaagucccgugcgccgcaguuuacgauccucgcccgcacuucucugccccaggacaauaccagaaaaccugggccagcagcuuacaacgucgaucagcauaggaagccccggggauggagcuucgguauucgacacuccgacuaucuugccccucuggugacagaugcugacaauuga

SEQ ID NO: 60062 - RNA, 774 nt, Artificial Sequence
  derived and/or modified sequence opt3 from ODF4__Homo_sapiens__NP_694552
auggacgccgaguacagcggcaacgaguuccccagauccgaaggggaaagggaucagcaccaacggccuggaaaggagcgcaaaucuggugaagcuggcugggggaccggagagcugggccaggacggucgacuccuuucaaguacacugagcuuguccucuaaucguucguuagggcagagacagaacucaccacugccguuucaauggaggaucacucauagcuuccgguggauggcacaggugcuagccagugagcucucccuggucgcguuuauucuucuguugguuguggcuuucucuaagaaauggcucgaucugagccgcucccuguuuuaucagagauggcccguagacgugucaaauaggauacacacgagugcccaugucaugagcaugggacucuuacacuucuacaagucucgguccugcucagaucuggaaaacggcaaagugaccuuuaucuucagcacacuuauguuguuuccuauuaauaucuggauuuucgagcuggaacgcaacguuaguaucccaauaggcuggucuuauuuuaucggguggcuagugcucauucuguacuucacuugugcaauccuuugcuauuuuaaucauaaguccuucuggagccugauuuugucgcaccccucuggagccgucuccuguucaaguagcuucgguuccguggaggagucuccucgagcucagaccaucacagacaccccaauaacucaagaaggcguacucgaucccgagcagaaggacacacacguuuga

SEQ ID NO: 60063 - RNA, 855 nt, Artificial Sequence
  derived and/or modified sequence opt3 from OFCC1__Homo_sapiens__XP_011513347
auggccaagggcgagaaagcugaaagcgggguggacaacaccgcaggacuguccgagaaggaaacacagaaaaaucccagagccccuauggaugaggcggacgucaagucugcugcccacucaagucaagguagcaucccgaaaaagauuggcccaugcuccauggauuacgaccccaaccuccuugaagaggaugacgagcugcauucucagggggauucguugacugaccacucaguuaagggaaaaagcacgguguggaggauaggcgaagcagaggauuauagucaggacaucuccuacuuagaggaacuggaggaacaucgguucucuguauguugcagcuccguggccgauucacgcuauggugacuuuuucaagcaccuacauuuuguccucgugagugcuagcucugagcugcagcuuucccaauggcagucacagggguucugguacauuauccuguugauguuuuuccucugguuucugcgacuguaucuccacuacuuaggacaguggcuguuccuucaagcaauuagcaccccuguuacaaaauuucacuucaguuugcauaucguggaacuguguuauccaacuucuucccuacacauaggcgaggaacuccccgucgugguaaugggcccucugaugcuuaaugccauccuguugcuccugguuuuaauucguugggggugccagcugcucuuugcuagcuguccagaugugcuuucgaagcugaucauuaccaugggauuguggacaauccuagacccccuggccgucuucauacucgacacccugcuuggugauaacaaagugacuguggcgucuagaauugacgagcaggagauguga

SEQ ID NO: 60064 - RNA, 3039 nt, Artificial Sequence
  derived and/or modified sequence opt3 from OFD1__Homo_sapiens__NP_003602
augauggcccagagcaacauguucaccguggcugacguccugucccaagaugagcucagaaagaaacuuuaccagacauuuaaggacaggggcauccuggauacuuugaaaacgcaguuacggaaucagcugauucacgaacuaaugcaucccguucucucuggggagcugcaaccucgcucaauaaguguggaaggaagcucccuucugaucggugcaucuaacucguugguagccgaccaccuccagcgaugcggcuaugaguacucacugagcguguucuuuccagaaagugggcuggcgaaggagaaagucuucaccaugcaggaucucuuacagcugauuaagaucaauccgacauccucucuuuauaagagcuugguguccggaucagacaaagagaaccaaaagggcuuucugaugcauuuccuaaaagaacucgcugaguaccaccaggccaaggaaaguuguaauauggagacucagaccagcucuacauuuaaccgugauucccuggcagagaaacuucagcugauugacgaucaauucgccgacgcuuauccccagagaaucaaguuugaaucauuggagauaaagcucaaugaauacaaaagggagaucgaagaacagcugcgggcagagaugugccaaaaguuaaaauucuuuaaggauaccgaaauugccaaaaucaagauggaggcuaaaaagaaguaugaaaaagagcugacuauguuccagaacgacuuugaaaaggccugucaggcgaaaagcgaggcacucguucuucgcgagaagaguacacuggaaaggauucauaaacaccaggagaucgaaaccaaggagauauacgcccaaagacaguugcuacugaaggauauggaccuccugcggggucgcgaagcugagcuuaaacagcgaguggaggccuucgaacugaaucagaaguugcaagaggaaaaacacaagucuauuacggaggcacucagaaggcaggagcagaacaucaaauccuucgaagagacuuacgaccggaagcugaagaaugaauuacugaaauaucagcuagagcucaaggaugacuacauuauccguaccaaccgccugaucgaagaugagaggaaaaauaaggagaaagcuguccaucuucaagaagaguugauugccauaaacagcaagaaggaagaacugaaucagucggugaacagaguaaaagaacucgagcuggagcuugaaucuguuaaggcgcagucccuggccaucacaaaacagaaccacauguugaaugagaaggugaaagaaaugucagacuauagucuccugaaggaggaaaaauuagagcugcuagcacaaaacaagcuccugaagcagcagcuugaggaaagccggaaugagaacuugcgacugcucaaucgccuggcucaaccugccccagaauuagcugucuuucagaaagagcugagaaaggccgagaaagcaauugugguggaacaugaggaguucgaguccugcaggcaggcccuucacaagcaguugcaagaugaaaucgagcacucugcucagcucaaagcgcagauacugggguacaaggcaagcgucaagucacuaacuacccagguugccgaccugaaacuccaacugaagcagacacagaccgcucuugagaacgaaguguauuguaaucccaaacagaguguaauugaucgguccgugaacggauugaucaauggcaacgucgugccuugcaauggcgagaucagcggggacuuucugaacaauccauucaagcaagaaaacguuuuagcccgcaugguggcaucuagaauuacgaauuaccccacugccugggucgagggaucaaguccugauagcgaccucgaauuuguggcuaacacaaaagccaggguaaaggagcugcagcaggaggcagaacgucuugagaaggcguuccgguccuaucaucgaagaguuaucaaaaacucugcuaagucgccacuggccgcaaaaagcccgcccuccuugcaccuccuggaagccuuuaagaauauuaccucaaguucuccugagaggcauauauucggugaagaucgcguggucagcgagcaaccacaggugggcacucuagaggaacggaacgacgucguggaggcucugacaggguccgccgcaucaagacucaggggaggcaccagcucucgccgacuguccaguacgccccuuccuaaagcuaagcggagcuuggaaucugagauguaccuggaggguuuagggcguucccacaucgccucaccaagucccuguccggacagaaugccucuccccagcccaaccgaaucgaggcauucccugucuauuccucccguuagcucaccacccgagcagaaggugggacuuuaccgccggcagacagaacugcaagauaaaagugaguuuuccgacguagauaagcuagcguucaaagacaaugaagaguuugagucuagcuucgaauccgccggcaacaugccuagacagcucgagaugggcgggcugucaccagcuggagauaugagccacgucgacgcagccgcugccgcagugccguugaguuaucagcaccccucuguugaucagaagcaaaucgaggagcagaaagaagaggagaagaucagggaacaacaggugaaagagcgacgccagcgggaagagagaaggcaguccaaucugcaggaagucuuagagcgugagcgccgggaacucgagaagcuguaccaggaaagaaagaugauugaggagagccuuaaaauaaagaucaaaaaggaacuggagauggaaaacgaguuggaaaugucgaaucaagagauuaaagacaagucagcgcauucugagaacccucucgaaaaguauaugaaaaucauucagcaggagcaagaucaggaaagugccgacaaguccagcaaaaagauggugcaggaggguucucugguagauacucuacagagcuccgacaaaguggaaucacugaccggcuuuagucacgaggagcuugaugacagcugguga

SEQ ID NO: 60065 - RNA, 1284 nt, Artificial Sequence
  derived and/or modified sequence opt3 from OGDH__Homo_sapiens__NP_001003941
auguuccaccugagaaccugcgccgcuaagcucaggccccuuacagcaagccagacugugaaaacguuuucccaaaaccggccugccgcggcucgcaccuuccagcagauccgaugcuacucugccccagucgcagccgaaccguuucugucaggcacaaguagcaauuauguugaagagauguacugcgcuugguuggaaaaccccaaguccgugcauaaaucuugggacauuuucuuucguaauacuaacgcaggggccccuccaggaaccgcuuaucagucgcccuuaccucugucaagagguagccuagccgcgguagcacacgcccaaagucucguggaggcucagccaaaugucgauaagcugguggaagaccaucuugccguucagucccugauaagggcauaccagauccggggccaccauguggcucaauuggauccccucgggauucuggacgccgaucuggacucuagcgucccugcggauaucauuuccucaacagacaaacucggauucuauggcuuagaugagagugaccuggauaagguguuucaccuuccaaccacuacauucaucggugggcaggagagcgccuugccgcugcgcgaaauaaucagaaggcuagagauggcauacugucagcacauuggaguagaauuuauguucaucaacgaccucgagcagugccaauggauucggcagaaguuugagacccccggcaucaugcaguucacgaaugaagagaaacgcacucugcuugcucgacugguuagaucuaccagguuugaagaguucuugcaacggaagugguccucagaaaaacguuucggccucgaggggugugaggugcugauaccugccuuaaagacaauuaucgauaaaagcagugaaaacggagucgacuaugugauuauggguaugccacaucgcggcagacugaaugugcucgcuaacgucaucaggaaggagcuugaacagaucuuuugccaguucgacucuaagcuggaggccgcagaugaaggguccggagacguuaaauaccacuugggcauguaccaucggcgaauuaaucgcgugacugauagaaacauaacccuaagccugguagccaaucccucgcaccucgaggcugcggacccuguggucauggguaagacaaaagcagagcaguuuuauuguggggauaccgaaggaaagaaagugaggccacgggagcgcagagccaggcaaaucguuaaggcucccuguucuuccauggaguuccguucaccgacguga

SEQ ID NO: 60066 - RNA, 2862 nt, Artificial Sequence
  derived and/or modified sequence opt3 from OGDHL__Homo_sapiens__NP_001137468
augagccagcugagacuccuucccuccaggcugggcgugcaagccgcucgguuguuagcagcccacgacgucccuguuuucggguggcgcucucgaucaaguggaccaccggcgaccuuucccagcuccaaggguggcgggggaucuucguacauggaggaaauguauuucgcuuggcuggagaacccucagucagugcauaaaauccguggccaccauguagcccagcuagauccacucgguauucuggacgcagaucuugacagcuuugugcccagugaucugauaacaacuaucgacaaguuggccuucuacgaucuccaggaagcugaccuggauaaagaguuucaacugccuacgaccacauucauugggggauccgaaaauacucucucuuuaagagagaucauuaggcggcuggagaacaccuauugccagcacaucggccuugaauuuauguucauaaaugacgucgagcagugucaguggauccgccaaaaguuugaaacaccaggcgugaugcaguucagcuccgaggagaaaagaaccuugcuggcaaggcuaguucggucaaugcgcuuugaagauuuccucgcccgaaaguggaguagcgagaagagauuugggcuggaaggaugcgaggugaugauucccgcucuuaaaacuaucauugacaagucuuccgaaauggguaucgagaacgucauacugggcaugccucauagggggcgguugaaugugcucgccaacguaauucguaaagaucuggagcagaucuucugucaguucgacccaaaguuagaagcggcagacgagggaucaggcgauguuaaauaccaccuggguauguaucacgaacgcauuaauagagugacaaacaggaauaucacccucagccuugucgccaacccgagucaucuggaggcuguggaccccgugguccaagggaagacgaaggccgaacaguuuuaccggggagaugcacagggcaaaaagguuaugucuaucuuggugcacggcgacgcugccuucgcggggcaaggaguaguguaugagacuuuucaucuauccgaucugccuagcuacaccacaaaugguacuguccacgugguugugaacaaucagauuggcuucaccacagacccacgaauggcccgcucgucucccuacccuaccgaugucgcaagagugguaaacgcuccaauauuucacguuaaugccgacgaucccgaggcugugaucuaugucugcuccguggccgcagaauggaggaacacguucaacaaagacgucgugguugaucucguguguuaccggcgcagagggcauaaugagauggacgaaccgauguuuacucagccucugauguauaagcagauucacaggcaaguacccguccuuaaaaaguacgccgacaaacugaucgcugagggaacagugaccuugcaggaauuugaggaggaaauagcgaaguaugaucguauuugcgaggaagcauacggccggucaaaggacaaaaagauccuccauaucaaacacuggcuggauaguccauggccugguuucuucaacguugacggggagcccaagagcaugacuuguccagccacaggcauucccgaggauauguuaacccauaucggauccguggcuucuagcgucccucuggaagacuuuaaaauucacacgggccuaucacgaauacucagagggagggccgauaugaccaagaaucgcacaguggacugggcacuggccgaguauauggcuuucggaagucuuuugaaggaagguauccacguacggcuguccggccaggauguggagagagggacuuuuagccauaggcaccauguucuccacgaccaggaagucgaucgccgaaccugcgugccaaugaaccaccuguggccggaccaagcccccuacacaguguguaauucuucacuuagugaguacggaguccugggcuucgaguuggguuaugcaauggcgagcccuaacgcucucguucugugggaagcccaguucggggauuuucauaauacugcacagugcauuaucgaccaguucaucuccaccggccaagccaaaugggugcggcacaacggaauuguguuacugcuaccacauggcauggaggggaugggacccgaacacucuucggcucguccugagagauuucuccagaugagcaaugacgauuccgacgccuacccagcauucacaaaggauuuugaaguaucacagcuguaugacuguaacuggauagucgugaauugcaguacccccgcuaacuacuuccauguucuuaggcgccagaucuugcugccguuucggaaaccucucauuaucuucacuccaaagucucuguuaagacaccccgaggccaaaagcuccuuugaucaaauggugucagguacgagcuuccagagggucauuccugaggacggcgcggccgcucgagcacccgaacaggugcaacgccugaucuuuugcacagggaagguuuauuacgaucuugugaaggagcggucuucccaggacuuggaagagaaaguagccauaaccagacucgaacagaucaguccauucccuuuugaucugauuaagcaggaggcugagaaauaucccggagccgaacuagcauggugucaagaggaacacaagaauaugggcuacuacgacuauaucagcccaagguucaugacuauucugcgucgcgcgcggccgaucugguacgucgguagagauccugccgcugcccccgcaaccgggaacaggaauacacaucucgugucucugaaaaaguuccuugacaccgcuuuuaacuugcaggccuucgagggcaagacuuuuuga

SEQ ID NO: 60067 - RNA, 1629 nt, Artificial Sequence
  derived and/or modified sequence opt3 from OGFOD1__Homo_sapiens__NP_060703
augaacggcaagagacccgccgagccugggccagcuagggugggaaagaaggguaaaaaggaagucauggcagaguucagcgacgccguuaccgaagagacacugaaaaagcaaguggcggaggcuuggucccggcgcacuccguuuucucacgaaguaaucgugauggauauggaccccuuccuccauugcgucauuccuaauuuuauacagucacaggauuuccuugagggccugcagaaggaauugaugaacuuagacuuucacgagaaauacaaugaucuguauaaguuccagcaaagugacgaucucaaaaagcgacgugaaccacauaucagcacgcuaagaaaaauucuguuugaggacuucagguccuggcuuucugauaucucgaagauugaccuggagucaaccaucgauaugagcugugccaaguacgaauuuacagacgcauugcucugccacgaugacgagcuggaagggcggcgcauagccuucauccuguaucucgugcccccuugggacagaaguaugggaggcacuuuagaucuguacuccauugacgagcauuuucagccaaaacagaucguuaagucucuuauucccagcuggaacaaauugguguucuuugaagucuccccugugucauuccaccagguaagugagguucugagcgaggaaaagucuaggcuauccaucucagguugguuccacgggccaagccucacccggccgcccaauuauuuugagccuccaauaccccgcaguccucauauuccacaagaucacgaaauccuguacgacuggauuaaccccacauaucuugauauggacuaccaggugcagauccaggaggaguucgaagagucuuccgaaauccuguugaaagaguuucucaagccggaaaaauucaccaaggucugugaggcucuggaacauggacacguggaguggagcucgcgaggcccucccaauaagagauuuuacgagaaagcagaagagucuaaguuaccagaaauucugaaagagugcaugaaacucuucagguccgaggcccuuuuucuguugcuaucaaacuucacuggccugaaacuccacuuucuggcuccuagugaagaggaugaaaugaaugacaagaaggaggccgaaacaaccgauauaacggaggaggggacuagccauucucccccagaacccgagaacaaucaaauggcgaucuccaacaauagccagcagucaaacgaacaaaccgacccugagccagaagagaaugagacuaaaaaggaaaguuccgugccgaugugucagggagagcuucggcacuggaaaacaggucauuauacccugauucacgaucauagcaaggcagaguucgccuuggaccucauccuguacugcggcugugaagggugggaacccgaguauggaggcuuuacaucuuacauagcuaaaggugaggacgaagaguuacugaccgucaacccugaaucaaacagucuagcccucguuuaucgugaucgcgagacgcugaaguucgugaagcacauuaaucacagaagccuugagcagaaaaagacuuuuccaaacaggacaggguucugggacuucuccuuuaucuacuaugaauga

SEQ ID NO: 60068 - RNA, 2034 nt, Artificial Sequence
  derived and/or modified sequence opt3 from OGFR__Homo_sapiens__NP_031372
auggacgaucccgacugcgauagcaccugggaggaagacgaggaagaugccgaggacgcugaagaugaggacugugaggauggcgaagcagccggggcgagagacgcugaugccggagacgaggaugaagaguccgaggaaccuagggcagcccggccaucuucauuccagagucgcaugacagguagccgaaacuggcgugcuacuagagacaugugcagguaccggcacaauuauccggaccugguggagcgcgauuguaacggcgacacgcccaaucucuccuuuuacagaaacgaaaucagguuccuuccuaaugggugcuuuauugaggauauacugcaaaacuggaccgacaauuaugauuuguuagaagacaaccauucuuacauccaguggcuguucccacuacgggagcccggagucaauuggcacgcaaagccucucacacugcgcgagguugaaguguuuaaaucgucacaggagauucaggaacgacuuguaagagccuaugagcugauguugggcuucuacgguaucaggcucgaagaucgggggacuggaaccgugggccgugcucaaaacuaucagaagcgcuuucagaaucugaacuggagaagccauaauaaccugaggauuacacggauccucaaaaguuuaggcgagcuggggcuugagcacuuccaggccccauugguccgauuuuuccuggaagagacccuagugcgcagagaacuccccggaguuaggcaauccgcgcuggacuacuuuauguucgcagugcggugucgccaucagagaaggcagcuuguccacuuugccugggagcacuuccguccucggugcaaguucgugugggguccacaggauaaacugcgaagauuuaagccgucuagcuugccccauccucucgaaggcuccaggaagguagaggaggaagggucaccaggagaccccgaucacgaggcuaguacucaaggccgcacaugugguccugaacauagcaaagggggaggccggguugacgagggcccacagcccagaucuguggagccgcaggacgccgggccucuggaaaggucccaaggagaugaggcugguggccacggggaagaccgccccgagccauuaucaccuaaggaaagcaaaaagcgaaaacuggagcucagucggcgugagcagcccccaaccgaacccggaccucagucugcauccgaggucgaaaagauagcccuuaaucuggagggcugcgcguugagccaggguucgcuaagaacggggacucaagaagugggcggacaggauccaggcgaggccgugcagccguguaggcagccccugggggcacgcgucgcugacaagguucggaaaagaaggaagguggaugagggagccggugacucugcugccguagcauccggcggggcccaaacccucgcucuggcgggaaguccugcaccaucaggccaccccaaagccggucauagcgaaaacgggguggaggaagauacagagggccgaacuggaccuaaggaaggcaccccagggucccccucugagacaccgggaccuagcccagcuggucccgccggcgacgagccugcagaaucacccagugagaccccagggccucgccccgccggaccagcuggcgaugaaccggccgaguccccuagcgagacgcccgguccacggcccgcagggccugcgggcgacgaaccagcugagucucccucagaaacuccuggaccgaguccagccggccccacaagagaugagccugcagaaagcccauccgagacccccgggccuaggccggccggacccgcuggcgacgagccagccgaaucuccuucggagacucccgguccacguccugcagggcccgcuggagaugaaccagccgagagcccguccgaaacaccuggccccucaccagcgggucccacccgcgacgagccugccaaagcuggcgaggcagccgaacuucaggacgcugaggucgaaaguucugccaagagcgggaaaccauga

SEQ ID NO: 60069 - RNA, 1038 nt, Artificial Sequence
  derived and/or modified sequence opt3 from OGG1__Homo_sapiens__NP_002533
augcccgccagagcucugcucccuaggcggaugggccaccgcacccuugcaagcacaccagcccugugggcguccaucccgugcccccgaucugaguugcguuuagaccuggugcuaccuucagggcagaguuucagauggagggaacaaagcccagcucauugguccggaguccucgccgaucagguuuggacucugacgcagaccgaggaacagcuucacuguacaguguaccggggugacaagucucaagcaucgcgccccacuccugaugagcuggaagccguaagaaaauauuuucaguuggacgugacccucgcucagcuguaccaucacuggggcucagucgauagccauuuccaggagguggcacaaaaguuucaggggguuaggcugcuccggcaggacccaauugagugcuuauucaguuuuauauguuccucuaacaauaacaucgcccgcauuacaggaaugguggaacgacugugccaggcuuucggccccagacuuauccaauuggaugacgucaccuaucacgguuuuccuagccugcaggcccuagcggggccagagguggaagcacaccucaggaaacugggacuuggcuaccgggcccguuauguauccgcuucagcccgcgcaauucuggaggagcagggcggguuggcuuggcuccaacagcugagagaaaguagcuacgaggaagcccauaaggcguuauguauccugccgggaguugguacuaaaguggccgauugcauaugucucauggcacuugacaagccccaggcugucccuguggaugugcacauguggcauaucgcccagagggacuauucuuggcacccaacaaccucccaagcuaagggccccucaccucagacgaauaaagagcuggggaacuucuuucggagcuuguggggaccauacgccggcugggcacaggccguccuauucagugcugaucugcgacagucucgccacgcgcaagaacccccggcaaagagaaggaaagguuccaaggggccugagggauga

SEQ ID NO: 60070 - RNA, 897 nt, Artificial Sequence
  derived and/or modified sequence opt3 from OGN__Homo_sapiens__NP_054776
augaagacccugcagagcacacuccuucuguuguuacuggugccccuaaucaaaccugccccaccgacucaacaggacuccagaauuauauacgauuauggcacggacaacuucgaggaaucuaucuuuucacaggauuacgaggacaaguaucucgaugggaaaaauauuaaggaaaaagagaccgucaucauucccaacgaaaagagucugcagcuucaaaaggacgaggcuaucacaccucugccacccaaaaaggagaaugaugaaaugccuacuugcuugcucuguguuugccugagcggauccguguacugugaggaaguagacauagaugcagugccaccccugccuaaagagucugccuaucucuacgcgagguucaacaagaucaaaaaguuaaccgcuaaggacuuugccgauauuccaaaucugcggcgccuugacuucacagguaacuugaucgaggauauugaagacggcaccuuuucgaaacugucacuacucgaggaacugagccuugcagagaaucagcuguugaagcucccgguccugcccccuaaauuaacucuguucaacgccaaguauaauaaaaucaagagucgagggauaaaagcuaacgcauuuaagaagcucaauaaccuuacauuccuguacuuggaccacaaugcccuagaauccgugccacugaaccuccccgagucucugcguguuauucaucuucaguuuaauaacaucgcuagcauuaccgaugacacguucugcaaagccaacgauacuuccuacaucagagacaggaucgaggaaauucggcuggagggaaauccuauaguguugggcaagcacccaaacucauuuaucugucucaaacgccugcccauugguaguuauuucuga

SEQ ID NO: 60071 - RNA, 3141 nt, Artificial Sequence
  derived and/or modified sequence opt3 from OGT__Homo_sapiens__NP_858058
auggccagcuccgugggcaacgucgcugacucuaccgagcccacaaagagaaugcugucauuccaggggcucgcagaacuugcccacagggaguaccaagcgggagauuuugaagcugccgagcggcauugcaugcagcuguggcgccaggaaccugacaauacugguguuuuguuacugcuaaguagcauccacuuccagugucgacgucucgauagauccgcacauuuuucuacgcuggccauuaaacaaaacccacuucuggcugaggcauauucgaauuugggcaacguguacaaggagagggggcagcuccaggaagccauagagcacuaucggcaugcucugcgccugaaaccggacuucaucgauggauacauuaaucucgccgcggcauuaguagccgcuggcgacauggaaggugccgugcaggcauaugucucagcucugcaauacaaccccgaucuuuauugcgugagaagcgacuuggggaaucugcuaaaggcccucggaaggcuggaggaggcgaaagccuguuaccuuaaggcaaucgaaacccagccuaacuuugcuguugccuggaguaaucugggcugcguguucaacgcucagggcgagauuugguuggccauccaccacuuugaaaaggcagucacacucgauccaaauuuccuggacgccuacauaaacuuagggaaugugcugaaagaggcucggaucuuugaucgcgcgguagcagccuaucuccgagcucuuucccugucucccaaccaugccguugugcacggaaauuuggcaugugucuacuaugaacagggucuaauugaccuggccaucgauacuuacagaagggcuauugagcuccaaccucauuucccagacgccuauugcaaccuggcaaacgcgcuuaaggagaaaggcagcguggcugaagccgaggacuguuacaauaccgcacugcgguugugccccacacacgccgauucccucaacaaucuggcuaacaucaagcgugaacaggggaauauagaggaagccgugcgcuuauauagaaaagcacuggaggucuuuccugaguucgcugccgcgcacucaaaccuagccaguguucuccagcaacagggaaagcugcaggaagcucuuaugcauuacaaggaggcaauuaggaucagcccaaccuuugccgacgcuuacucuaauaugggcaacacuuugaaagaaaugcaggaugugcaaggugcccugcaguguuauacacgggcaauucagaucaauccggcguucgccgacgcucacuccaaccucgccucaauccauaaggauagcgggaauauucccgaggcaauagcuaguuaccgaaccgcccugaaacuuaagccugacuucccagaugcauauugcaaccuggcccacuguuugcagaucguaugcgacuggacggauuacgacgaacgcaugaaaaagcucgugucuauugucgcugaucaacuggagaaaaauagauuacccuccgugcauccucaccacagcaugcuguauccacuaucgcauggauuuaggaaggcgaucgccgagcggcacggcaaccucugccuggacaagauaaauguucuucauaaacccccguacgaacacccuaaggacuugaaacugucugauggccgccucagagugggguaugucuccucagacuucggaaaccaccccaccagucaucugaugcagagcauuccagguaugcacaacccugauaaguuugagguguucuguuacgcauuaucccccgacgauggcacuaauuuuaggguaaaaguuauggcugaagccaaccauuucaucgaccugucucagaucccaugcaaugggaaggccgcugaucguauucaccaggacggaauccauauucuugugaacaugaauggcuacacaaagggugcacggaacgaguuguuugcccuccgacccgcgccuauacaagcuauguggcugggguauccaggcacuagcggagcccuauucauggauuacaucauuaccgaccaggagacaucaccggcagaagucgccgagcaguauagugaaaaacuggcuuacaugccccacaccuuuuucaucggcgaucacgcaaauauguuuccucaucucaagaaaaaggccgugaucgacuucaaauccaacgggcacauuuaugauaauagaauaguccugaacggaaucgaccuuaaggcguuuuuggacagccugccagaugugaagauuguuaaaaugaagugucccgacgguggcgauaaugcugacucuucaaacacggccuuaaauaugccugugaucccaaugaacacuauugcagaggccguaaucgaaaugauaaauagggggcagauccaaauuacaaucaacggauucaguauuagcaacggccucgcuaccacucagaucaauaacaaagccgcaacaggugaggaggucccccgcaccauaauugugacgacccggucccaguacgggcugccggaagaugcuaucguuuauugcaauuucaaccaacuuuacaagauugacccuucuacacugcagaugugggccaauaucuugaaaagagugccaaacucgguccucuggcugcuaagguuucccgcggugggcgagccuaauauacagcaguacgcccaaaacaugggacugccccagaaucgcaucauuuucagcccaguagcaccuaaggaggaacaugugcgacggggccagcucgcugauguuugucuggacacuccccuuugcaacgggcacaccacaggaauggaugucuugugggccgguacuccaauggugaccaugccgggcgaaacacuggcuucccguguggcagccucacaguuaaccugucucgggugccuggagcuuaucgccaagaauagacaagaguaugaagacauugcugucaaacugggaacugaucuagaguaccucaagaaaguuaggggcaagguguggaaacagcgcaucaguucuccucuguuuaacacgaagcaguauacaauggaauuggagcggcuguacuuacagaugugggaacauuaugcggcagguaauaaacccgaccacaugauaaagccaguggagguaaccgagagcgccuga

SEQ ID NO: 60072 - RNA, 690 nt, Artificial Sequence
  derived and/or modified sequence opt3 from OIP5__Homo_sapiens__NP_009211
auggccgcucagccccugagacacaggagccggugcgcaaccccuccacgcggcgacuucugugggggaacagagcgagccaucgaucaagcguccuuuacuacgucuauggaaugggacacccagguggucaaggguucaaguccgcucggccccgcugggcuuggagccgaggaaccugcagccggcccacagcugcccagcugguugcagccugagcguugcgcuguuuuccaaugugcacagugccaugccguguuagcugauuccguacaccuggccugggaccuaucuagaucgcucggugcgguggucuuuucaagggugacaaacaauguugugcuggaagcaccauuccuugucgggauugagggaagccugaaaggcaguacuuacaacuugcucuuuuguggcuccugcgggauacccgugggauuccaucuguauucuacccacgccgcucuggccgcacuccggggucauuuuuguuuaagcuccgauaagaugguaugcuaccugcuuaaaacaaaggcuaucguuaaugccucagagauggacauucagaacgugccuuugagugagaaaaucgcggaacugaaggaaaagauuguccuaacccacaaucgccucaaaagccugaugaagauccuuucugaggugacuccagaucaguccaaaccggagaacuga

SEQ ID NO: 60073 - RNA, 1638 nt, Artificial Sequence
  derived and/or modified sequence opt3 from OIT3__Homo_sapiens__NP_689848
augcccccuuuccugcuccuuaccugccuguuuaucacaggcacuagcguguccccagucgccuuggacccguguucugcuuacauuucauuaaacgagcccuggagaaauacggaucaccagcuggacgaaagucaagggccuccacuaugcgauaaccauguuaauggagagugguaucacuucaccgguauggcaggcgacgccaugcccacauuuuguauaccugaaaaccauugcgggacucacgcgccaguguggcucaauggaagccauccccuggagggcgaugguaucguacagaggcaggcuugugccuccuucaacgggaauugcugucuuuggaacaccacaguggaagucaaggcaugcccuggaggcuacuauguguaccggcugaccaaaccaucuguuuguuuucacguguauugcggccacuucuacgacauuugugaugaggacugccaugggucgugcucagauacuagcgaguguacaugcgccccgggaaccgucuugggucccgaccgccagacguguuuugaugaaaaugagugcgaacaaaacaauggcggguguagugagaucugcgugaaccucaaaaauuccuaucgaugugagugcggaguaggccguguucugagaucugacgguaagacuugugaagauguggaggggugccacaacaauaacggaggcuguagccauuccugccugggcucagaaaagggguaccagugcgaguguccuaggggacucgucuuaagugaagacaaccauaccugccaggugccagugcuguguaaaagcaaugcuauugaggucaacaucccccgggagcuuguugguggcuuggaacuguuccuaacaaauacuucuugccgcgggguguccaacggaacccacguaaauauacucuuuucacugaagacauguggcaccguggucgacgugguuaacgauaagaucguggcaagcaaucuugucacgggucugccuaaacagacuccagggaguucuggcgacuucauuaucagaacauccaaguugcucauucccgugaccugcgaguuuccgaggcuguacacuaucagcgaaggauauguaccuaacuuacgcaauucgccccuggagauaaugucucggaaccacggcauuuucccauuuacacucgaaaucuucaaagauaaugaguucgaggaaccuuaccgagaggcccuucccacccugaaguugagagacucccuauauuuugggauugaaccaguugugcacgucucaggacuggagagucucguggaaagcuguuucgcuacgcccaccuccaaaaucgaugagguccugaaguacuaucuuaucagggacgguugcgugucugaugacagcguuaagcaauacacaucacgggaucaucuggccaaacacuuucaggugccuguauucaaguuugucggcaaagaccauaaggagguguucuugcacugucguguucucgugugcgggguccuggaugaacgcaguagaugugcgcagggaugccacaggcggaugcgacgcggcgccgguggggaggacuccgcaggcuuacagggacaaacucugaccggcgggccaauuagaauagacugggaagauuga

SEQ ID NO: 60074 - RNA, 717 nt, Artificial Sequence
  derived and/or modified sequence opt3 from OLA1__Homo_sapiens__NP_001011708
augauuggccccauuauagacaagcuggagaaaguggccgucagagggggagauaagaaacucaagccugaauacgacaucaugugcaaaguuaagagcugggugauugaucagaagaaaccaguaagguucuaucacgacuggaacgauaaggagaucgaagugcuuaauaaacaucuguuuuugaccuccaagccgauggucuacuuagugaaccugucugagaaagacuauauucggaagaagaauaaauggcuaaucaagauaaaagaauggguugauaaguacgaccccggugcucucgugaucccuuucucaggcgcacuggagcuuaaacugcaagaguugagugccgaggaacgccagaaguaucucgaagcgaacaugacacagagcgcucugccaaaaauuaucaaggccggguuugcagcccugcagcucgaguacuucuuuacugcuggacccgaugagguccgagcauggacgauucguaagggcaccaaagccccucaagcugccgguaagauccacacagacuucgaaaaaggguuuauaauggcggaggugaugaaguaugaagauuucaaagaggaaggauccgagaaugcaguaaaggccgcuggcaaguacagacagcagggcaggaacuacauuguugaggacggggauaucaucuuuuucaaauuuaauacuccacagcaacccaagaaaaaguga

SEQ ID NO: 60075 - RNA, 1458 nt, Artificial Sequence
  derived and/or modified sequence opt3 from OLFM1__Homo_sapiens__NP_001269540
augagcgugccccugcucaagaucggcgucguucuuuccaccauggccaugauuacaaacuggaugucucagacucugccuucauuggugggguuaaauacgaccaaacugagugcugcaggagguggcacacuagacagaagcacugggguacucccaaccaacccggaggaauccuggcaaguguacucuucggcccaggauucagagggaaggugcauauguacagucguggcgccccagcagaccaugugcagccgggacgcucgcacuaagcaacugcgacagcuucuggaaaaaguucagaauaugagucaguccaucgagguguuggaucguagaacacaaagggaccuccaguaugucgaaaagauggagaaccagaugaaaggccuggagucuaaguucaaacagguggaagagagccacaagcaacaucuggcccggcaguuuaaggcaauuaaagccaagauggaugaacuccgcccuuuaaucccaguacuggaggaguacaaagcugacgcaaaacuuguuuugcaguucaaggaagaggugcaaaaucugaccuccguccuaaacgaacuccaggaggaaauuggugccuaugauuacgacgagcugcagucaagagugaguaaucuugaggaaaggcugcgggcuuguaugcagaaguuggccugcgggaagcucacgggaaucagcgaucccgugacugucaaaaccucuggcucccgcuuuggcucauggaugacagacccucuggcgccagagggggauaaccgaguuugguauauggacggauaccacaauaacagauucgugagggaauauaagagcaugguagauuuuaugaauacugacaacuucaccagucaucgguuaccccacccuuggucugguacaggccaaguggucuacaauggguccauauacuuuaacaaauuccagagccauaucauuauccguuuugaccugaagaccgagacgauucucaaaacucgcucgcuugauuaugcaggauacaauaacauguaucacuacgccuggggcggucacucugacaucgaucugaugguggacgaauccggguugugggcuguuuaugccacaaaccagaaugcaggaaacauaguggucucaagacuagauccagugagucugcagacccuccaaacuuggaauacaagcuacccgaagagguccgcuggcgaggccuucauuaucuguggcacccuguauguaacgaacggguacucuggagguaccaagguucauuacgcguaucagacaaaugccagcacuuacgaguauauugacauccccuuucagaacaaauacucacacaucaguaugcuugauuauaauccuaaggaccgggcacuguacgcuuggaacaauggccaucagauuuuguauaacgugacccucuuccacgucauacgauccgaugaacuguga

SEQ ID NO: 60076 - RNA, 1365 nt, Artificial Sequence
  derived and/or modified sequence opt3 from OLFM2__Homo_sapiens__NP_477512
auguggccccugaccgugccuccaccgcuccuucuguuguuaugcagcggccuggccgggcagacacuauuccaaaaccccgaggaaggauggcagcucuacacuuccgcucaggcaccugacgguaaguguaucugcacggccgucauuccagcgcagucuaccuguucaagagauggcaggagucgggagcugcgccaacuuauggaaaaaguucagaaugugagccaguccauggagguacuggaauugcgaacauaucgugaccuccaguacgugagagggauggagacucugaugaggucucuggaugcucggcuccgcgccgcagacggaucguuaucagccaagagcuuucaagagcugaaagauagaaugaccgaacuuuugccccugaguuccguccuagagcaguauaaggcugacacaaggaccauagugcggcuccgcgaagagguucgaaaccugucuggcagccuugcagccauccaggaggaaaugggugcuuacggguaugaggaucugcagcaaagagugauggccuuggaagcgaggcuccacgcaugcgcccagaaacugggauguggcaaguuaacuggcgucuccaauccuauuacagugcgggcuauggggucacguuucggaaguuggaugaccgacacgauggccccaagcgcagauucucgcguaugguacauggacgguuauuacaagggcagaaggguucuggaguuucggacucucggggauuucaucaaaggacagaacuuuauucaacaucuucugccccagccuugggcuggcaccggucacguggucuacaauggguccuuguucuauaacaaguaccagucaaaugugguggucaaauaucauuuucgaagccgcaguguucuagugcagagaucucugccaggagccggcuacaacaauacauucccguauuccuggggcggguuuagcgacauggauuucaugguagacgaaucgggacucugggcgguguacacuaccaaccaaaaugccgguaacaucgucgugucuaggcuggacccccacacacuugagguuaugcgguccugggauaccggcuauccuaagcgcucagcaggggaggcuuuuaugauaugcggagugcuguacgucacgaauagucauuuggccggcgcuaaaguguacuucgccuauuuuacuaacacaagcuccuacgaauauaccgacguaccauuccacaaucaguacucucacaucagcaugcucgauuauaaccccagagagagggcacuguacacuuggaacaauggucaucagguuuuauauaacgugacacuguuccacgucauuucaaccaguggggacccuuga

SEQ ID NO: 60077 - RNA, 1533 nt, Artificial Sequence
  derived and/or modified sequence opt3 from OLFM4__Homo_sapiens__NP_006409
augagacccggccugagcuuccuccuugcccuguuguuuuucuuagggcaggcugcaggagaccugggugaugugggcccuccaaucccgucccccggguuuucuucauucccuggagucgacaguagcuccucuuuuucgucaagcaguagguccggcucuagcuccucacggagucuagguagcgggggaucuguuucccaacucuucucaaacuuuaccggcagcguggaugaccgcggcacaugccaguguaguguaucucugccagauacuacguuccccguggaccgagucgagcgucuugaauuuaccgcccacgugcugucccagaaguucgagaaagaauugagcaagguuagagaguacgugcagcucauuucggucuaugagaaaaagcugcugaaucucacagugaggauagauaucauggaaaaagacacuauuucuuacaccgaguuagauuuugaacugaucaagguagagguuaaggaaauggagaaacuugugauucaauugaaggaguccuucgggggaucaagugaaaucgucgaccagcuggagguggaaauacggaacaugacacuacucguggagaaacuggaaacccuugauaagaauaacguccuggcgauccgcagagagauuguugcuuugaaaacuaagcucaaggagugcgaagccagcaaagaccagaauacaccugugguacauccacccccuaccccagguuccuguggccacgggggaguggucaacaucucuaagccgagcgugguucagcugaauuggaggggcuuuucauauuuauacggugcaugggggcgggauuauaguccccaacauccuaacaaaggacuguacuggguggccccacucaauacggacggccgccuucuggaguauuaccgauuguacaacacucuagacgaucugcuccuguauauuaaugcuagagaacuuaggaucaccuacggccagggguccggaacagcagucuauaacaauaacauguacgugaauauguauaacacugguaacauagcccggguaaaucugaccacaaacaccauugcuguuacgcagacuuugcccaaugccgcguacaacaaucguuucagcuaugcaaacguggccuggcaggacaucgauuucgcugucgacgagaauggccucugggugauuuacucuacagaagccucaaccgggaacauggucaucaguaagcugaaugauacuacauuacaagugcugaacaccugguacacgaaacaguauaagccuagcgcauccaaugcuuuuaugguuugcggagugcuauacgccacccgcacaaugaacacuagaaccgaggagaucuucuauuacuaugacacaaauacuggcaaagaagguaagcucgauauuguaaugcacaagaugcaggagaaaguccaaucuauaaacuacaauccauuugaccagaagcuguauguguacaacgauggguaccuuuugaacuaugaccugucgguucuccagaaaccccaguga

SEQ ID NO: 60078 - RNA, 2253 nt, Artificial Sequence
  derived and/or modified sequence opt3 from OLFML2B__Homo_sapiens__NP_056256
auggccaagcccagacugcucgugcuuuacuucgcucugaucgucguuccugcaugggugagcuccauuguauugaccggcacaucugagccaccggacgcccagacuguggcgcccgcugaagaugagacguuacaaaacgaagccgacaaucaggagaacguccugucacagcuacucggggauuaugacaaagugaaggcaaugagugaaggaagcgauugccaguguaaaugcguugugaggccucugggucgggacgccugucaacgcauaaaugcuggcgcaucccgaaaggaggauuuuuacaccgucgagacaaucacuucugggucgucaugcaaaugugccugcguggcuccacccagcgcccuuaacccuugugaaggagacuuccgucugcagaaguugagagaggcggauagucaggaccucaagcuguccaccauuaucgauaugcuggaaggcgcauuuuauggucucgacuuacugaaacuucacucuguaacaaccaaguugguugggaggguggauaaacuggaggaggaagucagcaagaaucuaacuaaagagaacgaacagauuaaggaggacauggaagagauccggacagagaugaauaagcgcggaaaagaaaacugcuccgagaauauacucgacucaaugccagauaucagaagugcccugcaaagggacgcugccgcagcuuacgcccaucccgaauaugaggaacgguuccuucaggaggagaccgugagccagcagauuaacucuaucgaacuguugcaaacgcgcccucucgcgcugccagagguggucaagucccagcgaccguuacagagacaaguucaccugaggggccggcccgccucacagccuacugugauucguggcaucaccuacuauaaagcaaagguaagcgaagaggaaaaugauauagaggagcagcaggacgaauuuuucaguggggauaacggaguggaccuccuuauugaggaucaacuguugcgccauaauggucuaaugacaucugucacuagaaggccagcugccacccggcagggccacuccacagcugugaccagcgaccugaacgcccgaacggcacccuggucgucugcccucccucagccauccacuucagaucccaguaucgcuaaucaugcgagcguugggccgacacugcagaccacuuccgugucuccugaccccacacgcgaaagcguccuucaaccaucaccucaggugcccgcaaccacgguagcccacaccgcuacacagcagccagccgcacccgccccuccagcuguuaguccgagagaggcccugauggaggcaaugcacacugugcccgucccuccaaccacagugaggacugauuccuugggaaaagacgcgcccgcuggcugggguaccaccccugccagcccaacacucucucccgaagaggaagacgauauucggaacgucaucgggcgcuguaaggacacucugucaacgaucacaggaccgaccacucaaaacaccuacggcagaaaugagggcgcauggaugaaagauccuuuagccaaggacgaaaggauuuacgugacaaacuauuacuaugggaauacccugguugaguuucguaaccuagagaauuucaagcagggacgguggaguaacagcuacaaacucccauauuccuggauagguacuggccaugugguauacaauggggcuuuuuauuacaaccgagccuucacaagaaauaucauuaaguacgaucugaaacagagguaugucgcagcuugggccaugcuucacgacguggcguacgaagaggccacgcccuggcgcuggcagggacauucugauguugacuuugcuguggaugaaaacggcuuguggcugaucuauccugcacucgacgaugaggguuucucgcaagaagucauagugcugagcaaacuuaaugccgcugaccuguccacccagaaggagacuacauggcggaccggguugagaaggaacuuuuacggcaauugcuucguaauuuguggagugcucuaugccguugauucauacaaccagcgcaaugcaaacaucaguuaugcguucgacacacacacuaacacccaaaucgucccccgacuguuauuugagaaugaauacucuuacacgacccagauugacuauaacccaaaggaucggcugcuauacgccugggacaauggccaccaggugacauaucaugugaucuucgcuuacuga

SEQ ID NO: 60079 - RNA, 816 nt, Artificial Sequence
  derived and/or modified sequence opt3 from OLIG1__Homo_sapiens__NP_620450
auguacuaugccgugagccaggcuagagucaacgcaguucccggcaccaugcugaggccucaacggccaggggaccuccagcuuggagccucccuguacgaguugguggguuaucgccagccgcccucuucaaguagcuccucuacaucgucaacuagcaguacguccucuagcuccaccacagcgccuuuacugccaaaggcugcccgagaaaaacccgaggccccugcagaaccacccggcccugggccaggaucaggcgcucacccgggugggagugcacgucccgaugccaaggaggaacagcaacagcagcuaagaaggaaaaucaauagccgggagcgcaagagaaugcaggaccucaaccuggcuauggaugcccuuagggagguaauucugccuuacucugcggcacauugccaaggagccccaggccggaaauuguccaagauagcuacucuccugcuggcccgcaauuauauccucuuacugggcucaagccuucaggaauugagacgagcacugggggagggagcuggucccgccgcgccuaggcuacuccuggccggccuuccacuguuggcagcugcccccgggagugugcuccuggcuccgggagccgucggcccucccgacgcauuacggccagccaaguaccugucucucgcucuugaugaaccucccuguggucaguucgcgcugccagggggaggcgcaggcgggcccggauugugcaccugugccgugugcaaauuuccucaccuaguuccagcuucccugggucucgccgcagugcaggcccaauucagcaaguga

SEQ ID NO: 60080 - RNA, 972 nt, Artificial Sequence
  derived and/or modified sequence opt3 from OLIG2__Homo_sapiens__XP_005260965
auggacagcgaugccucccuggugucuucaagacccaguagcccugagccagacgaucucuuccuuccggcuagguccaagggcagcucggggucagcauuuaccggagguacagucagcaguuccacucccucugacugcccuccagaacugagcgccgaguugcggggcgcgaugggguccgcuggagcccaccccggcgauaaauuaggugggucaggauucaagaguucuucuuccucaacgagcaguucuaccuccagcgcagccgcuucgucuacuaaaaaggacaaaaagcagaugacagaaccugagcugcaacagcuacgccucaagaucaacucccgagaacguaaaagaaugcaugaucugaauauugcaauggacggccuuagggagguuaugccauacgcccacggccccucagugcggaagcugaguaaaauagcuaccuugcuccuggcccgcaacuauauccugaugcucacaaauagcuuagaggaaaugaagagacugguauccgagauuuacgggggacaucacgcggguuuucauccuucugcauguggcgggcuugcccacagcgcuccauugccggccgcaaccgcucaccccgccgcggccgcacaugcugcccaccauccugcugugcaccacccaauccugcccccugccgcagccgcugcggcagccgcugccgcagccgcugccgucucaagugcaucccuaccaggaagcggccuccccucuguggguucaauuaggccgccucaugggcugcuuaaaagucccagcgcggcugccgcagccccacugggaggcggcgggggagguuccggcgcuucugggggauuccagcacuggggcgguaugccuugccccuguucgaugugccagguuccacccccucaucaccaugugagcgccaugggggcaggcuccuugccacggcucacuucagaugcuaaguga

SEQ ID NO: 60081 - RNA, 819 nt, Artificial Sequence
  derived and/or modified sequence opt3 from OLIG3__Homo_sapiens__NP_786923
augaacagcgacuccucuucagugaguagcagagccuccucucccgauauggacgagauguaccugagggaucaccaucaccggcaucaccaucaccaggaaucgcgccucaauucagucagcaguacccaaggcgacaugaugcagaagaugccuggggagucccuuucucgagcuggagcaaaagccgcgggugaaagcuccaaguauaaaaucaagaaacagcugucagagcaggauuugcaacaguuacgucugaagauuaacggcagagaaaggaagcggaugcacgaccuaaaucucgcuauggaugggcugcgcgagguuaugccauacgcccauggaccgagugugagaaaacuuagcaagauagcaacacuguugcucgccaggaacuauauccugaugcugacuucuucccucgaggaaaugaaacgguuaguaggcgagauuuacggugggcaccauucagcuuuccacugcggaacggugggccacagcgcaggccaucccgcccacgcugccaauaguguccauccugugcacccaauccuugggggagcgcugucuuccgguaacgcaagcucgcccuugucugccgcuucccugccugccauuggcaccauccgcccaccccauucacuacucaaggcaccuaguacaccaccggcucugcagcuugggagcggauuucagcacugggccggccugcccuguccuugcacuauaugucaaaugccacccccuccacacuuguccgcgcucucuaccgccaauauggcacgacugagcgcugaaucaaaagacuuacugaaguga

SEQ ID NO: 60082 - RNA, 546 nt, Artificial Sequence
  derived and/or modified sequence opt3 from OLR1__Homo_sapiens__NP_001166103
augaccuucgacgaucugaagauccagacagugaaagaccaacccgaugaaaagagcaacggcaaaaaggccaaagggcuccaguuucuuuacuccccuugguggugccuggcugcagccacuuugggagucuuaugucugggucuaguugugacgauuaugguacucggcaugcagcugucucaggugucagaccuucugacccaagagcaggcgaauuugacacaccagaagaagaaacucgaggggcagauaagugcuagacaacaggccgaagaggcaagccaggaauccgagaacgagcugaaggaaaugaucgagacucuggccaggaaacucaaugaaaagucuaaagagcagauggaguuacaucaccaaaaccugaaucuucaggaaaccuugaagcgggucgcuaacugcucgggacugcauccagcaucaaauuuccuauuucaguucagcauucucgauggcgccgugagugaggaaccgcaacugcccauggcucuuggugggcgcuuuuccuucgacgccccucugaucuga

SEQ ID NO: 60083 - RNA, 1266 nt, Artificial Sequence
  derived and/or modified sequence opt3 from OMD__Homo_sapiens__NP_005005
augggcuuccugagccccaucuacgugauauuuuucuuuuucggggucaagguucacugccaguaugagaccuaccaaugggacgaagauuaugaccaggagccugaugacgauuaccagacaggauuuccauucagacagaacguggacuaugguguaccguuucaucaauacacucucggcuguguguccgaaugcuucugucccacgaauuuuccuucuucaauguauugcgauaacaggaaacuuaagaccauuccaaauauccccaugcacauucagcagcuguacuugcaguucaacgagaucgaagccgucacagcuaauaguuuuauuaacgcaacucauuuaaaagagaucaaucugagccacaacaagauaaaaucccaaaagaucgacuacgggguguucgccaagcuaccuaaucuccugcagcuucaucuggagcacaacaauuuggaagaguuuccauucccccucccuaaaucucuggaacggcugcucuuaggauauaacgagauuucgaagcugcagaccaaugcgauggauggccuuguuaacuugacaaugcuggaccuauguuacaauuaucuccacgauucacugcuuaaagacaagaucuucgcuaaaauggagaagcugaugcaguugaaccucugcagcaaccgccuggaaaguaugccaccggguuuacccuccucucugauguaccucagccuugagaauaacuccauuucaaguaucccugaaaaguauuuugauaaacugccaaaguugcauacccuacgaaugagccacaauaaacugcaagacauacccuacaacauuuucaaucucccuaacaucguggagcugucugucgggcauaauaaacuuaagcaggccuuuuauauuccacguaaccuggaacacuuguaccuccagaauaacgagaucgagaagaugaaucugacugugaugugucccuccaucgacccguuacacuaccaucaccugacauauauuagaguagaucaaaacaaacuaaaggaaccuauaucaagcuacaucuucuuuugcuucccccauauucacaccaucuauuacggagagcagaggaguacgaauggccagacuauacagcucaagacccaaguuuuucggcgcuucccagacgaugacgaugaaucugaggaccaugaugacccugauaacgcacacgaaucccccgagcaggagggcgccgaagggcacuuugaccugcauuauuacgagaaucaggaauga

SEQ ID NO: 60084 - RNA, 1323 nt, Artificial Sequence
  derived and/or modified sequence opt3 from OMG__Homo_sapiens__NP_002535
auggaguaccagauccugaagaugagucucugccuuuucauucuguuguuuuuaacccccggcauacuguguaucugcccucuacaauguauuugcacagaaagacacaggcauguggacuguuccgggcggaaccucucuacucugccaucaggacuucaggagaauaucauucaccugaacuugaguuauaaucauuucacggaucuccacaaccagcugacccaguacacaaaucugcgcacucucgacaucagcaacaaucgauuagaaucccugccggcccaucuuccccguucuuuguggaacaugucggcugcaaauaacaauauaaaacugcuagauaagucagacaccgccuaucaauggaaccucaaauaccuggaugucagcaagaauaugcuugagaaaguugugcugaucaagaacacauugagaagucucgaaguacugaauuuauccucuaacaagcuguggaccgugccuacuaacaugccaagcaaacuccacauugucgaccuuuccaauaacucacugacacagaucuugcccgguacccuaauuaaucugacgaaccucacucaccuguaucuucauaauaacaaguuuaccuucaucccugaucagaguuuugaccagcuguuccaauugcaggagauaacacucuacaauaacagguggagcugcgaucacaaacagaauauuacuuaucuguuaaaguggaugauggagaccaaagcgcaugugaucggcacaccauguucuacccagauuuccucacugaaggaacacaacauguaccccacgccuagcggguuuacaaguucucuauucacuguuuccggaaugcaaaccguggacacuaucaauagccucucggucgugacacagccaaagguaaccaaaaucccgaagcaguaccggacgaaagagaccacauuuggcgcuacucugucuaaggauaccacauucacuuccaccgacaaagccuuuguucccuauccugaagauacaucaaccgagacuauuaacagucacgaggcagccgcugcaacgcuuacaauacauuugcaagacgguauggugaccaauacuagccugaccuccucuacaaagagcucaccaacccccaugacucucaguaucacauccgggaugccuaacaauuucagcgaaaugccacagcagucuacgacccugaaccuuuggcgcgaggaaacuacaaccaacgucaaaacaccccugccgucaguggccaaugcuuggaaggugaacgccagcuuuuugcuccuguuaaaugucguugugaugcuggcgguauga

SEQ ID NO: 60085 - RNA, 492 nt, Artificial Sequence
  derived and/or modified sequence opt3 from OMP__Homo_sapiens__NP_006180
auggccgaggacagaccccagcaaccucagcuggauaugccacucgugcuugaccagggccugaccaggcagaugcgguugcgcgucgagagcuuaaagcaacgaggggaaaaacgucaggauggagaaaagcugcuacagccggcugaguccguuuacagacucaacuucacacagcaacagaggcugcaguuugaacgguggaaugugguacuugacaaacccgguaaggugacuaucacgggcaccucucagaacuggacaccugaucugacuaauuugaugacccgccaacuccuggacccaacagcaauuuucuggagaaaagaggauucagacgccauagauuggaacgaggcggacgcucuggaauuuggggagaggcucagugauuuagccaagauccggaaggucauguauuuccuggugaccuuuggagaaggcguugagcccgcaaaucuuaaagccagcguggucuucaaccaguuguga

SEQ ID NO: 60086 - RNA, 1398 nt, Artificial Sequence
  derived and/or modified sequence opt3 from ONECUT1__Homo_sapiens__NP_004489
augaacgcccagcugaccauggaggcuaucggcgaacuccacggggugagccaugagcccgucccugcaccagccgaccuucugggagguuccccgcacgcgagaucuucaguugcucauaggggcagucacuugcccccugcccauccacggagcauggggauggcauccuuacuggauggaggcucuggugggggagacuaccaccaccaucaccgcgcccccgaacauucgcuagcuggcccucuccacccaacaaugacuauggcaugcgagacgcccccuggcaugucaaugccaaccacauauacuacccugacaccgcuucaaccccugccuccaauuagcaccgugagugauaaguucccccaccaucaccaucaccaucaccaccaucaccauccucaccaccaucagcgauuggccgggaauguauccggaucuuuuacucucaugcgugacgaaagaggucuggcuagcaugaacaaucuguacacaccauaucacaaagauguggccggcauggggcagucccucucacccuuaaguagcucuggacugggcuccauacauaacucacagcaaggucuuccgcacuacgcgcauccuggggcagccaugcccaccgacaagauguugacgccaaauggauucgaggcucaccacccugccaugcugggcaggcauggcgagcagcaccuaacucccaccagcgcagggauggucccaaucaacggacucccaccucaucacccacaugcucaccugaaugcccagggucacggccagcuucuggggacagcgcgggaaccgaaccccagugugacuggagcccaaguuucuaauggcuccaacagcggucagauggaggaaauuaauaccaaagagguggcacagcgcaucacaaccgaguugaagagauauucgauuccucaggcuaucuuugcccaaaggguccucugucggucucaggggacgcuguccgauuuacugcgcaacccaaaacccuggucaaagcucaagaguggccgagaaacuuucagaaggauguggaaauggcuucaggagccugaauuucaacggaugagcgcucugcguuuggccgcaugcaagcgcaaagagcaggaacauggaaaggacagaggcaauacacccaaaaagcccaggcuaguguucaccgauguacagcggcgaacucugcacgccauauuuaaggagaacaaacgcccguccaaggagcuccagaucacaauuucucaacagcuggggcuugaacugagcaccguuucaaauuucuuuaugaacgcuagaaggcggaguuuggacaaauggcaggaugagggauccagcaacucugguaauucaaguagcuccucuucgacguguaccaaggcguga

SEQ ID NO: 60087 - RNA, 1515 nt, Artificial Sequence
  derived and/or modified sequence opt3 from ONECUT2__Homo_sapiens__NP_004843
augaaggccgcuuacaccgcauauagaugccugacaaaagaccucgagggcugugccaugaaccccgaacuuacuauggagagccuggggacguugcacggaccugcggguggcggguccggaggcggugggggaggcggcgggggagguggcgggggaggcccaggucaugaacaggaguuacuggcuucuccgucaccccaccaugccgggaggggagcagccggcagucuacggggcccuccacccccuccaaccgcucaccaagaacucgggacagcagccgcugccgcggcagccgcuagccgcuccgccauggugacuucuauggcaucgauccuggauggaggugacuaccgacccgagcuuucaauuccucugcaucacgcuaugagcaugaguugcgauuccucuccaccgggcauggggaugagcaauaccuauacaaccuugacuccccuccagccucugccacccauauccacagucucagacaaguuccaccauccucacccacaucaccacccccaucaccaucaccaucaccaccaucagcgucugaguggaaacguuagcggcucuuuuacccucaugagagaugagagggguuuaccggccaugaauaaccuguacuccccuuauaaagaaaugcccgggaugucacagagccuuaguccauuggcggccacgccucugggcaauggacuaggcgggcuccacaacgcacaacagucucugcccaauuacggaccacccggucaugacaagaugcuuuccccuaacuucgaugcucaccacacugccaugcugacccggggcgagcagcauuugagccgcgggcucggaacaccaccggcugccaugaugucgcaccugaauggcuuacaucaccccggucauacucagucucacgggccugugcuggcaccauccagagaaaggcccccuucaaguagcuccggcucucaaguagccaccagcggacagcucgaggagaucaacacaaaagaaguggcucagcggauuaccgcggagcuuaagcgcuauucaaucccacaggcaauuuuugcccaacgaguccuguguagaagucagggcacguuguccgaccuacugaggaaucccaagccguggagcaaacucaagucugggcgggaaacuuuccgucgcauguggaaauggcugcaggagccugaauuucaaagaaugucagcucuuaggcuggccgcaugcaagcggaaagagcaggagccaaacaaggaucgaaauaacagucagaagaaaagccgcuugguguucacagaccuccagagaaggacccuguuugccaucuucaaggaaaauaaacggcccuccaaggagaugcaaauaacuaucucucagcaguuaggacuggaacuaacaaccguuucgaacuuuuucaugaacgcucgcagaaggagccucgagaaauggcaggaugaccuguccacggguggcucaaguucuaccagcuccacauguacuaaggccuga

SEQ ID NO: 60088 - RNA, 2883 nt, Artificial Sequence
  derived and/or modified sequence opt3 from OPA1__Homo_sapiens__NP_056375
auguggagacugaggcgggccgcuguggcaugcgaggucugucagagccucguuaagcacuccucuggcaucaaagggucacuuccccugcaaaaguugcauuuagugagucgcagcauuuaccacucccaucacccuacccugaaacuacagcgaccacagcuccguacaucuuuccagcaauuuucgucacugacuaaccuuccgcugagaaaguugaaauucagccccauaaaguauggauaccagccuaggcggaauuuuuggccagcccgccucgcgacgagacugcugaagcucagguauuuaauccuggguagugcuguaggcgggggauacaccgccaaaaagacauucgaccaguggaaagauaugauucccgaccuuuccgaauauaaguggaucgugccugauauugucugggagaucgacgaauacauagauuuugagaaaauccggaaggcauugccaucuagcgaagaccuggugaagcuagcccccgauuucgacaaaauuguugagucccucucacugcuuaaggacuuuuucacuucgggcagcccugaggaaaccgcuuuucgcgcaacagaucgagguucugaguccgauaaacauuucagaaaggugucagacaaagaaaagaucgaucagcugcaagaggaguugcuccacacccagcugaaauaucagaggauuuuagaacggcuggagaaggaaaacaaggagcuccguaaacuuguccugcagaaggacgacaaagggauccaccaucgcaaguugaaaaagagccuaauagauauguacagugaagugcuggacguacucucugauuacgacgccuccuauaauacucaagaucaucugccaagaguuguggucgugggagaccagagcgcuggcaagacaucggugcuugagaugauugcccaggcgaggaucuuuccgcggggcucuggggagaugaugacccgaucccccgucaaaguuacgcugucagaaggaccucaccacguggcauuguucaaggauaguagccgcgaguuugaccucacuaaagaagaggaucuggccgcuuuaagacacgaaauugagcugaggaugcggaagaacguaaaagaggguugcaccguguccccagaaacaaucucucuaaaugucaagggccccgggcuccaacgcauggugcugguugaccuuccuggagugaucaacacugucaccagcggcauggccccagauacaaaggagaccauuuucucaauaaguaaagcauacaugcagaaucccaacgcuaucauuuuguguauccaggacgguuccguggacgccgaaagaagcauaguaacggaucugguuucucagauggacccgcaugggaggcguacuauuuucgugcucacaaaggucgaucuggcggagaaaaauguggccucaccuagucggauccaacagaucauugaaggaaaacuuuuucccaugaaagcacugggcuauuucgcugucgugaccggcaaggggaacagcuccgagucuaucgaggccauucgagaauacgaggaagaguuuuuccagaauaguaaguugcucaaaacuagcaugcugaaggcucaccagguuacaaccagaaacuuaucccuggccgugucagacugcuuuuggaaaaugguaagggagagugucgaacaacaggcagauucuuucaaggccacgcgcuuuaaucuagagaccgaauggaaaaacaauuauccacggcucagagagcuggacaggaacgaacuuuucgagaaggcuaaaaacgagauauuggaugaagugaucagccugucccagguuacaccuaagcauugggaggaaauucuccagcaaucacugugggagcgcgugagcacucacgucaucgaaaauaucuacuuacccgcggcacagaccaugaacucuggaacauuuaauacuaccguggacauuaagcugaaacaguggacagauaagcagcuuccaaacaaagccguagagguggcuugggagaccuugcaagaagaguucucccgauuuaugacugaacccaaggguaaagagcaugacgauauauucgacaagcucaaggaagccguuaaagaggagaguaucaagcggcacaaauggaaugauuuugcagaagacagccugcgugucauucagcacaacgcccuagaggacagaucuaucuccgauaagcagcaaugggacgcugccauuuauuucauggaagaggcacugcaggcgaggcucaaagauacggagaaugcuaucgaaaacauggugggcccugacuggaagaagcgcuggcuguacuggaaaaaucggacacaggagcagugugugcauaacgaaaccaagaaugagcuugaaaagauguugaagugcaacgaggagcacccagccuaccuggcaucagaugaaauaacuaccgucaggaaaaauuuagagaguagagggguugaaguggacccgagccucaucaaggauacauggcaucaaguguaucgacgccacuuccugaagaccgcccuuaaccacuguaaucugugccggagaggauuuuacuauuaccagaggcauuucguagacucggaguuggaauguaacgaugucgugcucuuuuggcguauucagcgcaugcuggcuaucacugccaacacacuacggcagcaacugacgaauaccgagguuagaaggcucgagaaaaacgugaaggaaguccuggaggacuucgcagaagauggcgagaaaaagauuaaacuuuugacugguaagcgagugcagcuggcugaagaccucaaaaagguucgggagauccaggagaaguuagaugccuuuauagaagcgcugcaccaggagaaauga

SEQ ID NO: 60089 - RNA, 543 nt, Artificial Sequence
  derived and/or modified sequence opt3 from OPA3__Homo_sapiens__NP_001017989
augguggucggcgccuuccccauggcuaagcugcucuaccuugggaucagacagguuagcaaaccucuggcaaacaggauuaaggaggccgcgcggcgcuccgaauuuuucaaaaccuauauaugcuugccaccggcucaauuauaccacuggcuggagaugcgaacaaagaugcguaucaugggauuuaaugccgcagccauuaaaccccuaaacgaaggugcugcagccgagcucggcgcugaacugcuuggggagggaaucauuuucaucacugccuguucuugccugauguuggaguauuggagacaucagcuccagcagaggcggaaggaaaaggagcgcagaguggcgagggaagcacugcggggcgagguaggucaccuggggcucgccuuagaggaacugcaagcucaggugcaggccacgucaacccagcuugcauuggaggaacugcgcgcucaacuacaggagguccgagcccaucucugucugagagacccuccacccgcgccuccaguggcccccgcaagugaaaaauga

SEQ ID NO: 60090 - RNA, 1017 nt, Artificial Sequence
  derived and/or modified sequence opt3 from OPCML__Homo_sapiens__NP_001012393
auguaccaccccgccuauuggguggucuucagcgcuaccacagcacugcucuuuaucccuggcguuccagugagauccggggacgccacuuucccgaaggcgauggauaacguaacggugaggcagggagagucugcuacccuucggugcacaauugacgaucgcgucacucgaguggccuggcugaaucguucaaccauauuguacgcagguaacgacaaauggaguaucgaucccagaguuauuaucuuagugaauacaccuacccaauauagcauuaugauccagaacgucgacguguacgaugaaggcccauauacuuguuccguacagacagacaaucaucccaagaccucuaggguucaccugauagugcaggucccuccacaaaucaugaacauuucgucagauaucacggugaaugaggggagcagugugacucuacucugccuggccauuggacggcccgaaccuaccgucacauggcgccaucuuuccguuaaagagggccaggguuuugugucugaagacgaguaccuggagaucagcgauauaaagagagaccaguccggggaauaugaguguucagcuuugaacgauguagcagccccagacgugaggaaagucaagauuacugugaauuacccgcccuacaucaguaaggcuaaaaacaccggaguuagcgugggccagaagggcauucucucuugcgaagccuccgcggucccuauggcagaguuccaaugguuuaaagaggaaacacggcuggccaccgggcuggacggaaugcgcaucgagaauaagggucgaaugucaacgcucacuuucuuuaacgugagcgaaaaagauuauggcaauuacacauguguagcuaccaacaaguuagggaauacuaacgccaguaucacacuguauggaccaggcgcaguuauugacggugugaacucugcuuccagagcccuugcgugcuuguggcugagcgggacccuacucgcccacuucuuuauaaaguucuga

SEQ ID NO: 60091 - RNA, 2085 nt, Artificial Sequence
  derived and/or modified sequence opt3 from OPHN1__Homo_sapiens__XP_005262327
augggccaucccccucuggaguucagcgacugcuaccucgauuccccagacuuuagagaaaggcuuaaguguuaugagcaggaacuggagcggaccaacaaauucaucaaggaugugauuaaagacgggaaugccuugauaucugcuaugcgcaacuacucaagugcaguccaaaaguuuagccagacauuacaguccuuccaguuugauuucaucggagacacucugacggaugacgaaauuaauaucgccgagucuuuuaaagaguucgcggaacuacucaacgagguugaaaaugagcgaaugaugauggugcacaacgcuucggaucugcuuauuaagccgcuggagaauuuucguaaggaacaaaucgguuucaccaaagagagaaagaaaaaguuugaaaaagacggcgagagguucuauucauugcucgaucggcaucugcaccugagcaguaagaagaaagaaucccagcuccaggaggccgacuuacagguagauaaggagcgccacaacuuuuucgaaucuagccuggacuacguguaucaaauacaggagguccaggaauccaaaaaguucaauaucguggagcccguucuugcauuuuugcauucacuguucauuaguaacagccuaacaguggaacucacucaggacuuucugccuuacaaacaacagcuucagcugucuuugcaaaauaccagaaaccacuucuccucaacaagggaggagauggaggaacucaagaaacggaugaaggaagccccacagaccugcaagcugcccgggcagccuacuaucgagggauauuuauacacacaggaaaaaugggcucugggcauuagcugggucaaguacuauugucaauacgagaaagagaccaagacgcucacuaugaccccaauggaacagaaacccggugcaaagcaggggccucuugaucugacauugaaguauugcgugcgccgaaaaacugagaguaucgacaagagauuuuguuucgauauagaaaccaaugagaggccaggaacaauuacccuacaggcccugucugaggcuaaccggcgucucuggauggaagccauggacggcaaagagccgaucuaccacucccccauuacgaagcaacaggaaauggagcugaaugaaguaggcuuuaaauucguucgcaagugcaucaacaucauugagacuaaggggauaaaaacagagggacuuuauagaaccguggguagcaacauccagguccagaagcuguugaaugcguuuuucgauccuaaauguccaggcgacguggauuuucauaacucggacugggauauuaagacuaucacaucuucccucaaauucuaccugaggaauuuaucagaacccgugaugaccuaucggcugcacaaggagcuagucagugcagccaagagcgacaaccucgauuaccgacugggggcuauacauucccuuguuuacaaauugccugaaaagaaucgcgagaugcuggaacuccugauuagacaccuugugaacguaugcgagcacucuaaagagaaucugaugacgccaagcaacaugggagugaucuuuggccccaccuugaugagggcccaagaagacacagucgcagcuaugaugaauaucaaguuccagaacauugugguugagauccucauugaacauuucgguaaaauauaucuggggccgccugaggaaucagccgcgcccccagugccucccccacgggucacugcccgcagacacaagcccaucaccauuaguaaaagguuacugcgugagcggacaguguuuuacacuuccagccuagacgagucugaaggagaugcagacucauucaguaagguacgaccuccaggcgagaagccgaccaucaucagacccccuguuaggccacccgauccuccaugucgcgcugccacaccccagaaaccggaaccuaagccagacauuguggcuggcaaugccggggagauaaccagcuccgucguggcaucucggacuagauuuuucgagacggccucgaggaaaacaggaagcucccagggucgccuccccggcgaugaaucauga

SEQ ID NO: 60092 - RNA, 1095 nt, Artificial Sequence
  derived and/or modified sequence opt3 from OPN1LW__Homo_sapiens__NP_064445
auggcccagcaauggagccugcagagacucgcuggcaggcacccccaggacuccuacgaggauucuacccagucaaguaucuucacauauacuaacagcaauuccacgcgggggccuuuugaaggaccaaacuaccauauugcaccgcgcuggguguaucaccuuaccucugucuggaugauauucguugugacagccucgguauuuacuaauggucugguguuggcggcuaccaugaaguucaaaaaguuacgacauccccugaacuggauccuagucaaucucgccguggcagaccuggccgagacaguuauugcuucaaccaucagcauugugaaccaagucaguggcuacuuugugcuugggcacccuaugugcguacuggaaggauauacuguuuccuuguguggcaucacaggucucuggucucuggcaauaaucagcugggagcguuggaugguggucugcaaaccauucgggaaugugagauuugaugccaagcuggcuauugugggaaucgccuucuccuggauuugggcggcagucuggaccgcucccccuaucuuuggcuggucaagguacuggccacauggccucaaaacgaguugugggcccgacguuuucagcggaucuuccuauccuggugugcagucauacaugauaguauuaauggugacuugcuguauuaucccacuggccauuaucaugcuuugcuacuugcaggucuggcuggccauccgggcaguggcuaagcagcaaaaggaaagcgagaguacccagaaagccgagaaggaaguuacacgcaugguggucgugaugauuuuugcguauuguguaugcuggggcccguacacuuucuuugccuguuucgcagcugccaaccccggguaugcuuuccacccucuaauggccgcacucccagccuacuuugcuaaaucugcgaccauauauaaucccguuaucuacguguucaugaacagacaguuuaggaauugcauucugcagcuuuucggaaagaaagucgaugacggcuccgagcugagcucggcaucuaagacagaaguguccucagucaguagcguguccccugccuga

SEQ ID NO: 60093 - RNA, 1095 nt, Artificial Sequence
  derived and/or modified sequence opt3 from OPN1MW2__Homo_sapiens__NP_001041646
auggcccagcaauggagccugcagagacucgcuggcaggcacccccaggacuccuacgaggauucuacccagucaaguaucuucacauauacuaacagcaauuccacgcgggggccuuuugaaggaccaaacuaccauauugcaccgcgcuggguguaucaccuuaccucugucuggaugauauucguugugaucgccucgguauuuacaaauggucugguguuggcggcuacuaugaaguucaaaaaguuacgacauccccugaacuggauucuagucaaucucgccguggcagaccuggccgagaccguuaucgcuucaacaauuagcguggucaaccaaguguacggcuauuuuguacuugggcacccuaugugcguucuggaaggauacaccgugaguuuguguggcaucacuggucucuggucccuggcaauaaucucuugggagcguuggauggucgugugcaaaccauucgggaaugugagauuugaugccaagcuggcuauugucggaaucgccuucagcuggauuugggcggcaguuuggacagcucccccuaucuuuggcugguccagguauuggccacauggccucaaaaccucaugugggcccgacguguucaguggaagcucuuacccugguguacaguccuacaugauaguguuaauggucacgugcuguauuacuccacugucaaucauugugcuuugcuauuugcagguuuggcuggccauccgggccguggcaaagcagcaaaaggaaagcgagaguacccagaaagcugagaaggaagucacacgcauggugguaguuauggugcuagccuuuuguuucugcuggggcccguacgcguuuuucgccuguuucgcagcugccaaccccggguauccuuuucacccacucauggcugcccugcccgcauucuuugccaaaucugcuacuaucuacaauccugucauuuauguguucaugaacagacaguuuaggaauugcauacuucagcuguucggaaagaaagucgaugacggcuccgaguugagcucggcgucuaagaccgaaguguccucaguuaguagcguguccccagcauga

SEQ ID NO: 60094 - RNA, 1047 nt, Artificial Sequence
  derived and/or modified sequence opt3 from OPN1SW__Homo_sapiens__NP_001699
augagaaagaugagcgaggaagaguucuaccuguuuaaaaacaucuccucugugggccccugggacgggccucaguaucacauugccccagucugggcuuucuaccuccaagcagccuuuaugggaaccguuuuccuuauagguuuuccgcugaaugcgaugguguugguagcuacauuaagguauaagaaacugcggcagccccuaaacuacauccucgugaaugucucauucggcggguuucugcuuugcauuuucaguguguuuccuguuuucguggccagcuguaacggauauuuugucuucggccgccaugugugcgcacuggaaggguuuuuggguacuguagccggacucguuacgggcuggucccuggcuuuccuggcauucgagcgauacaucgugauuuguaagccauuuggcaauuuccguuuuucuucgaaacacgcccucaccgucguguuagcuacauggacuaucgggauaggagugucaauucccccuuucuuugguuggagcagauucaucccagaaggccugcagugcaguugugggcccgauugguauaccgucggaacaaaguacagguccgagucuuacaccugguuucuuuucaucuuuugcuucauuguuccuuugagccugaucuguuuuuccuauacucagcuacuccgggcccugaaggcgguggcagcccaacagcaggagucagcuacaacccagaaagccgaacgcgagguaaguagaaugguggucgugaugguuggcagcuucugcguguguuacgucccauaugcagcuuuugccauguacauggugaacaauaggaaccauggucuugaccugcgguugguaacgauaccgucuuucuucuccaagucagcgugcauuuauaaucccaucauuuacuguuuuaugaacaaacaauuccaggccugcaucaugaagaugguuugcgggaaagcaaugacugaugaaagcgacaccuguaguucucagaagacagagguguccacugucagcucgacccaggugggaccuaauuga

SEQ ID NO: 60095 - RNA, 1209 nt, Artificial Sequence
  derived and/or modified sequence opt3 from OPN3__Homo_sapiens__NP_055137
auguacagcggcaacagauccgggggacacgguuauugggacggcgggggagccgcuggcgcagagggucccgccccugcggggacccugucuccagcuccccucuucucaccgggaacauacgaaaggcuugcccuguuguuaggcaguaucggccugcuaggggugggaaauaaccuccugguccuuguucuguauuacaaguuucagcgguugcgcacuccuacgcaucuccugcuggugaauauuagccucuccgauuuacugguaucucuuuucggugugaccuuuacauucgucucgugcuugcgaaacggcugggugugggacacuguugggugugugugggauggauuuucaggcagccuguucgguauagucaguaucgcaacccuaacagugcucgccuaugagcguuacauuagaguaguucacgcuagggugaucaauuuuuccugggcauggcgggccauuaccuauaucuggcuguacucucuugcuugggccggggcgccacuguugggauggaaccgcuacauacucgacguccauggccugggcugcacuguggauuggaaaagcaaggacgcaaaugauuccucauucguguuauuucuguuccucgggugucuugucguuccccugggagugaucgcccacugcuauggucauauuuuguacaguaucagaaugcuaagguguguagaagaccugcaaacaauucaggugaucaaaauacucaaguaugagaaaaagcuggcuaagaugugcuuucuuaugauuuucaccuuucuggucuguuggaugccuuacaucgugauuugcuucuugguugugaacggccacgggcaccucgucacgccaacuaucagcaucgugucuuaucuguucgccaaauccaauaccguauacaaccccguuauuuauguguuuaugauacggaaguuccgccgaucauuacugcagcuacucugucugagacuuuugaggugccagcggccugcaaaagaucugccagcugccggaagcgaaaugcaaauccguccgauugucaugagucagaaggacggcgaucgccccaaaaagaaggugacauuuaauucuuccagcaucauauucauuaucacuucggacgagucucucuccgucgaugacucagacaaaaccaacgguaguaagguggauguuauccaggugagaccucuguga

SEQ ID NO: 60096 - RNA, 1470 nt, Artificial Sequence
  derived and/or modified sequence opt3 from OPN4__Homo_sapiens__NP_001025186
augaaucccccuagcggcccaagagugccgcccuccccuacccaggagccaucuugcauggccacacccgcuccuccaucauggugggacaguagccaauccucuaucucgucacuggggaggcuccccagcauuaguccuacugcaccaggaacgugggccgcggcuugggucccgcuucccaccguugaugugccugaccacgcccauuacacacuggguacuguaauauuguuagugggccugaccgggaugcuaggaaaccucacagucaucuauaccuucugucgggcagugcugcgcggcguuacugugaugaugcagucccgaucucuucguacaccagccaacauguuuauuaucaaucuggcugucagcgauuucuugauguccuuuacccaggcacccguguucuuuacgucaagucucuacaagcaguggcuguucggugaaacugggugcgaguuuuaugccuucuguggagcucuguuuggcauuagcucuaugaucacccucacagccauagcguuagacagauaccugguaaucacuaggccucuugcaaccuucggcguugccuccaaacggcgcgcugccuuuguguugcugggggucuggcuauaugcacucgcuuggucacugccacccuucuuuggauggagcgccuacgugccggaaggucuucugacaaguugcucuugggauuauauguccuucaccccugcggugagagccuacacgauguugcucuguugcuucgucuuuuuccugcccuuacugauuaucauuuacuguuauaucuuuauauucagggcaauucgggagacuggccgcgcucuccaaacauuuggggccugcaagggaaacggcgaaagccuuuggcagcgacagagacugcagucggaguguaaaauggcuaagaucauguugcuaguuauucuccuguucgugcugucuugggccccauacuccgcaguagcccuuguggcuuuugcggguuaugcacacguccugaccccuuacaugucaagugugcccgccguuaucgcuaaagccagcgcaauccauaauccaauuauauaugccaucacucaccccaaguacaggguggcuauugcccaacauuugccuugccucgggguccuguuaggagugucccggcgucacucucgcccauauccgagcuacagaucaacacacaggaguacccugacgucccauaccagcaaccuaucuuggaucucaauacggcgacgccaggagagucucggcagcgaauccgagguaggcuggacacacauggaagcagcggcuguuuggggagccgcacagcaggccaaugggagaucucuguacggucaaggccuugaggacuuggaggcuaaggcacccccuaggccacaggggcaugaagccgagacucccggaaaaaccaagggccugauuccuucgcaggauccacggauguga

SEQ ID NO: 60097 - RNA, 1065 nt, Artificial Sequence
  derived and/or modified sequence opt3 from OPN5__Homo_sapiens__NP_859528
auggcccugaaccacaccgcucucccccaggacgagcggcuuccucauuaccugagggauggcgacccauucgcaagcaaguuguccugggaagccgauuuaguggcgggguuuuaucugacaaucauuggaauacuaucuacuuucgguaauggcuacguccucuauaugucaagucggcgcaaaaagaaacugcgaccggcugagaucaugacgauuaaccuugccguuugcgaccuggggaucagcgugguaggaaagcccuuuaccauuaucuccuguuucugccaccguuggguguuuggcuggauagguuguagaugguacgggugggcaggauucuuuuucggcugcggcucuuugaucacaaugacugccgucucgcucgauagguaucugaaaauuuguuaccugucauaugggguguggcucaagcggaagcaugcuuacaucugcuuagcagccauuugggcuuacgccagcuuuuggaccacaaugccucugguuggacuuggugacuaugugccagaacccuucggcaccaguuguacuuuggauugguggcuggcgcaagcauccgucgggggacagguguuuauccuaaauauacucuucuuuugccugcuucugccuacagccguaauuguuuucucuuacgugaaaaucauugcuaaggucaaaagcuccucaaaggagguggcccacuucgacagucgcauccauagcucucacguguuggaaaugaaacucaccaaggucgcaaugcugaucugugcuggcuuuuuaauugccuggauaccauaugcgguuguguccguauggucagccuucgguagacccgauagcaucccuauucagcugaguguggucccaacgcuccuugcaaagucugcugccauguacaacccgaucauauaucaggugauugacuacaaauuugcuugcugucaaacugggggacugaaggccaccaaaaagaaauccuuggagggcuucaggcuacacacaguuacuaccgugagaaagagcucggcaguccuggagauccaugaagagugggaauga

SEQ ID NO: 60098 - RNA, 1143 nt, Artificial Sequence
  derived and/or modified sequence opt3 from OPRK1__Homo_sapiens__NP_000903
auggacagccccauccagauuuucagaggcgagccugggccaaccugcgccccguccgcuugucugcccccuaacucuucagcaugguuuccaggaugggccgaacccgauaguaaugguagcgcgggcuccgaggacgcucaacucgaaccugcccacauaucuccagcaauccccgugauuaucacagccgucuacucgguuguguucguaguggggcuugucggaaacucacuggugauguuuguuauuaucagguauacuaagaugaaaacggcuaccaauauauacaucuucaacuuggcauuagccgaugcucuggugacaacuaccaugccuuuucagagcacagucuaucuaaugaauaguuggccauucggcgacgugcucugcaagauuguaaucuccauugauuacuauaacauguuuaccucuaucuucacucugacaaugaugagcguugaccgguacauagccgugugucauccggucaaagcgcuugauuuucgcacgccccugaaggcaaaaauuaucaauauuugcaucugguugcucuccucaaguguggguaucagcgccauugugcucgggggaaccaagguccgagaggacguugaugugauagaauguucucugcaguucccugacgaugacuauuccuggugggaucuguuuaugaagaucugcguauucauuuuugcuuucgugaucccagucuuaauaauuaucguguguuacacucugaugauccuucguuugaaaucaguuagacugcuaagcggcaguagggagaaggaccggaaccuccgcagaauuaccaggcuggugcuugucgugguagccguuuucguggucugcuggacacccauccacauuuuuauacugguggaggcauugggcucuacuucccauagcaccgcugcccucucgucuuacuauuucuguaucgcgcugggguacacaaauuccucauuaaacccuauucuguaugccuuucucgacgaaaauuucaaacggugcuuucgcgauuucuguuuuccacuuaagaugcgaauggagagacagaguaccagcaggguccggaacacggugcaagaccccgcauaccugcgugauaucgacggaaugaauaaaccgguuuga

SEQ ID NO: 60099 - RNA, 1113 nt, Artificial Sequence
  derived and/or modified sequence opt3 from OPRL1__Homo_sapiens__NP_001186948
auggagccccuguucccugccccauuuugggaagugaucuacggcagccaccuccaggggaaccuuucccuguugucuccgaaucauucauuacugcccccucaccuacuccugaacgcuagucauggagcauuccuuccacuggguuugaaggucaccauuguuggccucuaucuggccgugugcguagggggacugcucggcaauuguuuagugauguacgucauacugagacacacaaaaaugaagacugcgacgaacaucuauauuuuuaaucuugcuuuggccgacacccuggugcuacucacacugcccuuccaagguacugauauccuucugggguuuuggccuuucggaaacgcauugugcaaaaccguuauugccaucgacuacuauaauauguuuacaagcaccuucacucucacagcuauguccguggauagguacgucgcaauaugucauccaauccgggcccuggacgugcgcaccucuucgaaggcucaggccguaaacguugcgauuugggcauuagccucaguggucggcgugcccguggcuaucaugggcagcgcccaggucgaggaugaagagauugaaugccugguugagaucccuacgccacaggacuauugggggccgguguuugcaauauguauuuuccucuuuaguuucaucguacccgugcuugucauuuccgugugcuacucucugaugauccgacguuugagaggaguuaggcuacugagcgguucccgggagaaagaucgcaaucucagaaggaucacucggcuggugcuugucgugguagcuguuuuugugggcuguuggaccccuguccaaguguucguccuggcccagggguugggagugcagccaucaagugaaacagcgguugccauucuccgcuucugcacugcacugggcuacgugaacagcuguuuaaaucccauacuguaugcuuuucuagacgagaacuucaaggccugcuuucgaaaguucuguugcgcuucugcccucagaagggauguacaggucuccgaccgggugcguucaaucgcaaaagauguugcccuggcuugcaagaccagcgaaacagugccucgcccagcguga

SEQ ID NO: 60100 - RNA, 1203 nt, Artificial Sequence
  derived and/or modified sequence opt3 from OPRM1__Homo_sapiens__NP_000905
auggacagcuccgccgcucccaccaacgcaucuaauugcacagaugcccuggcguacucaaguuguagcccugcuccauccccgggcucuugggugaaccucucgcaccuugacgggaaucugucagaucccugcggaccuaacagaacugacuuggguggcagggauagcuuauguccacccacggggaguccuuccaugaucaccgccauuacaauaauggcacuguauucuaucgucugcguugugggacuauucggcaauuuucucguaauguacgugauuguccgguauacuaagaugaaaaccgccacaaacaucuacauuuucaaucuggcucuugcagacgcccuggcuaccagcacuuugccauuucaguccgugaacuaucucauggguacauggcccuucgggaccauccuguguaagauaguuaucucaauugauuacuauaauauguuuacgaguaucuucacucugugcaccaugagcguggaccgcuacauugccgucugucauccugugaaagcgcucgauuuucgaacaccacguaacgcaaagaucauaaauguaugcaacuggauuuuaucuuccgccaucggacugccgguuauguucauggcuacuaccaaauacagacaaggcucaauugacuguacacuuaccuuuagccaccccacgugguauugggagaauuugcugaagaucugcguguucaucuuugccuucauuaugccuguccuaauaaucacuguguguuacggccucaugauucugaggcuuaagagugugcggaugcugucuggguccaaagaaaaggaucgcaacuugagaaggaucacacggaugguccucguugugguagcaguguuuauagucugcuggaccccaauucauaucuaugugaucauuaaagcucugguuacuauccccgagacaaccuuccagacggugagcuggcacuucugcauugccuuaggauacaccaauucgugucugaacccuguccucuaugcguuucuugacgaaaacuucaagcgcugcuuucgagaguucuguauaccaacaucuuccaauaucgaacagcagaacucaacuagaauuaggcaaaauacccgggaucaucccaguacagccaacacuguggaccguaccaaucaccagcuggagaacuuggaggcagaaacagcuccgcuaccuuga

SEQ ID NO: 60101 - RNA, 999 nt, Artificial Sequence
  derived and/or modified sequence opt3 from OPTC__Homo_sapiens__XP_011507708
augagacugcucgccuuccuuagccuguuggcuuuagugcugcaggagaccggcacagcaucccuacccaggaaggaacggaaacgccgagaggaacaaaugccucgugagggggacucuuuugaaguccucccacugagaaacgauguucuuaauccggacaacuacggagaggugaucgaucugucaaauuaugaggaauugacugacuacggugaucagcuccccgagguaaaggugacgagucuggccccugcgaccagcauuuccccagcuaaaucuacaacugcccccggcaccccuucgucaaacccaacaaugaccaggcccacuacagcagggcugcucuuaagcagucagccuaaucacggacugccaaccugccuugucugugugugcuugggcuccucuguuuauugugacgauauagaccuggaagauaucccgccccuaccucggcgcacggccuaccucuaugcuagauucaacaggauuagccggauccgcgcagaggacuuuaagggucugacuaaacuuaagcgaauugaucuguccaauaacuugaucucaaguauagacaaugaugccuucagacuccugcaugcuuuacaggaccugauccucccagagaaccaacuugaagcccugcccguguugccuagcgggauugaguuucuagacgucaggcugaaucggcuccagucuuccggaauccagccagcggcauuccgugccauggaaaagcugcaguuucuuuaccugucagauaacuugcucgacagcauucccggcccgcugccuuuaagucugcgcucugugcaccuacaaaauaaccucaucgagaccaugcagagagauguauucugcgaccccgaggaacauaaacacacaaggcggcagcuggaggauauacgacuugacggcaauccaauuaacuugucccuguuuccuagcgcuuauuucugucucccccgccugccaaucgggagauuuacuuga

SEQ ID NO: 60102 - RNA, 1734 nt, Artificial Sequence
  derived and/or modified sequence opt3 from OPTN__Homo_sapiens__NP_001008214
augagccaccagccccuguccugccucaccgagaaggaagacucuccuucagagaguacaggcaacgggccaccgcaucuugcccaccccaaucuggauacuuucacgccugaagaguuguuacaacagaugaaagaacugcuaaccgagaaccaucagcucaaggaggcuaugaaacugaauaaccaggcaaugaagggaagauuugaagaacuuagcgccuggacagaaaaacaaaaggaggagaggcaguucuuugaaauccaguccaaggaggcgaaagaacggcugauggcuuugucucacgagaaugaaaagcucaaagaggagcuggguaagcugaaaggcaagucggaacgcucaagcgaggacccaacugaugacagucgacucccccgugccgaagcagagcaggaaaaggaucaauuaagaacccagguggucaggcugcaggccgagaaagcugaccuuuuggggauuguuuccgagcugcagcuaaagcucaacucuagcggauccucagaagauaguuucguggagauacggauggcagaaggcgaggccgaagguagcguaaaagagaucaagcauucuccugggccaacacgcaccguguccacuggaacagcucugucaaaauacagaagcaggagugccgacggcgcgaagaauuauuuugagcacgaggagcuuaccgucucucaacuguugcucugucugcgggaaggcaaccagaaaguggagcgcuuagagguugcacugaaggaagccaaggagcgaguguccgauuucgagaaaaagacgagcaauagaucggaaauugaaacucagaccgaggggucuacagagaaagaaaacgacgaggaaaagggacccgagacugucgguuccgaaguggaggcucucaaucuucaaguaaccucacuguuuaaagaguugcaggaagcccacacaaagcuaagugaggcagaacugaugaagaaaaggcuccaggagaagugccaggcucuggaacggaaaaacagcgccaucccuuccgagcuuaaugagaagcaagaacugguuuacaccaacaaaaaguuggagcuccagguggaaucuaugcugagcgagauuaagauggagcaggcgaaaacggaagaugagaagucaaaauuaacuguccugcagaugacacauaauaagcuacuccaagaacacaacaacgcccugaaaaccaucgaggaacuuacucguaaggagagugagaagguggaccgcgcaguguugaaagaacuguccgagaagcucgaacuggcugagaaagcccuugcuagcaagcagcugcagauggaugaaaugaaacagacaauagccaagcaagaggaggacuuggaaaccaugacgauccucagagcacagauggaggucuauuguucugacuuccaugccgaaagggcugcgcgggagaaaauucacgaagagaaggagcagcuggcauuacagcuggccguucuacucaaggaaaaugaugcuuuugaggacggcgggcgacaaucacugauggaaaugcagagucgccacggagccagaaccagcgauuccgaccagcaagcauaccuugugcagaggggcgccgaggaucgggacuggcgccagcagagaaacaucccaauucauucuugcccgaaauguggugagguauugcccgauaucgacacacugcaaauacacgugauggauugcauuaucuga

SEQ ID NO: 60103 - RNA, 912 nt, Artificial Sequence
  derived and/or modified sequence opt3 from OR10A2__Homo_sapiens__NP_001004460
augagcuucuccucucugcccaccgagauccagucacuccuuuuucugacauucuugacuauuuacuuagugacgcugaugggcaacugccuaauaauccucgucacccuggccgacccuaugcuucacaguccaauguacuuuuuccugagaaauuugagcuuucucgaaauuggguucaaccugguuaucgugccgaagaugcugggaacacucuuagcucaagauacuaccauuuccuuucuggguugugcaacacagauguauuucuuuuucuuuuucggcguagccgagugcuuucuuuuggcgaccauggcuuaugacagguacguggccaucuguucuccccugcauuauccugucauaaugaaucagcggacucgcgcaaaacuagccgcugcaucgugguucccaggguuccccguggccacaguucagaccacguggcucuuuucauucccuuuuugcggaacuaacaaggugaaucacuucuuuugugauagcccacccguccugcgacuugugugcgcugacaccgcccuguucgaaaucuacgcgauuguaggcacaaucuugguugugaugauuccuugucuccugaucuuaugcaguuauacucauauagcagccgcuauucugaaaaucccauccgccaaggguaaaaacaaggcauuuucuaccuguagcucccaccuccuugucgugucacuguucuacauuaguuugagccuaacauacuuucguccgaagucuaauaacucccccgaggggaaaaagcugcucucacugagcuauaccgugaugacgccuaugcuuaauccaaucaucuacagucugagaaacaaugaagucaaaaacgcuuugucuaggacuguuuccaaggcccucgcgcugcggaauugcauucccuga

SEQ ID NO: 60104 - RNA, 948 nt, Artificial Sequence
  derived and/or modified sequence opt3 from OR10A4__Homo_sapiens__NP_997069
augaugugggagaacuggaccaucgugagcgaguucguccugguuuccuuuucugcccucucaacagaacuucaggcucuguuguucuuacuguuucuaacuauuuaccucgugacgcugaugggcaauguacuuauaauccuggugaccauugcagacagugccuugcaaagccccauguauuucuuucucagaaaccuguccuuccuggaaaucggguuuaaucucgucauugugccuaagauguuaggaacacugaucauacaggauacuaccaucucuuuccuugguugcgcgacacagauguacuuuuucuuuuucuuuggcgcugccgaguguugcuugcuggcaaccauggccuaugacagguacguugcuauuugugauccacuacacuauccggugaucauggggcauauuucgugcgcacagcucgccgcugccucaugguucagcggauucagugucgcgacugugcaaacaaccuggaucuuuuccuuccccuuuuguggcccuaaccggguaaaucacuucuuuugcgacucuccacccguuauagcacuggugugugccgauacgagcgucuucgaacuugaggcucugacugccaccguguuguuuauucucuucccuuuucuguuaauccuggguuccuacgugcgcauucucucaacaaucuuccgaaugccaagugcagaggggaaacaucaggcuuuuagcacuugcucugcccaccuucuggucguuuccuuguucuauucaaccgcgauccuaacauacuuucguccccagagcagugccucuuccgaaagcaagaaacugcucucgcugucuuccaccgugguaacgccuaugcuuaacccaauuauauacucaaguagaaauaaggaggugaaagcagcucugaagagguugauccaucggacucucggaagccagaagcuguga

SEQ ID NO: 60105 - RNA, 939 nt, Artificial Sequence
  derived and/or modified sequence opt3 from OR10C1__Homo_sapiens__NP_039229
augagcgccaacaccuccauggugacagaguuccugcuccuuggcuuuucucaccuggcugacuugcagggguuacuguucucagucuuucuaacuaucuaccuccugacgguugcaggaaauuuccuuauugugguacuggugaguaccgaugccgcguugcaaagccccauguacuuuuuccucagaacacuguccgcucuggaaauagguuauacuucugucaccgugccucucuuacugcaucaccuuuugacaggcaggcggcauaucucgcgcucagggugcgcccugcagauguuuuucuuucuauucuuuggagcaaccgaguguugccuccuggccgcuauggcauaugaccgauacgccgcuauuugugaaccacuucguuauccgcuguugcucagccacagaguuugccugcaguuagccggcagugcgugggcauguggugugcuggucgggcucggacauacucccuucaucuuuucccuuccuuucugcggcccaaacacaauuccccaguucuuuugugagauccaaccugugcugcaguugguaugcggcgauaccucucuaaaugaacugcagauaauccucgccacggcucugcuuauucuguguccauucggguugauccucggaagcuacgguaggauucugguuacuaucuuucggauacccuccguggccggccgcagaaaggcauucucaaccugcaguagccacuuaauuauggucucucuguuuuaugggacagcucuauucaucuacauuaggccuaaagccuccuacgacccagcgacugauccgcucgugucacuguuuuaugccguggucacccccauccuuaacccuaucauuuacagcuugcggaauacagagguuaaggcagcucugaaacgcaccauacagaagacggugccaauggagaucuga

SEQ ID NO: 60106 - RNA, 963 nt, Artificial Sequence
  derived and/or modified sequence opt3 from OR10J1__Homo_sapiens__NP_036483
augcugcucugcuucagauuuggcaaccagagcaugaagagggagaauuucacccuuaucacagacuuuguguuccaaggguuuuccucuuuccacgaacagcagauuacucuguuuggagucuucuuggccuuauacauacugacgcuagcugguaacaucauuaucguuaccauuauccggauggaucuccaucugcacacacccauguacuuuuuccuuucaaugcugaguacuagcgagaccguguauacauugguaauacucccucgcaugcuguccucucuggugggcaugucgcagccaaucucacucgcagggugugccacccaaauguuuuucuuugucacuuucggaauuacaaauugcuucuuacugaccgcgaugggcuaugaccgauacguggcuaucuguaacccgcuucguuauaugguuauuaugaauaaaagauugaggauccagcuggugcuaggugccugcagcauagggcucauugucgcaaucacucaggugacgaguguauuucggcugcccuucugugcccgcaagguuccucacuuuuucugcgauauuagaccagugaugaaacuuuccuguaucgacaccacagucaacgaaauccugacuuugauuauaucugugcucgugcuggucguucccaugggauuaguguuuaucagcuacguacugauuaucuccaccauacucaagauugcuucaguggagggcaggaaaaaggcauucgccacaugcgcuagucaucuuaccgucgugaucguucauuauagcugugccucuaucgcguaccugaagccuaaauccgaaaauacgcgggagcacgaucaguugauuucagugacuuacacagucaucaccccacuacugaaccccgugguauauacucuccgcaauaaggagguuaaagacgcacugugccgagccgugggcgggaaguuuagcuga

SEQ ID NO: 60107 - RNA, 990 nt, Artificial Sequence
  derived and/or modified sequence opt3 from OR10J3__Homo_sapiens__NP_001004467
augcccaagcugaacagcaccuucgugacagaguuucucuucgaaggcuuuuccucuuucagaaggcagcacaaacuugucuuuuucguuguguuucugacuuuguacuuacugacgcuaucagggaauguaaucauuaugaccauaauccggcucgaccaucacuuacauacaccuauguauuucuuucuuugcaugcugaguauuagcgagacuuguuacaccguggccaucauuccacacauguuguccggacuccugaacccgcaucaacccaucgcuacacagucuugcgcaacccagcuguucuuuuaucucacuuucgguauaaauaacuguuuucugcugacagucaugggcuacgaucgcuauguggccaucugcaauccucuucgauacucgguuauuauggggaagcgugcguguauccaguuggcuucaggaagccugggcauuggucuagggauggccaucgugcaagucaccaguguguucggacucccauucugcgacgcauuuguaauaucccacuucuuuugugauguuagacaucugcuuaaacuggccugcacggacacuaccgugaacgaaauuaucaauuucgucgugucugugugugucuugguucuccccaugggccugguguuuauuagcuauguauuaaucaucuccacaauucugaagauagcuucagcagagggccagaaaaaggccuucgcuacuugcgccagucaccucaccguggucaucauucacuacgggugugcgagcaucauauaccuuaagccuaaaucucaguccucacugggacaggauagguugauuagcgugacauauacccaucacaguccaacggaacccugcugcguucaaccugaggagcaggguggccagcgguguucugcacagucccgcggggccaagaacagcgugucgcuaaugaaaagaggaugcgaaggcuuuucuuucgcuuuuaucaauauguacuga

SEQ ID NO: 60108 - RNA, 930 nt, Artificial Sequence
  derived and/or modified sequence opt3 from OR10J5__Homo_sapiens__NP_001004469
augaagaggaaaaacuucaccgaggugagcgaauuuaucuuccugggcuuuuccucuuucgggaagcaccagauuacacucuuugucguuuuccuuacuguguacauacugacguugguagccaauaucauuaucgugaccauuaucugcauagaccaucacuuacauacacccauguacuuuuuccugucaaugcuagcuaguagcgagacugucuauacccucgugaucguuccuagaaugcugcuuucccugauuuuucacaaccaaccaaucucuuuggcaggaugugccacacagauguucuuuuucgugauucucgcgaccaauaacugcuuucugcugacugcuauggguuaugaucgguacgucgccaucugucgcccgcuccgauauacagugauaaugucgaaaggcuuaugcgcacagcugguaugugggucauucggaauuggccuuaccauggccguuuugcaugugacggcuauguucaaucugcccuuuugcgguacugucguggaccacuucuuuugugauaucuacccugugaugaagcuaagcugcauugacaccacaaucaacgaaaucauuaauuauggggucaguuccuucguuauauuugugccaaucggacucauuuucaucucuuacguacuggugauaagcuccauucuucagaucgcaucagccgagggccguaaaaagacuuuugcuaccugugucagucaccugacagugguuaucgugcauugcggcugugccagcauugcguacuugaagcccaaaucugaauccucaaucgagaaggaucucguccugagcgugaccuauacgauuauaacuccuuuacugaacccaguaguuuacagucucagaaauaaagaggugaaggacgcacuuugcagggucguggggcggaacaucucuuga

SEQ ID NO: 60109 - RNA, 942 nt, Artificial Sequence
  derived and/or modified sequence opt3 from OR10K1__Homo_sapiens__NP_001004473
auggaacaggugaacaagaccgucguuagagaauuugugguacugggcuuuagcucccucgccaggcuucaacagcuguuguucgugaucuuuuuacugcuauaccucuucacacuggggacuaaugcuauuauaaucucuacgauuguccuugaccgggcacugcacacccccauguauuucuucuuggccauccucucaugcagugagauuuguuacacauuugugaucguuccuaaaaugcugguggaucugcucagccagaagaaaacuauauccuucuuaggaugcgcgauccagauguuuucuuuccuguuuuucgguucgucacauagcuuucuuuuggcugccaugggcuaugaccgcuacauggcaauuuguaacccacugcgauauaguguccuaauggggcacggagugugcaugggccucauggccgcugcaugugccugcgguuucaccguaucccugguuacaaccucucuuguguuccaucugccguuucacagcuccaaucaauugcaucacuucuuuugugauaucucacccguccucaagcuggcuagucagcacagcggguucucucaguuagugauuuuuaugcugggaguguucgcccucgucaucccucuucuguugauucuaguuuccuacauacguaucauuucagcgauccugaaaaucccaagcagugugggcagauauaagacuuuuucuacaugcgcaucccaucucauuguagugaccguccacuacagcugugccucguucauauaccugaggcccaagacgaacuauacuucuucccaggacacccuuaucucagugaguuacacaauucugacuccuuuguuuaauccaaugaucuauagccuccggaacaaagaguucaaguccgcucugcgcagaaccauaggccaaacauuuuaccccuuaucuuga

SEQ ID NO: 60110 - RNA, 939 nt, Artificial Sequence
  derived and/or modified sequence opt3 from OR10K2__Homo_sapiens__NP_001004476
auggagagagugaacgaaaccgucguuagggaggugaucuuccugggcuuuagcucccucgcccggcuucagcaacuguuguucguaauauuuuuacugcuauaccucuucacacuggggacuaaugcuauaaucauuucuacgaucgugcuugaccgcgcacugcacauucccauguacuuuuucuuggccauccucucaugcagugaaauauguuauaccuuuaucauugucccuaagaugcugguggaucugcucagccagaaaaagacaaucuccuucuuaggaugcgcgauucagauguuuucuuuccuguuucuugguuguucgcauucauucuugcuggcuguuaugggcuaugaccgauacaucgccauaugcaacccacuacguuauagcgugcucauggggcacggagucuguaugggccugguggcagccgcuugcgcaugugguuuuacuguagcccagauuaucaccagucuuguuuuccaucugccguucuacuccucuaaucaauugcaccacuuuuucugcgauauugcucccgugcucaaacuggccagccaucacaaccauuuuucccagaucgucaucuucauguuauguacacuggugcucgcgauuccucuucuguugauucuagugucauauguccacauccugagugcaauucuccaguuuccaagcacccuggggagaugcaaggccuucucuacuuguguuucccaucuuaucauagugacaguacacuacggaugcgcuucauuuauuuaccugaggccccagagcaauuauaguucuucccaagacgccuugaucagcgugucguacaccaucauuacgccucucuucaacccaaugaucuauucucugcggaauaaagaguuuaaguccgcauuaugcaagauuguccgcagaacuauaucacugcuauga

SEQ ID NO: 60111 - RNA, 1008 nt, Artificial Sequence
  derived and/or modified sequence opt3 from OR10R2__Homo_sapiens__NP_001004472
augccccagauccugauuuucaccuaccucaacauguuuuauuucuuuccuccacuucaaauacuggccgagaauuugacaauggugacugaauuuuuacugcuaggauuuagcucccucggggagauccagcuggcucuuuucgucguuuuucuguucuuguaccucgugauucugucuggaaacguaacgaucauuucagugauccaccuggacaagagucuccauaccccgauguauuucuucuuagguauacugagcacauccgaaacuuuuuacaccuucgucauccuucccaaaauguugauuaaucugcuaucuguggcaagaacaaucucguuuaacugcugugcccuccagauguucuucuuucugggcuucgcgauuaccaauugccuucuguuggggguuaugggauaugauagguacgcugccaucugucacccucuccauuauccaacucugaugucauggcaagugugcggcaaguuagcagccgcuugugcaauagguggguuucuggccagccucacagucgugaaccuuguauucagucugcccuuuugcuccgcuaauaaaguuaaccacuacuucugugacauuucugccgugaucuugcuagcgugcaccaauacggaugucaacgaguuugugauuuucaucuguggagugcugguccucguugugccuuuucuguucaucugcguaagcuaccuuuguauucugcggacuauauugaagaucccauccgcagaaggccgccgaaaagccuuuucaaccugcgcuagucaucucagcguggucauugugcacuauggcugcgccucuuucaucuaccugcgucccacagcaaauuauguuuccaacaaggacagauuagugacugucaccuacacaauagugaccccucugcuaaauccaaugguauauucacucaggaacaaggauguucagcuggcuauucggaaagugcuugggaagaaaggcagcuugaagcuguacaauuga

SEQ ID NO: 60112 - RNA, 945 nt, Artificial Sequence
  derived and/or modified sequence opt3 from OR10T2__Homo_sapiens__NP_001004475
augagaggcuucaacaagaccacaguggucacucaguuuauccugguuggguucagcucccucggagagcuucaacuguuguuauuugugauuuuccugcuacucuaccugacgauacuuguagccaaugugaccaucauggcugucauuagguuuucuuggacacugcacacucccauguaugguuucuuguuuauccucucauucagugaaagcugcuacaccuuugugauuaucccucagcugcugguucaucucuuauccgacacaaaaaccauaucuuucauggcaugugccacucagcuguuuuucuuucuuggcuucgcgugcacaaacuguuugcugaucgcugugaugggguaugaucgguacgucgccauuugccacccacuacgcuauacccucaucauuaauaagcgacugggacuugagcugaucucguugucaggcgcaacggguuucuuuauagcccucguggcuacuaaccugauuugugacaugcguuucugcgggccgaauagaguaaaccauuacuuuugugauauggcacccguuaucaaauuagccugcaccgacacacacgugaaggaacuggcucucuucagccuuaguauucuggucaucauggugccauuuuugcuaauccugauuuccuauggauucauagugaauacuauccucaaaauuccuucugccgagggcaagaaggcguuugucaccugugcaagccaucugacaguuguguucguacacuacggcugcgccuccaucauauaccuuaggcccaaaucaaagagugcuagcgauaaagaccagcugguggccgucaccuauacggugguuacuccuuugcucaacccacugguguacucuuuacggaauaaggaagucaaaacagcacugaagcgcgugcuagggaugcccguagcuaccaagauguccuga

SEQ ID NO: 60113 - RNA, 981 nt, Artificial Sequence
  derived and/or modified sequence opt3 from OR10X1__Homo_sapiens__NP_001004477
auggugcugaacgucuacugcuguuucuuucagaucagcgacauucaaaccaugaagauaaaucagacaauccucaaagaguucauucuuguuggcuuuuccguguauccccacguacagacuuuccuguuuguggucuucuuuugcuuguacuuacugacgcuagccgggaaccucaucauuaugggacugaccuggguggauagaucucuucauacaccuauguaucuguucuugucagcucucaguuuuagcgaaacuuguuacacccugacaaucguuccaaagaugcuggaggaccucuuagcaaaagauagguccauaucugugaccgguugcucgcugcagauguguuucuuucuuggcuugggagggacuaauugcaucauucugacacuaaugggcuaugaccgguuccucgccaucuguaacccgcugcgcuacccccuucugaugaccaauauugucugcggucaauugguggcgucagcuuguacggccggguuuuucaucagccucacugaaaccgcacugauauuccgagauaguuuuugccguccuaacuuaguaaagcacuucuuuugucauaugcuggccguuauuagacucuccugcaucgacucuaaucacacagaguucauuaucacucuuaucagcguguccggacuguugggcacccuacugcucauuauacugacagaugucuuuaucauuucaaccgugcuuaggaucccaagugcugaaggcaaacagaaggcauucacgacuugcgccagccaucugacaguggucauaauucacuuuggguucgcuucuaucguuuauuugaagcccgaggccuccggagacgauacccucaucgcggugccuuacacuguaauuacaccauuucugucacccaucauuuucagcuuacggaacaaagacaugaagaaugcauuucgcagaaugauggguaacaccguggcccugaaaaaguga

SEQ ID NO: 60114 - RNA, 942 nt, Artificial Sequence
  derived and/or modified sequence opt3 from OR10Z1__Homo_sapiens__NP_001004478
augggccagaccaacgugacaagcuggagagacuucgucuuucugggguucuccucuucaggagagcuccaacuucuguuguuugccuuauuccugagucuauaccucguuacucugacgagcaauguguuuaucauuauagcuaucaggcuugauucccaucugcacacccccauguauuuguuccucucuuuucugucguucucagaaacaugcuacacucuggguauuaucccucggaugcucagcggcuuagcagggggagaccaggccauuaguuauguaggcugugcggcucagauguuuuucuccgccucuugggcaugcaccaacuguuuucugcuugccgcuauggguuucgaucgcuacguggcaaucugcgccccauugcacuaugcuagccauaugaauccgacacugugugcccagcuagucauaaccuccuuucucacuggguaccuguucggacuuggcaugacacuggugaucuuccacuugucauuuugcaguagccaugagauucaacacuucuuuugugacacgcccccuguucucucucuggcgugcggcgauaccgggccauccgaauuacgaaucuucauucugucacuccuugugcuguuggucagcuuuuucuuuaucacuauaaguuaugcauacauucuagccgcuauccugcguauucccucugccgagggacagaagaaagcauucuccaccugugcuagccaccucacagugguaaucauccauuacgguugcgccucguuuguuuaucugagaccuaaggcgucuuacucccuugaaagggaccagcugauugccaugacuuauaccguggucacaccauugcucaaccccauaguguacucacugcggaaucgcgcaauccagaccgcuuuaagaaacgccuucaggggccggcugcuagggaaaggauga

SEQ ID NO: 60115 - RNA, 948 nt, Artificial Sequence
  derived and/or modified sequence opt3 from OR11A1__Homo_sapiens__NP_039225
auggagaucgugagcaccggcaacgaaacaauuacugaguucguccugcucggguuuuacgacauacccgaacuucacuuccuguuuuucaucguuuuuacggccguguauguauucauuaucauuggaaauauguugaucauaguggcugucguguccucucagagauuacauaagccuauguacaucuuucuggcaaaccuaucauuccucgauauucuguauaccagugccguuaugccaaaaaugcuugaggguuuucugcaagaagcgacaaucagcguggcuggcugcuugcuccaguucuuuauuuucgggucccuggccacugcagagugucugcucuuagccgucauggcuuacgacagguaucuggcaaucugcuacccgcuucacuaucccuugcugaugggaccucggcgcuacaugggccuagugguaaccacauggcucucugguuuuguuguggaugggcuggucguggcccuuguggcucagcugcgauucuguggaccaaaucauauagaccaguucuacugcgauuuuauguuguucgucggccucgccuguucggacccccguguugcgcaagugaccacucugauuuuaucaguauuuugccugacaaucccuuucggccucauucuuaccagcuaugcaagaaucguggucgccgugcugaggguuccagcuggggccagucggcgcagagcauuuuccacguguucuagccacuuggcuguggucacuaccuucuacggaacacuaaugaucuuuuauguggcccccuccgcgguacauucacagcugcucaguaagguuuucagccugcuuuacacuguggucaccccucuguuuaacccagugauuuauacaaugaggaauaaagagguccaccaggccuugcggaagauacucugcaucaaacagaccgaaacgcuggauuga

SEQ ID NO: 60116 - RNA, 924 nt, Artificial Sequence
  derived and/or modified sequence opt3 from OR12D2__Homo_sapiens__NP_039224
augcugaacaccacaagcgugacugaguuccuccuucugggcgucacggacauccaggaauugcaacccuuuuuauucguuguguuucugaccauuuacuucauauccguaacagggaauggagccgugcuaaugaucgucauuucugauccuagacuccacucacugauguacuuuuuccuugguaaccugaguuauuuggacaucugcuauagcacugugacccucccaaagaugcugcagaauuuucuguccacacauaaagcuauuucuuuccucggcuguaucucgcaguuacacuuuuuccauucacuggggagcaccgagaguaugcuuuuugcaguuauggccuucgauuuguccguggcgauaugcaagccgcugagguacacugucaucaugaacccccagcuauguacacaaauggcuauuaccaucugggugauuggauuuuuccacgcccuccugcauucuguaaugacgagccggcuuaauuucugcggcuccaaccgcauccaccacuuucugugugacauaaaaccuuugcucaagcuggcaugcgguaauacugaauuaaaccaguggcugcucucaaccguuacagggacuauugccaugggaccauucuuucuuacccuguugaguuauuucuacaucauuacauaucuauuuuucaaaacccgaagcuguucuaugcugugcaaggcucucuccacgugugcaucacauuuuaugguggucauccuguucuacgcccccgugcuuuuuacuuacauccacccugcucuggagagcuucauggaucaggaccguauuguggccauaauguauacagucguuaccccaguguugaauccccucaucuacacucugagaaacaaggaaguaaaaggcgcguuaggcagggugauucggcgccuguga

SEQ ID NO: 60117 - RNA, 951 nt, Artificial Sequence
  derived and/or modified sequence opt3 from OR12D3__Homo_sapiens__NP_112221
auggagaacgugaccacaaugaaugaauuucugcuccuuggccugacugggguccaggaguugcaacccuuuuucuuuggaaucuucuuaauuauauaccugaucaaccuaauugguaauggcagcauccucguuauggugguacuggaaccucagcuucacuccccaauguauuucuuccuggggaacuugucuugccucgacauuucauacaguagcgugacgcugccgaagcugcucgucaauuuaguguguuccagaagggccaucucuuuucugggaugcauaacccagcuucauuucuuucacuucuugggcucgacagaggcuauccugcuagcaauuauggccuuugaucgguucguugcgaucuguaacccccuccgcuauacugugauuaugaauccucaggucugcauccugcuugcugccgcagccuggcugauaucauuuuucuacgcuuugaugcauagcgugaugaccgcacaccucaguuucugugguucccaaaaacugaaccacuuuuucuaugacguaaagccauuacuggaacucgccugcucugauacacuucugaaucagugguugcuaagcauuguuaccggguccaucucaaugggagccuuuuuccugacucuccugaguuguuuuuacgugauuggcuuccuucuguuuaaaaaccgaagcugccguaucuugcauaaggcucucucuacaugugcgucccacuucauggucgugugccuguuuuauggccccgugggguucaccuacaucagaccugcaucagccacgagcaugauucaggacaggauaauggcuaucauguacagugccgucacuccaguuuuaaauccccugauuuauacccuacggaacaaagaggugaugauggcacucaagaagaucuuuggacgcaaacuguucaaggauuggcagcaacaucacuga

SEQ ID NO: 60118 - RNA, 1044 nt, Artificial Sequence
  derived and/or modified sequence opt3 from OR13C3__Homo_sapiens__NP_001001961
augaucgugcagcugauuugcaccgucuguuuccucgccguuaacacauuucacgugagaagcuccuucgacuuucuuaaggcugaugacaugggcgagauaaaucaaacucugguaucugaguucuuguuacuggggcuaucaggauaccccaaaaucgaaauuguguauuuugcacucauccuggucauguaccuugugauucugaucgguaacggcguuuugauaaucgccaguauuuucgauagccauuuucacacgccuauguauuucuuucucgggaaucuguccuuccuggacaucugcuacaccucuucgucagugccaagcacacucgucaguuuaauuuccaagaaaaggaacaucucuuuuagcggaugugcggugcagauguucuuuggcuucgcuauggguuccacugaaugccugcuuuuggggaugauggccuucgaucgguauguagcaauauguaauccgcugcgcuaccccauuauccuaucaaagguugccuaugugcucauggcuagugucagcuggcugucuggaggcauuaacuccgcagugcagacccuucuggccaugcgauugccuuuuugcggcaauaacaucaucaaucauuucgcuugugagauucucgccgugcugaaauuagcgugcgcagacauaucacugaacaucauuacaauggucaucagcaauauggccuuucucguucuuccacugauggugauauucuuuaguuacauguucauuuuguacaccauccuacagaugaacucugcuacugggcguagaaaggccuuuuccacauguagcgcacaccugaccguagugaucauuuucuauggaacgaucuuuuucauguacgcuaagcccaaaucgcaagaucucauuggugaagagaagcugcaggcccuugacaaacugauaucuuuguuuuauggcgucgugacuccuaugcucaauccaauccuguacuccuuaaggaacaaggauguuaaagcggccgugaaguaucugcuaaauaagaaacccauucauuga

SEQ ID NO: 60119 - RNA, 957 nt, Artificial Sequence
  derived and/or modified sequence opt3 from OR13C4__Homo_sapiens__NP_001001919
auggacaagaucaaccagaccuucgugagagaguuuauucugcucggccuuagcggguaccccaaacuggaaauaaucuucuuugccuugauuuuagucauguauguugugauccugauuggaaaugguguacuaaucauagcuuccauccucgauucuaggcugcacaugccuauguacuucuuucuuggcaaccugucauucuuggacauuugcuauacaacgaguagcaucccauccacucucgugucucugauuucgaagaaacggaauaucucauuuagcgggugugcaguccaaauguucuuuggauucgccaugggcaguaccgagugcuuucugcucgguaugauggcguucgaucgcuacguggcuauauguaacccguuacgauaucccauuaucaugaauaagguuguguacguccugcuuacauccgugucuugguugagcgggggaauuaacuccacuguacagaccucacuggccaugcguuggccuuuuugcggcaauaacaucaucaaucauuuccuaugugaaauucucgcaguucugaaacuugccugcagugacauaagcgugaacaucgucacacuggcugugucuaauauugcauucuuggugcucccacuguuagucaucuuuuucuccuauauguuuauacuguacaccauucucagaacuaacucagccacaggcaggcacaaggcuuucagcaccuguagugcccaucuuacgguugugaucaucuuuuacgggacuauuuucuuuauguaugcgaagcccaaaucucaggaucuguugggaaaggacaaucuacaggcaaccgagggucugguauccauguucuacggcguggucacaccuaugcucaacccaaucauuuauagccugcggaauaaagaugugaaggccgcuauaaaauaccuucugucgcgcaaggccaucaaccaauga

SEQ ID NO: 60120 - RNA, 960 nt, Artificial Sequence
  derived and/or modified sequence opt3 from OR13F1__Homo_sapiens__NP_001004485
auguuccccgccaacuggaccagcgugaaggucuuuuucuuucugggcuucuuucacuacccuaaaguucaggugaucauuuucgcuguaugccuccuuauguaucugauaacauuguuagggaauaucuuucugauuuccaucacuauucuagacucucaucuccacacgccaauguaccuguuccuuucaaaccugaguuuucucgauaucugguauagcuccucugcacucucgccgaugcuggccaauuucgugucaggaagaaacaccauauccuuuagugguugugcgacacaaauguaccugucccucgcuaugggcucuacugagugcgucuuacugcccaugauggccuaugacagguacguggcaaucuguaauccucuucgguauccaguuauuaugaaccgccgaaccugcgugcagaucgccgcugggagcuggaugacaggauguuugaccgcaauggucgaaaugauguccgugcugccccuaucacucugcggcaauaguauuaucaaccauuucacuugugagauacuggccauucuuaagcugguaugcguugauaccagcuuggugcagcucaucaugcuggucauuucuguguuacugcucccuaugccaaugcuucugaucuguaucuccuacgcuuuuauuuuggccucaauacuacguaucagcaguguggaagguagaucuaaagcguucagcacaugcacggcacaccugauggucguuguguuguucuacgggacugcccugagcaugcaucuuaagcccucggcuguagacucucaggagauugauaaauuuauggcccugguguaugcaggacaaaccccuauguugaauccaaucauauacucccucaggaacaaggaagucaagguggcucugaaaaaguuacugauucggaaucacuucaacacagccuuuaucucaauccuaaaauga

SEQ ID NO: 60121 - RNA, 924 nt, Artificial Sequence
  derived and/or modified sequence opt3 from OR13G1__Homo_sapiens__NP_001005487
augaaccacagcguggucaccgaguucaucauucugggacucacaaagaaacccgaacuucaggggauaaucuuucuguucuuuuugauuguuuacuuaguggccuuccugggaaauaugcuaaucauuaucgcuaagauauauaacaauacucuccauacgccuauguacguauuucugcuuacccuggcaguggucgacaucauuugcacaacuuccaucauuccaaaaauguuggguaccaugcucacaucugagaacaccaucucauaugccggcuguaugagucaacuguuccuguuuacuuggagccucggggcggaaaugguguuauucacaaccauggcuuacgauagauauguugccauaugcuuuccgcugcacuacuccacgauuaugaaucaucacauguguguggcacuuuugucuauggucauggccaucgcugugacuaacucguggguacauaccgcacugauuaugaggcuaacauucugcggacccaauacuaucgaccacuuuuucugugagaucccuccacuccuggcccuuucaugcagccccguucggauuaacgaagugauggucuauguggcugauauaacccuggccaucggcgacuuuauuuugacauguaucaguuacgguuucauaauuguggcgauccuccgcauccgaaccgucgaggggaagcguaaagcauucuccacgugcucuagccaccugacuguugugacauuauacuauuccccuguaauuuacaccuauaucagaccagccucaaguuacacuuuugagagggauaagguggucgcugcccuguauacacucgugacccccacgcuuaauccuaugguuuacagcuuccagaaccgggaaaugcaggcaggcauucgcaagguguuugcuuuccugaaacauuga

SEQ ID NO: 60122 - RNA, 939 nt, Artificial Sequence
  derived and/or modified sequence opt3 from OR13J1__Homo_sapiens__NP_001004487
auggagccccugaacagaaccgaagugagcgaguucuuucucaagggcuucuccggguacccugcccuugaacaccuguuguuuccauuaugcucugcuauguaucuggucacacuacucggaaauacugcaaucauggccguuucagugcuggacauucaucuucacacgccgguauacuucuuucuggguaacuugaguacccucgauauauguuauacacccacuuucgugccucugaugcugguccaucucuuaagcuccaggaaaaccaucucuuuugcggugugcgcuauucagaugugucugucgcuuucaacaggcagcaccgagugcuugcugcuagccaucacugcauacgaccgguaucucgccauuugucaaccacugcgcuaccacguucuuaugagucaucgacugugcguguugcucaugggggcugcauggguccuguguuuacugaaguccgugacagaaaugguaaucucuaugcgucuccccuucugcggacaccacguugugagccauuuuaccuguaaaauacuugccguccugaaguuggcuugcggcaauacguccgugucagaggauuuccuacuggccgguaguauccuccugcuuccugugccacuggcguuuauuuguuugagcuaucuccugaucuuagcaacuauucugagaguccccucugccgcuaggugcugcaaagccuucuccaccugucuagcacaccucgcuguugugcuguuguuuuacgggacaaucauauucauguaccuuaagccuaagucaaaagaggcccauauuagcgacgaaguauucacugugcuguaugcgauggucaccacaaugcucaacccaaccaucuacagucugcggaauaaggaggugaaagaagccgcacgcaagguuuggggaagaucuagggcuucccgguga

SEQ ID NO: 60123 - RNA, 966 nt, Artificial Sequence
  derived and/or modified sequence opt3 from OR14J1__Homo_sapiens__NP_112208
auggugaaccugaccagcauguccggcuuccuccuuaugggguuuucugacgagagaaagcugcagaucuugcacgccuuagucuuccugguuacauaccuacucgcucugacuggaaaucuucugauuauaacgaucauuaccguggauaggcgguugcauucacccauguauuacuuucucaaacaccugagucugcucgacuuaugcuucaucagcguaacagugccucaauccauugcaaacucucugauggguaauggcuauaucucgcuuguccaguguauauugcaaguguuuuucuuuaucgcccuggcgucaagcgaaguugcuauucuaacugugaugaguuacgaucgcuaugccgcaaucugccagccacuccauuacgagaccauuauggacccgcgagccugucgucacgcugucaucgcaguguggauagccgggggacuguccggccuuaugcaugcugccauuaacuucucuaucccccugugcgguaagagaguaauucaccaguuuuucugugauguuccucagauguugaaacucgcgugcagcuaugaauuuaucaaugagaucgcacuggccgcuuucacaaccuccgccgcauuuauuuguuuaauaucaaucgugcugaguuacauuaggaucuucagcacuguccuccggauaccaucugcugaagggcgcacaaagguguucucaaccugccuuccccaccuguuuguggccacguucuuuuuguccgcggccggauucgaguuucuaagacugccuagcgacaguucuuccacugucgaucucguuuucagcguguuuuacaccguaauuccacccacacugaacccugugaucuauucgcuuaggaaugacucuaugaaagcagcucugcggaagauguuguccaaggaggaacucccacagcgcaaaaugugucugaaggccauguucaaauuauga

SEQ ID NO: 60124 - RNA, 930 nt, Artificial Sequence
  derived and/or modified sequence opt3 from OR1A1__Homo_sapiens__NP_055380
augagagagaacaaucagagcuccacccuggaguucauccuccuuggcgugacagggcaacaggaacaggaagacuuuuucuacauucuguuuuuguucauauaucccaucacuuuaauuggaaaccugcuaaucguccucgccauuugcucugauguuaggcugcacaauccuauguacuuucuucuggcuaacuugucacucguggacaucuucuuuaguagcguaacgauaccaaagaugcuggcaaaucaucugcucgguuccaaaucuaucucguucggcggguguuuaacccagauguauuuuaugauugcccugggaaacacagauucauacauccuugcggcuauggccuaugaccgggcaguggccauuagccgcccguugcacuacacuaccaucaugaguccccgauccugcauauggcugauugcuggcucuugggucaucgguaaugcaaacgcccuaccucauacacuccugaccgcuagccuuuccuucugugggaaucaagagguggccaacuuuuauugcgauauuacuccacuguugaagcucucauguagugacauccacuuccauguuaaaaugauguaccugggagugggcaucuuuagcguccccuuacugugcauuauagugucuuacauccguguauucuccacaguuuuccaggugccuucaaccaagggcguccucaaagcguuuagcacgugugggagucaccuuacuguggugucucuguauuacggaaccgucauggguacauauuucagaccauugacuaauuacucccuaaaggaugcaguuauuaccgugauguauacagccguaacccccaugcugaacccuuuuaucuacagccucaggaaucgggacaugaaggcugcccugcgcaaacuuuucaacaagagaauaucgucuuga

SEQ ID NO: 60125 - RNA, 945 nt, Artificial Sequence
  derived and/or modified sequence opt3 from OR1C1__Homo_sapiens__NP_036485
auggagaagagaaaccugaccguggucagggaauuuguucuccuuggccugcccagcuccgccgagcagcaacacuuguuaucugugcuguuucuaugcauguaccucgcuacaacucuggggaauaugcuuaucauugcaacgauaggauucgacucacaucugcacaguccuauguauuucuucuugagcaaccucgccuuuguagauaucuguuucaccuccacaacugugccacagauggucgugaauauucugaccgguacaaaaaccaucucuuuugcgggcugccugacucaacucuucuuuuucguuucguuugugaacauggacucauuacugcuuugugucauggcuuacgaucgguauguggccauuugccauccguugcacuacacagcacgcaugaaucugugucuaugcguacagcucguugccgggcuguggcuugugaccuaucugcaugcuuugcuccacacgguccugaucgcacaacugagcuucugugccaguaacauaauccaccacuuuuucugcgacuuaaauccccuccuucagcuguccuguucugaugugagcuucaacgugaugauuaucuuugcugucggaggcuugcuagcccugacuccucucguuugcauucugguguccuacggucuuaucuucucaaccguacugaagauaacaaguacucaggggaaacagcgagcggugagcaccuguucuugccauuuguccgucgugguucucuuuuauggaacagcaauugccguguacuucucaccaagcaguccccauaugccugaaucugacacccuguccacgaucauguacagcauggucgcuccaauguuaaaucccuuuauuuauacucugcguaacagagauaugaagaggggccuacagaaaaugcuccugaagugcacaguguuccagcagcaguga

SEQ ID NO: 60126 - RNA, 939 nt, Artificial Sequence
  derived and/or modified sequence opt3 from OR1D2__Homo_sapiens__NP_002539
auggacggcgggaaccagagcgagggauccgaauuucugcuccuugguaugucugagucacccgaacaacagagaauccuguuuuggauguucuugaguauguacuuagugaccgucguuggcaaugugcugauuauacuagccaucagcuccgauucuaggcuccacacaccuguauauuucuuccuggcuaaccuuucguuuacugaccuguucuuugugacgaauaccauuccaaagauguuggucaaccuccagucacauaauaaagcaaucagcuacgccgggugccugacacagcuguauuuccucgugaguuuaguugcgcuggauaaccuuauuuuggcugugauggccuacgaccgguaugucgcaaucuguugcccgcugcacuacacuaccgccaugucccccaagcuauguauacuccugcuuucucugugcuggguguugagcguacucuauggacugauccauacauuacugaugacccgcguuacuuuuuguggcucccgaaaaauucacuacaucuucugcgagauguacgugcuccuucguauggcuuguucaaauauucaaaucaaccauacaguccugauagcaaccgguugcuuuauuuucuugaucccuuuuggguucgugauuaucaguuaugugcuaaucauuagagccauacugaggaucccaagcgucucuaagaaauacaaggcuuucuccacgugugccucacaccucggagcgguuagccuguuuuauggcacucuuugcaugguguaccugaagcccuugcacaccuauaguguaaaagauucuguggcaacagucauguacgccgugguuacuccuaugaugaauccauucauuuauucccuccggaacaaggacaugcauggcgcucuggggcgcuuacuggauaaacacuuuaagagacuaaccuga

SEQ ID NO: 60127 - RNA, 945 nt, Artificial Sequence
  derived and/or modified sequence opt3 from OR1E1__Homo_sapiens__NP_003544
augaugggccagaaccaaacuagcaucuccgacuuccugcuccuugggcugcccauucagccugagcagcagaauuugugcuacgccuuauuucuggcuauguaucuaacaacucuccugggaaaccuucugauaaucguguugauuagacucgauucucaccuucauacgccaauguaccuguuccucucaaauuuaaguuuuagcgaccuguguuucuccucugucaccaucccgaagcuguugcaaaacaugcagaaucaggaucccucgauuccuuaugcagacugccugacacagauguacuuuuuccuacucuuuggugaucuggaaucauuccuucugguugccauggcguaugacagguacguggcuaucuguuuuccauugcacuauacugccauaaugagccccaugcucugccuggcauuaguagcccugaguugggugcucaccacauuccaugcuaugcuucacacccuguugauggcacggcuauguuuuugcgccgauaacgucaucccucauuucuuuugugacauguccgcucugcucaaacuggccuucucugauacucgcgugaaugaguggguuauuuucaucaugggcgggcuuauucuggugaucccauuuuugcucauacugggaagcuacgcgcgaauugucuccucaaucuuaaaggugcccaguagcaaaggcauuugcaaggcauucucuacaugugguucccaccugucaguaguuagccuauuuuacgggaccgugaucggacucuaucugugcaguucugccaacuccagcacgcuuaaagacacugucauggcuaugauguacaccguggugacaccuauguugaauccauucaucuauucgcugcguaacagagauaugaagggcgcccucucuagggucauucaccaaaagaaaaccuuuuucucccuguga

SEQ ID NO: 60128 - RNA, 972 nt, Artificial Sequence
  derived and/or modified sequence opt3 from OR1E2__Homo_sapiens__NP_003545
augaugggccagaaccaaaccagcaucuccgacuuccugcuccuugggcugcccauucagccugagcagcagaauuugugcuacgccuuauuucuggcuauguaucuaacaacucuccugggaaaccuucugauaaucguguugauuagacucgauucucaccuucauacgccagucuaccuguuccucucaaauuuaaguuuuagcgaccuguguuucuccucuguuaccaugccgaagcuguugcaaaacaugcagaaucaggaucccucgaucccuuaugcagacugccugacacagauguacuuuuuccuauauuuuucagaucucgagagcuuccugcuuguggccauggcguacgacagguauguagcuauuuguuuuccaaugcacuacacugccaucugcuuccuguugcauuacaccgcaauaaugagucccaugcucugucuguccguggucgccuuaucuugggugcugacaaccuuucacgcuaugcuccauacucuucugauggcacgguugugcuucugugccgauaacguuaucccucacuuuuucugcgacaugagcgcucuacugaaacucgccuguuccgauacacgcgugaaugaaugggucauuuucaucauggguggccugauucuugugaucccauuucuguugauacucgggucauaugcgcgaauuguaaguagcauccugaagguucccucuuccaaaggaauuugcaaggcauucucaaccuguggcagccacuuaaguguggucucucuguuuuacgguacggugaucgggcuauaucucugcccuuccgccaacagcucgacucugaaagacaccgugauggcuaugauguacacagucguuacuccaaugcuuaccccguucaucuauucuuugcguaauagagauaugaagggagcccuggaaagggugauuugcaagcggaaaaaccccuuucuccuguga

SEQ ID NO: 60129 - RNA, 942 nt, Artificial Sequence
  derived and/or modified sequence opt3 from OR1J2__Homo_sapiens__NP_473448
augagccccgagaaccaguccucugugucagaauuucugcuccuuggccugccuaucagaccagagcaacaggccgucuuuuucaccuuguuuuuagggauguaccugacaacuguucuaggaaaucuccugauuaugcuucugauacaguuggacagucaccuccauacgccgauguauuucuuucugagccaccuggcucucaccgauaucuccuucucuucggugacaguacccaagauguuaauggacaugaggacuaaauacaagucaauucuguaugaagagugcaucagccagauguacuuuuucauuuucuucaccgaucuugacaguuuucuaaucacauccauggcauaugaucgguacguggccauaugucauccucugcacuauaccgucaucaugcgcgaagaguugugcguguuccucguugcggugucuuggauucugagcugugcuuccucacuuagucauacucuguugcucacacgacugagcuuuugcgccgcaaacaccaucccacacgucuucugugacuuagccgcucugcucaaacuuucuugcuccgauauuuuccugaaugaguuggugauguuuacgguagguguuguggucaucacucuacccuucauguguauacuggugucauacggcuacauuggggcaaccauccuccgugugccuagcacaaagggcauucacaaagcccugaguacuugcggaucucaucuuuccgucguuagccuguauuacgguucgaucuuugggcaauauuuguucccaaccgugucuuccucaaucgacaaggauguaauuguggcucucauguacacagucgugacccccaugcugaacccuuuuauauauaguuuaagaaauagggacaugaaggaagcccugggaaaacuauucagccgggcgacguuuuucuccugguga

SEQ ID NO: 60130 - RNA, 951 nt, Artificial Sequence
  derived and/or modified sequence opt3 from OR1K1__Homo_sapiens__NP_543135
auggaggccgcuaacgaaagcuccgagggcaucucuuucgugcugcucgggcuuaccacaucacccggacagcaaagaccucuguuugucuuguucuuacugcuauacguugcaagucuccuggguaauggccuuauuguggccgcgauacaggcuagcccagcccugcacgcaccgauguacuuuuugcucgcccaucuguccuucgcugaccugugcuuugcaucuguaacugugcccaagaugcucgccaacuuacuggcucacgaucauucgaucucacuugccggguguuugacgcagauguauuucuuuuucgcgcugggagucaccgacagcugccuacucgcagccauggcuuaugauuguuacguggccauuaggcacccucugccauaugcaacacggaugagucgcgcuaugugcgccgcgcuuguuggcauggccuggcuggugucccauguccacucuuugcucuacauccuguuaauggcacgacugagcuuuugugcuucccaccaggugccccauuucuuuugcgaccaccaaccucuccuucgucugucauguagugauacucaucacauucaguugcuaaucuucaccgaaggugccgcuguaguugugacaccauuucugcucauacuggccagcuauggggcaaucgccgcugcgguccuucagcugcccucugcauccggaagauugagggccgugucaaccugcggcagccaccucgcuguggucagucuguucuacggcacuguuauugccguguacuuccaggcaacaucucggcgcgaggccgaaugggggagaguagcuaccgugauguauacggucgugacuccuauguuaaauccaaucauuuacucccuguggaacagggacguucaaggagcccuacgggcacuccugaucggucgccgaauaagcgcgucggauucuuga

SEQ ID NO: 60131 - RNA, 930 nt, Artificial Sequence
  derived and/or modified sequence opt3 from OR1L8__Homo_sapiens__NP_001004454
auggagagaaucaaccacaccagcuccgugucugaauuuauucugcucggccuuucaaguaggcccgaggaccagaagacacuguuugucuuguucuuaauaguuuaccuggugacuaucacggggaaucuacucauuauccuggccauucgguuuaacccucaucuucaaaccccaauguauuucuuucugagcuucuugucccucacagauaucugcuuuacuaccucuguagugccgaaaaugcugaugaauuuccugucggaaaagaaaacaauaucauacgcuggaugucucacccagauguauuuucuuuacgcacuggguaacagcgacaguugccuuuuggccgucauggcguucgaucgcuauguggcuguuugugaccccuuucacuacgugacuacaaugucccaucaccauugcguccugcuaguggccuucucuuguagcuuuccucaccuccacucccugcuucauacccuguugcucaaucgacugacguucugcgauucaaacguaauccaccauuucuuaugugaccugaguccaguucucaaguuaagcuguucuuccauuuuugugaaugagaucguccagaugacugaagcacccauugugcuggugacccguuucuugugcaucgccuuuucauauauaaggauucuaacaacuguccugaaaaucccuagcaccaguggcaagagaaaggcuuucucuacaugcggguuuuaccucaccguugugacgcuguucuacggauccauuuucuguguauaucuucagccacccagcacuuacgcagugaaagaucacgucgccacaaucguguauaccguucugucgucuauguugaacccuuucaucuacucccuccggaauaaggaccugaaacaaggcuuacgcaagcugaugucaaaaagaaguuga

SEQ ID NO: 60132 - RNA, 942 nt, Artificial Sequence
  derived and/or modified sequence opt3 from OR1M1__Homo_sapiens__NP_001004456
auggagcccagaaaccagaccagcgccucccaauucauccugcucggccuuucugaaaagccugagcaggaaacacuguuguuuucauuauucuuuugcauguaccuggugauggucguugggaaucuacucauuauacuggcuaucaguauugacagccaccuucauacuccaauguauuucuuucuggcaaacuugucccucguggauuucugucuggccacgaauaccaucccgaaaaugcugguaucucuccagacaggaucgaaggcgauuucauaccccugcuguuuaauccagauguacuuuuuccacuuuuucgguauaguggacagcgucaucauugcuaugauggccuaugauagguuuguggcaaucugccauccucugcacuaugccaaaauuaugagucuucgguugugucgccugcuaguuggcgcucucugggcauucuccugcuuuaucucucugacucauauacuucugauggcccgauugguguucugugggagccacgaggucccacacuacuucugcgaccucacccccauucugcguuuauccuguacagauaccucagugaacagaaucuuuauucugaucguagcuggaaugguuaucgccacuccuuucgugugcauucucgcgaguuaugcaaggauacuugucgccaucaugaaggugccaagcgcuggcggucggaaaaaggccuuuucuacauguuccucacaucugagcguggucgcauuguucuacgggaccacgauuggaguuuaccuaugccccaguucugugcugacuaccguaaaggaaaaggcuuccgccgugauguauacagcggucacuccuaugcucaauccauuuaucuacagccugcgcaacagagaccuuaaaggcgcccugaggaaauuggugaaucggaagauaaccucgucuuccuga

SEQ ID NO: 60133 - RNA, 936 nt, Artificial Sequence
  derived and/or modified sequence opt3 from OR1N1__Homo_sapiens__NP_036495
auggagaaccagagcuccaucucugaguucuuucugagaggcauuucagcucccccugaacaacagcagagucucuucgggauauuucuuugcauguaccuggugaccuugacaggaaauuuacugaucauucuagccaucgguagcgaccuccaccuucauacuccaauguauuucuuucuugcaaaccuguccuucgucgauaugggcuugacgucuucgaccguuacaaagaugcucgugaauauucagacuaggcaccauaccaucucauacacagggugucugacccaaauguacuuuuuccugauguuuggagaccucgauagcuucuuuuuagccgcgauggcuuaugaccgguauguagccauaugccacccgcuguguuacaguacugugaugcgcccccaggucugcgcacuuauguuggcccuguguugggugcuaacaaacaucguugcucucacccauacguuccugauggcacgacuuuccuuuugcgugacuggcgaaauugcccacuucuucugugauaucaccccuguccugaaauugucuugcagcgacacacacauuaaugagaugaugguguuuguacucggugggacuguucugaucgugccauucuuauguauagucaccuccuauauucauaucgugcccgcuauucugcgugugagaacaaggggaggcgucggcaaggccuuuucaaccugcaguagccaccucuguguugugugcguauucuacgggacgcuguuuucugcguaccugugcccuccauccaucgcaucagaagagaaagauaucgccgcugccgcaauguauacuauugugacacccauguugaacccuuucauauacagccuacggaauaaggacaugaaaggagcucugaagcgccucuuuagucauagaucuaucgucuccagcuga

SEQ ID NO: 60134 - RNA, 993 nt, Artificial Sequence
  derived and/or modified sequence opt3 from OR1N2__Homo_sapiens__NP_001004457
auggagggcuucuaccugagaaggagccacgaacuccaggggaugggaaagcccggucgggugaaccaaaccacagucuccgacuuucuucuguugggcuuaucugaguggccugaggaacagccacugcuauucgggaucuuucucggaauguaucugguuacuauggugggcaaucuucugauuauauuggccaucucaagugauccgcaucuccacacgcccauguacuucuuucuggcuaaccugagccucaccgacgcaugcuucacauccgccucuauuccuaaaauguuagcgaauauccauacucagucgcagauuaucucauauagcgguugucuggcucaacuuuacuuuuugcugauguucgggggacuagauaacugccuccuggccguaauggcauaugaccgcuacguggccauaugucagccacuucacuauaguaccuccaugucuccccagcugugcgcuuugaugcucggcgucuguugggugcugacaaauugcccugcauuaaugcauacccugcuccuuacucgaguugccuuuugugcucagaaggccaucccacacuucuacugcgaucccagcgcgcuguugaaacuagcauguuccgacacacacgugaacgaacugaugauuaucaccaugggccuccuguuucuuacggucccucuguugcucauuguguucucauacguacguaucuuuugggccguuuucgugauaaguagcccagggggaagauggaaggcuuucucuacuugcgguucccaucugaccgucguguuacuguuuuauggcucacuaauggggguguaccuccugccgcccagcacauauaguacugagagggagucucgggccgcaguccuuuacaugguuauuaucccuaccuugaauccauucauuuauucccugcgcaacagagauaugaaagaagcucucggaaagcuguuugugagcggcaagacauucuuucuuuga

SEQ ID NO: 60135 - RNA, 933 nt, Artificial Sequence
  derived and/or modified sequence opt3 from OR2A25__Homo_sapiens__NP_001004488
augggcgggaaccagaccagcaucacagaguuccugcuccuuggauuucccauugguccuagaauacaaaugcuguuguucggcuuauuuucccuguucuacaucuuuauucuacucgggaauggaacuauccugggccuuauuucucuggacucaagguugcacacgccaauguauuucuuucucagucaucuggccguggucgauaucgcuugcgcauguagcaccguuccgcagaugcuggugaaccucuuacaccccgccaagccuauauccuucgcggguugcaugacacagauguuucuguuccuuucuuuugcucauacugaauguuugcugcuaguagugaugucguacgaccgguaugucgccaucugccacccacuccgcuacucaaccauuaugacauggaaaguguguaucacccuggcacuuacuagcuggauucuggggguuuugcucgcccuggugcauuuaguccugcuccuuccccugaguuucugcggaccucagaaguugaaucacuuuuucugugagaucauggcugugcuaaaacuggcaugcgccgauacacacauaaacgaaguaaugguucucgcuggcgccguguccguccuggugggcgcguucuuuucuaccgugauuagcuauguccauauccuuugugcaauucugaagauccaauccggggagggaugccagaaagccuucucaaucuguaguagccacuugugcguugugggucucuuuuacggcacggcuauuauaauguauguagaaccacaguacgagucucccaaggagcagaagaaauaccuguuacuguuccauucccuauuuaauccuaugcucaacccacugaucuauucacuucgaaauaaggaagugcaagggacuuugaaacguaugcuggagaagaaaagaaccagcuga

SEQ ID NO: 60136 - RNA, 951 nt, Artificial Sequence
  derived and/or modified sequence opt3 from OR2AG1__Homo_sapiens__NP_001004489
auggagcuguggaacuucacccucggcagcggguuuauccuuguggguauucugaaugacuccggaucucccgaauuguuaugcgccacaauaacuauccuguaccuacucgcucugauuucaaacggccuucuguugcucgcaaucacgauggaggccagacugcacaugccuauguaucugcucuuagggcagcugagucuuauggauuugcuguucaccagcgucguuacaccaaaggcgcuagcugacuuucucaggcgggaaaauacuauuuccuucggaggcugugcccugcaaauguuucuugcacugaccauggguggggccgaggauuugcuccuggcuuucauggcauacgaccgcuauguggccaucugccauccguuaacauacaugacccugaugucuucgcgagcuuguuggcucaugguagccacuucauggauacuugcgagccugagugcauugaucuauacaguguacaccaugcacuaucccuuuugccgugcccaggaaauuagacaucuacugugugagaucccucaccuccugaaagucgcuugcgccgauacguccagguacgagcuuaugguguacguuaugggagugacuuuccugauuccaucuuuggcagcuauccucgccagcuauacccagauacuguuaacaguccugcauaugcccuccaacgaaggccggaagaaagcgcuagugacuuguucaagucaccucaccguaguuggcauguuuuacggggccgcaacauucauguaugugcugccuagcucuuuucacuccacccgccaggacaauauuaucucagucuucuacacgauugugacuccagcucuuaaccccuugaucuauagccugagaaauaaggaggugaugagggcccuccggcgcguccugggaaaauacaugcuuccugcucauaguacacuguga

SEQ ID NO: 60137 - RNA, 1008 nt, Artificial Sequence
  derived and/or modified sequence opt3 from OR2AK2__Homo_sapiens__NP_001004491
augaacaucagcgacgugauuuccuucgauauacuggucucugccaugaagaccggcaaucagucauuugggacagacuuccuccuuguuggacuguuucaauacgguuggaucaacaguuuguuauucgugguaauugcuacucuguuuacgguggcacuaaccggcaauaucaugcucauucaccugaucagacuuaacacaaggcugcauacucccauguauuucuugcucagccagcuguccauagucgaucugauguacaucucuaccacagugccuaaaauggccguuucguuucucucacagagcaagaccauucgguucuuagggugcgagauccagacuuauguguuucuggcgcuuggaggcacagaggcuuugcugcuagguuucaugaguuacgaccgcuaugucgccauuugucacccacuccauuacccgaugcugauguccaaaaagaucugcugucuuaugguggcaugcgccugggcuucugggagcauaaaugcauuuauucacacccuguauguauuccaauugcccuuuugucgaucccgucucaucaaccauuucuucugcgaaguuccugcccuguuaucacuggugugucaggauacgagucaguacgaauacacuguccuccuuagcggacugauuaucuugcuacugccauuucucgcuauccuggccucuuaugcgagagugcuuauuguggucuuccagauguccucaggcaaaggccaagcaaaggccguuaguaccugcagcucucaccugauaguggcuuccuuguuuuacgccacaacucucuucaccuauacaaggccccacagccugcggucgccuucucgcgacaaggcaguagcuguguuuuacaccaucgucacgccauuacugaaucccuucauuuauucccuaagaaacaaagaggugacuggggccguuaggcggcuccugggauacuggaucuguugccgcaaguaugauuuucgaucacuuuacuga

SEQ ID NO: 60138 - RNA, 963 nt, Artificial Sequence
  derived and/or modified sequence opt3 from OR2AT4__Homo_sapiens__NP_001005285
auggacgccaccgcuugcaacgagagcguggauggcucccccgucuucuaccugcucgggaucccuucucuuccagaaacauuuuuccugccgguuuucuucauauuuuuguuauucuaucugcuaauucucaugggaaaugcacugauccuuguggccguaguggcggagcccucacugcacaagccuauguacuuuuucuugauuaaccucaguacucuggacauccuguuuacgaccacaacugucccaaaaaugcucagcuuauuccugcuuggugauagauuuuuguccuucucuucgugucugcuacagauguaucucuuucaaucauuuaccugcagcgaggcuuucauucuggugguuauggccuacgacagguauguggcaaucugucauccccuucacuacccuguccugaugaauccacagacaaacgccaccuuggcugcaagugccuggcucacugcucuguuacugcccauaccugccgugguacggacaucccagauggcguauaauucuaucgcauacauuuaccauugcuuuugugaucaccucgccguugugcaggcuagcugcuccgacaccacgccacaaacucuuaugggcuucuguaucgccauggucgugucauuucugccguugcuacuggugcuccugaguuauguccauauucuugcaagcguucugcgcaucucuuccuuggaagggcgagcuaaggccuucucaaccugcagcagucaccuccuggugguaggaacauacuauucuuccauagcgauugccuacguggcauaucgugcugauuuaccccuggacuuucacaucaugggcaacgucguguacgccauucuaacuccuauccucaauccacugaucuauacccuuagaaacagggauguuaaagcugccauuacaaagauaaugagccaggaccccgguugugaucggucgaucuga

SEQ ID NO: 60139 - RNA, 1074 nt, Artificial Sequence
  derived and/or modified sequence opt3 from OR2B2__Homo_sapiens__NP_149046
augaacugggugaauaagagcgucccccaggaguucauccugcucguguuuuccgaccaaccuuggcuugaaauuccaccguucguuauguuucuguucucuuacauauugaccaucuuuggcaacuuaacaauuauccugguaucacacguggauuucaaacuacauacucccauguacuuuuuccucaguaaucugagccuucuggacuugugcuauacgaccuccacagucccucagaugcucgugaacauuuguaauacuagaaagguuaucucuuaugggggaugcguggcccagcuguuuauauuccuggcucucgguucgaccgaguguuuacugcuugcagucaugugcuuugauagguucguggccaucugucggccauugcacuacucaauuaucaugcaucagcgccugugcuuucaacuagcggcugccagcuggauuaguggcuucuccaacucuguacuccagagcacauggacccugaaaaugccccuuugugggcacaaggaaguugaccauuucuuuugcgaggugccugcacuguugaaacucuccugugucgauacuacagccaaugaagcugagcuguucuuuaucucaguguuauuccugcucauaccagugacccuuauucugaucaguuaugcauuuauuguccaggccguuuugcgaauccagagcgcugagggacaacguaaggccuucggcacgugcgguucucaccuaaucgugguaucccuguuuuacgggacugcgauuucaauguaucuccagcccccuagcccaaguucuaaggacagaggaaaaauggugucccuguucuguggcauaaucgcaccgaugcuuaacccccugauuuacaccuugaggaauaaggaagucaaagaggccuuuaagcggcucguggcuaaaagccuguuaaaccaggaaauccgcaauaugcagaugauaucguucgccaaggauacaguucugacuuaccuaaccaacuuuucugcauccugcccuauuuucgugaucacaaucgagaauuauugcaaccucccacaaagaaaguuucccuga

SEQ ID NO: 60140 - RNA, 942 nt, Artificial Sequence
  derived and/or modified sequence opt3 from OR2B3__Homo_sapiens__NP_001005226
augaacugggagaaugaaagcucccccaaggaguucauccugcucggcuuuucugacagagccuggcuucagaugccucuguucguggucuuguuaauuucauacaccauaacaaucuuugggaacguuaguauuaugauggugugcauccuggauccaaaacuacacacuccgauguauuucuuucucacgaaucugagcauucuugaccuguguuacaccacaacuaccguaccccauauguuggugaacaucggaugcaauaagaaaacaauauccuaugcugguugugucgcacaccucaucauuuuccuggcccugggcgcgaccgaaugccucuuacuggcugugaugucuuuugauagguacguugccgugugucggccucuucauuaugucgugaucaugaacuacugguucugcuugcgcauggcagccuuuucguggcugauuggguucggaaauucaguacuacaaagcagucucacucugaacaugccacgauguggccaccaggagguugaccacuuuuucugcgaagugcccgcacuucugaaguuguccugugcugauacaaaaccuaucgaggccgagcucuuuuucuucucuguccugauauuacugauuccagugacccucauccuuauuagcuaugguuuuaucgcucaggccgugcugaagauccguuccgcggaagggagacagaaggcauucggaacgugcggcucacauaugauugucguuaguuuguuuuacggcacugccauauacauguaucuacaacccccuagcucuaccuccaaagacugggggaagauggugucacuguucuacggaaucauuacaagcaugcucaauagucugaucuauucucuuaggaacaaagauaugaaggaggcuuuuaaacggcugaugccacgcauauucuuuuguaagaaguga

SEQ ID NO: 60141 - RNA, 942 nt, Artificial Sequence
  derived and/or modified sequence opt3 from OR2B6__Homo_sapiens__NP_036499
augaacugggugaaugacagcaucauucaggaguucauacugcucggcuuuuccgauagacccuggcuugaguucccucuguuggucguauuuuuaaucucuuacaccgugacaauuuucgggaaccugacuaucauucuaguaucaaggcucgacacgaagcugcacaccccaauguacuuuuuccuuacaaaucugaguuugcucgaucugugcuauacuaccuguacagugccgcaaaugcuggucaaccucugcagcauccggaaagugauauccuaucgcggauguguugcccaguuauuuaucuuccuggcucuuggugcaaccgaguacuugcugcuagccgugaugucuuuugaccgauucgucgcgauuugccguccccuccauuauucggugaucaugcaccagagacugugucuucagcuggcugccgcaucauggguaacuggcuuuagcaauaguguuugguuguccacacucacccugcaauuaccucugugcgauccauacgugauugaccauuuccucugugaaguccccgcccuucugaaguugucuugcguggagacgacugcuaacgaagcagagcuauuucuggugagcgaacucuuccaccugaucccucuuacccugauauugauuuccuaugccuucaucgucagggcuguucuccggauucagucagccgaagggcgccagaaagcguuuggaacauguggcagucaucugaucgugguuagcuuauucuacucuacugcaguguccgucuaccugcagccacccucaccuagcaguaaggaucaagguaaaauggugucucuauuuuaugggaucauugccccaaugcucaauccgcugauauacacccuuagaaacaaggagguuaaggaaggauucaaaagguugguggcucgggucuuucugaucaagaaauga

SEQ ID NO: 60142 - RNA, 939 nt, Artificial Sequence
  derived and/or modified sequence opt3 from OR2C1__Homo_sapiens__NP_036500
auggacggcgugaacgauagcucccugcagggguucguccucaugggaaucucugaccacccccaacuugagaugauauuuuucauugccauccuguuuucauacuuguuaacccugcuagguaauaguacaauuauccuccugagcagacuugaagcuaggcugcauacuccuauguauuucuuuuuguccaaccucucuucgcuggaucuggcauucgccacgucaagcguuccacagaugcucauuaauuuauggggcccggggaagaccaucaguuacggaggcugcauaacacagcuguauguguuucuuugguugggugcgacugaguguauccugcuaguagugauggcuuucgaccgguacgucgccgugugccgcccccuccgauauaccgcaauuaugaacccucagcuguguuggcuucuggccguuaucgcuugccucgggggauugggcaauuccgugauucaaucuacauuuacccugcaguuaccacuguguggccaccguagagucgaaggguuccucugcgaggugcccgcaaugaucaaacuugccuguggagauacuagccugaaccaggcuguauugaaugguguuugcacauuuuucaccgccgugccucuauccauaauugucaucucauacugucugauugcgcaggcagugcucaagaucaggagugccgaaggccggcgcaaagccuuuaacacgugccugagccaucuucugguggucuucuuguucuaugggucugcuuccuacggauaccuccugccagcaaagaacucaaaacaagaccagggcaaguuuaucagcuuauucuauagucugguuacucccauggugaauccucuaauuuacacccucagaaauauggagguaaagggugcucugaggcggcuuuuggggaaaggacgcgaggugggcuga

SEQ ID NO: 60143 - RNA, 954 nt, Artificial Sequence
  derived and/or modified sequence opt3 from OR2F2__Homo_sapiens__NP_001004685
auggagaucgacaaccagaccugggugagagaauuuauucugcucggccuuagcuccgauuggugcacacaaauaucucuguuuucauuguucuuagucacuuaccugaugacgguucuagggaauugucucaucgugcugcuuauuaggcuggacagucgguugcacacccccauguauuucuuccucacaaaccugagccugguagauguguccuacgccacuucugucgugccucagcucuuagcucauuuucuggcagagcacaaggccaucccauuccagucgugcgcggcucaguuguuuuucucacuugcccugggagguauugaauuuguucuacucgcagugauggccuaugaccgccaugucgcugugagcgaucgacugcguuacagugcaaucaugcacggcgggcuuugugccagacuggcuauaaccuccuggguaucuggaagcaucaauuccuugguucaaacagccauuaccuuccagcucccgaugugcacuaacaaauuuaucgaccauauuucaugugagcuguuagcgguggucaggcuggcaugcguggauacaaguagcaaugaagccgcuaucauggugucuuccauaguccuccuuaugacccccuucugucugguuuugcuaucauauauucggaucauuagcacgauccugaagauccagagucgcgagggcaggaaaaaggccuuucacacuugcgcaucucaccucaccgugguagcucuguguuacgguacaacuauuuucaccuauauacagccucauuccgggccaagcgugcuucaagagaaacugaucucggucuucuacgccauugugaugcccuugcucaacccuguuaucuacucucugagaaauaaggaagugaagggagcguggcacaaauuacuggagaaguuuuccggccuaacaucaaaacucggcaccuga

SEQ ID NO: 60144 - RNA, 954 nt, Artificial Sequence
  derived and/or modified sequence opt3 from OR2G2__Homo_sapiens__NP_001001915
augggcauggugagacacaccaacgagagcaaucuggccggguucauccuccuuggauuuuccgacuacccccagcugcaaaaggucuuguucguuuuaauucugauacuauaucuccugacaauccuugguaacacuacgauuauccuggugucuagguuggaaccuaaacuccauaugccaauguacuuuuuccugucacaccugaguuuucucuaucggugcuucaccagcuccguaauuccgcaguuacuggugaaucuuugggagcccaugaagacaaucgcuuacggcggguguuugguccaucuguauaacucucacgcacuaggaucgacugaaugcgugcucccugccguuaugucaugugaucgcuacguggcggucugccgaccacugcauuauaccgugcuuaugcacauacaccuguguauggcuuuggccagcauggcauggcucaguggcaucgccacaacccugguacaguccacuuuaacacugcagcuccccuuuugcggucaucgucaaguugaccacuucauuugugaggugccuguccuuaucaaacuggcuugcguggggaccacguuuaaugaagcagaguuguucguggccucuauucuauuucugaucgucccaguuagcuucauacucguguccucaggauacauugcucaugccguacugagaaucaagagugcgacuaggcggcagaaagcauuuggcaccuguuucagccaccuuacaguggucacuauuuucuacggcaccaucaucuuuauguaucugcagcccgccaagucucgcuccagagaucaggggaaguucgugucauuguuuuacacaguugugaccaggaugcucaacccucugauuuauacguuacggauaaaagaggucaagggagcucugaaaaaggugcuagccaaagcacucgguguaaauauccuguga

SEQ ID NO: 60145 - RNA, 930 nt, Artificial Sequence
  derived and/or modified sequence opt3 from OR2G3__Homo_sapiens__NP_001001914
augggccuggggaacgagagcucccucauggacuucauccuucugggauuuucugaucaccccagauuggaagccguguuauucgucuuuguucuguucuuuuaccuacucacccugguggguaauuucacaauuauaaucauuucauaucuugacccuccacugcauacuccgauguacuuuuucuugaguaaccucagccugcuggauaucugcuuuacgaccucccucgcuccccagacauuaguaaaucugcaaaggccuaagaaaacuauuaccuauggcgggugcguggcacagcuuuacaucucuuuggcccugggaucgacagagugcauacuacucgcggacauggcucuggaucgguauaucgccgucuguaagccacuucacuacgugguuauuaugaacccccgccugugccagcaguuggcaucaaucagcuggcucaguggccuggccuccucuuuaauucaugcuaccuucacucugcaacucccucuuugugguaaucaccgacuggaccauuuuaucugcgaagugccagcauugcuaaaacuggccugugucgauacaaccgugaacgagcucguacuguucguugugagcguccuuuuuguggugauacccccugcucugauuuccaucucauauggguucauuacgcaggccgucuugcguaucaagaguguugaagcgagacacaaagcauucagcacuuguucuucccaccucaccgugguaaucauauuuuacggaacaauuaucuacguguaucugcagccaucagacagcuacgcccaggaucaaggcaaguucauuaguuuauuuuauacuauggucaccccgacacugaaucccaucauauacacccuaaggaacaaggacaugaaagaggcucuccggaagcugcuuucuggcaaauuguga

SEQ ID NO: 60146 - RNA, 939 nt, Artificial Sequence
  derived and/or modified sequence opt3 from OR2H2__Homo_sapiens__NP_009091
auggugaaccagagcuccacccccggcuuccugcuccuuggguuuucugagcacccuggacuggaaagaacauuguucgucguuguguuaacuucauaccugcuaacgcucguagguaauacccugaucauucuucugagugccuuggacccaaagcuccauagcccgauguacuuuuuccuguccaaccugucuuuucucgauuuaugcuucacaacuucgugugugccccaaaugcuggucaaucuuuggggcccuaaaaagaccauaucauuuuuggacugcagcgugcagaucuucauuuuucugagucuagggacaaccgaguguauccuccugacuguuauggcuuucgauagguauguggcagucugccagccacuucacuaugccacaauuauccauccccggcuguguuggcaguuggcguccguggcuuggguaauaggacucguugaaucugugguccaaaccccuagcacgcugcacuuaccauuuugccccgaccgccagguggaugacuucgugugugaggucccugcccugauccgacucuccugcgaagauacuucauacaacgagauucagguugcaguggccaguguauuuauccuuguggucccacugagcuugauucuagugucuuauggcgcuaucaccugggcaguucugcguauaaauuccgccaaagguagaaggaaggcuuucgggacauguucaagccaucucacuguggucacccuguucuacaguucugugauugccguauaucuucagccgaaaaaccccuacgcgcaagagcggggaaaguuuuucggccuguuuuacgcaguuggcacaccuuccuugaauccacucaucuauacccugcgcaacaaggaagugacgagagccuucaggcgguuacuggggaaagagaugggacuaacucagagcuga

SEQ ID NO: 60147 - RNA, 939 nt, Artificial Sequence
  derived and/or modified sequence opt3 from OR2J2__Homo_sapiens__NP_112167
augaugaucaagaaaaacgccagcuccgaggacuucuuuauucugcucggcuucucuaauuggccccagcuugaagugguccuguuuguugugauauugaucuucuacuuaaugacccugacagggaaccuauuuauuaucauucucucauauguagauagucaucugcacacuccuauguacuucuuucuuagcaaucuguccuucuuggaccucugcuauacgaccucuucgaucccacaacugcuggugaaccucagaggaccggagaagacaauaucauacgcugguuguaugguccaguuauauuuugugcuggcacuuggcaucacugaaugcguuuugcugguggucaugagcuacgauagguauguggccguaugucggccccuacacuacaccguucucaugcauccucgcuucugccaucugcuuguggcggcuaguugggucauuggguuuacaaucuccgcccugcacucuagcuucaccuuuugggugccauuguguggacaccgacucguggaccacuucuucugcgagguccccgcacuguuacgucuguccuguguugauacucaugccaaugaacucacacuuauggugaugucaaguauuuuuguacugaucccuuugauacuaauucugaccacguacggcgcuaucgcaagagccgugcucagcaugcagucuacuaccggucugcagaaagucuucaggacaugcggggcucaccuuauggugguuucccuguuuuucauuccagugauguguauguauuugcaacccccuucagagaacagcccagaccagggaaaguuuaucgcccucuucuacacugucgugaccccgagucugaaucccuuaaucuauacacugcggaacaaacauguaaagggcgcggcaaagcgccuacucggcugggagugggggaaauga

SEQ ID NO: 60148 - RNA, 936 nt, Artificial Sequence
  derived and/or modified sequence opt3 from OR2J3__Homo_sapiens__NP_001005216
augaacgacgauggcaaggugaaugccagcuccgagggguacuucauccuggucggauuuucuaacuggccccaccucgaaguugugauuuucguagugguccuuauauuuuaucugaugaccuugaucgguaauuuauucauuaucauucugucauaccuagacagucaucuccacacaccuauguacuuuuuccugagcaaccuuuccuuucuggauuugugcuauacuacgucuucgaucccacagcuccuggugaaucuguggggcccggagaaaaccauaucauaugcuggguguaugauccaacucuacuucguuuuagcacugggaacaacugaaugcgugcuuuuggucgugaugagcuaugacagauacgccgcgguauguaggccccugcauuacaccguucuaaugcacccucgguuuugccaucuccuggcuguggccaguugggucuccggcuucacaaacucugcacuucacagcuccuuuaccuucugggugccacuguguggucaccgccagguggaucacuuuuucugcgagguccccgccuugcuccgacugucauguguugacacucaugugaaugaauuaacacugaugauuaccaguagcaucuucguacucauuccucuuauccugauauugacgucuuauggggcuauugugcgugcaauccuaagaaugcaguccacuaccggacugcagaaggucuuuggcacaugcggcgcccaucucauggcugugucacuguucuuuauuccagccauguguauguaccuucaacccccuagcgggaacagucaggaucagggaaaauucaucgcgcuguuuuauacuguugugaccccaucuuugaauccgcucaucuacacacugaggaacaaggucgugcggggugcaguaaaacgcuuaaugggcugggaguga

SEQ ID NO: 60149 - RNA, 939 nt, Artificial Sequence
  derived and/or modified sequence opt3 from OR2L2__Homo_sapiens__NP_001004686
auggagaacuacaaucaaaccagcacagacuucauccugcucggccuuuuuccccaauccagaauugggcuguucguguuuacuuugauauucuuaaucuuucugauggcccuaauuggaaaccucucuaugauccugcuuauuuuccuggauauccacuugcauacgccuauguauuuucuccugucacagcugagucucauagacuuaaauuacaucagcaccauugucccaaagaugguuuaugauuuccuguacgguaacaaauccaucucuuuuacaggcugcgggauucagucguucuuuuuccuuacuuuggcuguggcagaaggacugcuacucaccucaauggccuaugacagguacguagcgaucuguuuuccgcugcacuaucccauacggauuagcaagcgcgugugcgucaugaugaucacaggcaguuggaugauuuccucuaucaauagcugugcucauaccguguacgcccuuugcaucccuuacuguaaaucccgagcaauuaaccacuucuucugcgauguuccagccaugcugacuuuggcuuguacagacaccuggguguaugagucaacggucuuucucaguagcacuauauuccugguguuacccuuuaccgguaucgcaugcucuuacgggcguguacugcucgccguuuauagaaugcauuccgcugaaggaaggaagaaagccuacucaacauguagcacucaccuuaccguggucaguuucuauuacgcgccuuuugcauauacauacgugcggccacgcucucugagaucccccaccgaggauaagauuuuggccguguucuacacgauccuaacuccuaugcugaauccaauaauuuauagccucaggaacaaggaagucaugggcgcucugacacagguuauccagaaaaucuuuucggugaagauguga

SEQ ID NO: 60150 - RNA, 939 nt, Artificial Sequence
  derived and/or modified sequence opt3 from OR2M3__Homo_sapiens__NP_001004689
auggccagagagaacagcaccuucaauuccgacuuuauccugcucggcauuuucaaccacucucccacacauacuuuucuuuucuuucugguguuggcuauauucucagucgcauuuauggggaauaguguuaugguguuacugaucuaccuagauacgcagcuccacaccccuauguaucugcuucugagccaauugucccucauggaccugaugcugauuugcacaacuguaccaaagauggccuucaacuaccucucuggaucgaaaucaaucagcauggcggguugugcuacccagaucuuuuucuauacaaguuuacugggcuccgaaugcuuucuuuuggccgugauggcauacgauagguauaccgccauuugucauccgcugcgguacacuaaucuaaugucucccaagauaugcgggcucaugacagcuuucagcuggauccugggauccaccgacggcauuaucgaugucguggcaacguuuucauucaguuauugugguagccgcgagauugcccacuucuuuugcgacuucccuucucuucugaucuuguccuguucagauacuagcauauuugagaaaauucucuucaucugcuguauuguuaugaucguguuuccagucgcuaucauuauagccaguuacgcgcgagugauccuggcaguaauucauauggggucuggagaaggccguagaaaggccuucaccacaugcuccagccacuuacugguugugggcauguacuauggggcugcccucuuuauguacaucaggcccacuucggaccggucuccuacccaggauaaaauggucuccguguucuauacaauacuuaccccaaugcugaaccccuugauuuacucacuacgcaauaaggaagugacgagagcauuuaugaagauccugggaaaagguaagaguggcgaguga

SEQ ID NO: 60151 - RNA, 936 nt, Artificial Sequence
  derived and/or modified sequence opt3 from OR2M4__Homo_sapiens__NP_059974
auggugugggagaaccagaccuucaauagcaucuuuauucugcucggcauauucaaccacucccccacacauacuuuucuuuucucucuggucuuggggaucuuuucauuagcccugauggaaaauauuaguaugguucuacucaucuacauugagaagcaacugcacacgccuauguauuuccuucugagccaguugucccucauggaccugaugcugaucugcaccacacucccaaaaaugauauuuucuuacuuaucgggaaagaaaucaaucagccuggcugguuguggcacucagauuuucuuuuaugugagucuuuugggggcagaaugcuuccugcuagccguaauggcguacgauagauauguggcuaucugucauccgcuccaguacaccauucugaugaaccccaaacuuugcgucuuuaugacaguggccuccuggacccugggaucuuuggacggcaucauaguucucgcagccgugcugagcuucuccuauuguucaaguuuagagauucaccacuuuuucugcgaugucgcugcacugcucccucuuagcuguacugaaacaucugccuucgagaggcuguuggugaucugcuguguaguuaugcuaauuuuuccaguguccgucaucauccugucauacagccaugugcuccgggcugugauucacauggguaguggggagucucgccgaaaggccuucaccacgugcuccagccaucugucggucguuggacuuuacuauggcgcggcaauguuuauguacaugcgucccgccucuaagcacacuccugaccaagauaagaugguguccgcuuucuauaccauacugacaccaauguugaauccccucaucuacucacugagaaacaaagaaguauuuagggccuuacagaaggugcugaaaaagcggaaacuaauuuga

SEQ ID NO: 60152 - RNA, 939 nt, Artificial Sequence
  derived and/or modified sequence opt3 from OR2M7__Homo_sapiens__NP_001004691
auggccugggagaaccagaccuucaauagcgacuuucugcuccuuggcaucuucaaccacucccccacacauacuuuucuguucuuuuugguguuagcuauuuucucugucgcauuuaugggaaauucaauaaugguucugcuaaucuaccucgauacgcaacugcacaccccuauguauuuccuucugagucaguugagccucauggaccugaugcugauuugcacaacugugccaaagauggccuuuaacuaccucuccgggucuaaaucgaucucaauggcggguugugcuacccagauuuucuuuuauaucagcuuacugggcagugaaugcuuccuuuuggccguaauguccuacgauagauauacagcaauaugucauccgcugagguacaccaaucuaaugcggcccaagaucugcgggcucaugacugccuuuucuuggauucugggaagcacagacggcaucauugaugcuguggcaaccuucuccuucucauauugugguagucgcgagaucgcccacuuuugcugugacuucccuagccuucugauauugucuugcaacgauacguccauuuuugaagaggucaucuucauuuguugcaucgugaugcucguuuuuccaguggcuaucauuauaacuucauacgcccgagucauccuggcggugauucauauggggagcggagaaggccguagaaaagcauucaccacauguaguucucacuuaaugguaguuggcauguacuauggggccggacuguuuaugugcauccagcccacuucccaccauagcccuaugcaagacaagauggugucggucuucuacaccauagugacaccaaugcucaauccccuuauuuauucucugaggaacaaagaggugacccgggcuuugaugaagauccuagguaagggcaaauccggggauuga

SEQ ID NO: 60153 - RNA, 960 nt, Artificial Sequence
  derived and/or modified sequence opt3 from OR2S2__Homo_sapiens__NP_063950
auggagaaggccaacgaaaccagccccgugaugggcuucguccugcucagacuuuccgcucacccugagcuggagaaaacauuuuucguuuugaucuuacugauguaccuagugauucuccuggggaauggaguacuuauacuggugacuaucuuggacucuaggcuccauacgccaauguacuuuuuccuggguaaccugucauuucucgauauuugcuucaccacaaguagcgucccguuagugcuggacuccuuucuuacuccccaggaaaccaucucuuucucggcaugugccguucaaauggcguugucauuugcuauggccggcacagaaugccugcuacucagcaugauggcauucgaucgguauguggccauuuguaauccucugcgcuauagugucaucauguccaaggcugcauacaugccaauggccgcuucuagcugggccauagggggagcggcauccgugguacacaccucacuugccauccagcugcccuuuugcggcgacaacguuauuaaucauuucacuugugagaucuuggcugugcucaaacuggccugcgcagauauuaguaucaacgucauaagcauggaggugacaaaugugaucuuuuuaggugucccuguucuguucauuucuuucuccuauguguuuauuaucaccacgauccuccguauuccaucagcugaagggcgaaagaaaguauucagcacuuguagugcccaccuuaccguggucauaguguuuuacggaacacuguucuuuauguauggcaagcccaagucuaaagacuccaugggcgcggauaaggaggacuugagcgauaaacuaaucccucuguucuacgggguugugacuccaaugcucaacccgauuaucuacucgcugagaaauaaggacgucaaagccgcagugaggcggcuucugcgccccaagggauuuacccaguga

SEQ ID NO: 60154 - RNA, 939 nt, Artificial Sequence
  derived and/or modified sequence opt3 from OR2T10__Homo_sapiens__NP_001004693
augagacuggccaaccagacccucggcggggacuucuuucuucugggaaucuucagccaaauuucccaccccgguagguugugcuuacugauauuuucuaucuuccuaauggcugugucauggaauauuacacucauccugcuuauucauaucgauaguagccugcacacuccuauguacuuuuucauaaaccaguugucccucaucgaccugacguauauuucugucaccguuccaaagaugcuggugaaucagcucgcaaaagauaagacaaucucgguauuaggcugugggacucagauguacuuuuaucugcaacuuggaggcgccgagugcuguuugcuggcggcuauggccuacgaccgguauguggcaauuugccauccgcuacgcuacucaguccucaugagccaccgagugugucugcuucuggccagugguugcugguucguuggguccguggauggauuuauguugacccccaucgcuaugucuuucccuuuuugucguagccaugaaauacagcacuucuuuugcgaggucccagcagugcucaaacuguccuguucagacacaaguuuauauaagauuuucauguaccugugcuguguaaucaugcuccuuauucccguuaccgugaucagcgucucuuacuauuacaucauucugacuauacacaaaaugaacuccguggaaggcagaaagaaggccuucacaaccugcucaagccauaucacgguggucaguuuguuuuauggcgcugccauuuacaauuauaugcuaccuucuuccuaccagacuccagagaaagauaugaugagcucguucuuuuauaccauccugacacccguucucaacccuauaauuuacucuuucaggaauaaggacgugacucgggcgcugaaaaagaugcuuuccguacagaaaccaccguacuga

SEQ ID NO: 60155 - RNA, 963 nt, Artificial Sequence
  derived and/or modified sequence opt3 from OR2T12__Homo_sapiens__NP_001004692
auggagaugagaaacaccacacccgacuucauccugcucggccuuuuuaaucacacuagggcccaucaggugcuguucaugauguuguuagcuacgguccugaccagccuauuuagcaacgcacucaugauucugcuuauacacugggaucaucggcugcaccgcccuauguacuucuugcucucucaacugucacugauggacaugaugcucguuaguacaacugugccaaagauggccgcggauuauuuaaccgggaauaaagcuaucagccgagccggaugcgguguacagaucuuuuuccugccgacacuuggcgggggagaauguuuucuccuggcagccauggcuuacgaccguuaugcagccgugugccauccccuaagauacccuacccucauguccuggcagcugugucuuaggaugacuaugucuucguggcuguugggcgcugccgauggucuccugcaggcggucgcaacauuaucauucccauauugcggggcccacgagauugaccacuuuuucugugaagcucccgugcugguucggcucgccugcgcagauaccagcguguuugagaacgcuauguacauuuguugcguccuuaugcuguuggugccuuucagucuaauccuguccucuuauggacucauacuggccgcgguacuucugaugcgcagcacggaagccagaaagaaagcauuugcuacuuguuccucacauguugccguggucggcuuguucuacggcgcugggaucuucaccuacaugaggccaaagagucaccggagcacaaaucaugacaaaguggugucugccuuuuauacuauguucacccccuugcugaacccuuuaauuuacuccguccgcaauucagagguuaaggaggcacugaagcgauggcuaggaacaugcgugaaccucaaacaccaacagaaugaagcccacagauccagguga

SEQ ID NO: 60156 - RNA, 1110 nt, Artificial Sequence
  derived and/or modified sequence opt3 from OR2T1__Homo_sapiens__NP_112166
auguggcaggaguacuauuuccugaacguguuuuucccccuccuuaaggucugcugccugaccaucaauagccacguugugauuuuguuaccuugggaaugcuaccaucugauauggaaaauccuaccauauauuggcacaacuguaggguccauggaggaauacaacacgucuucaaccgacuuuacauucaugggacucuuuaauagaaaggagaccaguggucugaucuucgccauuaucagcauaaucuuuuucacugcucuuauggcaaacggcgugaugauuuuucugauccaaacagauuugaggcuccacaccccgauguauuuccugcugucccaucucucuuuaauugacaugauguacaucucgacuauaguccccaaaaugcuggugaauuaucuuuuggaucagcggacaauuucauuuguuggguguaccgcccagcacuuccuguaccuaacgcucgugggagcggaauuuuuccugcuuggccugauggcuuacgaccgcuaugucgccaucugcaacccuuugcgauacccagugcucaugagccguagaguauguuggaugauuaucgcagguaguugguucgggggaucccuggauggcuuuuuacugacucccaucaccaugucuuucccuuuuugcaauagcagggagauuaaccauuucuuuugugaggccccagcuguucucaaacuugcaugcgccgacacagcucuguaugaaacugugauguacgucuguugcguguugaugcuacugauacccuucuccgugguccucgccucauaugcgcggauccugaccacaguucaguguaugaguagcguggagggccgcaagaaggcauuugccaccuguucuucccacaugacgguagugucacuuuucuacggggcugccauguauacuuacaugcugccucacagcuaccauaagccagcacaagauaaagucuugaguguguuuuauacaauucucaccccgaugcugaaucccuuaaucuacucucugagaaacaaggacguuacuggagcucuaaaaagggcccucggucgguucaagggcccucagcgcguguccgggggagucuuuuga

SEQ ID NO: 60157 - RNA, 975 nt, Artificial Sequence
  derived and/or modified sequence opt3 from OR2T2__Homo_sapiens__NP_001004136
augggcauggaggggcugcuccagaacagcaccaauuucgugcuuacaggacugaucacucaccccgccuuuccugguuuguuauucgcuauugucuuuuccauauucguuguggcaaucacggccaaccugguaaugauucuacucauccauauggacucuagacugcacaccccaauguacuuucuucugucacaauugaguauuauggauacaaucuauauaugcaucacugugccgaagaugcuccaggaccugcugagcaaagauaagaccauuuccuuccucggcugugcgguccagaucuuuuuauaccugacacuuauugggggagaguucuuuuugcugggccuaauggcuuaugacagguacguggccguuugcaauccccuccgguauccucugcuuaugaaccgccgagugugucuguucauggucguggguucuuggguagggggaucguuggauggcuuuaugcucaccccaguuacuaugucauuccccuuuugccguagcagagaaaucaaucauuucuucugugaaauaccugcagugcugaaauuaaguugcacagacaccucccuguacgagacgcucauguaugccuguugcguccuuaugcuguugauuccacuaucugugaucagcguguccuacacucacauucugcucaccguccauaggaugaacucagcugaaggccggcgcaaggcauuugccacauguaguagccacaucaugguugugucuguauucuacggggcugccuuuuauacuaaugugcugccccacuccuaccauaccccugagaaagauaaggucgugucagcguucuauacaauccuuaccccaaugcugaacccguugauuuacagccucagaaauaaggacguugcagccgcucugaggaaaguguuaggacggugcgguaguucucaguccauacgcgucgccacggugauccgaaagggcuga

SEQ ID NO: 60158 - RNA, 963 nt, Artificial Sequence
  derived and/or modified sequence opt3 from OR2T33__Homo_sapiens__NP_001004695
auggagaugagaaacaccacacccgacuucauccugcucggccuuuuuaaucacacuagggcccaucaggugcuguucaugauggucuugagcauuguuuuaacgucccuguuugggaacucucuaaugauacuccugauccacugggaucaucggcuucacaccccuauguacuuccuguugucacaacucagucugauggacaugaugcuggugagcacaacuguaccaaagauggcugcagauuaucucaccggauccaaagccauuucucgcgcggguugcggcgugcagaucuuuuucuuaccgacacuugggggaggcgaauguuuucuguuggcugccauggcauacgaccgauaugccgcugucugccauccccugcguuacccuacccuaaugucguggcagcucugucugagaaugacuaugucaugcuggcuucugggugcagccgauggguugcuccaggcugugguuacacugagcuucccauauuguggagcccacgagauugaccacuuuuucugcgaaacccccguguuagucaggcuggcgugugcagauacgaguguguuugagaaugccauguacaucugcuguguacucaugcuucugguuccuuucuccuugauacuaucuagcuauggccugauccucgcugccgugcugcauaugcgguccacugaagcacgcaagaaagccuuugcuaccugcucaagucacgucgcgguggugggccuuuucuacggggccgcaauuuucacauacaugagaccaaagagccauaggucuacuaaccacgacaaagucguuuccgcuuuuuauaccauguucacaccccuguugaauccucucaucuacucagugaagaacagcgagguaaagggagcccugaaacggugguuagguaccugugugaauauuaagcaccaacagaacgaggcucaucgcagucgauga

SEQ ID NO: 60159 - RNA, 1047 nt, Artificial Sequence
  derived and/or modified sequence opt3 from OR2T4__Homo_sapiens__NP_001004696
auggacaacaucaccuggauggccagccacacaggcugguccgauuucauucugauggggcucuuuagacagucuaagcaucccauggcuaauauaacuuggauggcaaaccacacgggauggucagacuucauccuucuggguuuguuuaggcaaaguaaacauccugccuuacugugcguggucauuuucguuguguuucuaauggcgcucagcggcaaugcuguacugauccuucugauucacugugaugcccauuugcacaccccaauguacuucuuuaucucccagcucucucugauggacauggcauauauaucggugacagucccgaagaugcugcucgaucaggugauggggguuaacaaaaucucagcccccgagugcggaaugcagauguucuuuuacgugacuuuagcuggcagcgaguucuuucugcuugcaaccauggccuaugaccgguacgucgcuauuugucacccuuugcgcuauccagugcugaugaaucaucgaguaugccuauuccucaguuccgguuguugguuucuggggucuguugauggauucacauucacccccaucacuaugacauuuccuuuccguggcagcagagaaauucaccacuuuuucugcgaagugccagccguccuuaaccuguccuguucagacaccaguuuguacgagaucuuuauguaucucugcugugugcugauguuacugauacccguggucauuaucucaucuuccuaccuccuuauucuguugacgauccauggcaugaauagcgcggaagggaggaagaaagcauucgccacuugcagcagucaccuaaccguugugauccuguuuuacggagcugccauuuauacauacaugcucccuucuuccuaucauacuccagagaaggauaugaugguaagcguguucuacaccauacugacaccggucgugaacccccuuaucuauucgcugcggaauaaggacguuaugggugcauugaaaaagaugcucaccguggagccugcuuuucaaaaagccauggaauga

SEQ ID NO: 60160 - RNA, 948 nt, Artificial Sequence
  derived and/or modified sequence opt3 from OR2T5__Homo_sapiens__NP_001004697
auggccaacaucaccagaauggcuaaucacacaggcaagcuggacuucauucucauggggcuuuuuaggcggagcaaacaucccgcacuguuguccguggucauauucguuguguuuuuaaaggcccugucuggaaacgcgguacuaauccuccugauucacugcgaugcucaucuucacucaccuauguacuucuuuaucagucagcugagcuugauggacauggccuauauuuccgugacugucccaaaaaugcuccuggaucaagugauggguguuaauaaggugucugcaccggaguguggcaugcagauguuccuguaccucacguuagccgggucggaauuuuuccugcuugcuaccauggcauaugaccgcuacgucgccaucugccaucccuugcgauauccugugcugaugaaccaccguguaugucuauuucucgcuucaggaugcugguuccugggcagcguugaugguuuuaugcuuacaccaauaacuaugaguuuccccuuuuguagauccugggagauccaccauuucuucugcgaagugccugccgucaccauucugucuuguagcgacacauccuuguacgagacccucauguaucugugcuguguguuaaugcugcucaucccagugacuauuaucucaaguagcuaccuucugauauugcuaacaguccacaggaugaacucugcggaagggcggaaaaaggcauuugcuaccugcuccucacaucugacgguugugauucucuucuacggagccgccguauauacuuacaugcugcccagcaguuaucacaccccugagaaggauaugauggugucugucuuuuacacaauccuuacuccagugcugaauccguugauuuauucccuccgcaauaaagacguuaugggcgcacugaagaaaauguuaaccgugagauucguccuguga

SEQ ID NO: 60161 - RNA, 963 nt, Artificial Sequence
  derived and/or modified sequence opt3 from OR2W1__Homo_sapiens__NP_112165
auggaccagagcaacuacuccucucugcacggcuucauccuccuuggguuuucaaaucaucccaagauggagaugauucugaguggaguggucgccauauucuauuugaucaccuuaguugguaacacagcuauuauccuggcaagccuacucgauucccaacugcacacuccuauguacuuuuuccuuagaaaucugucguuuuuggaccucugcuucacgaccucuauuaucccacagaugcuggugaaccuguggggcccggauaaaacaauaucauauguaggguguaucauucagcucuacguguauaugugguuaggaagcgucgaaugccugcuuuuggccgugaugaguuacgacagguuuacugcgaucuguaagccccugcauuauuucguugugaugaauccucaccuaugccucaaaaugauuaucaugauaugguccauuucucuggcuaacagcgucgugcuuuguacccugacauugaaucucccaaccugcggcaacaauauccuggaucacuuuuuaugugagcugcccgcccucguaaagauugcaugcguugacacuacaaccguggaaauguccgucuucgcccuugguaucaucauugugcugacgccuuugauacuaauccugauuucauacggguacaucgcuaaagcagugcuccggacuaagaguaaggccagccagcgcaaagcuaugaacaccuguggaucucaucugacagucguuuccauguuuuauggcacuauaauuuacauguaucuucaaccaggcaaucgagccucaaaggaucaggggaaauuccugaccuuguuuuacacagugaucacccccagccucaacccucugaucuauacguuacguaauaaggacaugaaagaugcgcugaagaagcuaaugagauuccaccauaaaaguacuaagauuaaaaggaacugcaagucuuga

SEQ ID NO: 60162 - RNA, 936 nt, Artificial Sequence
  derived and/or modified sequence opt3 from OR2Y1__Homo_sapiens__NP_001001657
augggcagcuucaacaccuccuuugaggacggguucauccuggugggauuuucugauuggccccagcucgaaccuauucuuuucgucuuuauauucaucuuuuacucacugacauuguucgguaauacuauuaucauugccuuaaguuggcuggaccuaagacuccacacgccaauguacuuuuuccugagccaucuuucccuguuggaucucugcuuuaccacaucuacuguuccgcaacugcugaucaaccucuguggcguggacaggaccauaacacgcgggggaugcguagcucaguuauucaucuaucuggcacuuggcucgaccgaguguguguugcuggucgugauggccuuugaucgguaugcggcuguuugccgaccccuacacuacauggccauuaugcauccucaccucugucagacucuggcaaucgccucauggggugcuggguucgugaauagccuuauucagacaggacuggcaauggccaugccauugugcggccaucgucucaaccacuucuuuugugaaaugcccgucuuccugaaguuagcuugcgccgacaccgagggcacggaagcgaaaauguuuguggcaagaguaaucguuguggccgucccugcugcccugauacucgggaguuaugugcacauugcacaugcugugcuuagggucaaguccacugccggacggcgcaaagcguucgguaccuguggcucucaccuguugguuguguuucuauucuacgggagcgccaucuauacauaccugcaauccauucauaauuacucagagagagagggaaaguuuguagcacucuucuauacuaucaucaccccaauucugaacccccuuauauacacacugaggaauaaagaugugaagggcgcuuuguggaagguccucuggcggggucgcgacaguggguga

SEQ ID NO: 60163 - RNA, 945 nt, Artificial Sequence
  derived and/or modified sequence opt3 from OR2Z1__Homo_sapiens__NP_001004699
augggcgacgugaaccagagcgucgccuccgauuucauccugguugggcucuuuucucacucaggaaguagacaacuucuguucagcuugguggcuguaauguuugugauugguuuacugggcaauaccguccuacucuuccugauaaggguggacucccggcuucauacacccauguacuuucuguugucucagcucucgcuguucgauaucgggugcccuaugguuacuauuccaaagauggcaucagacuuucugcgcggagagggcgccacgagcuauggugggggagcggcucagaucuucuuucucaccuuaaugggcguggccgaaggcguccugcuuguguugaugaguuacgaucgauauguagcaguuugucagccgcugcaauaccccgugcuaaugcguagacaggucugccuccugaugaugggguccucuuggguggugggaguccuuaacgccagcauucagacauccaucacucugcacuucccuuauugugcuucaaggauaguugaccacuuuuucugcgaggugccagcauugcucaaacugaguugugccgauaccugcgcuuacgaaauggccuuaagcacaucugguguacugauccucaugcuuccccuguccuugauugcgaccucauauggccaugugcuacaggcaguccugagcaugcggagugaggaagcccgccauaaggcugugacuacauguucuucccacaucaccguuguggggcucuuuuacggagccgcagucuucauguacauggugccuugcgcuuaucacagcccacaacaggacaauguaguuucgcuguucuacucucuugugacgcccacucugaacccuuugauuuauucccucagaaauccagaggucuggauggcccuggugaaagucuuaucaagggcgggccugcggcagauguguuga

SEQ ID NO: 60164 - RNA, 948 nt, Artificial Sequence
  derived and/or modified sequence opt3 from OR3A1__Homo_sapiens__NP_002541
augcagcccgagagcggcgccaacgggaccgugaucgcugaguucauucugcucggacuucuggaagcaccugguuugcaaccagucguuuuuguguuauuccuguuugccuaccuaguaacagugagaggcaaucucuccauacuggcggcuguccuuguggaaccgaagcugcacacucccauguauuucuuuuuggggaaccucucuguucuggacgugggaugcaucucagucacggugccuaguaugcugagcaggcucuuaucccggaaacgcgccguaccauguggcgcaugccugacccagcuuuucuuuuuccauuuguuuguugguguggauuguuuccugcuaacagccauggcuuacgaccgauuucucgcaauuugccguccccugacuuauucuaccagaaugucgcagacaguccagaggaugcuuguggccgcuucaugggccugugcguucaccaaugcacugacucacacaguggccaugagcaccuugaacuuuugcgggccuaaugucaucaaccauuucuacugugaucucccacaacuguuccaguuaaguugcuccucuacgcagcugaaugagcuccuucuguuugcuguuggauucauuauggccggcacucccauggcauugaucgugauaagcuauauccacguagcugccgcggugcuacggauucgcuccgucgaaggcagaaagaaagccuuuucaaccugugggagucaucugacagugguugcaaucuucuacggaagcgguauuuuuaacuauaugaggcucggcucuacuaagcuguccgacaaagauaaggcuguggggaucuucaauaccgucauaaacccuaugcuuaauccaauuaucuacucauuucggaacccggacgugcagagcgccauuuggcgcaugcugacaggacgaagaaguuuggcuuga

SEQ ID NO: 60165 - RNA, 1035 nt, Artificial Sequence
  derived and/or modified sequence opt3 from OR4A15__Homo_sapiens__NP_001005275
auggagcugcucaccaacaaucuuaaguucaucacagaccccuuugugugcagacugaggcacuugagcccuacuccauccgaagaacauaugaaaaacaagaauaacgucacggaguucauuuuacugggccuaacccagaauccggaggggcaaaaaguucucuuugugacauuccugcuuauauacaugguaacuaucaugggaaaccuguugauuaucgugaccauuauggccucucagucacucgguagucccauguacuuuuuccuggcuagccuguccuuuaucgauacagucuacucuaccgcauucgccccuaagaugauaguggaccucuuaucggaaaagaagacuaucucauuucagggcuguauggcgcagcuguucauggaucaccuuuuugcuggggccgagguuauuuugcugguggucauggcauaugaccgguacauggccaucugcaagccacuacaugagcucauuacaaugaaucgccgaguguguguacugaugcuucuggcugcauggaucggaggcuucuugcacagccucguucaauuucuguucauauaucaguuacccuucugcgguccuaacgugauugauaauuuucugugugaccucuacccacuucugaaauuggccugcaccaacacguaugucacugggcuaaguaugaucgcuaauggaggcgccauuugugcggugaccuucuuuacaauccugcucuccuacggcgugauccugcauucucuuaagacucagagccuggaagggaaacguaaggcauucuauaccugcgccucccacgucacaguugugauuuuguuuuucguacccuguauauuucucuaugcuagaccuaacucaaccuucccaaucgauaaaaguaugacggugguccugacuuuuauuacaccgauguuaaauccccugaucuacacccuaaagaacgccgagaugaaaagcgcaaugaggaaacucuggucuaagaaagugucccuggcuggaaaguggcuuuaucacucauga

SEQ ID NO: 60166 - RNA, 930 nt, Artificial Sequence
  derived and/or modified sequence opt3 from OR4C12__Homo_sapiens__NP_001005270
auggagaagaaaaagaacgugaccgaauuuauccugauuggccucacacagaaucccauaauggagaaagucacuuuuguuguguuccuuguacuguacaugaucacguugagcgggaacuuacugauuguggucaccaucacaacuucccaagcccuaucuucaccuauguauuucuuccucacccaccugagucuuauugacacaguguacagcuccucuucggcuccaaagcugaucguugauucauuucaggaaaagaagauaaucagcuucaauggaugcauggcacaggccuaugcggagcauauuuuuggugcuaccgaaaucauuuugcucacugugauggccugugacugcuacgucgcaaucuguaagccgcugaacuauacaaccauaaugagucacucccugugcauucucuuaguggccguagcuuggguuggcggguuccugcaugcaacgauccagauucuuuuuacugugugguugcccuucuguggaccuaaugucaucggccacuuuaugugcgaucuguacccacuacucaaacugguguguaucgacacccauacacuuggucuguucguggccgucaacucuggguuuauuugcuugcucaauuuccugauauuaguugugagcuauguaaucauucugagaucccucaagaacaauucacuugagggaagguguaaagcucugaguacuugcaucagccacauaauuguggucguguuguucuuuguucccuguaucuucguguaccuacggucugucaccacacugccuaucgauaaggccguggcgguauuuuacaccaugguugugccaaugcucaaccccgucguguauacgcugcgcaaugcagaggucaaauccgccauucgaaaacuuuggcguaagaaagugacuucagacaacgauuga

SEQ ID NO: 60167 - RNA, 930 nt, Artificial Sequence
  derived and/or modified sequence opt3 from OR4C13__Homo_sapiens__NP_001001955
auggccaacagaaauaacgugaccgaguucauccugcucggccuuacagaaaaucccaagaugcagaaaauuauauuugucguuuucagcgugaucuacauuaacgcuaugaucgggaauguacugauuguggucacuaucacggcauccccuucuuugaggucaccaauguacuuuuucuuagccuaucugaguuuuauagacgcgugcuauagcuccgugaacaccccgaagcuaaucacagauucucucuacgagaauaaaacuauucuguucaacggauguaugacccaaguuuuuggugaacacuucuuucggggcguggaggucauccuucugacagugauggcuuaugaccauuacguagccauuugcaagcccuugcacuauaccacuguuaugaaacagcauguguguucgcuccuggucggggugucaugggugggaggcuuccugcacgcaacaauccagauacucuuuauuugccaguuaccuuucugugguccaaaugucaucgaucauuuuaugugcgaccuguacacccuuauuaacuuggccuguacgaauacucacacccuggggcuauucaucgcugcaaacagcggauucaucugccuccugaauugucuucuguugcucguuaguugcgugguaauucuguacuccuuaaagacacacucucuggaagcccgccaugaggcucucagcacuugugugucccacauaaccgucgugauccuuucauuuauucccugcaucuucguuuauaugcgaccuccagccacacugcccauagauaaggcgguggcagucuuuuacaccaugauuacgaguauguugaacccucuaaucuauacucugcguaaugcccaaaugaaaaacgcuaucagaaagcucugcagcaggaaagccauuucuuccgugaaguga

SEQ ID NO: 60168 - RNA, 930 nt, Artificial Sequence
  derived and/or modified sequence opt3 from OR4C6__Homo_sapiens__NP_001004704
auggagaaccagaauaacgugaccgaauuuauccugcucggccuuacagagaaucuggaauuguggaagauuuuuagcgccgucuucuuaguuauguacguggcuacuguacuggagaaccuacucauaguggucacgaucauuaccucccaaucucugagaucacccauguauuucuuccuuacauuucugaguuugcucgacgugauguucagcuccguuguggcaccuaaagucaucguggauacucugucuaagucgaccacaauuucacugaaagggugccucacccaguuauuuguagaacacuucuuuggagguguuggcaucauacugcuuacugugauggccuacgacagguaugucgcgaucuguaagccauugcauuacacaauuaucaugagcccgcgggugugcugucugauggucgggggagcuugggugggcgguuucaugcacgccaugauucagcuacucuuuauguaucagauccccuucugcgggccuaauauaauugaucauuuuaucugugaccuguuccaacuucugaccuuggcaugcacggauacucacauucucggacuguuaguuacccugaacaguggcaugauguguguggccaucuuccucauccuuauugcuuccuacacaguaauacugugcucuuugaaaagcuauuccucaaagggccgccauaaggcacuaaguacuuguagcucucaccugaccguggucgugcucuuuuucguuccaugcaucuuucuguacaugcgacccguggucacacacccuauugacaaagccauggcuguguccgauucaaucauaaccccaaugcuuaauccccugauuuacacguugcguaacgccgagguaaagagcgcgaugaaaaagcucuggaugaaaugggaggcacuggccgggaaguga

SEQ ID NO: 60169 - RNA, 936 nt, Artificial Sequence
  derived and/or modified sequence opt3 from OR4D10__Homo_sapiens__NP_001004705
auggagauggaaaacugcaccagagugaaggaguucaucuuucugggccucacacagaauagggaagucagccuuguucuguucuuguuuuuacugcuaguguacguaacuacgcuccuggggaaccuucugauuauggugaccgucacaugugagucccgguugcacacucccauguauuuccuccugcauaaucugucuauagccgacaucugcuuuucaaguauuaccgugccuaaaguucucguggauuuacugagcgaacgcaagacaaucuccuucaaccacuguuuuacccaaauguuccuuuuucauuugauuggaggugucgacguguucucucugucgguaauggcucuagaucgauacguugcaaucucaaaaccacuccacuaugccacuauaaugagccgugaccauugcaucggccugacaguggcggcuuggcuugggggauuuguccacaguauugugcagaucucccuguugcucccgcugcccuucuguggcccuaauguguuagauaccuuuuacugcgacguccacagaguucugaagcucgcccauacggauauuuucauccuugagcuguugaugauaucuaacaauggucuacugacuacccucugguucuuucugcuucuggugagcuauauuguaaucuugucccucccaaaaucacaggcaggggagggaaggcggaaggccauuaguacauguacuagccacaucaccguggucacacugcauuucgugcccugcaucuacguuuaugcucgcccuuuuaccgcauuaccaauggacaaggccauuucugugacguucacugucauaucaccccugcuaaacccucucaucuacacacugagaaaucacgaaaugaaauccgcuaugaggcggcuuaagcgccgauuggugccaagcgauagaaaauga

SEQ ID NO: 60170 - RNA, 915 nt, Artificial Sequence
  derived and/or modified sequence opt3 from OR4K13__Homo_sapiens__NP_001004714
auggagagagccaaccacagcguggucuccgaguucauccugcucggccuuucuaagucacagaaucugcaaauuuuguuuuucuuaggguuuaguguuguguucguaggaauagugcuggguaaccuacucauccuggucaccgugacauuugacagccuucugcauacucccauguacuucuugcucuccaaucugucuugcauugauaugauccuggcuucguuugcaacgccuaaaaugauuguugacuuccucagggaacggaagaccaucucaugguggggcuguuauagccagauguuuuucaugcacuuacuugggggaagugaaaugaugcuguugguggccauggcgauagaucgcuacgucgcuaucugcaaaccacugcauuauaugacaauuauguccccgcgagugcuaacuggccuccugcuuucuagcuacgccguagguuuuguucacuccucaagucagauggcauucaugcugaccuugcccuuuugugggccuaacgugaucgacagcuucuucugcgaucucccacuggucauuaaguuagccuguaaagacacauauauccugcagcuccuugugauagcugauucuggacuguugucccuagugugcuuucugcuccugcuugucucauacggcguuauuaucuucagcgugcguuauagagcagccaguaggucuuccaaggcuuuuagcacccugucggcccauauuacuguagugacauuguucuuugcgcccugugucuucaucuacguguggccuuuuucucgguacuccguugacaagauccucucaguguucuauaccauuuuuacgccacuguuaaaucccauaaucuacacucugcgcaaccaagaggucaaagcagccauuaagaaaagacuaugcaucuga

SEQ ID NO: 60171 - RNA, 939 nt, Artificial Sequence
  derived and/or modified sequence opt3 from OR4P4__Homo_sapiens__NP_001004124
auggaaaagagcaacaauuccacccuguucauccuccuuggcuuuucucagaacaaaaauauugaggugcugugcuucgucuuguuuuuauucuguuacauagccaucuggauggggaaccugcuaauuaugaucucaauuacaugcacucaacucauccaccagcccauguacuuuuuccugaauuaucuuagucugagcgacuuguguuauacguccaccguuacaccuaagcucaugguggaucugcuggcugagagaaaaacuauaucuuacaacaauugcaugauccagcucuuuaccacacauuucuuuggagguauugaaaucuucauuuuaaccggcauggcauaugacagguacguagccaucuguaagccacugcacuauacuauaauuaugucgcggcagaaaugcaacacaaucauuaucguguguugcaccgggggauuuauccauucagcgagccaauuccuuuugacgauuuuugucccguucuguggccccaaugagauagaucacuacuucugcgacguguacccucugcuaaagcucgcuuguaguaacauccauaugauuggucugcuuguuaucgccaauuccgggcugauagcauuggugacuuuugucgugcuccuguuaucuuauguauucauucuguacaccauccgcgccuauagcgcugaacgacguuccaaggcacucgccacaugcucaagucacguuaucguggucgugcuguuuuucgcuccagcccuuuuuauuuacaucagacccgugacuaccuucagcgaggauaaagucuuugcguuguucuauacaauuauagcaccuauguuuaacccacuaaucuacacccugaggaauacggagaugaagaacgccaugcggaaaguuuggugcugucagauucuccugaagcgcaaucagcuuuucuga

SEQ ID NO: 60172 - RNA, 936 nt, Artificial Sequence
  derived and/or modified sequence opt3 from OR4S2__Homo_sapiens__NP_001004059
auggagaagaucaacaaugugaccgaauuuauuuucuggggccugagccagucccccgagauagaaaaagucugcuucguuguguuuucuuucuuuuacaucauuauccuccuugggaaccuguugauuauguuaacaguaugucugucaaaucuauucaagaguccuauguacuuuuuccucagcuuucuguccuucguggacaucugcuauucuucggucacugccccaaaaaugauaguggaucuucuggcuaaggacaaaacgaucucauauguuggauguauguugcaacucuuuggugugcacuucuuuggcugcaccgagauuuucauccugacagucauggcauacgauagauauguggccauuuguaagccgcugcauuacaugacuaucaugaacagggaaaccugcaauaagaugcucuuagggacauggguaggaggcuuccugcacagcauaauucagguugcgcuugugguccaguugcccuuuugugguccuaacgagaucgaccauuauuucugcgaugugcacccagugcugaaacuagcuuguaccgagacuuacauugucgggguugugguaacagccaauaguggaaccaucgcacucggcuccuuugugauccugcuuauuucuuacagcauaauccuggucuccuugcggaagcagucagccgaaggccgccgaaaagcucucaguacgugcgggagccauauugcaauggugguuaucuucuuuggacccuguacuuucauguauaugcguccugacaccacauuuucugaggauaagaugguggccgucuucuacacuauaauuaccccaaugcugaaccccuuaaucuauacacugagaaaugcugaagugaaaaacgccaugaagaagcucugggguaggaauguauuucuugaggcgaaaggcaaguga

SEQ ID NO: 60173 - RNA, 942 nt, Artificial Sequence
  derived and/or modified sequence opt3 from OR51A2__Homo_sapiens__NP_001004748
augagcaucauuaacaccuccuacguggagauaacaacuuucuuucuggucggcaugcccgggcucgaauaugcccacaucuggauuucuaucccuauuugcucaauguaccuuaucgcuauacugggaaaugguacgaucuuguucauuaucaagaccgagccaaguuuacauggcccgauguauuacuuucugagcaugcuagcaauguccgaccucgggcugucucuuucgucacugcccacaguuuugagcauuuuccucuuuaacgccccugaaaccaguuccucugcguguuucgcucaggaguuuuucauccacggauuuagcgugcuggaauccucaguacugcucauaaugaguuucgauagauuuuuagccauucauaauccacugagguauacuagcauccuuacaaccgugcgggucgcacaaauuggcaucguguucucuuuuaaauccauguugcugguucuacccuucccuuucacucuccgcucacugcgauacugcaagaaaaaccagcuuagccacaguuauugucugcaucaggacgugaugaaguuggccugcucugauaaucguaucgacgucauuuacggguuuuucggugcucucugucugaugguggauuuuauauuaaucgcaguauccuacacacugauucucaaaaccguuccaggaaucgccagcaagaaggaggagcuuaaagcucugaacacgugcgugucgcacauaugugccgucauuaucuucuauuugcccaucauuaaucuagcgguggugcacagauuugcaggccaugucucuccucugaucaacguucucauggccaaugugcugcuucugguaccaccguugaugaagcccauuguguacugcgucaaaacuaagcagauaagggugcggguuguggcuaaacucugucaauggaagaucuga

SEQ ID NO: 60174 - RNA, 939 nt, Artificial Sequence
  derived and/or modified sequence opt3 from OR51A7__Homo_sapiens__NP_001004749
augagcgugcugaacaauuccgaggucaaacucuuccuucugaucggcauucccggguuggaacacgcccauauaugguuuucuaucccuauuugcuuaauguaccugcuagcuaucaugggaaacuguaccauucucuucaucauaaagacagagccaucacugcacgaaccgauguauuacuuucuugcaaugcuggccguuagugacauggguuugagccucuccucucugcccacuaugcugagaguguuccucuuuaaugcgaugggcaucucgccuaacgcuugcuucgcccaggaguuuuucauucauggguuuacgguaauggaaucaagcguguuacugaucaugagucuugauagguucuuggcaauucacaauccacugcgguauuccucuauccuaaccagcaaccgcgucgccaagaugggacucauacuggcuauucgauccauccuucuggugauucccuuuccuuucacauugcguagacucaaauacugucaaaagaaucuguuaucacauaguuauugccugcaccaggacacuaugaaacucgcauguagcgauaacaagaccaauguuaucuacggcuuuuucaucgcccuuugcacaaugcuggacuuggcucuaauugugcugucuuauguccucauacugaagaccauccuuuccauugccucacuggcggagagguugaaagcacucaacacuugugugagccacaucugcgccguacugacauucuacguuccaauaauuaccuuagcugccaugcaucacuuugcaaagcauaaaaguccccugguggucauccuaaucgcugauauguuccuccuggugccuccacuuaugaauccgauuguguacugugucaagacgcggcagaucugggagaaaauuuuggguaagcugcucaacguuugcgggcgcuga

SEQ ID NO: 60175 - RNA, 957 nt, Artificial Sequence
  derived and/or modified sequence opt3 from OR51E1__Homo_sapiens__NP_689643
augaugguggaccccaacggcaaugagagcuccgccaccuacuucauccugauugggcucccuggacuugaagaggcucaguuuuggcuggcauucccauugugcucuuuauaucugauagccguccuagguaaccucacaaucauuuacaucguuagaacugaacacucacugcaugagccgauguauauuuuucuuuguaugcugaguggcaucgauauauugaucagcacguccucuaugcccaagaugcucgcgauuuucugguuuaauucgaccacaauccaauucgacgcuugccugcugcagauguuugccauucacucacucagcgggauggaaaguacuguguuacuggcaauggccuucgauagguacguagcuaucugucauccucuucggcacgcaaccguguugacacugccacgcgucaccaaaauaggaguggccgcuguugugcgaggcgccgcgcuaauggcaccccucccugucuuuauuaagcagcugccauucugccguuccaacauccuuucucauagcuauugucugcaccaggacgugaugaaauuggccugcgaugacauuagaguaaauguuguguacggucucaucgucaucauuuccgcuauagggcuggauucauuacugaucaguuuuagcuaucuccuuauucugaagacuguguugggacuaacaagggaggcccaagcaaaggcuuucggcaccugugugucucacgucugcgccguuuuuaucuucuacgugcccuucauaggccuguccaugguacaucgguuuucaaaacgcagagacagcccucucccagugauucuggcgaacaucuaccuucuggucccgcccguguugaauccuaucguuuauggggugaagacgaaagagauuaggcagcggauccuccgccuguuccacgucgccacucaugcaagugaaccauga

SEQ ID NO: 60176 - RNA, 963 nt, Artificial Sequence
  derived and/or modified sequence opt3 from OR51E2__Homo_sapiens__NP_110401
augagcuccugcaacuucacccacgccacauuugugcugaucggcauucccgggcucgagaaggcucauuucugggucggauuuccucuucugucuauguacguuguggcaauguucgguaauuguauaguaguguuuaucgucagaacugaaaggucauugcacgccccaauguauuuauuccugugcaugcuagcggcuauugaccucgcccugaguacgagcaccaugccgaaaauccuugcacuguuuugguucgauucccgggagauuucuuuugaagccuguuugacacagauguucuuuauccaugcucucucggcaauagagucaacuauccugcuggccauggcuuucgaccgcuacguggccauuugccacccccuccgacaugcggcaguuuuaaacaauaccgugacagcccaaaucggcauugucgcugugguacgugggagccuguuuuucuucccucuuccauugcugaucaagagacuagccuuuugucacaguaacguucucucccacucuuauugcgugcaucaggaugucaugaaacuggcauacgcugacacccuucccaaugugguguauggacugacugccauauugcucgucaugggcguugaugugauguucauuagccuguccuacuuuuuaaucauuaggacaguacugcagcucccuucaaagagugaacgggcgaaagccuucgguaccugugugagccacaucggggucgugcuugcauuuuauguuccacugaucggauugucugugguccaucgcuucggcaacucccuacaccccauugugagaguaguuaugggcgacauauaccugcuccugccuccagugaucaauccgauuaucuacggggcuaagacgaagcagauaaggacucggguccuugccauguuuaaaauuucaugcgauaaggaccugcaagcugugggagguaaauga

SEQ ID NO: 60177 - RNA, 1029 nt, Artificial Sequence
  derived and/or modified sequence opt3 from OR51F2__Homo_sapiens__NP_001004753
augaccgagacaagccuguccucucagugcuuccccaugucagugcucaacaauacuaucgccgaaccucuuauuuuucuguugaugggcauaccaggguuaaaggcuacgcaauacuggaucaguauuccguucugucugcuauaugucguugcagugagcggaaacuccaugauccucuuuguagugcugugcgagagaucucuucacaaacccauguacuauuuccugucgauguugucagccaccgaccucagccugagucuguguacacucuccacuaccuuaggugucuuuugguucgaagcgagggagauuaaucugaacgcuugcaucgcccagauguuuuuccuucauggcuuuacauucauggaaucugggguguugcuggcaauggccuuugaucgguucguugcuauauguuacccucuacgcuauaccacuauccucacaaaugcacgaauugccaagaucggaaugagcaugcugauucguaacguggcugucaugcuuccagugaugcuguuuguaaaaagauuguccuucugcucaaguaugguucucagccacucuuacuguuaucauguggaccugauccaguuauccugcaccgauaauaggauaaacucaauucugggccucuucgcccuucugagcacgacugguuuugacugucccugcaucuugcuaaguuacauucugaucauccggucuguccucuccauugcgagcucggaggagcgcagaaaggcauucaauaccuguacaucucacauauccgccgugucaaucuuuuaccugccucuuauuagucugagcuuggugcauagguaugggcacuccgcuccacccuucguccacaucauaauggccaacguuuuucuccugauuccuccaguguuaaauccgaucaucuacucuguaaaaauuaagcagauccaaaaggcaauuauaaaagugcugauccagaagcauagcaaaucaaaccaccagcuauuccucauucgggauaaggcuaucuaugaauga

SEQ ID NO: 60178 - RNA, 966 nt, Artificial Sequence
  derived and/or modified sequence opt3 from OR51V1__Homo_sapiens__NP_001004760
auguuccugagcuccagaaugaucaccucugugucacccaguacaagcacuaacuccucuuuucuccuuacgggcuucucggggauggagcagcaauacccuuggcugucaauuccauuuagcaguauauaugccauggucuuguuaggaaauugcaugguucugcacgugaucuggaccgaaccgucccuacaucagcccauguucuacuuucucucuaugcuggcucuuacagaccuguguauggguuugagcacuguauauaccgugcucggcauucugugggggaucauuagggagaucucccuggauucaugcauagcacagaguuacuucauccacggacucagcuuuauggaaucuuccgucuuacugacaauggccuucgaccgguauauugcgaucuguaacccucuucgcuacucaagcauuuugaccaauagucgaaucauaaagauuggccugacuaucauuggucguucuuucuucuuuaucacaccacccaucauuugccuaaaauucuuuaacuauugucauuuccacauacucucccauagcuucugccugcaccaggaucuucugagauuggcuuguucggacaucagguuuaauucuuacuacgcccucaugcuggugauuugcaucuuacugcucgaugcaauacuuauucuguucuccuauaucuugauccuaaagucaguucuggccguggcuagucaagaggaacggcacaaacucuuucagaccuguauuagccauaucugcgcaguccugguguucuacauuccuauaaucucccuuacgaugguacaccgcuuugggaagcaucugucuccaguugcccacguguugauuggaaacaucuauauccucuuucccccucugaugaauccaauuauauacagcgucaaaacucagcagauccacaccagaauguuaaggcuguuuucacuaaagcgguauuga

SEQ ID NO: 60179 - RNA, 972 nt, Artificial Sequence
  derived and/or modified sequence opt3 from OR52B2__Homo_sapiens__NP_001004052
augagccacaccaacgugacaaucuuccaucccgccgucuuuguucugccuggcauuccagggcucgaggcuuaccacauauggcuuuccaucccgcugugcuugauuuauaucacugcaguguuaggaaauucuauucugaucguagugauagucauggaaagaaaccuacaugugcccauguacuucuuucucucaaugcuggccguuauggacauccuucugaguacgaccacagugccuaaggcguuggcuauuuucuggcuccaggcccacaauaucgcauuugaugccugugucacucaagguuucuuugugcauaugauguucguaggcgagagcgcuauucugcuggcaauggccuuugacagguucguugcuaucugcgccccacuccgguauaccacaguguuaaccuggcccgucguggggcgcauagcgcuggcagugauuacucgauccuuuuguaucauuuucccugucaucuuucuuuugaaacgucugccauucugccuaacaaacaucguuccccacucuuacugugaacacauuggaguggccagacucgcuugcgccgauauaaccguaaauaucugguauggcuucucggugccuauugucauggugauccuggacguuauacuuauugcagugucauacagccugaucuugagggcugucuuucggcucccaagucaggaugcccgccauaaggcgcuguccacgugugguucucacuuaugcgugauccugauguucuauguaccgagcuuuuucacucuccuuacccaucacuuugggagaaacauuccccagcacguucauauccuguuggccaaucuauacguggcagucccuccaaugcugaaccccauuguguacggagucaaaacaaagcagauaagggagggcguggcucaccgguucuuugacaucaaaacuugguguugcaccuccccucucggcucauga

SEQ ID NO: 60180 - RNA, 945 nt, Artificial Sequence
  derived and/or modified sequence opt3 from OR52B4__Homo_sapiens__NP_001005161
augcccaccgugaaccacagcggcacaucccauacugucuuccaucugcucgggaucccuggacuucaggaccaacacauguggauuucuauaccauuuuucaucucauacguuacggcccuguuggguaauaguuuacugauuuuuaucauucuaaccaagagaagccuccacgagccgauguaucuguuccuuugcaugcuggcuggcgcagauaucguguuguccacauguacuauaccccaggcccucgcgaucuuuugguucagggcuggggacauuucucuggaucggugcaucacccagcuguuuuucauucauucgacauuuaucucagaaagcggaauacucuuaguaauggccuucgaccacuacauugcaaucuguuauccucugcgcuacaccacuauucuuacaaacgccuugaucaaaaagaucugcgugaccgucagucugcgauccuauggcacgauuuuuccaauaaucuuccuacucaaacgucugacuuuuugucagaauaacauuaucccccacaccuucugcgagcauauaggucuugcuaaguacgcauguaaugauauuagaaucaacaucugguauggguucucuauucugaugagcacagugguuuuggacgugguccucaucuuuauuuccuacaugcugauauuacacgccguguuccauaugccuucaccagaugcuugccacaaagcccugaauacuuuuggaagucacguauguaucauuauccucuucuacggcagcggcaucuuuaccauucuuacacaaagguucgggcggcauauacccccuugcauccacauuccacuggcgaacguuuguaucuuggcaccgcccaugcuaaauccuauuaucuauggaauaaagaccaagcagauccaggaacaggugguccaauuucuguucauuaaacagaaguga

SEQ ID NO: 60181 - RNA, 957 nt, Artificial Sequence
  derived and/or modified sequence opt3 from OR52D1__Homo_sapiens__NP_001005163
augagcgacuccaaccugucugauaaucaccuccccgacaccuucuuucuuacaggcaucccugggcuggaggccgcucauuucuggauugcaauaccauuuugcgccauguacuugguggcguuagucggaaacgcugcccugauccuaguuauugcaauggauaaugcccuccacgcuccgauguaucuguuccuuugucuguugucacucacugaccuggcacugaguagcacgaccgugcccaagaugcucgccaucuuauggcugcaugcuggugaaauuuccuuuggcgggugccuugcccagauguucuguguacacucuaucuacgcguuggagucgucaauacugcuagcaauggccuuugauagauauguggcuaucugcaacccucucagguacacaacuauucugaaucaugccgucaucggacggauuggcuucgugggucuuuuucgcagcguugcaaucgugaguccauucauauuucuguugcgacgucuccccuauugugggcacagagucaugacccacacauacugcgaacauaugggaauugcuaggcuggccugugcgaacaucaccgugaauauuguauauggcuuaacuguugcccugcucgcaaugggccuugacuccauccugaucgcuauuucuuacggguucauauugcacgccguguuucaucuaccuagccacgaugcucaacacaaagcccuguccacaugcggaucacauaucgguauuauccucgucuucuacauaccagcauucuuuaguuuccugacccaccgguuuggccaucacgaggugcccaagcaugugcacauuuuccuugccaaccuguaugucuugguuccuccagugcucaauccgauccuguacggggcucgcacgaaagaaaucagaagcagguuacugaagcuacuccaccugggaaaaacuucuauuuga

SEQ ID NO: 60182 - RNA, 942 nt, Artificial Sequence
  derived and/or modified sequence opt3 from OR52E6__Homo_sapiens__NP_001005167
augcccaucgccaacgacacccaguuccacacaagcuccuuucugcuccuuggcauuccugggcuggaggaugugcauauauggaucggauucccauuuuucucugucuacuugauugcuuuacuggguaaugcagccaucuuuuucguuauucaaacugaacagucacuacacgagccgauguauuacugccucgcgaugcuggacaguaucgaucuuagccuguccacggcuaccauacccaagauguugggcaucuuuugguucaacauuaaagaaaucucuuuugggggauaucucucgcagauguucuuuauucauuucuuuacagugauggagucaaucguacugguggccauggcauucgacagauacauagccauuuguaagccucugugguauacuaugauccucaccagcaaaauuaucaguuuaaucgcuggcauugcaguccugaggucccuuuacauggugauaccauugguuuuccugcuacuccggcugcccuuuugcggucaccgcaucauuccucauacauauugugaacacauggggaucgcccgacuugcuugcgccucuauaaaggugaauauuauguucggacugggcagcaucuccuugcuccuguuagauguccugcucaucauucuuucacacauccguauucuguacgcgguguuuuguuugccaaguugggaggcaagacuaaaagcccugaauaccugcggcagccauauagggguaauccucgcuuucucuacucccgccuuuuucuccuuuuucacacacuguuuuggacaugacauuccucaguacauccacaucuuccuggcaaaccuuuauguuguggucccaccgacccugaaccccgugauuuacggugugaggacgaagcacauacgggagacugucuugcgcaucuuuuucaagaccgaucauuga

SEQ ID NO: 60183 - RNA, 975 nt, Artificial Sequence
  derived and/or modified sequence opt3 from OR52I1__Homo_sapiens__NP_001005169
augcugggccccgccuacaaccacaccauggagacuccugcuagcuuccuccuuguggggaucccaggacugcaguccucucauuugugguuagcaauuucacugagugccauguauauaacagcgcuacucgguaauacgcugaucgucaccgcuauuuggauggacagcacaagacacgaaccgauguacugcuuucuuuguguucuggccgcaguggauaucguaauggccuccucugugguccccaagauggugucgauuuucugcucaggcgacagcaguaucuccuuuucugcuuguuucacucaaauguuuuucguucauuuggcaaccgccguggagacagggcuccugcugaccauggcuuuugauagguaugucgccauaugcaaaccucuccacuacaagcggaucuuaacuccacaggugaugcugggaaugagcauggcgguaacaauucgcgcaguuaccuucaugacgccccuuuccuggaugaugaaccauuugccuuuuuguggcucaaauguggucgugcacaguuauugcaaacacaucgcccuggcucgacuagccugugcagacccagugcccagcucucucuacucccugauugguucaagccuuauggucgggagugauguugcuuucaucgccgcgucuuauauacugauuuugcgugccguguuugaccucuccagcaagacugcacagcugaaggcuuuaucgaccugcggaucucauguaggcgugauggcccuguacuaccucccuggcauggcuuccaucuaugccgcauggcuugggcaggauauugucccacugcacacacaaguguugcuagccgaccuguacguuaucaucccggcuacucucaaccccauuauauauggaaugagaaccaaacagcugcuugaagguaucuggucauaccugaugcauuucuuguuugaucacaguaaucucggcagcuga

SEQ ID NO: 60184 - RNA, 1053 nt, Artificial Sequence
  derived and/or modified sequence opt3 from OR52I2__Homo_sapiens__NP_001005170
augugccagcaaauccugagagacuguauucuccuuauacaccaucugugcaucaacaggaagaaagugagcuuggucauguuaggccccgccuacaaucacaccauggagacuccugcuuccuuccugcuaguugggauuccaggacuccagucuucacaucuguggcuugcaaucagucugagcgccauguauauuaucgcguugcucgguaacacaauaaucgugacggcuauuuggauggauuccacccggcacgaaccgauguacuguuuucugugcguacuggccgcaguggacaucgucauggccucuucggugguucccaagauggugucaauuuucuguagcggcgauaguuccaucucuuuuagcgcuugcuucacacagauguuuuucguccaucucgcaacugccguggagaccggguuacugcuuacaauggcuuuugaccgcuauguagccauauguaaaccuuugcacuacaagcguauucugaccccacagguuaugcuaggaauguccauggcgaucacuauucgagcaaucaucgccauuacaccccucucauggauggugagucaucugccuuucugcggcagcaaugucguggugcacucuuauugugaacacauagcucuugccagacuggcaugcgcugauccaguccccuccucauuguacagccucaucgguaguucucugaugguuggguccgacguggccuuuauugcggccagcuauaucuuaauacugaaagcaguauucggacucucgucuaagaccgcucaacuuaaggcccuguccacguguggcucacaugugggcgucauggcuuuguacuaccuaccugggauggccaguauuuaugcagccuggcugggacaggaugugguuccacuccacacucaggugcugcuugcugaccuguacgucaucaucccggcgaccuugaaccccauuaucuaugguaugaggacaaaacagcuccgggagcgcauuuggagcuaccugaugcacguguuauuugaucauuccaaucugggcucuuga

SEQ ID NO: 60185 - RNA, 945 nt, Artificial Sequence
  derived and/or modified sequence opt3 from OR52K1__Homo_sapiens__NP_001005171
augcugcccagcaacaucaccuccacacacccugccguguuccuccuugucggcauuccagggcuggagcauuugcacgcuuggauaucuaucccguuuugcuucgcauacacuuuagcccugcuaggaaauuguacgcuccuguuuauuauccaggcggacgcugcccuucaugaacccauguaucuguucuuggcaaugcucgccaccauugaucugguucugucaaguacaacucucccuaagauguuagcuaucuuuugguucagagaccaagagauaaacuuuuucgcaugccuggugcagauguuuuuccuucacagcuuuuccaucauggaaucugccguauugcuggcuauggccuucgauagguacguggcgauuuguaaaccacuacauuauaccacaguccucaccgguucgcugaucacuaagauuggcauggcagccguggcucgggccguuacacuuaugaccccucugcccuuuuugcuccgccgauuccacuacugccgugggccagugaucgcacacuguuauugcgagcauauggcugucgugagacuggccuguggagacacgucauucaauaacauauacggcauugcgguagccauguuuaucguuguguuagaucugcucuuugucauucuuagcuauguguuuauccugcaggcaguguugcagcuagcuagucaagaagccagguacaaggcuuucgguacuugcgucucccacaucggggccauucugucuaccuacacacccguugugauaagcuccguaaugcaucggguggcacgccacgccgcuccuagaguccacauccuccuggcgauuuucuaucuucuguucccaccgauggugaaucccaucauauacggaguuaaaacuaaacagauuagggaguauguguugucacucuuucagcggaagaacauguga

SEQ ID NO: 60186 - RNA, 945 nt, Artificial Sequence
  derived and/or modified sequence opt3 from OR52K2__Homo_sapiens__NP_001005172
augagcgccuccaacaucacccugacacaccccacugcuuuccuccuugugggcauuccugggcuggagcauuugcacauauggaucucuauuccauuuugcuuagcauacacgcuggcccuacucggaaauuguacccugcuucugaucauucaggcggacgcugccuugcaugaaccgauguaucucuuccuggcaaugcuggccgcuaucgaucucgucuuaucaaguagcgcacugcccaagaugcuugccauauuuugguucagagacagggagaucaacuuuuucgcuugcuuggcccaaauguuuuuccugcacuccuuuucuauuauggaaucggcgguucuacucgcaauggccuucgaucgguacguggcuaucuguaaaccucugcauuauacaaagguacuuacugguucacugauuaccaaaaucggcauggccgcaguggcucgcgccgucacauugaugaccccacuccccuuucuguuacgaugcuuccacuacugucgugggccugugauagcgcacugcuauugugagcauauggccguugugagacuggcaugcggagacacuagcuuuaauaacauuuacggcaucgcugucgccauguucauugugguacucgaucuucuguugguuauccuaaguuauaucuucauucugcaggcugugcuccugcuugccucccaggaagcaagguacaaggccuuugguacaugugucucucacauaggggcuauccuggcguucuacaccacgguggugauuagcuccgucaugcaucggguugcacgccacgccgcuccacacgugcauaucuugcucgccaauuuuuaucuguuauuucccccuaugguaaacccaauaauuuacggagugaaaacuaagcagaucagagagucaauccugggcgucuucccgaggaaggacauguga

SEQ ID NO: 60187 - RNA, 954 nt, Artificial Sequence
  derived and/or modified sequence opt3 from OR52M1__Homo_sapiens__NP_001004137
augcugaccuuccacaacgugugcagcguccccuccucuuuuuggcucacaggcaucccugggcuugagucacugcauguuugguugaguauuccauucggaagcauguacuuaguggccguaguggguaaugucacuauacuggcugugguuaagaucgaaagaucccuacaccagccgauguacuuuuuccucuguaugcuggcagccauugaccuugugcugucuacgucgaccauccccaaauugcucggcaucuuuugguucggggcgugcgauaucggacuggacgcuugucugggccaaauguuucucauacauugcuucgccacagucgagucagguaucuuuuuagcaauggccuucgauagguauguggcuauuuguaacccucugcggcacagcaugguacuuacuuauaccguuguggggcgcuugggacuggucagucuacuccgaggcgugcuguacaucggcccacuuccccugaugauucguuugagacucccucuguauaagacacaugugaucucccacucuuacugcgaacacauggcagucguugccuuaaccuguggggacagcagggugaauaacguauauggacuguccauagguuuucucgugcuuauucuggauucagucgcuaucgccgcgaguuacgugaugauuuuccgggcaguuaugggcuuggccacuccagaggcucgccuaaaaacacuggggaccugcgccagccaucucugugcaauccugaucuuuuacgugcccauugcugucucuucccuuauacacagauucggacagugcgugccuccaccgguacauacgcuguuggccaauuucuaucuccugauucccccuauuuuaaacccaaucguuuacgcggugaggacuaagcagauacgggaaucacugcuacagauuccccgcaucgagaugaaaauccgauga

SEQ ID NO: 60188 - RNA, 942 nt, Artificial Sequence
  derived and/or modified sequence opt3 from OR5D18__Homo_sapiens__NP_001001952
augcugcucaccgacagaaacacaagcggcacuacguucacccuucugggguuuuccgauuaccccgaguuacaggugccuuuguuccuggucuuucuagccaucuauaauguuacagugcucggaaacauuggucugauaguaaucauuaagaucaauccaaaacuucacacuccgauguacuucuuucugucucaauugucauucguggacuuuugcuauaguagcauuaucgcucccaagaugcucgucaaccuggugguuaaagauaggaccauauccuuccugggcugugugguccaguuuuucuuuuucugcacauuugugguaaccgaaucuuuccucuuagcaguuauggccuacgaccgguucguggcgaucuguaauccucugcuuuauacugucaacaugucgcagaaguugugcgugcugcuaguggucgggucauacgcuuggggaguuagcuguagucucgagcugacaugcuccgcccuuaaacuguguuuucauggcuucaauaccauuaaccacuuuuucugcgaauuuucuagcuugcucucccugucauguagugauacguauaucaaucagugguuacuguucuuucucgcaacuuucaacgagauuagcacccuucugaucguguugacaucuuacgccuuuauaguagugacuauucuaaagaugcgcuccgucucaggucgacguaaggcuuucaguaccugcgcaagccaucugacagccaucaccauuuuucacgggacgauccucuuccuguacugugugccaaauucuaaaaacuccagacauacuguuaagguggcuagcgucuuuuauacagugguaauccccaugcuuaauccucugauuuacucguugaggaacaaagacguuaaggauaccgugacugaaauacucgacacaaaagucuucucuuauuga

SEQ ID NO: 60189 - RNA, 945 nt, Artificial Sequence
  derived and/or modified sequence opt3 from OR5H2__Homo_sapiens__NP_001005482
augagcaacgaggacauggaacaggauaauaccacacugcucacugaguucgugcuuacgggccugaccuaccaacccgaauggaagaugccuuuguuuuuagucuuccugguuaucuaucuaauuacaauaguguggaaccucgggcugaucgcccuuauuuggaaugacccacagcugcacaucccgauguacuuuuucuugggaucccucgcuuuuguagaugcauggauuucuucaacugugacccccaaaaugcuggucaacuuccuggccaagaauagaaugaucagucucagcgagugcaugauacaguuuuucuccuuugcguucgguggcacaaccgaauguuuucugcuggcuacuauggccuaugacagguacguggcaaucugcaaaccucuuuuguauccaguuauuaugaacaauucucuguguauccggcuacucgccuucucguuuuuagggggauuccuucaugcucugauucacgagguguugaucuuccgccucacauuuugcaacucaaauauaauucaucacuucuacugugauaucauuccccuguuuaugaucagcugcaccgacccuaguaucaacuucuuaauggucuuuauucuguccggcucuauacagguguucacgaucguaacuguucucaauagcuauaccuuugcacuuuucacaauucugaagaaaaaguccgugcgagguguccguaaggccuuuucaacuuguggggcucauuugcuaagugugagccuguacuacggaccacucaucuucauguaucugagacccgccucuccucaagcggaugaccaggauaugauagacuccguguuuuacaccauuaucaucccacuucugaacccgauuaucuauucauugaggaauaaacaggucauugauagcuucacaaagaugguuaaacggaacguguga

SEQ ID NO: 60190 - RNA, 978 nt, Artificial Sequence
  derived and/or modified sequence opt3 from OR5H6__Homo_sapiens__NP_001005479
auguuccuguaccucugcuuuaucuuccagagaaccuguagcgaggaaauggaggaagagaacgccacacuucugacugaauuuguguugacgggcuucuuacaccaacccgacugcaagauuccucuguuucuagcuuuccucgucauauaucugaucaccauuauggggaaucuuggacugaucguuuugauuuggaaagauccacaucuccacaucccgauguaccuguuucuggguucccucgcauucguggacgccucuuuaucaaguacaguaacucccaagaugcugauaaacuuucuugcgaaaagcaagaugaucuccuugucugaguguauggugcaguucuuuucgcuggucaccacagugaccacugagugcuuccuacucgcuacaauggccuaugauagguacguugcaauuuguaaagcccugcuuuauccugugaucaugaccaaugaacugugcauucaguugcucguccugucauuuaucggcggguuacugcaugcucucauacacgaggcauucagcuuccggcuuacguuuuguaacaguaauauuauccagcauuucuacugcgacauuaucccacuguugaagaucuccuguacugauucuagcauuaacuuucuaaugguguucauauuugccggauccguacaaguuuucaccaucggcacaauucugaucucauauacuauaauucucuuuaccauccuggaaaagaaaaguaucaaggguauucgcaaagcugugagcacaugcggggcccaccuucugucugucuccuuguacuacggaccccucaccuucaaguaucugggcucagcgagcccucaggcagacgaucaggacaugauggagaguuuauuuuacacggugaucgugccacugcuaaaucccaugauuuauucucuccgaaacaaacaggucauagccuccuucacuaagauguuuaagagcaauguuuga

SEQ ID NO: 60191 - RNA, 927 nt, Artificial Sequence
  derived and/or modified sequence opt3 from OR5K1__Homo_sapiens__NP_001004736
auggccgaggaaaaccacaccaugaagaaugaguucauccugacaggcuuuacugaccaucccgaacucaaaacgcuucuguucguggucuuuuucgcuauuuacuugauaaccguuguggggaacaucagcuuaguagcacugauuuuuacacacagaaggcuacauacuccuauguauaucuuccucggaaaucuggcccuuguggauuccugcugugcgugcgcuauuaccccaaagaugcuggagaacuuuuucucugaaaauaaacggaucucauuguacgagugugccguccaguuuuauuuccucugcacaguggagaccgcagacuguuuucugcuggccgcuauggcauacgaucgcuauguugccauaugcaacccgcuccaauaccacaucaugaugaguaagaaauuauguauucagaugacuacaggugcuuucaucgccggcaaucugcauagcaugauucacguggggcuugucuuucgauugguguucugcggauccaaccacaucaaucauuucuauugugacauacugccccuauaccgucucucuugcguagauccuuacauuaacgaacugguucuuuuuaucuucucgggcucagugcaggucuuuaccauugguagcgugcugaucaguuauuuguacauccuccugacgauuuucaagaugaaguccaaagaggggagagcgaaggcauuuucuacuugugccagccacuucuuauccgugucacuguuuuauggaagucucuucuuuauguacgucaggccaaaucuucuggaagagggcgacaaagauauacccgcugccaucuuguucaccauuguugugccucuacugaacccauuuaucuauagccuccggaaucgcgagguaauaucugugcugagaaagauucuuaugaaaaaguga

SEQ ID NO: 60192 - RNA, 951 nt, Artificial Sequence
  derived and/or modified sequence opt3 from OR5K2__Homo_sapiens__NP_001004737
augguggaggaaaaccacaccaugaagaaugaguucauccugacaggcuuuacugaccaucccgaacucaaaacgcuucuguucgucguguuuuucgccauuuacuugauaaccgugguagggaacaucagcuuaguggcucugauuuuuacacacugcagacuacauacuccuauguauaucuuccucggaaaucuggcacuugucgauuccuguugcgccugugcgauuaccccaaagaugcuggagaacuuuuucucugaagguaaaaggaucucauuguacgagugcgcugugcaguuuuauuuccucuguacaguugagaccgccgacugcuuucugcuggcagccguggcuuacgaucgguaugucgcaauauguaauccgcuccaauaccacaucaugaugaguaagaaauuaugcauucagaugacuacaggcgccuucaucgcugggaaccugcauagcaugauucacgugggacuuguauuucgcuugguuuucuguggccugaaucacaucaaccauuucuauugcgacacccuaccccucuaccgacuguccuguguggauccuuuuauaaaugaacuuguccuguucaucuuuucugguucgguucagguguucacgauugggucagucuugauuagcuaccucuauauccuguuaacuaucuuucguaugaagaguaaggagggcagagccaaagcguucucuaccugcgcaucccacuuuagcuccguuucacuguucuacggaaguauauuuuuccucuauauuaggccaaaccuucuggaagagggcgggaaugacauccccgccgcuauuuuguuuacaaucgugguaccucuacugaacccauucauauacagccuccggaauaaggaggugauuucuguccugcgcaaaauccuucugaagaucaaaucccagggaucagugaacaaguga

SEQ ID NO: 60193 - RNA, 966 nt, Artificial Sequence
  derived and/or modified sequence opt3 from OR5V1__Homo_sapiens__NP_110503
auggagagaaagaaccagaccgccaucacagaguucauuauacugggcuuuagcaaucucaacgaacuucaauuccuguuguuuacuaucuucuuuuuaacguacuucugcacccuagggggaaauauucugaucauucucacaacugugaccgacccccaucugcacacaccuauguauuacuuucuugguaaccuggcuuucaucgauauauguuauaccacuuccaaugucccacagaugaugguucacuugcucucuaaaaagaaaucaaucaguuacgugggcugcguagugcagcuguuugcauucgucuuuuucguggggagcgaaugucugcucuuagccgcgauggcuuaugacagguacauugccaucugcaacccgcugcgguauuccguuauucuuucuaagguguuguguaaucagcuggcagccucgugcugggcugcaggauuucuaaacucagucgugcauacaguacucaccuucugucugcccuucugcggcaauaaccaaaucaauuacuuuuucugugauauaccuccacuucugauuuugagcugcgguaacacgaguguuaaugagcucgcccuguuauccacugggguguuuaucggauggacccccuuccuguguauuguccucucuuacaucugcaucauuagcacaauacuucgcauccaguccucagaaggccgacguaaagccuuuaguacuugcgcuagccaccuggcgauuguguucuuguuuuauggcucugcaaucuucaccuacgugagaccuauauccacauauucacuaaagaaggacaggcuggucagcguucucuacagugugguaaccccaaugcugaaccccauuaucuauacgcuucggaauaaagauaucaaggaggccgugaaaacuauugggucuaaguggcagccuccaaucuccagccuggacucgaaauugacauacuga

SEQ ID NO: 60194 - RNA, 936 nt, Artificial Sequence
  derived and/or modified sequence opt3 from OR6B1__Homo_sapiens__NP_001005281
auggagcuggaaaaccagaccagagugacaaaguucauccucgucggcuuucccgggagccuuuccaugagggccgcuauguuccugauuuuucuuguugcauacauauuaacuguggccgagaauguaaucauuauccugcuagugcuccaaaaccggccucugcacaaaccaauguauuucuuucuugcgaaucugucuuucuuggaaacgugguacauuucagucaccgugccgaagcuccuguuuaguuucuggagcguuaacaauuccaucucuuuuacacugugcaugauacagcucuauuucuuuaucgcuuuaauguguacugagugcgugcugcuugccgcaauggccuacgaccgcuaugucgcuauuugucgacccuugcauuacccuaccaucaugucgcacggacugugcuuccgucuagcacucgguucaugggccauuggcuuugggaucagccuggcuaaaauauauuucauuaguugucuuuccuucugcggaccaaacgugaucaaucacuuuuucugugauauuucucccguacugaacuugagcugcacagacauguccaucaccgaacucguugauuuuauccuggccuuagugauuuuccuguuuccucucuucauaacuguccuuucauacggcuguauccuggcgacaauuuugugcaugccaaccgguaagcagaaagcauuuaguacgugugccagccaucuagugguggucacuaucuucuacucugcuauaauuuuuauguaugccagacccaggguuauccaugcauucaauaugaacaagaucauuuccaucuuuuacgcuauugugaccccuucacugaauccauucauauauugccuccggaaccgcgagguaaaggaggcccugaaaaaguuggcguacugccaggccagcagaagugacuga

SEQ ID NO: 60195 - RNA, 939 nt, Artificial Sequence
  derived and/or modified sequence opt3 from OR6B2__Homo_sapiens__NP_001005853
augagcggcgagaacgugaccaaggucuccacauucauccugguugggcuccccacugccccuggacuucaguaccuguuguuuuuacuguuccuacucacguaucuguuugugcuuguagaaaaucuggcuauuauauugaucguguggucuucaaccagucuccacagaccaauguacuauuuccugagcuccaugucuuuucuggagauuugguacgucucggacaucacaccgaaaaugcucgaagguuucuuacugcaacagaagaggauuucauuugugggcugcaugacucagcuuuauuucuuuagcaguuugguuuguaccgagugcgugcugcuagcauccauggccuacgaucgguaugucgcgaucugucauccccuccgcuaccacgugcugguaacaccugggcuuugccugcaguugguuggauucucuuuugugagcggcuucaccauauccaugaucaaagucuguuuuauuucaagugugacuuucugcgguagcaacgugcucaaucauuucuuuugugacaucucuccaauucugaaguuagcuugcacagauuucuccaccgccgaacuggucgacuuuauccucgcauucauaauucuuguuuuuccccuguuggccacgauccuaucauacuggcacauuacucuggcugugcuccgaaucccuagcgcaaccggguguuggcgugccuucaguacaugcgcuucucaucugacuguagugaccgucuuuuauacagcccuucuguucauguacgugagaccacaagcgaucgauucccagagcucgaacaaauugauuucugcaguuuauaccguggucacgcccauaaucaauccucucauuuacugucugaggaacaaggaguuuaaggacgcccugaaaaaggcuuuaggacuaggccagacuucccacuga

SEQ ID NO: 60196 - RNA, 939 nt, Artificial Sequence
  derived and/or modified sequence opt3 from OR6C1__Homo_sapiens__NP_001005182
augagaaaccacaccgagaucacagaguucauucugcucggccuuacugacgaucccaauuuucagguggucauauucguuuuucuguugaucacguacauguuaagcauuaccgggaaccugacacuaaucacuauuacccuccuggacucccaucuucaaacaccuauguauuucuuucugaggaauuucucuaucuuggaaauaucauuuaccacugugaguaucccaaaguuccucggaaacauuaucagcggugauaaaacaauuuccuuuaauaacugcaucguacagcuguucuuuuucauacugcucggcgugaccgaauuuuacuuacuggccgcuaugucuuaugaccgguacgucgcaauuuguaagccgcuucacugcuugucgaucaugaaucgccgaguguguacgcugcuaguuuucacuucauggcucgugagcuuccugauuaucuuucccgcccuuaugcuguugcucaaacugcauuauugccguaguaacaucauugaucacuucaccugugacuacuuuccuuuacugcagcucgcgugcuccgauacaaaguuccuugaggucaugggguuuucuugugcugccuucacucugauguuuaccuuggcacuaauauuccugagcuauaucuacauuaucagaacaauacucaggauuccauccaccucacagcggacgaaagccuuuaguacuugcagcucucauauggugguaguuuccaucucauacggaagcuguaucuucauguauauuaagcccagugcuaaggaccgcgugucucuguccaaaggcgucgcaauccuuaauacaagcguggccccuaugaugaacccauuuauuuacucgcugagaaaucaacaggugaagcaggcuuucauaaacauggccaggaaaaccgucuuuuucacuucuacauga

SEQ ID NO: 60197 - RNA, 927 nt, Artificial Sequence
  derived and/or modified sequence opt3 from OR6F1__Homo_sapiens__NP_001005286
auggacaccggcaacaagacacugccccaggauuuccuccuucugggguuuccuggaagccaaacuuugcaguuaucccuguucaugcuauuucucgugauguacauccugacggucucugguaauguugccauucuuaugcuggugucaaccagucaccaguugcauacaccaauguauuucuuucucagcaaccuguccuuccuggagauaugguacacuaccgcugcaguaccgaaagcccucgcgaucuuacugggcagaucucagacaauuucguuuaccucaugccuuuugcaaauguauuucguguuuagccugggguguacugaauacuuccuacucgcugccauggcauaugacaggugccuggccaucuguuacccccuucacuauggagcuauuaugaguucccuguugucugcacagcucgcccugggcagcugggucugcgguuuuguggcuaucgccguuccuacagcguuaauauccgggcugucauucuguggaccacgggcaaucaaucacuuuuucugcgauauugcccccuggaucgcucucgccuguaccaacacgcaggcaguggagcuugucgcuuucgugauugccguaguugugauccugaguagcugcuugauaacuuuugucucuuacguguacauuaucuccaccauucuacgcaucccuucagcgagcggccgaaguaaggccuucucuacauguuccagccaucugacugugguccucaucugguauggcucgaccguuuuucugcaugugcguacaucuauuaaagacgcacuugaucugauaaaggcuguacacguguugaauaccgucgugacgccaguucucaaccccuucaucuacacucugagaaauaaagaagugagggagacauuacugaagaaguggaaagggaaguga

SEQ ID NO: 60198 - RNA, 975 nt, Artificial Sequence
  derived and/or modified sequence opt3 from OR6K2__Homo_sapiens__NP_001005279
auggagagccccaacagaaccacaauccaggaguucauauuuuccgccuucccuuacucuugggugaagucagucguuugcuuugugccauuacucuucauauaugcuuuuaucguagugggcaaucuugucauuaucacugugguucaacugaacacgcacuugcauaccccgauguacacauucauuagugcacugagcuuucuggaaaucugguauacuaccgccacaauacccaaaaugcuauccucucuccugucggaaaggucaaucagcuucaaugggugucuucugcagauguacuuuuuccacaguaccggaauuugcgagguguguuugcucacugucauggcguuugaccauuaucuggcuaucugcuccccucugcacuacccaucuauuaugacacccaagcucuguacccaguuaacgcugagcugcugugugugcgguuucaucacuccucuuccagaaauagccuggauuuccaccuugcccuuuuguggcucaaaccaucuggagcacaucuucugcgauuuccuaccuguacuccggcuggcauguacagacacucgcgccauuguuaugauccagguggucgaugugauccacgcuguggagauuauaaccgcagucaugcuuaucuuuaugaguuaugacgggauuguugccgugauccugcgaauacauagcgcuggaggccguagaacagccuucucuaccugcguaucccacuuuauuguguucucauuguuuuucgguagcgucacgcucauguaccugagguuuagugcgacuuacucuuuauucugggauaucgcaaucgcccuggcuuuugccgugcucuccccauucuuuaauccgauuaucuauagccuucggaacaaagaaauuaaggaggcaauuaaaaagcauaucgggcaagcuaagauuuucuuuucgguucgccccggaacaucuuccaaaaucuucuga

SEQ ID NO: 60199 - RNA, 948 nt, Artificial Sequence
  derived and/or modified sequence opt3 from OR6K3__Homo_sapiens__NP_001005327
auggagagcggcaaccaguccaccgugacagaguucaucuuuacuggguucccccaacugcaggacggaucucuccuuuacuuuuucccucuguuguuuauuuauacguucauaaucauugauaauuuacugaucuuuucagccgucagacuagacacccaccuccauaacccaauguacaauuucauuaguaucuuuagcuuccuggaaauaugguauacaacugcuaccaucccgaagaugcuuuccaaccugauuucugagaaaaaggcaaucucgaugacagguugcauuuugcagauguacuuuuuccacucacucgaaaauagcgaaggcauccugcugaccacuauggccauagauagguauguugcgauuuguaacccccuccgguaccagaugaucaugacaccucgcuuaugcgcucaacugagugccggguccugucuuuuuggauucuugauucugcuaccagagaucgugaugaucucuacccuccccuucugcggcccuaaucagauucaucagauauuuugugaccugguaccagugcuuagccuggcaugcacggauacuuccaugaucuugauugaggacgucauccacgccgugaccauaauuaucacauuccucaucauugcucugucauauguucgaaucgugacugucauuuuacguauacccaguagcgaagguagacagaaagcauuuucuaccugugccgggcaucugaugguguucccuaucuuuuucggauccguaucacucauguaccuuagguuuagcgauacauacccaccgguucuggacaccgcuauugccuugauguucacggugcuagcgcccuuuuucaacccuaucaucuauagucugcggaauaaggauaugaacaaugcaauuaaaaagcucuuuugccugcaaaagguccuuaacaaaccaggcggcuga

SEQ ID NO: 60200 - RNA, 1032 nt, Artificial Sequence
  derived and/or modified sequence opt3 from OR6K6__Homo_sapiens__NP_001005184
augaagcaguacagcgugggcaaccaacacuccaauuauagaucucugcucuuucccuuucuuugcucacagaugacccagcugacagccagugggaaccagacuauggucacggaguucuuguuuagcauguucccucaugcucacaggggagguuuacuguuuuucaucccacuacuccugauuuacggcuuuauacuuaccgggaaucugaucauguucauuguuauccaagugggaauggcauugcauacaccgcucuauuucuucauuuccguacugucuuuucuggaaaucuguuacacuaccacaaccauacccaaaaugcucucgugcuuaaucucagagcaaaagagcauuaguguggccggcugucugcuucagauguauuucuuucacuccuuggguaucacugaaucuugcguccugacagcgauggcuauugaccgguacaucgccauauguaacccucuacgcuauccaaccauuaugauccccaaacucugcauucagcugacgguggggagcuguuucugcggauuccuucugguuuugccugagaucgcauggaucuccacucucccauuuuguggcucaaaucagauucaucagauauucugcgauuuuacccccgugcugaguuuagccuguacagacacuuuccuggucgugaucguagaugcuauucacgcagccgaaaucguugcuagcuuucucgugauagcccuuucuuacauucgaaucaucauugucauccugggcaugcacuccgcggaggggcaucacaaggcauucucaaccugcgccgcucauuuggccguguuucuacuguucuuuggaagcguggcagucauguaccuccguuucagugcuacauauucuguguuuugggacaccgccauugcgguuacguucguaauacuggccccauuuuucaacccuaucauuuacucccuuaaaaauaaggauaugaaggaggcaaucgguagacuguuccacuaucagaaaagggcuggcugggccgggaaguga

SEQ ID NO: 60201 - RNA, 939 nt, Artificial Sequence
  derived and/or modified sequence opt3 from OR6N1__Homo_sapiens__NP_001005185
auggacaccggcaacuggagccagguggccgaguucaucauucugggguuuccccaccuccaaggaguccagauauaccuuuuccuguuguuacugcuaaucuaucucaugacaguucuggguaaucuucugaucuuuuuggugguaugccucgauuccagacugcauacuccuauguaccacuucgugucuauucugucauuuagugaacucggcuauacggcugcaaccauuccaaagauguuagccaaccugcuuagcgagaaaaagacaaucuccuucucuggguguuugcugcagauauacuuuuuccauucgcuaggagcgacugaaugcuaucuccugaccgcuauggccuacgacagguaucuugcaaucugucggccgcugcacuaccccacauugaugaccccuacucucugcgccgagauugcuaucggcuguuggcuggguggguuagcaggaccagucguggaaauuucacugaucagccgccuccccuuuugcggcccuaaucgaauacagcauguuuucugugauuuuccacccgugcuuagucuggccugcacagacaccuccauuaacgucuugguggauuucguaaucaauucuuguaaaauucuagcuacguuucugcucauccugugcagcuacguucaaaucauuuguacugugcuucguauaccuuccgccgcgggcaagagaaaagcaaucucaaccugcgccagucacuucacagucgugcugauuuucuaugggagcaucuugucuauguacgugcagcucaagaaguccuauucacuggacuacgaucaggcuuuagccgucguuuauagcgugcugacuccauuucuaaacccguucauauacagucucaggaauaaagagauuaaggaggcaguacggcgccagcugaaaagaaucggaauccuugcuuga

SEQ ID NO: 60202 - RNA, 954 nt, Artificial Sequence
  derived and/or modified sequence opt3 from OR6N2__Homo_sapiens__NP_001005278
auggaccaguacaaccacagcucccuggccgaguucguguuucucggcuucgcuucugucggguauguuagaggauggcuuuuugugcuguuguuacuggcauaccuauucaccaucugcgguaauaugcucauauuuucaguaauuaggcuggaugccgcgcuucauacacccauguaucacuucgugaguguccugagcuuuuuggaacucugguacacugcuacgaccaucccuaagaugcuguccaacauucugucugagaaaaagacaaucucguucgccggcugucucuuacaaacuuacuuuuuccauucacugggggcaagcgaaugcuaucuuuugaccgccauggcuuaugaccgguaccuggcaauuugucgcccacuacacuacccgaucauaaugacaaccacucucugcgccaaaauggcugccgcguguuggacaugcggauuucugugucccaucagugaggugauucuugcaucccagcugccuuucugcgccuauaaugaaauccagcauaucuuuugugauuucccacccuugcucucucuggcuugcaaggacaccagcgccaacauuuuaguugauuucgcaauaaaugcuuuuauuauccugauuacguucuuuuucaucaugaucuccuacgcccgaauuauaggcgcggugcucaaaaucaagacugccucaggucguaagaaagcauuuaguaccugugcuagccaccuugccgucgugcugauuuucuuugggucuaucauauucauguauguaagauugaagaaauccuacucacuaacacuggacaggacucucgcuauuguuuauagcgugcugaccccuauggucaacccaaucaucuacagucuucggaauaaggagauuaucaaagccauuaagcgcacaauauuucagaagggagauaaagcaucucuggcccacuuguga

SEQ ID NO: 60203 - RNA, 939 nt, Artificial Sequence
  derived and/or modified sequence opt3 from OR6X1__Homo_sapiens__NP_001005188
augagaaacggcaccgugaucacagaguucauucugcucggguuucccgucauacagggacuucaaacuccucuguucaucgccauuuucuugacguacaucuuaacccuggcugguaauggccuaauuaucgcaacaguuugggccgaaccaaggcuccagauaccgauguauuucuuucugugcaaccuuagcuuccuggagaucugguacacuaccacagugauucccaaguugcucgggaccuuuguaguggcgcggacugucaucuguauguccugcugucugcugcaggcuuucuuucacuucuuugugggaacaaccgaauuucucauuuuaacgaucaugucuuuugaccgcuaucugacuauaugcaauccucuucaucacccaaccauuaugacaucaaaauugugucugcagcuagcccucaguagcuggguugugggcuucacuaucgucuucugccaaaccaugcugcuuauucagcugcccuuuugugguaacaaugugaucucccauuucuacugcgauguagggccuucuuugaaggcagccuguaucgacacaucgauucucgagcuguuaggaguuauagcuaccauccuggugauuccaggcucacuccuuuuuaacaugaucagcuauauauacauucugagugcaaucuugcgaauccccuccgccacgggccaccagaaaacuuucucuacaugcgcuagccaucuaaccgucgugucccugcucuauggggccgugcuguuuauguaccuucguccuacugcgcacucaaguuucaagauuaauaaagucguuagcgugcugaacacaaucuugaccccacuccugaauccguuuauuuacacgauaagaaacaaggaaguaaagggagcauuaaggaaagccaugaccugucccaagacaggucacgcuaaauga

SEQ ID NO: 60204 - RNA, 978 nt, Artificial Sequence
  derived and/or modified sequence opt3 from OR6Y1__Homo_sapiens__NP_001005189
augaccacaaucauucuggagguggauaaccacacugucacgaccagauucauacuccuuggcuuucccacaaggccugccuuccagcuguuguuuuucagcaucuuuuuagcuacuuaccugcuaacccuccuggaaaaucuucugauuaucuuggcaauucauuccgaugggcaacuccacaagccaauguauuucuuucugucucaucugucauuccucgagaugugguacguuacagugaucaguccgaaaauguuaguagacuuucugagccacgauaaguccauaucuuucaacggaugcaugacccagcuuuacuuuuucgugacuuuugucuguacagaauauaucuugcuggccauuauggcguucgaccgguauguggcuaucugcaauccccuacgcuacccuguuauuaugaccaaccagcucugugguacgcuggccggcgggugcugguucuguggacuuaugacugcaaugaucaaaaugguguuuauagcccagcugcauuauugcggcaugccacaaauuaaucacuacuucugugauaucucgcccuugcucaacgucucaugcgaggacgcuagccaggcagaaaugguggacuuuuuccuggccuuaaugguaauugcuaucccucuguguguuguggucgccaguuacgcggcaauccucgccaccauucuucgaauaccauccgcucagggucgucagaaggccuuuucuacaugcgcaagccaccugacuguggugaucuuguucuauuccaugacccuauuuacauacgcuagacccaaacugauguaugccuacaauucaaacaaggucguuagugugcucuauaccguaauugugccucugcuuaauccaaucauauacugucugaggaaccaugaggucaaggcggccuugcggaaaacgauucacugccgcgggagcggaccgcaaggcaauggcgcauucucuuccuga

SEQ ID NO: 60205 - RNA, 963 nt, Artificial Sequence
  derived and/or modified sequence opt3 from OR7C1__Homo_sapiens__NP_945182
auggagaccggcaaccagacacacgcccaagaguuccugcuccuuggguuuagcgcuacuuccgaaauccaguucauucuguuuggauuguucuuaucuauguaccuggugacguuuaccgguaaucuacucauaauccuggcaauuugcucagacagucaucuucacacacccauguauuucuuucugagcaacuuguccuucgccgaucucuguuuuacuucuaccacagucccuaagaugcugcugaauauccucacccagaacaaauucauuacuuacgcgggcugcuuaucgcagaucuuuuucuuuacaucauucgggugucuggacaaucuuuugcugaccguuauggcuuaugauagauucguggccguaugccauccacuacacuacacggugauaaugaacccgcaacucuguggacugcuuguccugggcagcuggugcaucagugugauggguuccuugcucgaaacucugaccguuuuaaggcugucuuuuuguacagagauggaaauuccccauuucuuuugcgaccuccuugaggugcugaaguuggcauguagcgauacuuucaucaauaacgucgugauuuauuuugccaccgggguacuaggaguuaucuccuucacaggcauauuuuucucauacuauaaaauuguguuuaguauccugcggauuagcucugcuggccgcaagcacaaagcauucucaaccugcgggucccaccucagcgucgugacgcuguuuuacggaacugguuucggcguguaccuuaguucugccgcuacaccuuccagccgaaccucgcuggucgccucuguuauguauacuauggugacaccaauguugaaucccuuuaucuacucccuccguaacaccgacaugaagagagcgcuggggagguuacugucacgggcaacguucuucaauggagauaucaccgccggccuaaguuga

SEQ ID NO: 60206 - RNA, 939 nt, Artificial Sequence
  derived and/or modified sequence opt3 from OR7D2__Homo_sapiens__NP_787079
auggaggccggcaaccagaccggguuccuggaauuuauccuccuuggacugagcgaggaccccgaauugcaaccuuucauuuuugguuuauuccuguccauguaccuagugacaguccucggcaaucugcuuauaauccuggcuauuucuucagauagucacuugcauacuccaauguacuuuuuccucagcaaccuguccuggguugacaucugcuuuucuacguguauugugccgaagaugcugguaaauauccagaccgagaacaaagcaauaucguauauggauugccucacacagguguauuucucaauguuuuuccccaucuuagacacucugcuuuugaccgucauggccuacgauagauuuguggcgguuugucacccucugcauuauaugauuaucaugaauccacaccuaugcgggcuccugguguucgucacauggcuuauuggagugaugaccagccuguugcauaucagucucaugaugcaccugauauuuuguaaggacuucgaaauuccccacuucuuuugcgaguuaacuuacauccugcagcucgcuuguuccgauacauuccuuaacucuacccugauuuauuuuaugacgggcguauuggguguuuucccucuacuggggaucaucuuuagcuacuccaggauugccucaaguauacggaaaaugucuagcuccggaggcaagcaaaaagcacucucaacuugcggcagccaucugaguguggucucucuuuucuacgggaccggaaucggugugcacuuuacauccgccgugacucauagcucgcagaagauuucugucgcuuccguuauguauaccgugguaacaccaaugcugaaucccuucaucuacucauugcgcaacaaggacgugaaaggcgcacucgggagucuguuaagccgagccgcuuccugucuguga

SEQ ID NO: 60207 - RNA, 1020 nt, Artificial Sequence
  derived and/or modified sequence opt3 from OR7E24__Homo_sapiens__NP_001073404
augagcuacuuccccauccuguuuuucuuuuuccucaagagaugcccuuccuauaccgagccacagaaccuuacaggcgugucugaauuucuguuguuagggcugucagaggacccggaacuacaacccguccucgccggacuguuccuuaguauguaccugguuacuguguuggguaaucuccugauuauacuggcuguaagcuccgauucucaccuccauacgccuauguacuuuuucuuaucgaaccugucacuugcagacaucggcuuuaccagcacaacugugccaaaaaugauugucgauaugcagacccacaguagggugaucuccuaugagggguguuugacacagaugucuuucuuuguucuguucgccugcauggacgauaugcuacucagcgugauggcguaugaccgguuugucgcuauuugucauccccugcacuaccgcaucauaaugaauccucgacuuugcggauuccugaucuugcucuccuucuuuauuucacuguuagauagucagcugcauaaccucaucaugcuucaacugaccuguuucaaggacguggauauuagcaacuuuuucugcgacccaucucaguugcuacaucugcguuguuccgauacuuuuaucaaugaaaugguaauauauuucaugggcgccauuuuugguugccuccccaucucagggauucuguucagcuacuacaaaaucguuaguccuauccuuagagugccaacaucugacggaaaguauaaagcauuuuccaccuguggcagccaccuggccgucgugugcuuguucuacggcacggggcucgugggauaucugucgucugcugucuuaccgucccccaggaagucaaugguugcaagugugauguacacuguagugaccccuaugcugaauccauuuauuuauagccuacggaacaaggauauacaguccgcccucugucgccugcacgguagaaucauuaaaucucaccaucuucaccccuucugcuacaugggcuga

SEQ ID NO: 60208 - RNA, 1080 nt, Artificial Sequence
  derived and/or modified sequence opt3 from OR8S1__Homo_sapiens__NP_001005203
auggcccugggcaaccacagcaccaucacagaguuccuccuucugggguuguccgcugaccccaauauuagagcauuacuguuugugcuauuccucggaauauaccugcuuacuaucauggaaaaccugauguugcuccugaugauuagggccgauucuugccugcauaagccuauguacuuuuuccucucacacuuaaguuuugucgaccuguguuucagcuccguuaucgugccaaaaaugcuugagaauuugcugucucagcggaagacgauuucgguagaagguugccuagcgcaaguguuuuucgucuuugugaccgcuggcacagaggccugucuccugucagggauggcauaugaucgccaugccgcuaucugccgaccgcuucuguauggacagauaaugggcaaacaguuguacaugcaccucguuugggguagcugggggcugggauucuuagacgcacugaucaacgugcuccuugccgucaauaugguguuuugugaagcuaagauuauccaucacuauaguuacgagaugcccucccuguugccucuaucuugcagcgauauuucccguucacugaucgcccuccuguguaguacucuucugcacggcuugggcaacuuccuccugguauuuuuaagcuauaccagaauaauuucuacaauccuguccauuucaagcaccagugggaggucuaaagcguucuccacuugcagcgcacaucuaacagccguuacccucuacuacggaucgggucugcuucggcacuugaugccaaauucuggcucccccaucgagcugaucuucucagugcaguauacggucgugacuccuaugcucaacagucugauuuacagccuuaagaauaaggaagugaaaggggagcgcucccugagagacucuagccauuugccacaacuccacaagggacaggcuagguggaaacggcccgccuuuaccgaaggccgccgagagccuggucacccagagcugucaauaccggucacaccccagccucagggggcaugugcuugcagugccuuaagagcggccccaacugcacugcccuga

SEQ ID NO: 60209 - RNA, 1008 nt, Artificial Sequence
  derived and/or modified sequence opt3 from OR9K2__Homo_sapiens__NP_001005243
augcugggcagcaagcccagagugcaccucuacauccuuccuugcgccucccagcaagucucuaccaugggggacaggggaacaucaaaccauagugaaaugacugauuucauucuggcugguuuucggguucgcccagaauugcacauauuacuguuccuacucuuucuguucguguaugcaaugauccuucugggcaauguagggaugaugacgauuaucaugaccgacccgcgauugaacacacccauguacuuuuuccucggaaaucugagcuuuauugaucuguucuauuccucugugaucgagccuaaagccaugauaaacuuuuggucggaaaauaagucaaucagcuucgcgggcugugucgcucagcucuuuuuauucgcccugcuuauugugacugagggguuuuugcuggcagccauggcuuacgaccguuucaucgcaauuugcaacccacuacucuauaguguucagauguccaccagacuguguacacagcuuguggccgguucuuacuucugcggauguaucagcuccgucauacaaaccucaaugacuuuuacacugaguuucugcgcuagcagggccguggaucauuuuuauugugacucucggcccuugcagcgccucuccugcucagaucuguucauucacagaaugaucagcuuuaguuuaucuuguauuaucauccugccuaccauuauaguaaucauuguuuccuacauguacaucgugagcacgguccucaaaauacauucgacugaaggccacaagaaagcguucucuaccugcuccucacaccuuggcguggugaguguccuguauggggcaguguuuuucauguacuugacaccagacagguuucccgagcuaagcaagguugccucccuguguuauucucucguaacuccuaugcugaauccacuuauuuacagccugcggaacaaggaugugcaggaggcuuugaaaaaguuccucgagaaaaagaauaucauccuguga

SEQ ID NO: 60210 - RNA, 945 nt, Artificial Sequence
  derived and/or modified sequence opt3 from OR9Q2__Homo_sapiens__NP_001005283
auggccgagagaaacuacaccguggucacagaguucuuucugacugcuuucacggaacaccuccaguggaggguuccccuuuuucugaucuucuugagcuuuuauuuagcaaccaugcugggcaauacagggaugauucuacucauacggggagaccgccgacugcauacuccuauguacuucuuucuuucccaccugucuuugguggauaucugcuauucaagugccauuaucccacaaaugcucgcgguacugugggaacaugguaccacaauuagccaggcucguugugccgcacaguucuuucuguucaccuuuuucgccuccaucgacugcuaccucuuagcuauaauggcauaugauagauacacugccgugugucagccgcugcuuuaugucacaaucauuaccgagaaggcuagguggggcuuggugacgggggccuacguugcgggauuuuucucugcauucgugcggacugucaccgccuuuacacugucguucugcggcaacaaugaaaucaacuuuauuuucugugaccuacccccucuccugaaacuuucaugcggugauagcuacacucaagaggugguaaucauaguuuuugcucuguucgugaugccagccuguauuuuggucauccucgugaguuaucuguuuauuaucguggcaaucuuacagauucacuccgcugggggacgcgccaagaccuucucuacaugcgcgagccaucugaccgccgucgcacucuuuuucggcacgcuuauauuuauguaccugagagacaauacuggccaguccucagagggggauaggguugugaguguauuguauacaguggucacccccaugcuaaacccucugaucuacagccuccggaauaaagaagugaaggaggcuacucgcaaagcccugucuaaguccaagccagcucgaagacccuga

SEQ ID NO: 60211 - RNA, 906 nt, Artificial Sequence
  derived and/or modified sequence opt3 from ORAI1__Homo_sapiens__NP_116179
augcaccccgagccugccccaccgcccagcagauccucuccugaacugccacccucaggcgggaguaccacaagcggauccaggcggucucgccgacguucgggugacggcgagccuccaggggcucccccuccaccgcccucagcagugacuuacccugauuggaucggacagagcuauagugaagucaugucccucaacgagcauucuaugcaagcccuuagcuggagaaagcuguacuuguccagggcgaaauuaaaggcuucaagucggacgagcgcccugcuaucuggcuucgcaaugguugccaugguggaaguacagcucgacgcugaucacgacuauccacccggucugcuuauugcauuuuccgccugcaccacagugcuggucgcugugcauuuguucgcccucaugauaucaacuuguauccugccuaauauugaggcgguuagcaacgugcacaaucugaacagugucaaagagucuccacaugaacgcaugcacagacacaucgagcucgcaugggccuuuuccaccgugauugggacauuacuguuccuugcugaaguaguuuugcugugcugggugaaguuucuaccccucaaaaagcagccgggacagccuaggcccaccagcaagccuccagccucgggcgcagcugccaaugucucuacuuccggcaucacacccgggcaagcggccgcaauagcuucaaccacgaucauggugccauucggacugauuuuuaucguguucgccguccauuuuuaccggagucuuguuagccacaaaacugaucgccaguuccaggagcugaacgaguuggcugaauuugcccgacuccaggaccaacuggaucauagaggugaccaccccuuaaccccuggcucccacuaugcauga

SEQ ID NO: 60212 - RNA, 888 nt, Artificial Sequence
  derived and/or modified sequence opt3 from ORAI3__Homo_sapiens__NP_689501
augaagggcggggagggagacgccggugaacaggcuccccugaacccugagggcgaaagcccagcaggguccgccaccuacagagaguucgugcacaggggauaucucgaucuuaugggcgcgucucaacauucacugcgggcuuugaguuggcgccgauuauaccugagccgugccaaacuaaaggcauccucuagaacaucggcccuccugucagguuuugcuauggucgcaaugguugaagugcagcuugagagcgaccacgaguauccgcccgggcuguugguagccuucagugcuugcacuacggugcucgucgccgugcaucuguuugcgcugaugguuuccaccugucucuuaccucacaucgaagcagugucuaauauucauaaccugaauagcguccaccaguccccacaccagaggcuucaucgguacguggaguuggccuggggauucucaacagcucugggcacuuuucuauuccucgccgaaguaguucuggugggcugggucaaauuugugcccauaggggcaccucuugauaccccaacacccauggugccuaccagucgcgucccaggaacucuggcuccgguugccacaagccuuucucccgcguccaaccucccuagaucaagcgccagugcagcuccaucucaagccgagcccgcuugcccuccaaggcaggccugugguggcgggggagcacacggccccgguuggcaggccgcuauggcguccaccgcaaucauggugccgguagggcugguguucgucgccuuugcuuuacauuucuaucggagccugguggcccacaagacggaccgcuacaaacaggagcucgaagaguugaaucgacugcaaggagaauugcaggcaguuuga

SEQ ID NO: 60213 - RNA, 414 nt, Artificial Sequence
  derived and/or modified sequence opt3 from ORAOV1__Homo_sapiens__NP_703152
auggccggcagccaggacaucuucgaugcuauugugauggcagacgagagauuucacggggaaggauacagggaggguuaugaagagggcuccucucugggggucauggaaggacggcaacauggcacccuccacggugccaagauagggucagagaucggaugcuaccagggcuucgcguuugcuuggaaaugucuucugcauaguugcacaacugagaaggauagccgcaaaaugaagguuuuggaauccuuaauuggcaugauccagaaauuccccuaugacgauccuacguacgacaagcugcacgaggaucuagacaagauucgagggaaauuuaagcaguucuguucucuccugaacgugcaaccagauuuuaaaaucucggccgaaggaucaggucuuagcuucuga

SEQ ID NO: 60214 - RNA, 1734 nt, Artificial Sequence
  derived and/or modified sequence opt3 from ORC2__Homo_sapiens__NP_006181
augagcaagcccgagcugaaagaagacaagaugcucgaggugcacuucgucggcgaugacgauguucuuaaccauauccuggacagagaagggggagccaaauugaagaaagagagggcucaguuacuggugaauccuaagaagauuauaaagaagccagaauacgaucuagaggaggacgaucaagaaguacucaaagaccagaacuauguggagaucaugggucgggauguccaggaaucccugaagaauggcucugcaaccgggggaggcaacaaaguguacucauuucagaaucgcaagcacagugagaagauggccaaacuugcgagcgagcuggcuaagacaccgcaaaaauccguuucuuucucguugaagaacgaccccgaaauuacuaucaaugugccucagucaagcaaaggucauagugccuccgauaagguccagcccaaaaacaaugacaagucugaguuucucagcacggcaccacgaucccugcguaagagacugauugugccuaggucacacagugauagcgaaucugaguauuccgccucaaacagcgaagacgacgaggggguagcucaggagcaugaagaggauaccaaugcaguuaucuucagucagaaaauacaagcccagaaccggguggucucugcuccagugggaaaggaaacacccuccaaacgcaugaagagagacaaaacuagcgaucucguggaggaauacuuugaggcccacucgucuuccaaggucuuaaccucagacaggacacugcagaaacuuaaacgggcgaaguuggaucaacagacccugcgcaaucuacucaguaaaguuagcccuuccuucucugcagagcugaagcagcuuaaccaacaguaugaaaaacuguuucacaaguggauguugcagcuccaucugggcuucaauaucguguuauacggccuggggagcaagcgagaccuccuugagagauuuaggacuacaaugcugcaggauucaauucacguagugaucaacggauucuuuccagguauuagugucaaauccguguugaacagcaucaccgaagagguucuagaccauaugggcacguuccggucuauacuggaucaacucgacuggauugugaauaaguuuaaagaagauucaagucuggagcuuuuccuguugauccacaaccucgacagccagaugcugcguggggagaagucccagcagauuaucggacaauuaucuucgcugcacaauaucuaucuaauugccagcauagaccaucucaacgcuccgcugaugugggaucacgccaaacagucccuuuucaauugguugugguacgaaacuaccacauacucacccuauacugaggaaaccaguuacgagaacucucugcucgucaagcagagcggcucccugccucuuucaagccugacacauguguugcgcucucucaccccaaaugcaagagguaucuuuaggcuguuaauuaaguaucagcuggacaaccaagauaaucccuccuacaucgggcuaaguuuccaggacuuuuaucagcagugccgggaggcuuuccucguaaacagcgaucugacgcuucgagcccaauugacugaauuucgcgaccacaaacugauaagaacaaagaaaggaaccgauggcguugaguaccuccugauuccuguggacaauggcacuuuaacagauuuccuggaaaaggaggaagaggaggcguga

SEQ ID NO: 60215 - RNA, 1707 nt, Artificial Sequence
  derived and/or modified sequence opt3 from ORC3__Homo_sapiens__NP_001184188
augaagcacuuccugcagaaacucaucagccaacuuauggacugcuguguggauauuaaguccaaagaggaagagucuguccauguuacccagagaaagacacacuacucaauggacagucugagcuccugguauaugacugugacgcagaaaaccgaucccaagauguugucuaagaaaaggacaacuucgucacaguggcaaagcccuccaguaguggucauauuaaaggacauggaaaguuuugccaccaaagugcugcaggauuucaucauuaucuccucucagcaucuacacgaguuuccgcucauucugaucuucggcauagcuacaagccccaucauuauccaucggcuucugccucacgcaguuuccucauugcucugcauugaacuguuucagagucugagcuguaaggagcaccucaccacuguguuagacaaacugcuuuugacaacccaauucccauuuaagaucaacgagaagguccuucaggugcuaacgaauauauuccucuaccaugauuuuucuguacagaacuucauuaaagggcugcagcuuucccuguuggaacacuuuuauucacaaccccucagcguucugugcuguaauuuaccugaggccaagcgccgaaucaacuuccugaguaauaaccagugcgaaaauauucguagacucccaucuuuuaggcgguacguggagaaacaggcguccgagaagcaagucgcucugcugacuaacgaacgcuauuugaaagaggaaacccagcuacugcucgagaaucugcauguguaccacaugaacuauuuccuugugcugagauguuugcacaaguucacaagcucgcuccccaaauacccucugggaaggcagauccgggaauuauacugcacuugucuggagaagaauaucugggacucugaggaauaugccuccguccuacagcuccugcgcaugcuugcaaaggaugaguugaugaccauucuggaaaaaugcuuuaagguuuucaaaucauacugugagaaccaucucgguaguacagccaagcgaauagaagaguuucuggcucaauuccagagccuugacgagaccaaagaagaggaagaugcauccggcucucagccaaaggggcugcagaagacggacuuguaucaccuccaaaaaucacuguuagagaugaaggaacugagaaggagcaaaaagcagacuaaauuugaggugcuacgggagaauguagugaacuucaucgauugccucguccgugaauaccugcuuccgcccgagacacagccuuugcaugaagugguuuauuuuagugccgcucacgcccugcgcgagcaucucaaugcggcaccaagaauugcccugcacaccgcuuuaaacaaccccuacuauuaccugaagaaugaggcccuuaaguccgaagagggaugcaucccuaacauagcaccagacauuuguaucgcuuacaaauugcaccucgaaugcagcaggcugaucaaucuaguggacuggucugaggccuucgcgacugucgugacagccgcagaaaagauggaugcuaacucagccaccagugaggagaugaaugaaauuauccaugcucgguuuauucgagccguaagcgagcuggaacuccugggcuucauaaaacccacgaagcagaaaaccgaccacguugcacgccuuacaugggguggguguuga

SEQ ID NO: 60216 - RNA, 1059 nt, Artificial Sequence
  derived and/or modified sequence opt3 from ORC4__Homo_sapiens__NP_001177810
auggagaucgaagaggugagcgaaaacguccugcagguucaccucaauggccuucugcaaauuaacgacaagauagccuugaaagagaucacuagacaguuaaaucuggaaaacgugguaggggauaagguguucggauccuuugcugagaaucuaucuuuccuccuggaggcacuuaaaaagggugacaggacaucaaguugccccgucauuuuuauccuggaugaguucgacuuguuugcccaucacaaaaaccagacucuccuguacaaucuguucgauauuagccaguccgcgcaaacgccuaucgcugugauaggccucaccugucgguuagacauccuggagcuuuuggaaaagcgcguuaagucucgauuuucgcaucgucagauucaccugaugaacucauucggguuuccacaguaugugaaaaucuucaaggagcagcuaagccucccggccgaguuucccgauaaagucuucgcagaaaaguggaaugagaacgugcaauaccugagugaagacagauccguacaggagguucuucagaaacauuuuaauauuucuaagaaccugaggagcuugcacaugcuccugauguuagcccugaaucgggugacagcuucccacccuuucaugacugcagucgaucucauggaagccucacagcuuugcaguauggacagcaaggcuaacaucgugcauggacugucuguguuggagauaugucuaauuaucgccaugaaacaccugaaugauauuuaugaggaagaaccauucaacuuucaaauggucuacaacgaguuccagaaguuuguucagcgcaaagcgcauuccguguauaauuucgaaaagcccguagugaugaaagcauuugaacaccuccaacagcuggagcuuaucaagccuauggagagaaccucaggcaacagccagagggaauaccagcugaugaaauugcuccuggacaauacacaaaucaugaacgccuuacagaaguauccaaauugccccaccgauguccggcagugggcuaccaguucucuguccuggcuauga

SEQ ID NO: 60217 - RNA, 1308 nt, Artificial Sequence
  derived and/or modified sequence opt3 from ORC5__Homo_sapiens__NP_002544
augccccaccuggagaacgugguccucugcagagaaagccagguuuccauccuucaaucucuguucggcgagaggcaucacuuuucauucccuaguauuuuuauauacgggcauaccgccagcggaaagacauaugugacucagacguuguuaaaaacccuggaacuaccacacguauucgugaauugugucgagugcuuuacacuccggcugcuucuggaacagaucuugaacaagcucaaucaucuguccucuucggaggaugguuguucaacugagauuaccugcgaaacauucaacgauuuugugcgccuguucaaacagguuaccacugcugagaaucucaaggaccaaacaguguacaucgucuuagauaaagcagaauaucugcgagacauggaggccaaccuuuugccgggcuuucugcgucuacaggagcucgcggauagaaaugugaccguacuguuccuuagcgaaauuguuugggagaaguuuaggcccaacacgggguguuucgaaccuuuugugcuguacuucccagacuauaguaucggaaauuugcagaagauacucucccacgaucaucccccugaguacucugcugacuucuaugccgcauacaucaacauucuguuaggcgucuuuuacacugugugccgggaucugaaagaacuccgccaccuugccgugcugaauuucccaaaguauugugagcccgucguuaaaggugaggcuagcgaaagagacaccaggaaguuguggcggaacaucgagccucaccugaaaaaggcaaugcagacaguguaccuacgcgaaauuuccucaagucaaugggagaagcuccagaaagaugacacugauccagggcagcugaagggacuuagcgcccauacccacguagaacugccguauuacucuaaauuuaucuugauagcugccuaucucgcguccuacaaucccgcacgaacagacaagagauucuuucugaaacaccauggcaagauuaaaaagaccaacuucuuaaagaaacacgagaagacgucaaaucaucugcuaggcccuaaaccauuuccccucgacaggcugcuugccaucuuguauagcauuguggauagucgggucgcuccuacugccaacaucuucucucagaucacaucccuggugacccuccaacugcuuacucugguugggcacgacgaucaguuggacggaccaaaguacaaaugcacagugagccucgauuuuauucgugcaauagcucgcaccgucaacuucgacaucauuaaguaccuguaugacuuuuuauga

SEQ ID NO: 60218 - RNA, 759 nt, Artificial Sequence
  derived and/or modified sequence opt3 from ORC6__Homo_sapiens__NP_055136
augggcagcgagcugaucgggagacucgcccccaggcuuggacuggcugaaccugacauguugcggaaggcagaggaauacuuacgccugucccgagugaaaugcgucggucuaucugcccguaccacagagacuucaagugcgguuaugugucucgaucuggcugccagcuggaugaagugcccacuugacagagcauaucugauuaaauuguccggccucaacaaggaaacguaccagucuugucugaaaucguucgagugccugcucggguuaaauucaaacauaggaaucagggaucuggccgugcaauuuagcuguauugaggcuguaaauauggcaaguaagauccuuaaguccuaugaaucuagcuugccgcagacccaacagguggaccuggaucuaucccggccccucuucacaucagccgcucugcuuagugccugcaaaauucugaaguugaaagucgacaagaacaaaaugguggcgacuagcggcguuaagaaggcaaucuuugaucgccucuguaaacagcuggagaagauaggucaacagguggacagagaaccuggggaugucgccaccccacccaggaaacggaagaaaaucgugguagaggcuccugccaaggagauggaaaaaguugaggaaaugccacacaagccccagaaggacgaggauuuaacacaggacuacgaagaguggaaacgcaagauucuggagaaugcagcuucugcccagaaagcgaccgccgaauga

SEQ ID NO: 60219 - RNA, 606 nt, Artificial Sequence
  derived and/or modified sequence opt3 from ORM1__Homo_sapiens__NP_000598
auggcccugagcugggugcucaccguccuuucccuguugcccuuacuggaggcucagaucccucuaugcgcaaaccucguuccagugccgauuacaaaugccacucuggacagaauaacgggcaagugguucuacaucgcgucugcuuuuaggaacgaagaguauaauaaaucaguacaagaaauucaggccaccuucuuuuacuucacacccaacaagacugaggauaccaucuuucuucgggaauaucagacacgccaggaccaauguauuuacaauaccacuuaucugaacgugcagcgagagaaugggacaaucagucguuacgucggaggucaggagcacuucgcacauuugcucauacugagagauaccaaaacguauaugcuggccuuugacgugaacgaugaaaagaauuggggccucagcguuuacgcugacaaaccugagacuaccaaggaacaguuaggggaguucuacgaggcacuggauugccuuaggaucccaaaguccgacguggucuauacagauuggaaaaaggacaaaugugaacccuuggagaagcaacacgaaaaagagcggaagcaggaagagggagagucuuga

SEQ ID NO: 60220 - RNA, 606 nt, Artificial Sequence
  derived and/or modified sequence opt3 from ORM2__Homo_sapiens__NP_000599
auggcccugagcugggugcucaccguccuuucccuguugcccuuacuggaggcucagaucccucuaugcgcaaaccucguuccagugccgauuacaaaugccacucuggacagaauaacgggcaagugguucuacaucgcgucugcuuuuaggaacgaagaguauaauaaaucaguacaagaaauucaggccaccuucuuuuacuucacacccaacaagacugaggauaccaucuuucuucgggaauaucagacacgccagaaucaauguuucuacaacaguagcuaucugaaugugcagcgagagaacgggaccgucucccguuacgagggagguagagaacacguggcacauuugcucuuucugagggacacuaaaacacugauguucggcucuuaucucgaugacgagaagaauuggggguuaucguuuuacgccgauaaaccugaaaccacgaaggagcagcugggagaguucuacgaagcucuugacugcuuguguauuccacggucagauguuauguauacugacuggaagaaagauaagugcgagccccuggaaaaacagcacgagaaggaacgcaaacaagaggagggcgaaagcuga

SEQ ID NO: 60221 - RNA, 462 nt, Artificial Sequence
  derived and/or modified sequence opt3 from ORMDL3__Homo_sapiens__NP_001307731
augaacgugggcaccgcccacagcgaggucaaucccaacacaagaguuaugaacuccagggggaucuggcugucuuacgugcucgcuauuggacuucugcauauaguauuguuaucaaucccuuucgugagugucccagugguuuggacucugacgaaucuaauucacaauauggguauguauaucuuucuccauaccgugaagggcacaccguucgaaacucccgaccaggggaaagcacggcugcuuacccacugggagcaaauggauuacggaguccaguuuacagccagccgcaaguuccugaccauuacuccuaucguguuguauuuucucacauccuucuacaccaaauaugaccagauacauuuuguacugaacacgguuucucugaugucggugcucaucccaaaguuaccccagcugcacggcguccgaauuuucgguaucaauaaauacuga

SEQ ID NO: 60222 - RNA, 1839 nt, Artificial Sequence
  derived and/or modified sequence opt3 from OS9__Homo_sapiens__NP_001017956
auggccgcugagacccugcucagcucccuucugggcuuguuacugcuagggcuccugcuucccgcaucucugacaggaggugugggcucauugaaccucgaagaacugagugaaaugagauacgggaucgagauucugccucucccagucaugggaggccagagccaauccucugacguugugauaguaucgucaaaguauaaacagagguacgaaugccgguuaccggccggugcgauccacuuccagcgcgagcgagaggaagagacucccgcuuaucaggggccuggcauuccagaacugcuuagccccaugcgugaugccccuuguuugcugaagacgaaagacugguggaccuacgaguuuugcuauggaagacauauccaacaguaccacauggaggauagugaaauuaagggcgaggugcuauaucucggguacuaccaguccgcauucgacugggaugacgaaacagccaaagccucuaagcagcauaggcugaagcgguaucacagccaaacuuacggaaaugguuccaaaugugaucuuaacggccgcccaagagaggcagaagucagguuucugugcgacgagggggccggaaucucaggcgauuauauagaccggguggaugagcccuugaguuguagcuacguucucaccauccgcacaccucgacugugcccacauccguuacugagacccccuccaucugcugcuccccaggcgauucucugucacccuucccuucagccagaagaguauauggcauacgugcagaggcaagccgacucaaagcaguauggugauaaaaucauugaagaacugcaggacuuggggccccaagucuggagcgaaaccaagaguggaguggcuccgcagaaaauggccggcgcaucuccuacuaaggacgauuccaaggacagcgauuucuggaaaaugcuaaaugagcccgaggaccaggcuccaggcggggaagagguaccugccgaggagcaggaucccucgccagaagcggccgacucugcauccggagcucccaacgauuuucaaaauaacguucaggugaaggucauccggaguccugccgaccugauacguuucauugaggagcucaaagguggcacaaagaaagggaagccaaauaucggacaggaacagccgguggaugacgcugccgaggugccccaacgcgaaccugagaaagagagaggcgauccagaaaggcagcgggagauggaagaggaagaggacgaggacgaagaugaggacgaagaugaggacgaacgacagcugcuuggugaguuugagaaggaacuggaggggauuuugcuccccucagaucgcgacagacugaggagcgaagucaaggcaggcauggagcgggaauuagagaacaucauccaggagaccgaaaaagagcuggauccugacggacuaaagaaagaauccgagcgcgauagagccaugcucgcucugacgucuacucuuaauaaguugauuaaaaggcuggaggaaaagcaaagcccagagcucguuaagaaacacaagaaaaagcgugugguacccaaaaagccgccuccaucaccccagccuaccggcaagauagaaaucaaaauugugcggcccugggcggaggggacagaagagggagcacgauggcugacugacgaggauaccagaaaccuuaaggaaaucuucuuuaauauacuggucccaggugccgaggaagcucagaaagagaggcagcgccaaaaggaauuggagaguaacuaccggagaguguggggcuccccugggggagagggcacaggugaccucgaugaguucgacuuuuga

SEQ ID NO: 60223 - RNA, 2253 nt, Artificial Sequence
  derived and/or modified sequence opt3 from OSBP2__Homo_sapiens__NP_001269667
augcacagacagaggacccggacaaugagcucccuggccgcuaagcgccucggcaugaaccgacgucccgcagggucuggagguggcgggggagaggccgcgacuuggggccauagauucuggaggccucaagaacggccaacggaccgcaaucagggugagauggcucauaccugcagagggacaaucaaccuuucaacugcccacauugauaccgaagacaguuguggaauacuguugacaagcggcgcaagguccuaccacuuaaaagccucuucggagguggaucggcagcaguggaucaccgcucuggaacuagcaaaggccaaagcuguccgcguuaugaauacucauucagacgauagcggcgacgaugacgaggccacaaccccggcggauaagagugagcuccaccacacgcugaaaaaccuuucccugaaguuggacgaucucucuacuugcaaugaccugauugcaaagcauggggccgcucugcaacgaagccucaccgaauuagauggacugaaaauccccuccgagucaggugaaaaacuuaaggugguaaacgagagagccacauuguuuaggauuaccaguaaugcaaugaucaacgcuugucgggacuuccuggagcuagccgaaauacacagccguaaguggcagcgcgcgcuccaguaugagcaggaacaaagagugcaucuggaggaaaccaucgagcagcuugccaaacagcacaauucucuggagagggcauuucacuccgcuccuggccggccagccaaccccucaaagagcuucauugaagggaguuugcucacaccuaagggagaggacucugaagaggaugaagacaccgaguacuuugaugcuauggaggacuccacgagcuucaucacugucauuacagaagccaaagaggaucgaaaggcagaaggcucgaccgguacuucuuccguggacuggucaagugccgauaauguucuggacggggcuagcuuagugccaaaaggauccucuaaggucaaacgcagagugaggauccccaacaagccuaauuauagccugaaccucuggucaauaaugaaaaauugcauuggccgggagcuuagucgcaucccaaugccgguaaacuuuaacgaaccccuguccauguugcagagacuaacagaggaucuggaguaccaucaccuccuggacaaggcgguucauuguaccagcucuguggaacaaaugugccuugucgcagccuucucagugaguagcuauuccacgaccgugcacaggauugcuaagccuuuuaauccaaugcugggcgagacauucgaauuggaucgucucgacgacauggggcugcggucuuuaugugagcaggucucgcaucaucccccuagcgccgcacacuacguguuuuccaaacacggauggucacuguggcaggagaucacuaucaguucuaaguuccgagguaaauauauuagcauaaugccacuaggcgccauccaccucgaauuucaggcuuccgggaaccauuacguuuggagaaagucaaccagcacaguacacaauauuaucgugggaaaacuguggauagaucaaucuggcgacauugagaucgucaaccacaagacuaaugauaggugccagcuuaaguucuugcccuacuccuauuucaguaaagaagccgcacgcaaggugaccgguguugugagcgacucucaggggaaagcgcauuacguccuguccggcucaugggaugagcaaauggaauguaguaaggugaugcacagcucgccguccucuccuagcucagacggaaaacagaagacaguauaucagacccucagugcuaagcugcuuuggaaaaaguacccccugccagagaacgccgagaauauguauuacuuuuccgaauuggcacucacucugaacgagcaugaagagggcguugccccuacggauucucgguuaagacccgaccagaggcugauggaaaaagggcgcugggaugaggcuaauacagagaagcaacgacuagaagagaaacagcggcucagccguagaaggcgccuggaagccugcggaccagguuccucauguagcagugaggaagagaaggaggcagacgcuuauacuccccuuugguucgaaaagcgguuggauccucugacuggcgagauggccugcguguacaaagggggauacugggaagcgaaggagaaacaggacuggcacaugugcccaaacaucuuuuga

SEQ ID NO: 60224 - RNA, 2424 nt, Artificial Sequence
  derived and/or modified sequence opt3 from OSBP__Homo_sapiens__NP_002547
auggccgcuaccgagcugaggggcguggucgggcccggaccugcagccaucgcggcucucgguggcgggggagccggcccaccgguugugggugggggaggcggcaggggagacgcagggcccgguagcggcgccgcuuccgggacaguaguggcagccgcugccggaggcccugguccaggggcgggaggcgucgcagccgcuggccccgccccugcaccacccacugggggaucugguggcucaggggcuggaggcagugguagcgcccgggaaggguggcuuuucaaguggacgaacuacauuaaaggcuaucagcgccgaugguuugugcuguccaauggauuguuaucuuacuaucguucgaaggcggagaugagacauaccugcaggggcacaauaaaccuggccacugcaaauaucaccguugaagauucauguaacuucauuaucagcaaugggggagcucaaacauaccaccuaaaagccaguuccgagguggaacggcagcgcugggucaccgcucucgagcuggccaaggcaaaagccgugaagaugcuugcugagucugacgaaagcggugaugaggaauccguaucacagacugacaagacagagcugcagaacaccuugagaacgcucaguagcaaaguugaggaucugucuacuugcaaugaccugauugcgaagcacggcaccgcacuccaaagguccuuaucagaacuggagagccuuaaauugccugccgaaaguaacgagaagaucaaacaggugaaugaacgggcuacacuguuucgcauaacuucuaacgccaugaucaaugcaugucgagauuuccuaaugcucgcccagacccauuccaagaaguggcagaaaagccugcaauaugagagagaccagaggauucggcuugaggaaacacuggagcaguuggcuaagcagcacaaccaucucgaacgugccuuucgcggggcaaccguccugccagcgaauacgccgggaaacgugggcucggguaaagaucaaugcuguucugggaagggcgacauguccgaugaggacgaugaaaaugaguucuuugacgcucccgagaucauuacuaugccugaaaacuuaggacacaaaagaacaggcucaaacaucaguggggccagcuccgacauaucucuggaugagcaguacaagcaccagcucgaagagaccaaaaaggaaaagaggacucggauuccauauaaacccaauuacagccuuaaccuguggucaaucaugaagaauugcauuggaaaagaguugaguaagaucccuaugccagugaacuucaaugagccccuauccaugcugcaacgacucacagaagaccuggaguaccaugaacuucuggaucgcgcagccaaaugugagaacagcuuggagcagcucugcuaugucgcugccuuuaccguuucuucauacaguacgaccguguucagaacaagcaagccguuuaauccucuguuaggugaaacuuucgagcuggacaggcuagaagagaacggcuaucggucccucugugaacagguaucucaccaucccccagcagcugcccaccacgcggagucgaagaauggguggacccugcgccaggagaucaaaauuacaagcaaguuuagaggaaaauaccuuuccauaaugccuuugggcacuauccauugcauuuuccacgccaccggucaucacuauacauggaagaaagugaccacuacgguccauaacaucauaguggggaagcuguggauugaucaaucaggcgaaaucgacaucguuaaucacaagacaggagauaaauguaaccucaaguucgugcccuacaguuauuuuucuagggacgucgcucguaaagugaccggcgagguaacugauccaagcgggaagguucacuucgcacugcuuggaaccugggacgagaaaauggaaugcuuuaaggugcagcccgucauuggcgaaaaugguggggaugcccggcagcgaggacaugaggcugaggaauccagagugaugcuguggaagaggaacccuuugccgaaaaaugccgagaacauguacuacuucucagaacucgcacugacauuaaacgcgugggagagcggcaccgccccaacugacucucgccugcggcccgaccagagacuaauggaaaaugguaggugggaugaggcuaacgccgagaagcaacgccucgaagagaaacagcgacugucccggaagaaacgugaagcagaggcuaugaaggccacagaggacggcacgccuuaugauccauacaaagcacuuugguuugaaagaaagaaggaccccgucaccaaagaguugacucacaucuauagaggggaauacugggagugcaaggaaaaacaggauuggaguagcuguccugacauuuucuga

SEQ ID NO: 60225 - RNA, 2103 nt, Artificial Sequence
  derived and/or modified sequence opt3 from OSBPL10__Homo_sapiens__NP_001167531
auggagagagccgugcagggcaccgacgggggagguggcagcaacuccucuucaaggaguagcucccgggcuacaucugcagggucgucacccagcugcagucuggccggacgcggcgucuccucucgaagcgcggcugccggucucgggggaggcggcucccguucaaguccugggagcguugcagccucuccauccggagguggcgggagaaggcgggaaccggcucuugagggagugcugucaaaguacacuaauuuguuacaaggcuggcagaaccgcuauuucguacuggauuuugaagcagguauccuacaguacuucgugaaugagcagagcaaacaccaaaagcccagagggguccucagucugucuggagccauugugucccuuagcgacgaagcuccucauaugcugguuguguauucggccaacggcgagauguuuaaauugagggcggcagaugccaaggagaaacaguucugggucacgcagcuccgggcuugugccaaguaccacauggaaaugaacucuaagaugaugaaucagguggagggccaacagaaaaaucugguacaugcaauagaaucccugccagggucaggaccccucaccgcuuuagaccaggaucugcuuuugcugaaggccacaagugcggccacucuaagcugccucggugagugucugaaccuucugcagcaauccguucaccaggcaggccagccuucucaaaaaccaggggcuagcgagaauaucuugggauggcauggcucaaagagucacuccaccgaacagcucaaaaacgguacacuggggagcuuacccucugccucagcuaauauuaccugggccauccugccuaacagugcagaggacgaacagacuagccagccagagccggaacccaauuccggcucugagcucgugcuuucggaggaugaaaagagcgacaacgaggauaaggaagagacagaacugggagucauggaggaccaacgcuccauuaucuugcaccuaauaucacagcugaaacucggcauggaucugaccaagguggugcuuccuacguuuauccuggagaaacgaaguuugcucgaaauguaugccgacuucauggcucauccagaucuguuacuggcgauuacugcaggggccacccccgaggaaagagucaucugcuuuguugaguacuaucuaacagcuuuccacgaaggaaggaagggugcccucgccaaaaagccuuacaauccaauuaucggcgagacuuuucauuguucuugggaggugcccaaagaccggguaaagccgaagcguaccgcaagccgcuccccugcuucaugccacgaacaccccauggccgacgauccaagcaaaucuuacaagcugagauucguggcagagcaggucucccaucacccucccauaaguuguuuuuauugcgaaugugaggagaaaaggcuuugcgugaacacacauguuuggaccaagagcaaauucauggggaugucugugggagucuccaugauuggcgaagguguguugcggcugcucgagcacggggaagaguacguauuuacgcugccaucagcguaugcucgaaguauccuuacuauucccuggguugaacugggcggaaaggugagcaucaacugugccaagacaggcuacucggcaaccgucaucuuccauacuaaaccuuucuaugggggaaaggugcaccgcgucacagccgaggugaaacacaauccaaccaacacgauuguuugcaaggcucauggugaguggaauggcaccuuggaauuuacauacaacaauggggagacuaaagugauagacaccacaacucucccgguauaucccaagaagaucagaccucuggaaaaacagggaccaauggaguccaggaacuuauggcgggaagucacccgcuaccugagacuaggcgauauugacgccgcaacagagcaaaagaggcaccucgaggaaaaacagcguguggaggaacggaagcgagagaaucugagaacccccuggaaaccuaaguacuucauccaggaaggugauggguggguuuauuuuaacccacuuuggaaggcucauuga

SEQ ID NO: 60226 - RNA, 2244 nt, Artificial Sequence
  derived and/or modified sequence opt3 from OSBPL11__Homo_sapiens__NP_073613
augcagggcggggagcccgugagcaccaugaaggucuccgaaucugagggaaaacuggaaggucaagccacagcuguuacuccuaacaaaaauucaaguugcggcgggggaaucagcuccucuucgucaagcagaggcgguagugcaaaaggguggcaguacuccgaccacauggagaacguguauggauaccucaugaaguauacgaaucuuguaaccggcuggcaguacagguucuuugugcugaacaaugaagccggcuuguuagaguauuucgucaacgagcagucucggaaucaaaaaccacgcgggacacugcagcuagcgggagcugugauuagcccguccgaugaagacucacauacuuuuaccguuaacgccgcaaguggugagcaguacaagcuccgagccacagaugcuaaggaacgucagcacugggugagcagacugcaaauauguacccagcaucacacugaggcaaucggcaaaaauaaucccccucuuaagucuagguccuucucacuggccagcaguucuaacuccccaauuagccagcggcgccccucgcagaacgcuaucuccuuuuucaaugucgggcauucuaaauugcaaucacucaguaagagaacaaaccugccuccagaccaccugguggagguaagggaaaugaugagccacgccgagggacagcagcgggaucucauucgccgaaucgaaugcuuacccaccuccggccaucugucuagccuugaccaagauuugcugaugcuaaaagcgacgucaauggcaacuaugaauugucucaacgacugcuuucacauacugcagcuucagcaugccagucaccagaaggguucccugccuagcgggaccacaaucgagugguuggaaccaaagauuucucucucaaaccacuauaaaaauggagcugaucaaccguucgccacugaccagaguaagcccguugcagugccugaggagcagccagucgcugaaagcggccuguuagccagagagcccgaagagaucaacgcggaugacgaaauugaggauaccugugaccauaaagaggacgaucugggcgccguggaggaacagagguccgugauccuccaccuucugucucaauugaagcuagggauggaccugacacgggucguucucccuaccuuuauacuggaaaaacguucgcuucuggagauguacgcagauuucaugagccauccagacuuguuuauugcuaucacgaauggagccacugcugaagaucgcaugauuagauucguggaguacuaucucacauccuuucacgaggguaggaagggcgccaucgcaaagaagcccuacaacccgaucauuggggaaaccuuccauugcucauggaagaugccuaaaagugagguagccucuagcguguucuccucaagcucuacucagggagucacaaaucacgcuccccuguccggcgaaaguuuaacccagguggguagcgacuguuauacgguucgguuuguggcggagcaggucucucaccauccaccuguguccggguucuacgcagagugcaccgaacgaaagauguguguaaacgcccacguuuggacaaaaucaaaguuucugggcaugaguauaggagugacuauggucggcgaggggauccuaagccuccuggaacauggagaggaauauaccuucucgcuucccugcgcuuacgcccgcuccauuuugacagugccaugggucgagcuggguggcaaagugucuguuaauugugcaaagacuggguauagcgccucaaucaccuuucacacaaagcccuucuacggaggcaaacuccacagagugaccgcugagguaaagcauaacauaacuaauacggucgugugcaggguucaaggugaauggaacagugugcuggaguuuacauacuccaauggggaaaccaaauaugucgaucuuacuaagcuggccgugaccaaaaagcggguacgcccuuuggagaagcaggacccauucgaaucuagaaggcucuggaaaaacgugacagauagccugcgugaguccgagauugacaaggcaaccgaacacaaacauacuuuagaggaacggcagcgaacagaggaaagacacaggacggagaccggcacuccguggaagacaaaauacuuuaucaaggagggagauggcuggguuuaucauaagccccuguggaaaaucauuccuaccacacagccagcggaauga

SEQ ID NO: 60227 - RNA, 1314 nt, Artificial Sequence
  derived and/or modified sequence opt3 from OSBPL1A__Homo_sapiens__NP_060500
augagcgaggaaaaggacugcggcgggggagaugcccuguccaacgguaucaaaaagcacagaaccucucuccccucaccuauguucaguaggaaugacuuuagcauuugguccauacuucggaaauguaucggcauggagcugucuaagauuacaaugccagugaucuucaacgaaccguugucguuuuuacagcgccugacugaguacauggaacauacguaucuaauucacaaggcuucaagccucagugaucccgucgagcgaaugcaaugcguugcagccuucgcgguguccgcuguagccucucagugggagcguaccgggaagccuuuuaauccacugcuuggagaaacauacgagcuggugagagacgauuugggcuucaggcucaucagcgaacaggucucccaucaucccccuauaucagcauuucacgccgagggucugaacaaugacuucaucuuucacgggaguauuuauccaaagcugaaauucuggggaaagagcguggaggcugaacccaaaggcacuaucacccucgaguuacuggaacacaacgaggcauacacauggaccaauccuacuuguugcguucauaacauuaucgugggcaaacuuuggauagaacaguaugggaaugucgagauuaucaaccacaaaacaggagauaaguguguguugaauuuuaagccaugcggucuguucggcaaagagcuacauaagguagaaggguacauucaagacaaaucuaagaaaaagcucugugcccuguauggaaaauggaccgagugccuuuacuccguugauccggcuacguuugacgccuacaagaagaacgauaaaaagaauacugaagagaaaaagaacucaaaacagaugagcaccagugaggaacuggacgagaugcccgugccugauucugaauccgucuucaucaucccaggcagcguguugcucuggcggauugcgccccgcccuccaaauucggcacagauguauaacuucacaucuuuugccauggugcugaacgaggucgacaaggacauggaauccguuauacccaagacugauuguagauuaaggccggacauccgggcuauggagaauggugaaauugaucaggccucagaggagaaaaagcgccuggaagagaaacaacgagcagcuagaaagaacaggaguaaaagcgaagaggacuggaagacccggugguuccaccaggggccuaaucccuacaacggagcccaggauuggaucuauuccggcucuuacugggaccguaauuauuuuaaccucccagauauauacuga

SEQ ID NO: 60228 - RNA, 1113 nt, Artificial Sequence
  derived and/or modified sequence opt3 from OSBPL2__Homo_sapiens__NP_001265578
augcccaucgccuucaacgagccucugagcuuucuccagagaauuaccgaauacauggagcacguguaucuuauacauagggcuuccugccaaccacagccgcuggaacggaugcagucugucgcagccuucgcgguuucagcuguggccagucagugggagcgcacaggcaagcccuuuaauccuuuguuaggggaaacuuacgagcugauccgagaggaccuaggauuccguuuuauuagcgaacaaguaucccaccauccacccaucucugcauuccacucggagggucucaaccaugauuuucuguuccacggcucaauuuauccuaaacuuaaguuuugggggaaaagcguggaagccgagccaagaggaacgaucacccuggaguugcucaagcacaaugaggcuuacacauggacuaaccccaccuguugcguccauaaugugauaaucggcaaacuguggauugaacaguaugguacaguugaaauccugaaccacaggaccgggcauaagugugugcuccacuucaagccuugcggauuauuuggcaaagagcugcacaaggucgaaggccauauucaggacaaaaauaagaaaaaguuguucaugaucuacgggaaguggacugagugucuuuggggaauagauccagugaguuaugaguccuuuaaaaagcaggaacggcgcggugaccaccugagaaaagcaaagcuagaugaggacucuggcaaagccgauagcgacguagcugaugacguuccgguggcccaagaaacaguccaggugauucccggguccaagcuccuguggaggaucaacacccggccuccaaauucagcgcagauuuggcccgcacgccgaagaaguggauggaggcggagccgugagaaacauggcgguucugggccucgcagaaggcaguccggacggcgaggcggcucaacgcaagccaucacuccaacccuugggcccccgacaggaugcaugcaggguaucacucugagcggcauuaguccuaccgcucagauaucuacagaaggguuggagggacccggcgcccgcgauagaaggcucacccggcuggacuucuuagaguggccacuguga

SEQ ID NO: 60229 - RNA, 2664 nt, Artificial Sequence
  derived and/or modified sequence opt3 from OSBPL3__Homo_sapiens__NP_056365
augaugagcgacgagaagaaccugggcgugucccagaaacucgucucucccucaagaaguaccagcuccugcaguucgaagcaagggucaaggcaggauagcugggaaguuguggagggacuucggggugaaaugaauuacacacaggagccuccaguacagaaaggcuuccuguugaagaaacgcaaguggccguuaaagggguggcacaaacgauuuuucuaucuggacaagggaauccuaaaauacgccaagagucaaacugauauugaacgugagaaacuccauggcuguauagacgugggucuguccgucaugucugugaaaaagagcuccaaaugcaucgaucuugacacggaggaacacauuuaucaucugaagguuaaaucagaggaaguguuugaugagugggucaguaaguugagacaccauaggauguaccggcagaacgagaucgcuauguucccccacgaagugaaucacuuuuucagcgggucuaccauuacagacuccucaagcggaguauuugauaguaucucuucccgcaaaagaagcucgauaucuaagcagaaccucuuccagacuggcuccaauguuucauuuaguuguggcggggagaccagggugccucuguggcugcaaagcuccgaagacauggagaaaugcucuaaggaucucgcacauugucacgccuauuuagucgaaaugagccagcugcuucagucaauggacguguugcaucggacauacagugcgccagcuaucaacgccauucagggagguuccuucgagagccccaagaaagagaagcgcucucaccgaagauggaggucacgggcaaucggcaaagaugccaaggggacccugcaagugccuaaaccauuuaguggacccguccgucuacacagcuccaauccuaaccucucuacucuggacuucggcgaagagaagaauuauucggacgguagcgaaacauccucagaguuuaguaagaugcaggaagaucuuugccauauugcucacaaaguuuacuucacccugcgcucugcauucaacaucaugagcgccgagagagagaaguugaaacagcucauggaacaagacgcuuccucaagcccaucugcccaggugauagggcugaagaaugcguuauccagugcacuggcccagaacacggaucucaaagagaggcuucggcgcauucaugcugaaagccuguugcuagacucuccggccguagcaaaguccggagauaaucuggcugaggaaaacucacgagacgagaauagagcccucgugcaccagcugaguaacgagagcaggcuuucgaucacugauucccugucugaauuuuucgacgcgcaagaggucuugcucagccccucaaguuccgaaaacgagauuucugaugacgauagcuacguguccgacaucucagacaaucugagcuuagauaaccugaguaaugaccuagauaacgagcggcagacccucggcccuguucuggacucuggccgcgaagccaaguccagaaggcguacaugucuuccagcacccugcccuagcucgucaaauaucucuuuguggaacauucugcggaauaacauagggaaagaucucaguaagguggcuaugccagucgagcugaaugaaccccuuaacacucugcagcgauugugugaggaacucgaguauuccgagcuguuagacaaagccgcucagaucccgagcccucuggaaagaaugguguacguagccgcauuugccauuucugcuuaugcgagcuccuacuauagggcaggaucaaagcccuucaauccaguucuaggugagaccuacgaaugcauccgcgaggauaaaggcuuucaauucuuuagugaacaggugagccaucacccucccauaucugccugucacgcugagucccggaacuucgucuuuuggcaggacgugagauggaagaauaaguucugggggaaaucaauggagauugucccaaucggaacaacccaugugacgcuccccguuuuuggcgaucacuucgaauggaacaaggugacuucuugcauccauaauauucugagcggucagagguggaucgagcacuauggggaaauuguaauaaagaaccuucacgacgauuccugcuacuguaaggucaacuuuaucaaagccaaguacuggucuacaaaugcacaugagauugaaggcaccguguucgaccgcucgggaaaagccguucaccgauuguucggcaaguggcaugagagcaucuauugcgggggagguucauccagugcuuguguguggcgggccaacccuaugccaaagggcuacgagcaauauuacucuuuuacucaguucgcacuggaacucaaugagauggauccgagcuccaaaucacuguuacccccuacagacacccguuuuagaccagaccagagguuccuggaagaggggaaccuugaggaagcggagauccagaagcaacgcauugaacaguugcagcgggagagaaggcgaguccucgaagagaaucacguggagcaucaaccccgcuuuuuccggaaaucugaugacgauagcuggguaaguaacggaacguaucuggaacuaagaaaggaccugggcuuuuccaaacucgaucacccugugcugugguga

SEQ ID NO: 60230 - RNA, 2640 nt, Artificial Sequence
  derived and/or modified sequence opt3 from OSBPL5__Homo_sapiens__NP_065947
augaaggaggaagccuuccugagaaggcgguuuagccucugcccuccuuccucuaccccacagaaaguggacccgcgcaaacuuacacgaaaccuguuguuaucaggcgauaaugagcuguacccccuaaguccugggaaggacauggaaccaaacggacccagccucccucgugaugaggguccacccacuccuuccucugcuacgaaggucccaccggcagaauauagacuguguaauggcucggacaaagagugcguuucacccaccgccagggugacaaagaaggagacucuuaaagcgcaaaaggaaaacuaccggcaggagaaaaagcgcgcuaccagacagcuguugagcgcccucacagauccuaguguagugaucauggcagacucccugaaaauuagggggacccugaagucuuggacuaagcucuggugugucuuaaaaccaggagugcugcuuauauauaagacacccaaaguuggccaguggguggguaccgucuugcugcacugcugugaacuaaucgagcggccuagcaagaaagauggguucugcuuuaaacucuuccauccacuggaccaauccgugugggccguaaagggacccaagggcgagucaguuggcaguauuacgcagccgcuuccuagcucuuaccugaucuuucgcgcugcauccgaaucagaugggcgauguugguuggacgcccucgagcuggcuuuaagaugcagcagucugcucaggcuuggaacuuguaagcccggucgggauggcgaaccagggaccucuccugacgccucccccagcucgcugugcggauugccagcgucugcaacagugcaccccgaucaggaccuauucccucugaauggcuccucacucgagaacgacgccuuuagugauaaaagcgaacgugagaauccagaggaauccgacacugagacccaggaucauucucgcaagacagaaagcgguucagaccaaagugagaccccgggggcucccgucagaaggggaacgacuuauguggaacaggugcaggaggagcugggcgaacuuggcgaggccucccaggucgaaacaguuagcgaggaaaacaaaucucugauguggaccuugcucaagcaacugcggccugggauggauuuaucacgagugguacugccaacuuucgugcuagagccccgcaguuuucucaauaaacugagcgacuacuauuaccacgcagaucuuuuguccagagcugccgucgaggaagacgcguacucuaggaugaagcuggugcuccggugguaucugucgggauucuacaagaaaccuaaggguauuaaaaagccauauaaccccauccuuggcgagacauuucgcuguugcugguuccauccgcagaccgauagcagaacguuuuacauagccgaacagguuucccaccacccuccagugucagcauuccaugucaguaauaggaaagacggguucugcaucucuggaagcauuaccgcuaagucccguuuuuauggcaacucacugagcgccuugcucgaugguaaggcuacacugacuuucuuaaaucgggccgaggacuacacccugacaaugcccuaugcacacuguaaagggauccuauacggcacuaugacccucgagcugggaggcaaggugacaauugaaugcgccaaaaacaauuuucaagcucagcuugaguucaaguugaaacccuuuuucgggggaucuaccuccaucaaccagauaagugguaagauuacuagcggcgaagagguacuggcgucucucuccgggcauugggaccgagauguuuuuaucaaggaagagggaucaggcaguagcgcacuguucuggacgcccucgggugaggugagaaggcagcgcuuacggcaacacacagucccacuggaggaacagaccgaacuugaguccgaaagauuguggcagcacgugacuagggccauuucuaaaggggaccagcaucgcgcuacccaagagaaguuugcccucgaggaagcacagcgacagcgggcccgugagagacaggaaagccugaugccuuggaaaccccaacuauuccaccuggauccaaucacacaggaguggcauuacagguaugaagaccacucaccgugggauccucucaaggacaucgcucaguuugagcaggauggcauucugcgcacccuucaacaggaggccgucgcacggcagacuacauucuugggaagucccggcccaagacaugaaagguccgggcccgaccaacgacugcgcaaagcgucugaucagccuagcggacacucccaggcuacggagucaagcgguaguaccccagaaucuugucccgaguuauccgacgaggaacaggauggcgacuuugugccugggggagagagcccgugcccacgguguagaaaggaagccaggcgucuccaagcacugcacgaggccauacuuucgauccgcgaagcucagcaggagcugcaucggcacuugucagccaugcucucuaguacugcaagagcugcccaggcgcccacaccuggccugcuacaauccccaaggagcugguuccugcucugcguuuuccuggccugucagcuuuuuauuaaccauaucuugaaauga

SEQ ID NO: 60231 - RNA, 2880 nt, Artificial Sequence
  derived and/or modified sequence opt3 from OSBPL6__Homo_sapiens__NP_001188409
augagcuccgacgagaagggcaucucucccgcccacaaaaccucaacaccuacucauagaagugcuagcuccucuacgucgucacagagggauagccggcaaaguauucacauacuggaacgcaccgcauccucuagcacagagccauccgugucacgacagcuccuugaaccggagcccgucccucugaguaaggaagccgacagcugggagaucauugagggguugaaaaucggacagacuaacguucagaagccagauaaacaugaagguuucauguuaaagaagcguaaauggccccugaagggcuggcacaaaagauuuuucgugcuagacaaugggaugcucaaguacucuaaagcgccucuggauauucaaaagggaaagguacauggcuccaucgacgugggucuuucagucaugagcauuaaaaagaaagcuaggcggaucgaucuggacaccgaggaacacauuuaucacuugaaggugaaaagucaggauugguuugacgccuggguuucuaagcuccgccaucacagacuguacaggcagaacgagaucgugcgguccccacgcgaugcaucauuccauauuuuucccucgacaucuaccgccgaguccagcccugcugcaaaugucagugugauggacgggaaaaugcagccaaacagcuucccguggcaaucaccccugccuugcucuaauagccucccagccacuuguacaaccggacagucaaagguagcugccugguuacaggauagugaagagauggaccgaugcgcggaagaccuggcacacugucaguccaaccuuguugaguugagcaagcugcuacaaaaucucgaaauccugcagagaacgcagucugcccccaacuuuacugauaugcaagcuaauugcguggacauauccaaaaaggauaaaagggucacccggcguuggcgcacaaagagugugagcaaagacacuaagauucagcuucaggagggcccuccagccaagggccaguucuccaccacaagaaggcggcaacgacuggcagcugccguggcgaccacgguccccuuuucugccacuaugucgccgguucgcuugcacagcuccaacccuaaucucugugcagauaucgaguuccagacacccccaucacaucugaccgacccuuuagaaaguucuacugauuauacaaaacugcaggaggaauuuugccucauugcucagaaggugcacagccuucugaaauccgccuucaacucaaucgcuaucgagaaggaaaaauugaagcaaaugguaagcgagcaggaccauucuaaggggcacuccacccagauggccagacuaaggcagagucugagccaagcacucaaucagaacgccgagcugcggucucgccuuaauagaauacauuccgaaucaauaaucugugaucagguggucagugugaacauuauccccagcccagacgaggcuggagaacagauacacguuucgcugcccuugucccaacagguggcgaacgagucuaggcucagcaugucagaaagugucuccgaguuuuucgaugcacaggaggugcuguuaucugccagcuccucagaaaaugaggcuagcgacgacgaaaguuacauuucugauguauccgacaacaucagcgaggauaauacgucgguugccgacaacaucucacgucaaauucugaauggugagcuaaccggcggggcauuccggaacggaagacgagccugccucccugcuccauguccggauacaucuaauaucaaccuguggaauauucuuaggaacaauauaggcaaagacuugaguaagguguccaugcccgucgaacugaacgagccucucaauacucugcagcaccuuugcgaagagauggaauauagcgagcuguuggauaaagccucugagaccgacgauccauacgaacgcauggugcucgucgcagcguuugcugugagcgguuauuguuccacauacuuccgggccgggucaaagcccuuuaacccuguucugggagagacuuacgaaugcaucagagaggacaaaggcuucagguuuuucagugaacaggugagccaucacccacccauuucugcaugccauugugaguccaagaauuuuguauucuggcaggauauccgcuggaagaacaaauuuuggggcaagucaauggagaucuuaccggucgggacccugaacgugaugcuaccuaaauauggagacuacuauguuuggaauaaggugacaaccugcauucacaacauacucaguggucgacgguggaucgaacacuacggcgaggucacuauucguaauacgaaaagcuccguguguaucugcaagcugacauucguaaaagugaacuauuggaacucuaauaugaaugaaguucaaggggucgugauugaucaggagggaaaggccguguacagacuuuuuggcaaguggcaugaagguuuguauuguggggucgcuccaucggccaaaugcaucuggaggcccggcagcaugccuaccaacuacgagcuguacuauggauucacucgcuuugcaauagagcucaaugaacuggaccccguuuuaaaggaccugcuuccaccuaccgaugcucgguucagacccgaccagagguucuuggaggaaggcaaccucgaggccgcggccucagagaaacagcgaguggaggaacugcaacgcucccggagaagguacauggaagagaauaaccuagaacacaucccaaaguuuuucaaaaaggugauugaugcuaaucagcgugaggcauggguaaguaacgacacauauugggagcugcgcaaggauccgggguuuucuaaagucgacagcccugugcucugguga

SEQ ID NO: 60232 - RNA, 2544 nt, Artificial Sequence
  derived and/or modified sequence opt3 from OSBPL8__Homo_sapiens__NP_001003712
augagccagagacaaggcaaggaggccuaccccaccccuacaaaagaccugcaccagccaucccucucuccggcuucaccccauagucagggguucgaaaggggaaaggaggauaucagccagaacaaagacgaauccucucuuucgaugucaaagagcaaaagugaguccaagcuguauaaugguucugaaaaggauagcuccacuucaaguaaauugacgaagaaagagagcuuaaaggugcaaaagaagaacuaccgggaggaaaagaaacgcgcaaccaaggagcugcuaucuacaauuacugacccuuccgucauaguuauggccgauuggcucaaaauccgaggcacccugaagucauggacaaaacuuuggugcgugcugaagccagggguauugcucauuuauaaaacccagaagaauggacagugggugggcacuguccugcugaacgcgugugaaaucauugagcgucccagcaagaaagacgguuuuugcuucaagcucuuucacccuuuagagcagaguaucugggcugugaaagggccaaagggagaagccguuggcucuauaacacaaccccugccuuccagcuaccuuaucauuagagcaaccucggagucugaugggagguguuggauggacgccuuggaacuggcucuaaaaugcuccucacuccugaagcggacgaugauccgcgagggcaaggaacaugaucuuagugugagcuccgacucuacucacgucaccuucuauggacuguugagagcaaauaaccuccauagcggugauaauuuucagcugaacgacucagagauugagaggcagcacuucaaagaucaggacauguacagugacaaguccgauaaagaaaaugaccaagagcacgaugaaagcgacaacgaggugaugggcaagucugaagagucagauacagacaccagugagcggcaggaugacagcuauaucgaaccagagccgguagaacccuuaaaagagacuacauacaccgaacagucccaugaggagcugggggaagccggagaggcuucucaaacggaaacuguuucggaggagaauaagagccucauauggacacuucugaaacaggugcgcccuggcauggauuuguccaaagucgugcuaccaaccuuuauucuggaaccccgaucauuccucgacaagcugagugauuacuauuaccacgccgacuuucuuucugaggcggcacuggaagagaacccuuauuucagauugaaaaagguggucaaaugguaccucagcgguuuuuauaagaagccaaaagggcugaagaaacccuacaauccgaucuuaggagaaacuuucaggugucuguggauucauccucggacaaacuccaagaccuuuuauaucgccgagcagguuucacaccaucccccaaucagcgcuuucuacgugucuaaucguaaagacggcuucugccuauccggcaguauucucgccaagagcaaauuuuacgggaacucucuguccgcaauacuugagggagaagcucgcuugacguuccugaacagaggugaggauuauguaaugaccaugccuuacgcccacuguaagggcauccucuaugggacaaugacucuggaacuuggaggcaccgugaauauuacaugccagaagacugguuacucagcgauccuggaguuuaaauugaagcccuuccucgggaguagcgacugugucaaccaaauaucgggcaaacugaaguuaggaaaagaagugcuggccacccuagagggccacugggauuccgagguuuuuauuacagacaagaagaccgauaauucugaaguguucuggaacccaacucccgacaucaaacaguggaggcucauccggcauacggucaaguuugaggaacagggggauuucgagagcgaaaaacuguggcagcgagugacacgcgcaauuaaugcuaaggaccaaaccgaggccacucaggagaaauauguacuugaagaggcucagagacaggccgcaagggaucggaagaccaagaacgaagaguggucaugcaaauuguuugagcuggacccucucacaggagaauggcacuacaaguucgccgauacccgcccaugggacccgcugaaugauaugauccaauuugagaaagacgguguuauucagacuaaggugaaacauagaacacccauggucagugugccuaagaugaagcacaaaccaacgaggcagcagaagaaagucgcuaagggcuauuccucucccgaaccugacauacaagauagcuccgggucagaggcgcagagcgugaaaccaaguacccgucggaagaaaggaaucgaauuaggcgacauucagucuuccaucgagagcaucaagcaaacucaggaggaaauuaagcgaaacauaauggcacugagaaaucaccuuguuucgucaacacccgccaccgauuacuucuugcagcagaaagacuacuuuaucauuuuccuccugauccuacugcaagugauuaucaacuucauguuuaaguga

SEQ ID NO: 60233 - RNA, 2280 nt, Artificial Sequence
  derived and/or modified sequence opt3 from OSBPL9__Homo_sapiens__XP_011538901
auggccagcaucauggagggcccccuguccaaguggaccaacgugaugaaaggguggcaguacagaugguucguccucgacuauaaugcuggacuucugucuuacuauacaucaaaggauaaaaugaugagggguagucggcgcggcugcguucgauugcguggggcagugauuggaauagacgaugaagacgauagcacuuuuacgaucaccguagaccaaaagacauuccacuuucaggccagagaugcggacgagagggaaaaauggauucaugcuuuagaggaaacuauccugcggcacacccuacagcuccagauuuccacaacccuggccuucuuucaaucuucgggcaucucaccugugcuugaguucagcaagauaaucggucuggauaguggguuugucccauccgugcaggacuucgauaagaaauugacugaggcagacgccuaccuccagauucugaucgaacagcugaagcucuuugaugacaaauuacaaaacuguaaggaggacgaacagcgcaaaaagauugagacacugaaggagaccacuaauucuaugguugaaagcaucaaacauugcauagugcuuuugcagauugcuaaggaucaguccaacgcagagaaacacgccgacggaaugaucucaacgauuaauccggucgaugcuaucuaucaacccaguccucuggaaccagugaucagcaccaugcccucucagacaguacuaccuccagagcccguucagcucuguaaguccgaacaaagaccuucaagccugccagugggcccgguccuugccacucugggccaucaccagacccccacaccuaacaguaccgggucuggacacuccccacccagcucgucuuugacguccccuucacaugugaaucucaguccaaacacugugcccgaguucagcuacuccucuagcgaggacgaauuuuaugaugcggacgaguuccaccagucagguaguuccccgaaaaggcugauugauagcucuggcucagcaagugucuuaacacauagcuccucuggaaauucgcugaagcggccugacaccacugaaagccucaacuccucacuuaguaaugggacaucugaugccgaccuguuugauagccacgacgaccgcgaugacgaugcugaggccggcuccguugaagaacacaaaucagugauaaugcauuugcuaagccagguacgacuggguauggaccucaccaaggugguccugcccacguucauccuugagagaaggucucuguuggaaauguacgcagauuucuuugcucacccagaccucuucguguccauuagugaucaaaaggacccuaaagaucggaugguucagguggucaagugguaccugagcgccuuucaugcggggcguaaaggaucuguggccaagaaacccuauaacccaaucuuaggcgagauauuccagugccacuggacccugcccaaugacacagaagagaacacugagcuaguauccgagggcccuguuccaugggugucaaagaauagugucaccuuuguggcagagcaggucagccaucacccgcccauuucggcuuucuacgccgaauguuuuaacaagaaaauccaauucaacgcucacaucuggacaaaguccaaauuucucgggaugucuauuggagugcauaauaucggucagggcugcguuagcugucuggauuaugacgagcacuacauucuuacuuucccuaacggguauggacgcucaauauugaccgugccauggguagaacugggcggugagugcaauaucaacuguaguaagacaggguacuccgccaauauuaucuuucauaccaaacccuucuauggcggaaagaagcacagaaucacugcagagauauuuucuccuaacgauaaaaagagcuucugcuccauugaaggcgaguggaauggggucauguacgccaaauacgcuacgggagaaaacacaguguucguugacaccaagaaacucccaaucauuaagaagaaagugaggaagcuggaggaccagaaugaauaugagucacggagccuuuggaaagaugucacuuuuaaccugaagauccgagacauugaugcggcaaccgaggccaaacaccgcuuggaagagagacagagggcugaagcccgggagcgcaaggaaaaagagauccaaugggagacaagacucuuccaugaagacggugaguguuggguguacgaugaaccccuguuaaagaggcugggcgcagccaagcacuga

SEQ ID NO: 60234 - RNA, 849 nt, Artificial Sequence
  derived and/or modified sequence opt3 from OSCAR__Homo_sapiens__NP_001269278
auggcccuggugcucauccuucagcuguugaccuuauggccccugugccacacagacauuacuccuagcgucccaccggcuuccuaccaucccaagccuuggcuaggcgcacaaccagccacgguugugacccccgggguaaacgugacacucagauguagggcgccucagccagcuuggcgguucggacuguuuaaacccggugagauagccccucuucuguuccgcgaugucucuucagaauuggcagaguuuuuccucgaagaggugacuccagcccagggcgggaguuaucgaugcuguuaccguagaccggacuggggacccggcguuuggagccagccuuccgaugugcuggaacugcucgucaccgaggaguuaccaaggcccucucugguggcacuuccugguccaguaguugggcccggagcuaaugugucguugcggugcgccggccgccugagaaacaugucauuuguccuauauagggaaggcguggcugccccgcuccaauaccggcacagcgcgcagccuugggcagacuucacacugcuuggggcccgcgcucccggaaccuauaguuguuacuaucauacuccauccgccccuuacgugcugucucagcgaagcgaggucuugguuaucuccugggaaggugagggccccgaggcaagaccagcuucaagugcccccgggaugcaggcgccuggaccaccgcccagcgauccuggcgcccaagcaccaucucucuccucauuuaggccccggggucugguguuacagccucugcucccacagacacaggacagcugggaucccgcuccgccuccaagugaccccgggguauga

SEQ ID NO: 60235 - RNA, 879 nt, Artificial Sequence
  derived and/or modified sequence opt3 from OSER1__Homo_sapiens__XP_011527155
augaaaagcgaggccaaggacggcgaagaggaaucccugcagaccgcuuucaagaaacucagaguggaugcaucugggucagucgccagucuuagcguuggagaggguacaggcgugagggcgcccguacggacugcuacggacgauaccaagccuaaaacaacuugcgccuccaaggacucuuggcacgggucgacccgcaagucaagccgaggagcagugcguacacaaagaaggcggcgcaguaaauccccaguccugcauccgcccaaguuuauccacuguucuaccauugccagcuccucaaguagccaguugaaacauaagucucagacugauuccccugacggcucaagcgguuuagggauaaguucuccaaaagaguucuccgcuggagaaagcucgacaucucuggaugcaaaccacaccggcgccgugguugagccccuaagaacguccgugccuaggcucccaucagaaaguaagaaggaggacagcuccgaugcuacucaggucccccaagccucucugaaagcgagcgaccuuucagauuuucagaguguguccaagcugaaucagggcaaaccuugcaccuguaucgggaaggaaugccaguguaaacgguggcaugacauggagguauacagcuucucuggauugcaaucaguuccaccgcucgcacccgagcgccgaaguacacuggaagauuauagccagucccugcacgccagaacucucucugguucgccuaggagcugcuccgagcaggcucggguguuugucgacgacgugaccauugaagauuuaucaggcuacauggaguauuaccuguauaucccaaagaaaaugagucacauggccgaaaugauguacacauga

SEQ ID NO: 60236 - RNA, 1008 nt, Artificial Sequence
  derived and/or modified sequence opt3 from OSGEP__Homo_sapiens__NP_060277
augcccgccgugcugggcuucgaggggagcgcuaacaagaucggagucgguguugugagagacggcaaaguacucgcaaauccuaggcggaccuacgugacaccaccggggacuggauuucuucccggcgauacggcccgccaccaucgagcggucauucuggacuuguuacaggaagcucugaccgaguccggucuaacaucucaagauauagacugcaucgccuauacuaaggggccuggaaugggcgcaccacucgugucaguugccguggucgcucguaccguggcacagcuguggaacaaaccccuuguaggcguuaaucacuguauugggcauaucgaaaugggaagacugauuacaggugccaccaguccuacuguguuguacgucagcggcgggaacacacaggugaucgcuuauuccgagcacagguaccggauauucggagaaaccaucgauauugccgugggcaauugccucgaccgcuuugcgagaguccugaagaucucuaacgauccaucgcccgguuauaauauugagcagauggcaaaaagggggaagaagcugguugagcucccuuacacggugaaaggaauggacguaucauucagcggcaucuuaaguuuuauagaagauguggcccaucggaugcuggcuacuggcgaguguaccccagaagaccuuugcuucuccuugcaagagacagucuuugccaugcugguggagauuacugaacgcgcaauggcucacugugggucucaggaggcccuaaucguuggaggugugggcugcaacguccgacuccaggaaaugauggcgaccaugugucaggagagaggggccaggcuguucgcaacagaugaacgguuuugcauugacaauggagcuaugaucgcccaagcuggcugggagauguuccgugccggucaccgcaccccgcuuagcgauuccggggugacgcagagauauaggacugacgagguagaaguuacauggcgggacuga

SEQ ID NO: 60237 - RNA, 1434 nt, Artificial Sequence
  derived and/or modified sequence opt3 from OSGIN1__Homo_sapiens__NP_892026
augagcuccucuagaaaggaccaccugggcgccucaaguagcgagccccucccugugaucauugucgggaacggaccauccgguauaugccuuucuuaccuguugucgggcuauaccccguacacaaaacccgaugcuauccauccucacccauuacugcagaggaagcuaacugaagcacccgggguuucaauucucgaccaagaucuggacuaucuuagcgagggacuggaaggccggagucaguccccuguggcccucuuguucgaugcgcugcugcgcccagacacggauuuuggugggaauaugaaaucuguacucaccuggaagcaucgaaaagagcacgcuaucccccauguggucuuaggacguaaccugccuggcggcgccuggcacagcauugaaggguccauggugauccuuucacagggacaguggauggguuugccagaccuggagguuaaggauuggaugcaaaagaaaagaaggggccuacggaauagucgcgcaacagccggggacauagcucacuacuauagagauuacguggucaagaaaggacucggccauaacuucgugagcggugcaguaguuacugccguggagugggggaccccggaccccucuuccuguggagcucaggauucaagcccucuguuucaggucaguggcuuccuuacaaggaaucaggcccaacagccauuuucucugugggcgcggaacgugguguuggcaaccggcacuuucgacucccccgcccgccucgggaucccuggagaagcucugccauuuauucaccaugaguuaagcgcccuggaagcagcuacacgagucggugccguuacccccgcgucggacccggugcucaucauuggcgccgggcuuucugcagcugaugccguacuguaugcuagacacuacaauaucccugugauacacgccuucaggcgggcagucgacgaucccggauugguguuuaaccagcuaccaaagaugcuguacccugaguaucauaaaguucaccagaugaugcgugagcaauccauucucucacccaguccauacgaaggcuaucgcagccugcccagacaucagcuucugugcuucaaggaggacugucaggccguguuucaagauuuggaaggugucgagaagguguucgggguaucccucguucugguguuaaucggcucucacccugaccugagcuuucuaccaggagcuggcgcggauuucgcagucgacccggaucagccccucucagccaaaaggaauccuauugacguggauccauucacguaccagaguacucggcaggaagggcuguaugcuaugggaccccuugccggugacaacuuuguccgauucgugcaaggcggggcauuggccguugcuuccagccugcuccgcaaggagaccagaaaaccuccauga

SEQ ID NO: 60238 - RNA, 759 nt, Artificial Sequence
  derived and/or modified sequence opt3 from OSM__Homo_sapiens__NP_065391
augggcgugcugcucacccagagaacacuucugagcuuggucuuagcccugcuauuccccuccauggcuucuauggcagccaucgggucaugcaguaaggaguacaggguucuccugggacaacuucagaaacagacugaccugaugcaggauacgagccgguugcucgacccuuauauucgcauacaaggucuggaugugccaaagcugcgagaacacugucgugagagaccgggcgcguuucccuccgaagagacccucaggggguuaggacggcgcggcuuccugcagacacuuaacgcuacuuuggguugcguacugcauagacuagccgaccucgaacagaggcugccuaaagcacaggaucuugagcggucugggcugaauaucgaggacuuggaaaagcuccaaauggcccgcccaaacauucugggauuacgaaauaacaucuacuguauggcucagcugcucgauaauucggacaccgcagagcccacaaaagccggcagaggcgcuucacagccuccaacccccacuccugccagcgaugcguuucagaggaaacuugaagggugccgguuccugcacggauaucaucguuuuaugcacagugugggucgcgucuucuccaaguggggcgagucuccaaacagaagcaggcggcauuccccgcaccaagcauugcgaaagggggugcgcagaacaaggcccucacggaagggaaaacgccuaaugaccagaggccagcugccuagguga

SEQ ID NO: 60239 - RNA, 1029 nt, Artificial Sequence
  derived and/or modified sequence opt3 from OSMR__Homo_sapiens__NP_001161827
auggcccuguucgcuguguuucagaccacauucuuucucacucuucugagcuugagaacguaccaauccgaggucuuagcagaaaggcugccccuaaccccuguuucucucaaggugucaacaaacaguacucggcagagccugcaccuucaguggaccguacauaaucugccauaucaccaggaguugaaaaugguguuccaaauccagauuucccgcauagaaacaucuaacgucaucugggugggcaauuacucgaccacuguuaaguggaaccaggugcuccauuggucaugggagagcgaacugccgcuggagugcgccacacacuuuguccgaauuaaaagucucguggacgaugcgaaguuccccgagccuaauuuuugguccaacuggucuagcugggaagagguauccguucaggacucaaccgggcaagauaucuuauucguguuuccaaaagacaagcuggucgaagagggaacgaaugugacuauuuguuaugugagucguaacauccagaauaacgucagcugcuaccuugaggguaagcagauacauggcgaacaguuggauccccacguuaccgcuuucaaucugaacucugugccuuuuaucagaaauaaagggacaaacauuuauugugaggccucccaaggaaauguaucagaaggcaugaaggguaucgugcuauucgucagcaaagugcucgaggaaccaaaggacuuuaguugcgagacugaggauuucaaaacccugcacuguacaugggaccccgggaccgauacggcacuuggauggucuaagcagccuucccagagcuacacucuguucgaaucguuuucuggcgagaagaaauugugcacacauaagaacugguguaacuggcaaauuacccaggacucccaggaaacuuauaauuucacacucaucgccgagaacuaccugaggaaacggucaguuaauauauuauuuaaccugacccaccgcggcgaaacgagaguggucaccgcucauagggggcacuga

SEQ ID NO: 60240 - RNA, 801 nt, Artificial Sequence
  derived and/or modified sequence opt3 from OSR1__Homo_sapiens__XP_006712005
augggcagcaagacccugcccgccccugugccaauccacccgucccuccagcuuacaaacuacucuuuccugcaagcugucaauggguugcccacuguuccuucagaccauuuaccaaaccuguauggauuuagugcacuacacgccgugcaucuccaccaguggacgcuggguuaccccgcgaugcaucuuccuagaagcuccuucucuaaaguaccaggcaccgugucgucacuggucgaugcuagguuucaguugcccgccuucccuugguuuccacacgugauucagccgaagcccgagauaacagcagggggaagcguuccugcccucaaaacuaagccacgguucgacuuugcuaaucuggcacuggccgcuacccaagaagaucccgccaaacucggccgcggugaggggccuggaaguccagcgggcggcuuaggggcacugcuugacgugacaaaguugucccccgaaaagaaaccgacccgaggacgucugccuucuaagacuaaaaaggaguucgucugcaaauuuugugguagacacuucacaaagagcuauaaccuacucauccaugaaaggacccacacggaugagcggcccuacacuugcgacauuugucauaaggccuuucgcagacaggaucaccugagggaccaccgguauauccauuccaaagagaagccauucaaaugccaggaauguggcaagggguuuugccagucacgcacccuugcugugcacaaaacacugcauagucaaguaaaggaguugaaaacuagcaagauuaaguguuga

SEQ ID NO: 60241 - RNA, 939 nt, Artificial Sequence
  derived and/or modified sequence opt3 from OSR2__Homo_sapiens__NP_001135934
augggcagcaaggcccugcccgcuccuaucccacuccacccgucccuucagcugaccaacuacucuuucuugcaagcagugaauacauuucccgccacugucgaccauuuacaggggcuguauggacuaucagcgguucagacgaugcacaugaaccauuggacccucgguuacccuaaugugcacgagauuacaagaaguacuauaaccgaaauggcugccgcacagggccugguagaugccagguucccauuucccgcacuuccuuucacaacccaucuguuucacccaaaacaaggggcuaucgcccacguguugcccgcucuccauaaggaccggccucgcuucgauuuugccaaccuggcggucgcagccacucaggaggacccaccgaaaaugggagaucugagcaagcucucccccggcuuagguucuccuauuucggggcugucaaaacuuacaccagaccgaaagcccagccguggaagauugccuaguaagaccaaaaaggaguucaucugcaaauuuuguggcaggcacuucacgaaguccuauaaucugcuaauucaugaacggacucacaccgaugaacgcccauacacaugcgacaucugucacaaggcuuuuagaaggcaggaucaucuccgggaccaccgcuauauacauucuaaagagaagcccuucaaaugccaggaguguggcaagggguuuugccaaagccgaacucuggccgugcacaaaacccuucauaugcaggaauccccgcacaaguguccuacaugcggaagaaccuucaaccagaggucaaaucugaaaacgcacuugcucacucauacagauaucaagcccuacaguugugagcagugcgguaaaguuuuccggcguaacugugaccugcgcagacacagcuuaacccauacuccaaggcaagauuuuuga

SEQ ID NO: 60242 - RNA, 645 nt, Artificial Sequence
  derived and/or modified sequence opt3 from OSTF1__Homo_sapiens__NP_036515
augagcaagcccccuccaaaaccggugaagcccggccaggucaaaguuuucagagcccuguacaccuuugagccuaggacaccagacgaacucuauuucgaggaaggggauaucauuuacauaacugacauguccgauacgaacugguggaagggaaccucuaaaggucggacaggccuuauccccucaaauuauguggcugagcaagcagaaaguauugacaacccucugcacgaggccgcgaagcgcgggaauuugagcugguuacgagagugccuggauaaccguguaggagugaauggccuagacaaggcugguuccacugcccucuacugggcaugucaugggggacacaaagauaucgucgaaaugcuguuuacccagccaaacauugagcuuaaucagcagaacaagcugggcgacacagccuugcaugcugcagccuggaaaggcuaugcugauaucgugcaacuccugcuggccaagggggcgagaaccgaccucaggaauauagagaaaaaguuagcauucgauauggccacuaacgcugccugcgcaucucugcuuaagaaaaagcagggaacagacgcuguucggaccuugucgaaugccgaagauuaccuggacgacgaggauucagacuga

SEQ ID NO: 60243 - RNA, 1005 nt, Artificial Sequence
  derived and/or modified sequence opt3 from OSTM1__Homo_sapiens__NP_054747
auggagcccggcccuaccgccgcucagagaaggugcagccugccaccguggcucccccuugggcuguuguuaugguccggacuggcacuaggugcccucccuuucgggucuucaccacaccggguguuucaugaccugcuuagugaacaacagcuguuggaggucgaagaucucagccugucccugcuccagggcggaggcuuagguccccugucucuuccuccagacuugcccgaucuggacccugagugucgcgaacuacuccuggauuucgcgaacucgucagcugagcuuacagggugccugguucgaagcgcccguccagugagauugugucagacuugcuacccgcucuuucaacagguagugaguaagauggacaauaucuccagggcagccggaaacacgucugagagccaguccugugcucggucacuguuaauggcagaucgcaugcagauugucgugauacugagugaguucuuuaauaccacauggcaagaggccaacugcgcuaauugucucacuaacaauagcgaagaacuuucuaacuccaccguuuauuuccugaauuuguuuaaccacacacuaaccugcuucgagcauaaucugcagggcaacgcccacucacuccugcagacuaaaaauuacagcgaaguguguaagaacugcagagaggcguauaaaacacuuaguucucuguacuccgaaaugcagaagaugaaugaguuggaaaacaaagcagagcccggcacccaucucuguaucgacgucgaggaugccaugaacauuacgaggaagcuguggagccggacuuuuaauugcucggugccuugcucugacaccguaccaguuaucgcuguguccgucuucauuuuauuucugcccgugguguucuaucuaucaaguuuucuccacagcgaacaaaagaaacgcaagcugauccuuccuaaacgauugaaguccucuacaucauucgccaacauacaggagaauagcaacuga

SEQ ID NO: 60244 - RNA, 1065 nt, Artificial Sequence
  derived and/or modified sequence opt3 from OTC__Homo_sapiens__NP_000522
augcuguucaaccucagaauccuucugaauaacgccgcuuuuaggaauggccacaacuucauggugcggaauuuucgcugcgggcagcccuugcaaaacaagguccaguuaaaaggacgagaccugcuaacccucaagaauuucacaggugaggaaauuaaauacaugcuguggcuuagcgcagaucugaaguuucguauaaaacagaagggcgaguauuugccucuccugcaggggaagucccugggaaugaucuucgagaaaagaucuacuaggacgcggcucucaaccgaaacaggcuuugccuuacugggugggcauccauguuuccuuacuacccaagacauucacuugggaguuaacgaaagucugacagauaccgcgcgcgugcuaagcuccauggcugacgccguacucgcaagaguguacaagcagucugaucuggacacucuugccaaagaggcuucgaucccgauuaucaauggccugucagauuuguaucaucccauacagauccucgcagacuaccugacauuacaggagcacuauagcagucugaagggccucacccuuuccuggauuggggauggaaacaauauccugcauucuauuaugaugagcgccgcuaaauuugguaugcacuugcaagccgcgacgccuaagggcuacgaaccagacgcauccgucacuaagcuagccgagcaguaugcuaaagaaaacgggaccaagcugcuccugacaaaugauccccuugaggccgcacacggaggcaacgugcugaucacugacaccuggauaucaaugggucaggaggaagagaaaaagaaaagguugcaggcuuuccaaggguaccagguuacaaugaagaccgccaaaguggcggccagugauuggacguuucuccauugccugccucggaagccagaagaggucgacgacgaaguguucuacagcccccgcucuuuaguauuuccugaggcagagaaucgaaaguggacuauuauggcuguuauggugucccugcuaacagauuauucaccacagcuccaaaaaccgaaguucuga

SEQ ID NO: 60245 - RNA, 3183 nt, Artificial Sequence
  derived and/or modified sequence opt3 from OTOA__Homo_sapiens__NP_001155155
augggcaacagcaucaccuacagagaccaggccgcuguggagaaucaccuggaacaaaggcuccaucagccccagaaacuucuggaggauuugcggaagacagacgcacagcaauuccgcacugccaugaagugcuuacuggaagauaaaaaggacgggcuagaucucaaagacauuauaaucgaucugggagagauucgagaacgugcgcuucaguccccuggugucaacagaucucuguuuuugaucacgcucgagagguguuuccagauguuaaauucacuggagugcguugaaauucucggcaagguguuacgggggaguagcggauccuuucugcagccagacaucaccgagcgccuuccgagagauuugagggaagacgcuuucaagaaccugucugccguauuuaaagaucuauaugacaagacaucggcacacucacaacgggcccucuacagcuggaugacuggcauacugcagaccaguuccaaugcuacagaugacucugcaagcuggguguccgccgagcaucuuuggguccugggucgcuauauggugcacuugucauucgaggaaaucaccaaaauuagucccaucgagauugggcucuuuaucagcuacgacaacgcuacuaagcagcuggauaugguuuaugacauaacaccugaauuagcccaggcguuccuggagcgaauuucuuccucaaauuuuaacaugagaaauaccagcacgauccauaggcucggacuucugguguguuucuacaacgauuuggaacuacuggacgcaacugucgcccaagugcuccuguaucagaugauuaaaugcagucaccuucggggcuuucaggcuggcguacaaaagcugaaggccgaguugcucgauaucgcaauggagaaucagacccugaacgaaacauuagggucucuguccgacgcuguugugggacuaacuuacagccagcucgagucgcugucuccagaagccguccacggugcgaucuccacccuuaaucaggugucaggcugggccaaaagucaagugauuauauugagcgcaaaguaccuggcucaugagaaaguccucuccuucuauaacguuucucagaugggggcccugcuugcuggagugagcacacaggccuuuuguucaaugaagcguaaagauaucagucagguacugcgcuccgcagugagccaauacgucucugacuugucacccgcccagcagcagggcauucucaguaagauggugcaagcugaagauaccgcgccugguaucguugagauacagggggcauucuucaaagaggugagccuguuugacuuaagaaggcagccaggauucaauuccacgguccugaaggauaaggaacuaggccggucucaggcccucuuucuguaugagcuuuugcugaaaacuacacgacgccccgaggaacuccugucggcuggccaauuagugaaggggguaaccugcagccacauugacgccauguccacugacuucuuucuggcacauuuccaggauuuucagaacaacuucgcccuuuugucaccuuaccaaguuaauugucucgcuuggaaauauugggaagugaguagacugucuaugccaccguuucuacuggccgcacuccccgcgagguaccuggcuagcgucccugccucccagugcgugccauuccuuaucucauugggaaagagcuggcuggacucuuuaguccucgauucccacaaaaagacaagugugcugcggaagguucagcagugucuugacgauagcaucgcagacgaguauaccguggauauuauggguaaccuguugugccaccuccccgccgcuaucauugaccgcggcauaucuccuagagccugggcaacggcucugcaugggcuaagggauuguccagaccugaaucccgagcaaaaagccgcgguacgucucaagcugcuuggacaguacggcuugccgcagcacuggaccgccgaaacaacuaaagaucuggguccuuuucugguccucuucuccggggacgagcugucaaguaucgcuaccaaguuucccgaaauucuucugcaggcagccagcaaaauggcucggacacuaccaacuaaggaguuccucugggccguguuccaaucgguucgaaacuccucugauaagaucccuagcuacgaccccaugccaggcugccauggaguggucgcacccucaagugacgauaucuuuaaacuggcggaggccaaugcuugcugggccuuggaagaccugagauguauggaggaagauaccuucauuaggacaguggaguuacucggcgcaguacagggguuuucccgcccucagcugaugacccuuaaggaaaaagcuauacaggugugggacaugccaucuuauuggcgggagcaccauaucguuagccugggaagaauugccuuggcacucaacgaguccgaacuggagcaacuagaucugucaagcaucgacacugucgccagucuuucuuggcagacggaauggacaccgggucaggcugaguccauucuccaaggcuaccuggaugacagcggguauucgauccaggauuugaagucauuccaccuggugggauuaggcgcgacccucugcgccauaaauaucacugaaauuccccugaucaaaauuucugaguuuaggguggucguugcacgcaucgguacccuucuguguaguacacacguguuggcugaguucaagcgaaaggccgaagugguauuuggggacccuaccgaguggacuuccagcguccuccaggaacugggcacaauagccgcuggacuaacgaaagcagagcugcggaugcuugauaaggaccucaugccauacuuccagcccucugccauuaaaugccugccugaugaaaucuuuaaggaguugagcgcggagcaaauugcuuccuuaggcccagaaaacgccgcagccgugacccaugcucagcguagaaggcugucaccccuccagcugcagagucuucaacaggcacuggacggggccaaaacucacagcuggcaggacgcgccggcuucugccggaccuacacgcaccuccucaagucggagcccagccggugcauugcaguccuggggccuauggcugggguguccccuccugguucuuauggcuaaguuacugugguga

SEQ ID NO: 60246 - RNA, 3693 nt, Artificial Sequence
  derived and/or modified sequence opt3 from OTOF__Homo_sapiens__NP_004793
augaucaagaccgagaaaagcuaccccgaaagaaggcugcggggcgugcucgaggaacuuuccugcggguguugccgcuuccugucuuuggccgacaaggaucaaggacacucaagucgaacacguuuagacagagagaggcugaaaagcuguaugcgggaacuagagaacaugggucaacaggcucgcaugcucagagcacaggucaagaggcauacuguucgggauaaacugcgccuuugccagaauuuucugcaaaaguugcgauuccucgccgacgagccucagcacuccauuccagauauauuuaucuggaugaugucuaacaauaagagaguggcguaugcuaggguaccgucgaaagaccugcuguucucaauuguggaagaggaaacgggcaaggauugugccaaagucaagacccucuuuuuaaaacugcccgggaagcggggauucggcagcgcagguuggacagugcaggccaagguugagcuuuacuuguggcuggggcuaaguaaacagcguaaggaguuucucugcggacugccuuguggcuuccaagaagugaaagcugcacagggccuugggcugcaugccuuuccacccgucuccuugguguauacuaagaaacaggcuuuccagcuccgcgcccacauguaccaagcgagaucucuguuugcagccgacagcuccggauuaucagauccuuucgcuaggguauuuuucaucaaccagagucagugcaccgagguucugaaugaaacacucuguccaaccugggaccaaaugcuuguguucgauaaccuggaguuguauggugaagcccaugagcuacgggacgaucccccuauuaucgucauagagaucuacgaccaggacagcaugggcaaggcagauuuuauggggcgaacuuucgcuaaaccacuggugaagauggccgacgaagcguauugcccgccccgcuuuccuccacagcucgaguacuaccagauuuauagaggaaaugccacagcaggcgaucugcuugcugccuucgaacuguugcaaaucggucccgcugggaaggccgaccucccuccaauuaacggacccguggaugucgacaggggcccgaucaugccuguucccaugggcauacggccagugcugucuaaauaccgcguagagguguuauuuugggggcugagagaucuaaagagggucaaucucgcacagguggaccguccucggguugauauugaaugugccggaaaaggugugcaguccucacugauccacaacuauaagaaaaaucccaacuucaauacccuugucaagugguuugagguggacuugccagagaacgaacugcuccaucccccucugaauauucgaguaguugauugcagagcuuucggcagguacacgcuuguggggagccacgcggucaguucucugcgccgguuuaucuauagaccaccggacagguccgcacccagcuggaacacuaccggagagguggucgugacaauggaaccugagguuccaaucaagaaauuggaaacuauggugaagcucgacgccaccucggaggcuguagucaaaguggauguugccgaggaagagaaggagaaaaagaagaaaaagaaaggcacagcagaggagcccgaagaggaggaaccugacgaaucuaugcuggauuggugguccaaguacuucgccucaauugacaccaugaaagagcaguuacgccaacaggagccaagugguauagaucuggaagagaaggaagagguggacaacacggaagggcuaaagggcagcaugaaaggaaaggagaaagcucgagccgcaaaggaggagaaaaagaaaaagacucaguccucuggcagcgggcagggaucagaagcgcccgaaaagaaaaagccgaaaaucgaugagcucaaggucuauccuaaagaacuggagagugaguuugacaauuucgaagauuggcuucacacauuuaacuugcugcgggguaagaccggcgacgaugaggacggguccacugaagaggagcguauugugggaagauucaagggcagccucugcguauacaaagugccacugcccgaagauguuucuagggaggcugguuacgacucaacauaugggauguuccaaggcaucccuaguaaugaccccauaaacgucuuagugcgcguguacgucguucgggccaccgaucugcauccagcagacauuaauggaaaggccgauccuuauaucgcuaucagacuuggcaaaacggacauuagggauaaggaaaacuacaucagcaaacaguugaaucccguguuugggaaguccuucgacauugaggccucuuuuccaauggaaucgaugcucaccguggcaguauaugauugggaccuggucggaacagaugaccuaauaggugagacuaagaucgaucuggagaaccgauucuacagcaaacaccgcgcuaccuguggcauugcccagacauauuccacucacggguacaauaucuggcgggacccgaugaagccuucacagauccucaccagacugugcaaagauggaaagguggacggcccccauuuugguccacccgggaggguuaaaguggcgaaccgugucuucacaggcccuagugaaauugaggacgaaaauggacaacgcaagccaaccgaugagcacguggcccuuuuggcucugcggcauugggaagacauacccagagcaggcuguagguuaguuccugagcacguggagacucgaccgcuccugaacccagauaagcccgggaucgaacagggacggcuugagcuguggguagacauguuuccuauggauaugccagcccccggcacgccuuuggacauuucuccgcgcaaacccaagaaauacgaacucagagucaucauuuggaauacagaugagguggugcuggaagacgaugacuucuuuaccggugaaaagagcuccgauaucuucgucaggggguggcuaaaaggacagcaagaggacaagcaggacacugauguucauuaucacucacugaccggcgaagguaacuuuaauuggcgguaccucuucccauuugacuaucuggcugccgaggagaaaauagugaucagcaagaaggaaucuauguucuccugggaugagacagaauacaaaauuccugcacgacuuaccuugcagaucugggacgcggaucacuucagugccgacgauuuucugggcgcuauugaguuagaccucaacagauucccccgcggggccaagacugcaaaacagugcacaauggaaauggcuacgggagagguagaugugccacuggucagcaucuuuaagcagaaaagggugaagggcugguggccucuucuggcccguaacgaaaaugacgaguucgagcuaaccgggaagguugaagcagagcuccaucuguugacugccgaagaggcugagaaaaaccccgugggacuggcgcggaaugaaccagauccguuagagaagccuaacagacccgacacaucuuuuauaugguuccucaauccacugaaauccgccagguauuuucuuuggcacaccuaccgcuggcuguugcucaagcugcuacugcuucuccuguugcuguuacuccuggcacuuuuccuguauucaguccccggcuacuuggugaaaaagauucucggugcuuga

SEQ ID NO: 60247 - RNA, 8778 nt, Artificial Sequence
  derived and/or modified sequence opt3 from OTOG__Homo_sapiens__NP_001264198
augggcgugcuggccagcgcucucugcuggcuucugugugucugguugcccuggggagaacaggcugccgaauccuuaagaguucaaaggcugggggagcggguggucgacucuggucgcucaggcgcgcgagggaugcguaacgugaagggaaugagaaauggcccugcucagaccagggucaguagcuccucuucgcaccaggaagccacacuagcuaugggugauaaagccacugugguugggggacagcaagcugaggcaccagacucaguggccaugagcaguugggaacggcgccuccacagagcuaaaugcgccccguccuaccuguucucuuguuuuaacggcggcgagugcguccaccccgcguucugugauugcaggcgguuuaaugcaacggggccucgcugucagaugguguauaacgccggaccagagcgagacagcaucugcagagcuuggggucagcaucacguggaaaccuucgauggccuuuacuauuaccuguccgggaaaggaucauauacauugguuggcaggcaugagcccgaaggucagaguuuuagcauucaagugcacaaugacccucagugugggucuuccccauacacuugcucacgggccgucagccucuucuuugugggagagcaggagauacaccuggcaaaggaagugacccauggcggcaugcguguccagcugccccacguuauggggagugcucgccuccaacaguuagccggauaugugaucguaagacaucagucugcguucacacuggccugggauggugcauccgcuguguacauuaaaaugagcccugagcuuuugggcuggacccacgggcuguguggaaacaauaacgccgacccaaaggaugaccuagucacuucgucuggcaagcucacagaugacgugguugaauuugugcacuccuggcaagagcaggcuccgaaucagcccccugguccaaccacgucaagucugcccaggccuccaugccuucagcaaaaccccgggacuaugcagggcgucuacgaacagugcgaggcccuguugcggccgccuuucgaugcaugucaugccuaugugagcccccucccauuuaccgcuuccugcacaucugaccugugucagagcaugggagacguagcgacuuggugccgagcauuagccgaguacgcucgcgccugugcacaagccggcagaccucugcagggguggaggacccagcuccggcagugcacaguucacuguaaagaaaaggcuuucaccuauaaugagugcaucgccuguugccccgcaucaugucauccacgcgcgaguugcguggauuccgaaauugcuugcgucgacggauguuacugccccaacggucuuaucuuugaggauggcggguguguggccccugcagaaugcccaugugaguuccacggaacgcuguauccgcccggcagcgucgugaaagaggacugcaauacuuguacaugcaccucugguaagugggaauguucaacugccguuugcccugcugaguguagugugacaggggauauacauuucaccacguuugacggcagaagguacaccuucccagccacaugccaauauaucuuggcaaaaagccguuccucuggaacuuuuaccguaacacuacagaacgcucccugcggccugaaucaggauggggccuguguccagucggugagcguuauucuccaccaagacccucggcgacaggugacucugacccaggcgggagauguccuucuguucgaccaauacaagaucauuccacccuacacagaugacgccuuugaaaucagaagguuguccucaguguuccuccgcguacggaccaacguggguguuagaguccuguaugacagggagggcuuacgccuguaccuacagguggaucagcgauggguggaagacacugucgggcucugcggaacguuuaacggcaauacacaggaugacuuccugaguccgguuggugugccugagucuaccccacaacuuuuugggaacagcuggaagacuuuguccgcuuguucaccccuggugagcggcucuccucucgaucccugcgacguacaucugcaggcagccuccuauaguguccaggcuuguagcgugcuuaccggagagauguucgccccaugcucugcauuucuguccccuguucccuacuucgaacagugucggcgugaugcgugcagauguggccaaccaugcuugugugccacacucgcucauuaugcccaccugugcaggcgccauggguuaccgguggacuuucgggcaagacugccugcuugcgcccuaucaugugaggcaaguaaagaauacagccccugcgucgccccauguggaaggaccugccaggaucucgcuucgcccgaggcguguggcguggacgguggggaugaccugucccgagaugagugcguugaaggaugugccugcccuccagacacuuaucuugacacacaggcagauuugugugugccccgcaaucagugcucuugucacuuccaaggcguagacuacccuccgggugauagcgacauaccaucacugggccacugccauugcaaggauggggucaugaguugugacucccgggcucccgccgccgcuugcccugcaggacagguguucgugaacuguucugaucuccacacggaccuggaguuaagcagagaaaggaccugcgagcagcaacugcuuaauuuguccgucucagcccguggcccaugucucagcgggugcgcguguccccagggacugcuacgccauggcgaugcuugcuuucugccugaagaguguccgugcacuuggaaagguaaggaguacuuccccggggaccagguuaugaguccaugucacacaugcgugugccagcggggaucuuuucaauguacccuccauccuugcgccuccacauguacugcauauggcgauagacacuacaggaccuucgacggucugcccuuugauuucguaggcgccugcaaagugcaccuugucaagagcacgucggacgugucauuuucuguuauuguggaaaacgucaauuguuauaguuccgggaugaucugccgaaaauucauuagcaucaacgugggaaauucuuugaucguuuuugacgaugacagcggcaacccauccccugagucauuccuggaugacaagcaggaagugcauaccuggcgggucggguuuuucacauuaguacacuuuccccaggagcauauuacucuccugugggaucagcgcaccacagugcacguucaagcuggaccacaguggcagggccagcuugcaggucugugugggaauuucgacuugaagacuauaaacgaaaugagaaccccggagaaucucgagcugacgaacccucaagaguucggaaguagcugggccgcgguggagugccccgauacacuagacccaagggauauguguguccugaauccccuccgggaaccuuuugcuaaaaaggagugcucuauccugcuuuccgaaguguucgagauuugucauccaguaguggacgucaccugguuuuacucaaacugcuugacugauacauguggcugcagucaggguggcgacugcgaguguuucugcgccagcguuuccgcauaugcccaccaguguugccagcacgggguggcuguggacuggcgaacccccagacuguguccuuacgauugcgacuuuuucaacaaagucuuaggaaagggcccguaucaacucucuucgcuggccgcagggggagcucuugugggcaugaaagccguuggugaugacaucguacuggugcgcacugaagaugucgcgccagccgacauagugagcuuucuacucaccgcagcucuguacaaggccaaggcucaugaucccgacguugugucauuggaggcagccgauaggccuaauuucuuucugcacgucacagccaacggguccuuagaacucgcuaaauggcagggacgugacacguuccagcaacaugcgaguuuucugcuucaccggggcaccagacaggcaggccugguggccuuggagucucucgcuaagcccagcuccuuccuguacguaucaggggccguccuagcacugaggcuuuaugagcacacugaaguguuccgccgaggaacacucuuuagacuguuggaugccaaaccaucuggugcugcguacccuauuugugaguggcgguaugacgccugcgcaagccccuguuuccagaccugcagggauccacgcgcugccaguugucgugacguuccuagaguggaaggcugcgucccggugugccccacaccacagguucuggacgaggugacucaacggugugucuacuuagaagauugcguggagccugcaguaugggugcccaccgaggcccucgggaaugaaacgcugccaccuucccagggacuucccacaccgagcgacgaggaaccacagcugucucaggagucaccuaggacccccacucaucgcccagcuuugacccccgccgcgccucucacaacugcacugaacccgcccguuaccgccacagaagaaccagucguguccccuggccccacgcaaaccacucuacagcagccucuggagcuuacagcuagucagcucccagccggucccaccgaaagcccugcuucgaagggggugacugcaucucuguuggccaucccacacacacccgaguccagcucauuaccggucgcucugcaaaccccuacgccaggaaugguaaguggcgccauggaaacuacccgagugacaguuaucuuugcaggcucucccaauauuaccguguccagcagaucaccuccagcgccccgguucccgcucaugacuaaagccgucacagugagggggcauggaagucugccuguucgcaccacacccccacagccuagccuuacugcuucccccucuagcagaccaguggccucccccggugcaaucucaaggucuccuaccaguucgggcagccacaaggcuguccugacgccagccgugacaaagguaauuucccggaccggggugccgcagcccacucaagcacagucugccucaagcccuuccaccccauugacaguugcuggaacugcggccgagcagguccccgugaguccucuagcaacccguucucuggaaauagugcucagcacggagaaaggcgaggcuggucauucacagccaauggggucccccgccaguccucaaccgcacccacugcccagcgccccuccccgcccagcacagcacacaaccauggcuacucgaucuccugcccuucccccagaaacaccggcggcugccuccuuaucaaccgcaacugauggacuggccgcuacaccuuuuaugagccucgagucgaccagacccucucaguugcugaguggccucccacccgacacgucccugccucuugcaaaggucggcacuagcgccccaguugcgacccccgggccuaaggcuucagugaucacaaccccgcugcagccacaagccacaacuuugcccgcacagacccuauccccuguacugccauucacgcccgccgcuaugacacaggcccauccucccacucacauugcaccaccggcugccggaaccgcgccuggucucuuacugggcgccacacuucccaccucuggggugcugccagucgcagaaggaacugcuagcauggugaguguugugccuaggaaguccaccacaggcaaagucgccauccucagcaagcagguaucuuugcccacgucaauguaugguagugcagaagggggcccaacugagcugaccccugcuacaucccauccccucaccccgcugguggccgaaccagagggcgcccaagcgggcacugcacuuccuguucccacaagcuacgcacuaucucgggugucggcccgcaccgcuccacaggauucaaugcuggucuuguuaccccagcuggccgaagcacacgggacgagcgccggaccucaccucgcugcggagccgguggacgaagccacuacagagccauccgguagaagugcacccgcucugucuaucgucgagggccuugccgaagcacuggccaccaccacugaggcuaacacaagcaccacaugugugccuauugccgaacaggauugcguuaggcauauaugucucgaggggcaauugauccgggugaaucagucccagcacugcccccaaggagcggcaccaccucgauguggcauucugggucuagccguaagagucgggggagaccgcugcuguccccugugggaaugcgcuuguaggugcucaaucuuuccagaucucaguuucgugacuuuugacggcucucauguugcccuuuucaaggaggcaauuuauauccugagccaguccccugaugagauguuaacggugcacgucuuggacugcaaaucagcuaaccugggccaucucaauuggccgcccuuuugucuggugaugcuuaacaugacccaccuggcccaccagguaacaauagaucgguucaaucguaaggugacuguugaccuccagccaguguggccucccgucagcagauacggguuuaggaucgaagacaccggacauauguacaugauuuugacaccaucugauauccaaauucaguggcugcacuccagugguuuaaugaucguggaggcuagcaaaaccucgaaggcccagggccaugggcuaugcggaauaugugacggcgaugcagcgaacgaccugacucucaaagaugguuccgucguagggggcgccgaagacccugcucccuuccuugauucuuggcagguuccgucaagccugacgaguguaggacaaacccgcuuccggccagacuccugcgccacaacugauuguucuccuugcuugcgaauggugagcaauagaaccuuuucagcaugucacagguucguacccccagaguccuuuugcgaacuguggauucgcgacacaaaguaugugcagcagcccuguguugcucucaccguguacgucgccaugugccacaaauuccauguguguaucgaguggcggagaagugauuauugcccuuuucugugcagcucugacucaacuuaccaggcauguguaacagccugcgagcccccaaagacgugucaagacggcauucuugggccucucgauccggaacacugccaggugcugggagaggguuguguuugcuccgaaggcaccaucuugcaucguaggcacagcgcgcuguguauacccgaggcuaagugcgccuguacugacucuaugggggucccacgggcauuaggagagacauggaacaguucgcuauccggcugcugucagcaucaaugccaggccccugauaccaucgugcccguggaccuggguugcccaagcccucgccccgaaucaugucuccgauucggggaggucgcacuucuguugccgaccaaagauccuugcugucugggcacaguuugcguguguaaucagacucucugcgaaggacuggccccaacguguagacccggccacaggcuuuuaacccacuuucaggaggacucuugcuguccuagcuauuccugcgaaugugauccagaccugugcgaggcagagcucguacccaguugccggcaagaucagauuuugaucacagggcgccugggagacucauguugcacuucuuacuucugugcuugcggugauuguccugacagcauuccagaaugccaggagggcgaagcccuaaccgugcauagaaacacaaccgagcuguguugcccccucuaucagugugucugcgaaaacuuuagguguccgcaagugcagugcgggcuuggaacugcgcugguugaggugugguccccugaucgaugcugucccuacaagaguugcgagugugacugcgacacgaucccagucccccggugucacuugugggagaaaagccagcuggaugaggaguucaugcauuccguggagaauguaugcggcugugcuaaguacgaaugcguuaaagccccugugugucucucucgugagcugggugucaugcagccagggcaaacagugguggaguuaucagcagacggcgucugccacaccagcagauguacuaccguucuugauccccugacaaacuuuuaucagauaaauacuaccucggugcucugcgacauucauugcgaagccaaccaggaguacgaacacccucgcgaucuagcugcauguugcggauccuguaggaauguaaguugccuguucacauuuccaaacggcacgaccucuuuguuccugccgggggccagcuggaucgcggacugugcccggcaccauugcucauccacuccccucggagcugugcuugucagaucuccuaucaguuguccaccccugaaugagacagagugcgcaaaggugggcgguagcguugugccuuccuuggaaggguguugccgcaccuguaaggaggauggaaggucaugcaaaaaggucacuauucgaaugacaauccggaaaaacgaaugcagaagcucuaccccagugaaucugguaaguugugacggaaggugccccuccgccagcauuuauaacuacaauauaaacacguaugcucgcuucuguaagugcugucgugagguuggucuccaacggagaucagugcaguuauuuugcgccaccaaugcaacaugggucccguacacugugcaggaaccuaccgauugugcuugccaguggucuuga

SEQ ID NO: 60248 - RNA, 7035 nt, Artificial Sequence
  derived and/or modified sequence opt3 from OTOGL__Homo_sapiens__NP_775862
augauccccuggagcauuuuccugcuccacgugcuucuguuuuccuugcaagaguacauaugcgcaucuucaaucuuaaugggcaccaguaaaaacggguucaaugaaaacagacagaagagggcucugcuagcagcccaguuugaggcgacaagcccucgguauuucuuucaugacgcuauuaauuggggagaauccaagaucaaagguucuuguccauacgagugccucaacggcgccuucuguucgaagacugggacgugcgauugucagauuuuucaggcacugggaacccgcugccaaaucauaccgaauaugggcaacggucgagacgggaucuguaaaacauggggacaguaucacuucgaaacuuuugauggcauuuacuauuacuuccccggcaauugcucauauaucuuugccaaggacuguggggaucuugagccucguuacaccgucuggguucauaacagcccaaagugccugggaaguguguacuccuguuauagaucuauuagcuuguucuuuuccaaucaggaggaaaucaggauauacggucacgagauuaaaaagaacggcaucucacucacacugccccagaccauugggcaaaucuucaucgaaaaacuggcugacuauauucucguaaagacuacauucggauuuaguuuagcaugggauggcauaagcgguaucuaccugaaacuuucugaggaccauaaggggaaguccugcggauugugcggcaauuauaacgauauucagucagacgauuucaucauacugcaggaggacuacaccgaagauauugccauguuugcuaauagcuggagugugcagacgccugacgacacuaaauguguccuaaccccaucugauuuccccaacccuugcuccagcggcaugccagccuuugaggcgaucuucuuuaagugucaaauccuccugcaguucccguuucuuucgugccacgaauauauugaccccuaccuguacaucgcaucuugugugaaugauuugugcaaaacagacgaugacgagacuuauugucgggccgcuaccgaauacgcccgcgcaugcucccacgcuggguauccuauucaggauuggagagacgauuucccagccuguacagacaagugcgaugacucauuuguucauagggacuguauaaguugcugucccccuaccuguacguucgagaaacaaugccucggaagcaaccugcacuguuuagaugguugcuacuguccagacggccuggugauggauaacgggacuugcaucucccucgagaauugucccugcggauuucauggccuugcguauucugucgguagcaagauugaacaggaguguacagaaugcguguguguagggggcguuuggaacugcaccgagcaggacugcccggugcaguguucagucgugggagauagucacuucacuacauucgacggccggcacuacuccuuuaucgggaugugccaauauauccuggugaaaggaaccgguaaggauaaguucacgauuaccuugcagaaagccccuugugaacagaaucuaggccuggucugccuccagagcauaacacugauccuugaggacgauuuuaacaagcaaguuacucuggggcgcggaggccagauuuugaccucucccaaucaggguuucaaccucaaugggaucguggagauucagacacugucaaguuuauuuauccugcuaaaaacuaccuucggccucaagauacuguuugcaaucgacggagaacgaauuuacauccaacuuacaagcgcuuggaaaagaaggaccuugggccugugugggacuuucaacggaaauauucgggaugacuuucucuccccaucugguaugaucgagggcacgccucagcugcaugccaacgcuuggcguguaucgagcacaugcuucgcccccgugcacgucccagugguugaucccuguaauauaaaccagcagaauauuggguacgcagcccauugcgacgugauccaccaagaacuuuuugcuccuugucauauuuauaucuccccaggacuguacuaucaguugugccgccacgacgcguguaagugcggcucaaguugccucuguaacgcacuggcccacuacgcuuauuuaugcggucagcauggggucccgauagauuucagaacccaaaucucuuuuugugccgugguaugccagaagggcaugcuguaccaccauuguagcuccuucugccuacacucauguauuagccucucuucccccgagcagugcagugacgauugugcagaaggaugcaauuguccugagggcaaauucuaugaggacacucugaacuuuugcguuccaaucuuccacuguaggugccauuaccgggggagcguguaccagcccggagaacuuauuccuaccccaucuggcuugugccaaugcuccaacgguacagucaagugcgaugagcuggccacccccucagcugugcacaucuguccggaagggaaagaguauuuugacugccgauucccugauccagagcuccccgccggaggcgucaauugugaaacuacaugcgcaaaccuggcgaugaauuuuacguguaccccuaguagccccugcauaucggguugugugugcgcuccaggcauggccgagcaucgcgggaagugcuacguuccugaauccugucccugcauuuggaaagacugggaguauuuaucuggagaagugaucgcaacuccauguuacacaugcguauguagaaggggcauguucaacugcaccuauuacccguguccugccgucugcacaaucuauggggaucggcacuacuacagcuuugacggacuggaguaugauuacauuucagacugucagguguuccuuaucaagagugcugaugacuccgacauuucuguuauagcccagaauaagaaaugcuuugauaacgacaucguguguagcaaguccgucuugauuucagugggcgauacugagaucuaucucaaugacacccccuacaaacagaagcaaagcgguuucuuucuggaaaacaaaaguacguaucagcuauggaaggcaggguacuauauuguaguguacuucccagagaaggauaucaccauacugugggaccgcaaaacaacuauccauauuaagguuggaccccaguggaaaaauaagcucucuggccugugcgguaacuucgauaaauguaccuccaaugacaugacaacuagcaacaaucuugaagucagaaacgcuaggguguuuggcgauucgugggccuuggggcagugcgagucaccugacgaaaccaucaagccaugcgaggcgcaccaaaauaaauuccccuacgccaagaaggaguguucuauucuguauagugauaucuuugcuuccugccguaacgugauagacgucacgagcuucgccaaaaacugucacgaagacacaugcaauuguaacuuaggaggcgauugcgagugucucugcaccucuauugccgcuuacgccuauaaguguugccaggaagggaucagcauccauuggcgguccucaacuguuuguagucuggacugcgaguacuauaaugaaggacuuggcgaggguccuuacaugcuggcaagcuaugggcagucuggauuggugcucggcgcgaacaugacaucccgaucaguguuuugccugccgagaaguagcguacacaccucccuauucuuuuacuucaugauuacuccaggucuguuuaaagagaaggucucuucgcucgcccuggugagccuugaaucagcugagaggcccaauuacuucuuguauguucaugauaacgacacccuguccuuagaacucugggaggccaauagugcauuucaccgccgggcuacauucuuucaucaccaaggccuguggauaccuggguacucugccuucgagcuuuauagcaaaaagggauucuuuaucauuuucacggauuccucagugaaggcaucuaaauacgacgauagcgaagaguuuaagcacaguuccagcuucucuaucgaagagauucaggccgcugucccauauagaaaaaugugugaauggagguacgagcccugcgcgaccccuuguuuuaagacuugcucagacccggaggcccuggcauguaaauuccuacccccaguggaaggcugccucccuuauugucccaagaacaugauccuggaugagguuacauugaagugcguguacccacgcgacuguauaccuguaauccccaccgaaccaacacugaugccgccugcuaaacccacugucccaauguuuaccgugugggagaugauuacgcccuccgauaucacaguguucgacauguuaaccccuacuaccgggcucgaaugcgagccacagaaguuugaucccgucuacgacuguagucaguauauuugccugaauauggaguggcaacuuuacaacuggagccugaauugcccuaaagacguugaaaugccggauuguggauuccgaggccggccagugcagguaaacucggacaucugcugucccgagugggaaugcccuugucguugcucuauguuguccgagcucagcauaauuacauuugaugguaauaacgccgcccuguauucaauggcuaguuacauccuagugagaauccccggggaaauuaucgucgcacauauagagaaguguucuaugaaucagaacggaaacucccugaagaaacuugccccaagcggcaggauuucaggccucugcuucaagaaacugaaugugacuaccccuauccacaaaauuaucguuaaccgcuuggcgcggaaaguggaggucgacaguauagugguuccccugccauuuagcucccaggaauuaucuauugaggauagcggguccauguaugugaucacaacgccugcuggacucaucauuaaguggucacaucugaccgguaucauugacauacacuucggcuucagauuuaaucuuucuaguuacacugaagggcuguguggaaucugcaacgaggauccggacgaugacuugaggaugcaaaauggcacaauuaucaccaacauggaggauaucggucucuucauugaaucgugggagauagaaaagagcuuugaggucacuaugcgacgccccguacggaauuguacagagcacgacugcucccagugcaucgaucugcuaaacagaaggauuuucaucccaugucaugacaaggugucuccugaggacuuuugcgagaaaauguggauuaauuauaccuacuucuggaacuacgaaugugaugcccugucagcauauguugcccuuugcaauaaguuugacaucuguauacaguggcguacgcccgauuacugcagccucuccuguccagaggggaaggaauaucagccuugcgugcgccccugugaggcucggacuugccugaaccaaugguucuacggacacaccaguuguuugaauuuaagagaagacugcgucugcaaagugggcacaauccugcauaggccgcacucugcacaguguauuccagagaaggagugcgccuguaccgauagcgaagaccagccucgaacugcgggcgagaucuggaacgggggaauugaugaaugcacacucuauaaaugucuggagaaugguucaaucauacccauugaaccagacugcgaugaggagcccaccccuguaugugaacgggaggcugaaguggucaugggcaucauugacaaguggacaugcuguuccaaagagguuugcgggugugauacuacccuuugcgagacgaguaucccgacaugcaccaacagccagaagcugauagugggacauucucccuuguccuguugcccacaauacaagugugaaugcgacccucuaaaaugucccucaaucagcacuccugagugccgcgaagaccaguuuaugauucaggugagacaagaggaaccauguugcuucucgcccuuuugugucugcgagucuuguaccaagccugugccacugugccacgauggcgaguuccucacaguugaccugaauaguacucacuuuugcuguccccaguauuacugcguaugugaaccgaaccuuugcccuaugccauuacugaacugugccgaggauaugaaucucgugaaagaaaacgucuccggucagugcugucccaccuggcauugcgaguguaauugcgaaaacuugaucaugccuacgugugaggugggggaguucacagcaauugaccacaauuuccagagcgauugcggaugcauccaauaccugugugaaaaggacgauguuugcguguuucaggaggucucagugcucaacccaggccaguccaugauaaaauaucuggaagaggacuucuguuacgccauugaaugccuugaggagaaggauaaucauaccggcuuucacacucugaacuucacauugguaaauuguucuaagaaaugcgacguccaccagguguauacccccagcccgagugauuacggguguugcggaacuuguaagaacguuuccugcaaauuucauauggaaaaugguacaagcguggucuaugcugugggcucuaccuggcacuacaacuguacgacuuaugagugcguuaagaccgacgaaggggccaucauccuaaauuacacaauggugugcccucccuucaacgagaccgaguguaaaaugaaugaaggaauugucaagcuguacaacgagggcugcuguaagaucugcaaaagggaagaacggauaugucaaaaggugauuaucaaaucaguaauucgaaagcaggauugcaugagucaguccccaaucaacguggcaagcugugacgguaaaugcccuucugcuacaauauauaauaucaacauugaaucgcaucucagauuuuguaagugcugucgcgagaaugggguuaggaacuuaucagucccccuguacugcagcggaaauggcacugagaucauguauacccuucaggaaccaauugacugcacgugucaauggaacuga

SEQ ID NO: 60249 - RNA, 1434 nt, Artificial Sequence
  derived and/or modified sequence opt3 from OTOL1__Homo_sapiens__NP_001073909
auguggauguucagcuggcugugcgccauccucauuauacuugcuaucgcaggcaugaacaccauugccaagacaacuccccacacgaaauuuaccaagaaauccgaggaaagagagaugccuaaggggcugaaaccaucuucaggaccgcccccugaagaggaagagacauuguucacugagauggcggaaauggcugagccaaucaccaagcccagugccuuagacagcguguuugguacagcaacccuguccccuuucgaaaauuuuacucuagauccagccgacuucuuucucaacuguugcgauuguugcucucccgucccuggccagaagggggagccaggagagacaggccaaccgggucccaaaggggaagcuggaaaucugggcauuccuggcccacccgggguugugggaccucaggguccaaggggcuacaagggggagaaaggacuuaagggcgaacggggugaccaggggguacccggauauccgggcaaaccuggcgcacagggggagcccggaccaaagggugauaagggcaacaucgggcugggaggcgugaaaggucaaaaggggucgaaaggcgacaccuguggaaauugcacgaagggcgaaaaaggggaucagggagccauggguucaccuggcuugcaugggggacccggcgcuaagggugagaaaggggagaugggcgaaaagggagagaugggcgacaagggguguugcggagauagcggugaacgcggcgggaaaggacagaagggcgagggugggaugaaaggcgaaaagggaaguaaaggcgacuccgggauggagggaaagucuggccgaaacggucucccaggggccaagggagaucccggcauaaaaggugagaagggcgaacuggggccuccaggacugcucggcccgacugggcccaaaggagacaucggcaauaaggguguccgugggccuaccggaaagaagggcagcagagguuucaagggcuccaaaggggaguuagcgagggugccacggucagcauuuagugccggacugagcaagcccuucccuccacccaacauuccgaucaaauuugaaaagauucuuuacaaugaucagggcaacuauucuccuguuacagggaaauucaauuguuccaucccaggaacuuacguguuuucauaucacauaaccguccgcggcagacccgcuaggauuagcuugguggcccaaaacaagaagcaguucaaaagucgggagacacuguacggucaggaaaucgaccaggcaucucuacucguaauucugaaacuuuccgcuggggaccaaguuuggcuggaggugagcaaagauuggaauggagucuaugugucggccgaggacgauucuaucuucaccggcuuuuugcucuacccugaagagacguccgguaucucacccuga

SEQ ID NO: 60250 - RNA, 1839 nt, Artificial Sequence
  derived and/or modified sequence opt3 from OTOP1__Homo_sapiens__NP_819056
augcuggagggccucgggagccccgccuccccuagagcugcagccucugcgucaguggcuggaaguagcgguccagccgcaugcuccccgcccucuucgucagccccuaggagcccagaaagucccgcuccucggcgcggcgggguccgagcauccguuccacagaaacuugccgagaugcugucuagccaauacggauugaucguguucguagcuggcuuacugcuacuccuggccugggcggugcacgcagccggugucuccaaaucagaccuucugugcuuuuugaccgcucucaugcugcugcagcucuuauggaugcugugguauguggggcguaguagcgcccauagaaggcuuuuccgguugaaggauacacacgcaggagcuggcuggcugcgcggcucuauuacucuauuugccguuauaacggugauccucgggugucugaaaauuggauacuucaucgguuuuuccgaaugucuuucagcgaccgagggcgucuuccccgugacacauagcguacacacucuguugcagguuuauuuucucugggggcaugccaaggacauuauccagaguuucaaaacccuggaaagauuuggagugauacacucugucuucacaaacuuacugcucugggcaaauggcgugcuuaacgaguccaagcaccaacugaaugagcauaaggaaagguugaucacccuagguuuugggaacauuacuacagugcuggaugaccacaccccucagugcaauuguacgccaccgacucucugcaccgcuaucagccauggaauuuacuaucuguaccccuucaacaucgaguaucagauacuugccucgacaaugcuguacgucuuguggaaaaauauuggccggaagguugauucucaccagcaccaaaagaugcaguuuaaguccgacggcgugaugguaggggcugugcucggacugacugucuuagccgcaaccaucgccgugguuguggucuaccugauucauaucggucgcucaaaaacaaagagugaaagcgcucuaaucauguucuaucucuacgcgauuacccugcuuauguugaugggcgcagccgggcuggcuggaauacgaaucuauagaauugaugagaagucccucgacgagucuaaaaacccugccaggaagcuggauagcgaccuucuggugggcacggcaucagguaguugguugaucuccugggggagcauacucgccauucugugugcugaaggccacccacgguacacuugguauaauuuacccuacucuauccuggccaucguagagaaauauauucagaaccuauucaucuuugaaucaauucaucgugagccugaaaagcucagugaggauauacagacacugcgcguugugaccgucugcaauggaaacacuaugccacuugcaagcuccugucccaaaucuggcgggguggcgagagacgucgcuccgcaaggaaaggauaugccucccgccgcaaaugguaacgugugcaugagggagucgcacgacaaagaagaggaaaagcaggaggaaagcuccuggggcgggucaccaaguccuguucgguugccccgauuccugcagggaaaugccaagcgcaaagugcucagaaacaucgcugccuuucuguucuuauguaacauuucucuguggaucccacccgcauuuggcugcaggccugaguacgacaauggucuugaggaaaucguauucggguuugagccauggauuauagucgugaacuuggcuaugccguucagcaucuuuuaccggaugcaugccgcggccucccucuucgaaguuuauugcaagauuuga

SEQ ID NO: 60251 - RNA, 387 nt, Artificial Sequence
  derived and/or modified sequence opt3 from OTOR__Homo_sapiens__NP_064542
auggccagaauccugcuccuuuuccugcccggcuugguggcugucugcgcaguucacgggauuuuuauggacagguuagccagcaagaaacugugugcggaugacgagugcguguacaccauaucccuagcuucugcccaggaagauuauaacgcaccugacugucgguucaucaauguaaagaaaggacaacagauuuacguguauucaaagcucgucaaagagaacggugccggcgaauuuugggcugggaguguguacggagauggccaggacgagauggguguugugggguauuucccacgcaaucuggucaaggaacagcgaguguaccaagaggcaacaaaggagguaccgacuacggauaucgacuuuuucugcgaauga

SEQ ID NO: 60252 - RNA, 978 nt, Artificial Sequence
  derived and/or modified sequence opt3 from OTP__Homo_sapiens__NP_115485
augcugagccacgccgaccuccuugaugcuagacugggcaugaaggacgcagccgaguuguuagggcauagggaagcggugaaaugccggcugggagucgguggcuccgaucccgggggacacccuggcgaccuagcuccaaacucugauccgguugagggugccacccuccugcccggggaagacaucacaacugugggaucaacgccugcaagucuugccguaagcgcuaaggauccagacaaacagcccggcccucaaggcgggccaaaucccucccaggcaggacagcagcaaggucagcagaagcagaaacgccaucgaacccguuucacuccugcccaacugaacgaguuggaaagaucuuuugcuaagacacacuacccagauauuuucaugagggaggagcucgcccugcggauaggccugaccgaaucgcgcgugcaggucugguuucagaauagaagggcgaaguggaaaaagcggaaaaagacaaccaacguguuccgcgcaccggggacucucuuacccacaccuggacugccacaguuucccucagccgcugccgcagcugccgcggccaugggcgacagccuuuguaguuuccaugcaaaugauacccgaugggcugccgcugccaugccugguguuucccaauugccacugcccccggcacuagggagacagcaggccauggcucaaucucucagccagugcucccuggcggcaggaccucccccaaacucaaugggccuuaguaauagccuggccggcucuaacggggcuggauugcagucccaccucuaucagccugccuuucccgguauggugccagcaucacugcccggcccuagcaaugucagugggucuccacaauuauguuccagcccggacucgucugauguguggaggggaacguccaucgccucacugcggcguaaagcucucgagcacacuguaaguaugagcuucaccuga

SEQ ID NO: 60253 - RNA, 816 nt, Artificial Sequence
  derived and/or modified sequence opt3 from OTUB1__Homo_sapiens__NP_060140
auggccgcugaggaaccccagcaacagaagcaggagccucugggcagcgacuccgaaggggugaacugccucgcauacgaugaggccaucauggcgcagcaagacaggauucagcaggaaauagcuguccagaauccacuuguuucugagagacuggaguugucaguguuauauaaagaauacgccgaggaugacaacaucuaucaacagaagauuaaagaucugcacaagaaauacaguuauauccggaagacccgcccggacggaaauuguuucuaccgagcauuugguuucagccaucuagaagcccuccuggaugacuccaaggagcuucagcguuuuaaagcuguaucugcaaagucgaaagaggaucuggugucacagggcuucacagaauuuacuauugaggacuuccacaacacguuuauggauuugaucgaacaagucgagaagcagaccagcguggccgaccuccuggcuaguuucaaugaucaguccacaucugacuaucugguuguguaccucagauuacugacuagcggguaccuucaaagggaauccaaauuuuucgagcauuuuauagagggaggccggaccgucaaggaguucugccagcaggagguggaacccauguguaaggagucagaccacauccauauuaucgccuuggcgcaggcacugaguguaagcauucaaguugaauauauggaucgcggugaagggggaacaaccaacccucacaucuuuccagagggcucugaacccaaaguguaccuacucuauagaccuggccacuacgacauacuguauaaguga

SEQ ID NO: 60254 - RNA, 1446 nt, Artificial Sequence
  derived and/or modified sequence opt3 from OTUD1__Homo_sapiens__NP_001138845
augcagcuguacagcuccgugugcacccacuaucccgccggcgcuccugggccaacagcagccgcgccggcucccccugccgcagccacuccauucaaggucucucuccaacccccuggagcugccggugcagcuccagagcccgaaacgggcgagugucagccugccgcggcagccgaacauagagaggcugccgcaguuccagcugccaaaaugccggcguuuucaaguugcuucgaagugguaagcggggccgcagcucccgccuccgcugccgcaggaccuccaggcgccucuuguaagcccccucuuccaccccacuacaccucgacagcucagaucacugugagggcgcugggugcagaccgguuguuacugcaugggccggauccuguccccggagccgcuggcucagccgcagccccacgcggccgaugccuacuccuggcuccugcccccgcagcgccagugcccccucguagagggagcagugcuuggcuucuggaggaguugcucaggccagacuguccggaacccgccggacuggaugcaacccgggaggguccugaccgcaacuuuagacuguccgaacacaggcaggcccucgcugccgcaaaacaucggggcccagcugccacacccgggucuccugauccaggacccggcccguggggugaggagcacuuagcggaacgcgggccucgaggaugggagagaggcggcgacaggugcgaugccccagggggagacgcugcacggcgucccgauccugaagccgaggcucccccagccgguagcauugaagcagcgccuuccucagccgcugagcccguuauagugagucgcagcgacccaagagaugagaagcuggcccuuuauuuggcagaagucgagaaacaagacaaguaccugaggcagcggaauaaguaucgauuccacaucauuccggauggcaacugucuauaccgcgcugugucuaaaaccguauauggggaccagucccuccauagagaacugagggagcagacuguucacuacaucgccgaccaucuugaucacuuuucaccucugauugaaggagacgugggcgaguucaucauagcagccgcucaagauggugcgugggccggguaccccgaguugcucgcaaugggccagaugcugaaugucaacauccacuuaacaaccggaggccggcuggaaagcccaacggugaguacuaugauucauuaucucgggcccgaggacucucuucgcccuuccaucuggcugagcugguugucgaauggacacuacgaugcuguguuugaccauucuuauccaaaccccgaauacgauaauuggugcaagcagacccagguccaaagaaaaagggacgaggaacuagccaaguccauggccauuucacugaguaaaauguauaucgagcagaacgcuuguagcuga

SEQ ID NO: 60255 - RNA, 3150 nt, Artificial Sequence
  derived and/or modified sequence opt3 from OTUD4__Homo_sapiens__NP_001096123
auggccugcauccacuaccugagagagaacagggaaaaguucgaggcuuuuauugaaggcagcuucgaggaauaucucaaacggcuugagaauccccaggaguggguggggcaagucgaaauauccgcacugucuuugauguaccgcaaggacuuuaucauuuaucgagagccuaacguuucaccaagucaggugaccgaaaauaacuucccggagaaaguauuacuguguuuuagcaauggaaaccauuacgauaucguguaucccauuaaguacaaagaguccucugccaugugccagucgcuacucuaugaacugcuuuacgagaaggucuucaagacagacgugucaaaaaucguuauggaacuggauacuuuggagguggcggacgaagauaauagcgagauaagugacuccgaggaugacucuuguaagagcaaaacggcugccgcagccgcugaugucaacgguuuuaagccucucuccggcaaugaacagcugaaaaacaaugggaacucaaccagucugccacucagccguaagguguuaaagucucugaaucccgcaguauacagaaacguugaguaugaaaucuggcuuaaauccaagcaagcccagcagaaaagggacuacucaauugcugccggauugcaguaugaggugggcgauaagugccaaguccggcuggaccacaaugguaaauuccuaaacgcggaugugcaggggauccauagcgaaaacggaccugugcucgucgaggagcugggcaagaaacacacaaguaagaaucuuaaggcaccacccccugaaucuuggaacacuguuuccggcaaaaagaugaaaaagccaagcaccucggggcagaauuuucauucugacguggacuaccgcggaccgaaaaaccccuccaagccuauuaaggccccaucagcucugcccccuagauugcagcacccaagugguguaaggcaacacgccuucagcucccauucuagcggcucacagagucagaaauuuuccagcgagcacaagaaucucucucggacacccucacaaaucauacgcaaaccggaucgagaaagaguggaggacuucgaucauaccaguagggaaagcaacuauuuugggcuguccccugaggagcggcgugaaaagcaggcaauugaggaaucucgcuuacuguacgagauccagaauagagacgagcaggcuuuccccgcccucucgagcuccucagucaaccaaagugcgucucagagcuccaauccaugugugcagaggaaaucaagccacguuggagaucggaagggcucucgacgcagaauggacacugaagagaggaaggauaaagacuccauucacggucauagucagcuugauaagcggccugaacccagcacacuggagaacaucaccgacgauaaauaugccacggugucuuccccaucaaagaguaaaaaguuggaaugccccagcccugcagagcaaaagccagcugagcacgucucgcuauccaauccggcuccccugcucgugucuccugaaguacaucugacuccagccguucccagccuuccugccaccgugccagcauggcccucagagccgacaacuuucgggccuaccggagucccagcccccaucccugugcugagugucacacagaccuugacgacuggccccgacuccgcugugucucaggcgcaccucacaccaagcccuguucccguguccauucaggcaguaaaccaaccacugaugccguuaccucagacccugucacuauaccaggacccccucuacccaggcuuucccuguaaugaaaaaggggaucgcgccauagucccuccauauagccugugccagacuggagaggaccuucccaaggauaaaaacaucuugagauucuuuuucaaucugggugugaaggcuuacaguuguccuaugugggccccgcauucuuaucucuacccacugcaccaagcauaucuugccgcuugcaggauguaccccaaaguuccugugccagucuauccccacaacccuugguuucaggaagccccggcagcgcagaacgaguccgacuguacaugcaccgaugcucauuuccccaugcaaacggaggccagcgugaauggccagaugccacagccugaaauugggcccccaaccuuuucgucaccucugguaauacccccaucucaggugagugagucccacggacaauugagcuaccaggcagaccucgaaucugagacaccgggccagcuguuacaugccgauuacgaagagagccuguccgguaagaacauguucccucagcccucauuugggccaaaucccuuccuaggcccuguuccaaucgcucccccguuuuucccucacgucugguauggauacccauuucaaggcuucauugagaaccccgugaugcgucagaauaucgugcucccuagugacgaaaaaggggagcuggaucuuagcuuggaaaaccuggaccucucuaaggauugcggauccgucucaacuguugacgaguuccccgaggcccggggugaacacgugcauagucugccagaggcaagcguguccucuaagccugaugaaggccgaaccgagcagucgagccagacaagaaaagcugacacugccuuagcgucaauucccccaguagccgaagggaaggcucacccuccgacccaaauccugaauagggagcgcgagacaguccccguggaacuugagccaaaacggaccauccaguccuugaaggagaaaacugaaaagguuaaggacccuaaaacggcagccgauguggucagucccggagcuaacucuguggacagcagaguucagaggccaaaggaagaguccucagaggaugaaaaugaggugucuaacauucuccgcagcggccgaaguaaacaauuuuauaaucagacauacgguucccggaaguauaaaagcgacuggggguacucuggccguggaggcuaucagcauguaagaucagaagaguccuggaaggggcagccuaguaggagccgcgaugaaggauaccaauaccaccggaacgucagagguaggcccuuccgaggcgaccgccggagaucggggaugggagauggccauaggggucagcacaccuga

SEQ ID NO: 60256 - RNA, 2781 nt, Artificial Sequence
  derived and/or modified sequence opt3 from OTUD7A__Homo_sapiens__NP_570971
auggugagcuccguccugcccaacccuaccucugccgagugcugggcugcacuccuucacgacccaaugacacuggauauggacgccguuuugucagauuucgugagaaguacuggcgcggaaccgggguuagcuagggaccugcuagagggaaagaauugggaucucacggccgcacugagcgacuacgaacagcuucggcaaguacauaccgccaaccugccccacguguuuaaugagggucgcggcccuaaacagccagaacgagagccccagccugggcauaaggucgagcguccauguuugcagagacaagaugacaucgcucaggaaaagaggcucucccggggaauuucucacgcaucgucagccauagugagccuggcucgcagucauguugccuccgagugcaacaaugaacaguucccccuggagaugccuaucuauacauuucagcucccagauuuaucuguguacagcgaggacuucagauccuuuauugaaagggaucugaucgagcaagcgacuauggucgcacuugaacaggccggccgguugaacugguggucaaccguguguacaaguugcaagcgccugcuaccgcucgcuaccacuggugacgggaauugucugcuucacgccgcaagccugggaauguggggcuuccacgaucgagacuugguacucagaaaagcucuguauacaaugaugaggaccggcgccgagcgggaagcguuaaagcgucgcuggagauggcagcagacgcaacagaacaaggaggaggaaugggagagggaauggacugagcugcucaaacuugccucuuccgaaccccggacccauuuuucaaagaaugggggaacagguggcgggguugacaacagcgaggauccuguguacgagagucuggaagaguuccacgucuuuguguuggcacauauucuacgacgcccaaucguggucguugcugacacuaugcugagagauucuggaggcgaagccuucgcucccauaccuuuuggugggaucuaucucccacuggaggugcccccgaauaggugccacuguuccccucuuguacuggccuacgaccaggcacacuucagcgccuuggugucgauggaacaacgggaucagcagcgcgagcaggcugucauuccccucaccgacucugagcauaaacuguuaccacugcacuuugcgguggauccuggaaaggacugggaauggggcaaagaugacaacgauaaugcaagacuagcccaucucauccugucccuugaggcuaaguugaaccugcuccacucauauaugaauguuacauggauuaggauccccagugaaacccgugccccacuggcacaacccgagagcccuacggccuccgcuggcgaggacgugcagucucuugccgacagccuggauucagaccgggauagugucugcuccaacagcaacucuaauaacgggaagaauggaaaagacaaggaaaaagagaagcagcgaaaagaaaaggauaaaacuagagcagacucaguggcgaacaaguuggguaguuucagcaagacacucggcauaaaacugaagaaaaauaugggaggauuaggcggucugguacaugggaagaugggcagggcuaacuccgccaaugggaaaaacggcgauucugcagagcgcgggaaggaaaagaaagccaagucgcggaaaggaagcaaggaggaguccggugcuucagccaguaccucuccaagcgagaaaacuacaccgucccccaccgacaaggcagcuggcgccagcccugcggaaaaagggggaggcccaagaggugaugccuggaaauacucaacggacguuaagcuaucucucaauauucugagggcugcaaugcagggggaacgcaaauucaucuuugccggccuuuugcugaccucccaccgacaccaauuccaugaggaaaugauuggauacuaucucacaagugcucaggagcgguuuagcgccgagcaggaacagcguagaagggaugcagcgacugccgcugccgcagcugccgcagccgcugcggccaccgcaaagcggcccccucggagaccagagacagaaggcgugcccgucccggagagggcuucuccugggccacccacucaacugguguuaaaacugaaggaacgaccuucccccggaccagccgccggucgcgcugcacgggccgcggcuggcgggaccgccucaccuggaggcggugcaagaagggccagugcuagcgggcccgucccaggccguucgccgccugcacccgcccgccaguccgugauccacguucaggcgucuggagcucgggacgaggccugugcaccagccgugggcgcucuuagacccugcgccacauacccucagcaaaacaggagcuugucaagucaguccuauucuccagcacgagcugccgcgcuccggaccguaaauacugucgagagccuggcccgcgcagugcccggggcucuaccuggagccgcuggcacggccggugcagccgaacauaagucccagacauacaccaacggguucggagcucugagagauggccucgaguuugcggacgcagacgccccgacugcuaggucaaauggugaauguggccgcgggggaccaggccccguucaacgaagaugccagcgcgagaacugcgccuucuaugggagggcagagaccgaacacuacuguagcuauugcuaccgugaggaacugcggagaaggcgcgaggcccgaggagcuagaccuuga

SEQ ID NO: 60257 - RNA, 2559 nt, Artificial Sequence
  derived and/or modified sequence opt3 from OTUD7B__Homo_sapiens__XP_011508087
augacccuggacauggaugccgugcucagcgacuucgucagauccacaggcgcugagcccgggcuugcaagggaucuguuggaaggaaagaacugggacguuaaugccgcguuaucugauuuugagcagcugcggcaagugcacgcugguaaccuaccuccaucauucagugaaggcagcgggggaucccgcacuccggagaaaggcuuuucugaccgagaacccacgcguccuccaagacccauccuccagaggcaggaugacauuguacaggagaagcggcugucgcgcgguauaucacaugccagcaguuccaucgugucucuugcaagaagccacgucuccucaaaugggggaggcggcgggaguaacgagcauccucuggaaaugccaauuugcgccuuccaauugcccgaucucaccguguacaaugaggacuuuaggagcuucaucgaacgggaucugauugagcagucuaugcugguugcucucgagcaggcaggacgcuuaaacugguggguguccgucgacccuacaucacagcgacugcuuccauuggccacuaccggugauggcaauugucugcuacacgcugccagccucgggauguggggauuucaugacagagaccugaugcuuaggaaagcgcuguaugcauugauggaaaagggcguggagaaagaagcccucaagcggcguuggcgcuggcaacagacacagcagaacaaggagaguggucugguauacaccgaagaugaguggcaaaaagaguggaaugaauuaaucaagcuggcuucuuccgagccgagaaugcaccucgggacuaacggagccaauugcggcggcguugaaagcucggaggaacccguguaugagucucuugaggaguuccacgucuuugugcuggcacauguguugaggcggccuauagucguuguggcugacacaaugcuacgagauuccgggggagaggccuucgcgccaauccccuuugguggcauuuaccugccucucgaaguaccagccucacagugucaccgcaguccccuggugcuugcauaugaccaggcucauuucagcgcccuggucuccauggagcaaaaagaaaacaccaaggagcaggcugugaucccguugacggauucugaguacaaacuccugccuuuacacuuugccguugaccccgggaagggaugggaauggggcaaggaugacagcgauaaugugagacuggcaucagucauucuaagucucgaggugaaacugcaccuuuugcauuccuauaugaacguaaaguggaucccacugagcucugacgcccagguuaaaacuucaccuaccaguacacucgcuccccuggcgcagccagaaagccccacugcauccgccggugaugagccuaggucuaccccagagucgggggacagcgacaaggaauccgugggcucaaguucuacaagcaaugagggaggccggcgcaaagaaaaguccaaaagagauagggagaaggacaagaaacgugcugauucagucgccaacaagcucgggagcuucggaaaaacccuggguucuaaguugaaaaagaacaugggcgggcucaugcacuccaagggaaguaaaccgggcgguguggggacgggccugggaggcagcucugggacugaaacauuagagaagaaaaagaaaaauucccugaagucauggaagggagguaaagaggaagcagccggcgacgggcccgucagugagaagccuccagcugaaagcgugggaaacggcgguucgaaauacucccaagagguuaugcagucucuaagcauacuccggaccgccaugcagggggaaggcaaguucauuuuugugggaacucugaaaaugggccaucgacaccaguaccaagaggagaugauccagagauaucuuucagaugcagaagagagguucuuggcggaacagaagcagaaggaggcugaacgcaaaauuaugaaugggggaaucggcggugggcccccuccagccaagaaacccgagccggacgcacgggaggaacaaccuacaggaccacccgccgagaguagagcuauggccuuuuccaccggcuacccuggugauuucacgauccccaggccaucuggcgggggaguacauugccaggaaccucgccgacagcuggcaggcgggcccugugucggaggccucccaccguaugcuaccuuuccucggcagugucccccaggucgucccuacccucaccaagacagcauuccaucccuggagcccgggucacacagcaaggauggauuacauagaggcgcccugcuuccuccgccauauaggguggcggacaguuacucuaacgguuaucgcgagcccccugaaccagauggcugggccgggggauugcggggccuucccccuacacagacuaaaugcaagcagccgaauugcuccuucuacgggcaccccgagaccaacaauuuuuguagcugcuguuacagagaagaacugaggcgacgcgaacgggagccagacggagagcuacugguucauagauucuga

SEQ ID NO: 60258 - RNA, 1059 nt, Artificial Sequence
  derived and/or modified sequence opt3 from OTULIN__Homo_sapiens__NP_612357
augagcagaggcaccaugccccagccugaggccuggccaggggcuuccugcgcagaaacaccggccagggaggcggcugccacugcacgggacggagguaaggccgcugcaucuggccaaccccgcccugaaaugcaguguccagccgagcacgaagaggauauguaccgagcugccgacgagaucgaaaaagagaaggaacugcucauucaugagcguggggcgucagagcccagacuuaguguggcaccugaaauggauauaauggacuauugcaaaaaggaguggaggggaaacacgcagaaagccaccuguaugaagaugggcuacgaagaggucagccagaaguucacauccauccggcgcguuagaggugauaauuauugcgcucugagggccacuuuguuucaagcaaugucucaggcugugggguuaccacccuggcugcaggacccugaacuaaugcuccugccagagaaacuuauuucgaaguacaacuggaucaaacaguggaagcugggauugaaauucgauggcaagaaugaggaccucguagauaagauuaaagaaucacugacccugcuccggaagaaaugggccggcuuagcggagaugcgcacagccgaagcacgacaaaucgcuugugacgagcuguuuaccaacgaagccgaggaguauagccuuuacgaagcugugaaguucuugaugcugaauagagccauagagcuauauaacgauaaagaaaaggggaaagaggucccguuuuucagugugcuccuguuugcaagggacacuuccaaugaucccggacagcuucugcggaaccacuugaaucagguuggucauacaggcgggcucgaacagguggagauguuccuguuagccuacgcuguccgucacaccauccaaguguaccgccugucuaaguauaacacggaggaauuuauuacuguauacccuaccgacccacccaaggacuggccuguugugacacucaucgcggaggaugacagacauuauaauauuccagucagggugugcgaagagacuagccuuuga

SEQ ID NO: 60259 - RNA, 1065 nt, Artificial Sequence
  derived and/or modified sequence opt3 from OTX1__Homo_sapiens__NP_055377
augaugagcuaccugaagcagcccccuuauggcaugaacgggcucggacuugccgguccagcuauggaccuguugcacccguccgugggcuaccccgcaaccccuagaaaacaaaggcgggagcgcacaacuuucacgcgaucucaguuagauguccuggaagcccuauuugcgaagacccguuauccagacaucuucaugagagaggaaguugcucucaaaauuaaucugcccgagucaagggugcagguaugguuuaagaaccggcgcgccaaaugcagacagcaacagcagagugggagcggaacaaaguccaggccugcaaagaaaaagucuucgccagugcgggaaucaagcggcagugaguccucuggucaguucacucccccugccgucagcuccucagcuaguucuagcuccucagcaagcaguucuuccgccaauccagcugccgcggcagccgcugggcuuggaggcaacccgguggccgcagcuagcucgcugucuacccccgccgcguccucaauauggaguccugccagcaucuccccaggcucugcacccgcuagcguuucagugccugagccauuggccgcucccaguaauacauccuguaugcaacgcagcgucgccgcaggggccgcuaccgcggcagccucuuacccgaugucauauggacaggguggcaguuacgggcagggauauccuacucccagcuccucuuacuuuggcgguguggauugcucgagcuaccucgcuccaaugcauucccaccaucacccucaucagcugucacccauggccccaaguucuauggcagggcaccaccaucaccauccccacgcccaccauccucugagccaauccucaggacaccaucaccaucaccaccaucaccaucaccagggcuauggcgggagcggacucgcuuucaacucugccgacuguuuagauuacaaagaaccaggugcagcggcugccuccagugcauggaagcugaauuuuaacagcccggacugccuugauuauaaagaccaggccucuuggcgauuccaaguauuguga

SEQ ID NO: 60260 - RNA, 870 nt, Artificial Sequence
  derived and/or modified sequence opt3 from OTX2__Homo_sapiens__NP_001257453
augaugagcuaccugaagcagcccccuuaugccgugaacggccucucccuuaccacaucugggauggaccuguugcacccaucagucggauacccggcuacucccagaaaacaaaggcgggagcgcacgaccuucacacgagcacaguuagauguucuggaagcccuauuugcgaagacucguuauccugacaucuucaugagagaggaaguggcucucaaaauuaaucugccagagaguaggguacaggugugguuuaagaaccggcgcgccaaaugcagacagcaacagcagcagcaacagaaugguggccagaacaaggucaggcccgcaaagaaaaagaccagcccugcccgggaaguguccucugagucggggacaucaggacaguucaccccacccagcaguacuuccguuccuacaauagcuucuagcuccgcaccagugucaaucuggaguccggccagcauuucuccccuuuccgauccucugucaaccagcaguucuuguaugcaacgcuccuacccaaugacguauacucaggcuagcggcuacucgcaggguuaugccgggucuaccuccuacuuuggaggcauggacugcggcucauacuugacacccaugcaucaccaacucccugggccaggagcgacucugagucccauggguaccaaugcagucacaagccaucugaaccaguccccggccucucucagcacccagggcuauggggcuucaaguuuaggauucaauuccacgacugauugucuggacuacaaagaucagacagccagcuggaaacuuaacuuuaaugcagacugcuuggauuauaaggaccaaaccucuucauggaaguuccaggugcuguga

SEQ ID NO: 60261 - RNA, 684 nt, Artificial Sequence
  derived and/or modified sequence opt3 from OVCA2__Homo_sapiens__NP_543012
auggccgcucagagaccccugagggugcucugccuugcaggcuuccggcaaagcgagcgcggguuucgagaaaagaccggagcccugcguaaagcguugagagguagggcugaguuagucugucuguccggcccucacccaguuccggaucccccugggccagaaggagcccggucugacuucggcucaugucccccugaggaacagccacgcgguuggugguuuagugagcaggaggcagacguguucagcgcccuagaggaacccgcuguaugcagagggcucgaagagucccugggaaugguggcacaggcccuuaacaggcugggcccuuuugauggcuugcucggguucucucaaggagcugcccuggcggcacuggucugcgcccucggucaggcuggcgacccacgguuuccguuaccccgcuucauccugcuugugucgggguuuuguccucgaggaauuggcuucaaggagucaauauugcagagaccacugagccuacccagucuccauguuuuuggugauacagacaaagugaucccuucccaggaaucuguccaacuggccagccaguucccaggggcaauuacucuuacgcacuccggaggccauuuuauccccgcugccgcgccgcagaggcaggccuaccugaaguucuuggaucaauucgcagaguga

SEQ ID NO: 60262 - RNA, 804 nt, Artificial Sequence
  derived and/or modified sequence opt3 from OVOL1__Homo_sapiens__NP_004552
augcccagagccuuccuggugaagaaaccuugcgucagcaccuguaagaggaacugguccgagcucccagacgaggaacggggcgaaaucuacguuccggugucucuuggguuuugucccccucagccauaucgcgagcccgaaccuucaguagcugagccacccaguugcccucuggcauugaauaugagcuuacgagauuccucuuacucgauggccccaggaccgugcguggucgcgcaacugcccucagaggacaugggucaccuaacagauccucagagccgugaccauggcuuccucagaacuaaaaugaaggugacgcugggggauaguccauccggagaccuuuuuaccuguaggguuugccagaaggcuuucacauaucagcggaugcugaaccgccacaugaaaugucauaaugaugugaagagacacuugugcacuuacuguggcaaagguuuuaacgacaccuucgaucucaagaggcauguccggacacacaccggggugcgccccuauaaaugcucucugugugacaaggccuuuacucaacgaugcagccuggaaucccaccucaaaaagauucauggaguacagcagaaguacgcauauaaagagagaagggccaaguuauacguuugcgaagaguguggcugcacaucagagagucaggaaggccacgugcugcaucuuaaagagcaccacccugauagcccauugcugcggaagaccucuaaaaaggucgcuguggcacuacaaaauacggugacuucccuccugcaggggucaccccaucuuuga

SEQ ID NO: 60263 - RNA, 828 nt, Artificial Sequence
  derived and/or modified sequence opt3 from OVOL2__Homo_sapiens__NP_067043
augcccaagguguuccuggucaaaagaaggagccucggcguuuccgugcggucuugggacgagcuuccugaugaaaagcgcgccgacaccuacaucccaguagggcugggacgauuguuacacgauccgcccgaggacugccguucagaugguggcaguagcuccgggucuggaucgucaagcgcuggcgaaccugguggggcagagaguuccucuagcccacaugcccccgaauccgagacaccugagccaggagacgcggaaggccccgauggccaccuggcuacuaaacagagaccuguggccaggucaaagauuaaauuuacgaccgggacauguagugacagcgucgugcauucuugcgaucuauguggaaaggguuuccggcuccaacgcaugcugaacagacaccuuaagugccauaaucagguuaaaaggcaccuguguacuuuuugcggcaagggguucaacgacaccuuugauuugaaacggcacgugcgcacacauaccggaauacgaccauauaaguguaaugucugcaacaaagcauucacucagagauguucccucgagucacaccugaagaagauccauggcgugcagcaacaguacgccuauaaacagaggcgggacaagcuguacguaugcgaagauugugguuauacagggccgacccaggaggaccucuacuuacacguuaauagcgcucaccccggaaguucuuuucugaaaaagacguccaaaaaguuggcagcccuucugcaaggcaaacuaacuagcgcucaucaggagaacaccucgcucucugaagaggaggaacguaaguga

SEQ ID NO: 60264 - RNA, 1488 nt, Artificial Sequence
  derived and/or modified sequence opt3 from OXA1L__Homo_sapiens__NP_005006
auggugaccuggcuguacagauuccuccccacaagcaacauggccgcuaaacuuaggucccuguugccuccagacuuacggcugcaguuuuggcuacacgcacgccuccaaaagugcuuccugucucgaggcugugggucauauugcgccggagcgaaggcuaguccgcuucccgguaaaauggccaugggccugaugugugggcguagagaguugcucaggcugcugcagagcggacggcgcguccauuccguugcaggcccuucucaguggcucgguaagccauuaacuacgagacugcuuuuucccgccgcuccuugcuguugcaggccacacuacuuguuccuggcagccucggggccccggucacuaagcaccagugcuaucuccuuugccgaagugcagguacaagcgccuccaguggucgcagccacaccgucucccacugcugugccugagguugccagcggagaaaccgcagaugugguccagacagcugccgagcaguccuucgcggaacucggccugggcucauauaccccaguggggcuuauucagaaucuguuggaguuuaugcauguagaccucggacugcccugguggggugccauagcagcuuguacuguuuucgcccgcugcuuaaucuuuccucugauugugacaggccaacgagaggcugccagaauccacaaccaucucccagaaauucagaaauucaguagcaggauccgggaggcaaaacuugccggggaucacauagaauacuauaaggcuucuuccgagauggcgcuguaccagaagaagcacggaaucaaauuguauaagccccuaauucugccggucacccaggcaccuaucuuuauuucauucuuuaucgcccuccgugagauggcuaaucugcccgugccaagccuucaaacgggcggucuguggugguuccaggacuugacugugagugauccuauauacauucucccccuggccgucaccgcaacaaugugggccguuuuagaacugggggcugagacuggagugcagucuuccgaccuacaauggaugcgcaacguaaucagaaugaugccacucauuacccugcccaucacaaugcauuucccuaccgccguguuuauguacuggcuuagcucgaauuuguucucucugguccagguguccugucucaggaucccagcaguucggacggugcugaaaauuccgcagcgagucgugcacgaucuugacaagcugcccccucgcgaaggcuuuuuggagucauucaagaaaggcuggaagaacgcggaaaugacuagacagcucagggagcgggagcaacgcaugagaaaucagcuggaauuagcugccagggggccacugcgucagacauuuacccauaacccccuacuccagccuggaaaagauaauccacccaacauaccgaguagcuccucuaagccuaaaagcaaguauccauggcacgacacucuggguuga

SEQ ID NO: 60265 - RNA, 1563 nt, Artificial Sequence
  derived and/or modified sequence opt3 from OXCT1__Homo_sapiens__NP_000427
auggccgcucugaagcuccuuagcuccggccugagauugugcgcaucugccagggggucaggagcgaccugguacaaagguugugugugcaguuucagcacauccgcucaccggcauacuaaguuuuauacggaccccgucgaggccguuaaagauaucccugacggcgcaaccguguuaguagggggauucggccugugugguauuccagaaaaccuaauagaugcccuccugaagacaggggugaaaggacuuacugcugucucuaauaacgcaggcguggacaauuuuggccugggguugcuccugcgcucgaagcagaucaagcgaaugguuucaagcuacgugggagagaacgccgaguucgaacgucaauaucugaguggugaacucgaggucgaguuaaccccgcagggcacacuggcugaaagaauuagggccgggggagcgggcgugcccgcauuuuacaccccuacugguuaugggacacuuguacaggagggaggcuccccaaucaaauacaauaaggauggcucuguugccauugcuagcaaaccccgggaagugcgcgaguucaacgggcagcacuuuaucuuggaggaagccauaaccggagacuucgcacuggucaaggcuuggaaagccgauagagcggguaaugugaucuuuaggaaguccgcccggaacuucaaucuaccuaugugcaaggcagcugagacgacuguggucgaaguugaggaaauuguggacaucggcgccuuugcuccagaggauauucauaucccccaaauauauguacaccgccucauuaaaggggagaaguacgaaaaacgaaucgagagacugucaauuaggaaggaaggagacggcgaggccaaaagugcaaagccuggugaugacgugcgggaacguaucaucaaacgcgccgcucuugaguucgaggaugggauguacgcgaaccugggcauuggaauaccauugcucgcaagcaauuuuaucucuccgaacauuaccguccaucugcaguccgaaaauggcguguuagggcugggacccuauccuagacagcacgaggccgacgcugaccucaucaacgccgguaaggaaacaguuacuauacuuccaggcgcaucauucuucagcagugaugagucuuuugccaugauuaggggagggcacguggaccugaccauguugggcgcuaugcaggucuccaaguacggugaucuagccaauuggaugauccccgggaaaauggugaagggcaugggaggcgcaauggaccugguaagcucggcgaaaacaaagguuguggucaccauggaacauucugcuaaagggaacgcccacaagaucauggagaaguguacgcucccucugacuggaaaacaaugcgugaaccggauuaucacagagaaggcagucuucgauguggacaaaaagaaaggucuuacccugauugaauugugggagggccucacuguugaugacgugcagaaguccacagggugugauuuugccguaucaccaaagcugaugcccaugcagcagauagcuaauuga

SEQ ID NO: 60266 - RNA, 1272 nt, Artificial Sequence
  derived and/or modified sequence opt3 from OXER1__Homo_sapiens__NP_683765
augcugugccacagaggcgggcagcucaucgugcccauuauaccucuuuguccagagcauagcugcaggggacggcgccugcaaaacuuguuauccgguccguggcccaagcagccuauggaacugcacaaucuaucuucaccaagucccagccucuccucuucgguccugccuccaucauucagccccaguccuuccucugccccaagcgcuuuuaccacaguuggcggguccucaggaggcccgugucaucccacgaguagcucucuuguguccgcauuccuggccccuaucuuggcgcucgaguuuguacugggucugguggggaacucacucgcuuuauucaucuuuugcauucacacucgaccauggaccagcaauacagucuuccuggugagucuuguugccgcagacuuuuugcugauuucuaaccuaccccuccguguggauuacuaucugcuucaugaaacuuggagauucggagccgcugcauguaaagucaaucuguuuauguuguccaccaacaggacagccagcgugguauuccucaccgcuaucgcccugaaucgguacuuaaagguugugcagccucaccacguccugucgcgcgcgucugugggcgcagccgcuagaguggccggcgggcucugggucggaauacuucuguugaacggucaucuacugcucuccacuuuuucaggcccaaguugccugagcuauaggguugggacaaaacccuccgcaucucuucgguggcaccaggcucuguacuugcucgaguucuuucugccguuagcccugauccuauucgcgauugugagcaucggacucaccauucgcaaucgaggccugggugggcaagccggaccucagagagcaaugaggguacuugcuaugguggucgccguguauacgaucuguuucuugcccucaauaauuuuuggcauggcuaguaugguugccuucuggcuguccgcaugccggagccucgaccuguguacucagcuuuuucauggcucucuggccuucaccuacuugaacucagugcucgauccaguccuguauugcuuuaguagcccuaauuucuuacaccagucccgugcucugcuagggcucacacgcggaagacaaggucccgugucugacgaaucgagcuaccagccauccaggcaguggcgguaccgagaggcgucacgcaaggcagaggccaucggcaaacugaagguacagggggaaguuagucuugagaaggaaggaucuagccaaggcuga

SEQ ID NO: 60267 - RNA, 1014 nt, Artificial Sequence
  derived and/or modified sequence opt3 from OXGR1__Homo_sapiens__XP_005254103
augaacgagccccuggacuaccucgccaaugcuagcgauuucccugacuaugcagccgcguuuggcaacugcaccgaugaaaauaucccacuuaagaugcacuaccugccggugauuuaugggauaaucuucuuggucggauuucccgguaacgcuguugugauuuccacauacaucuucaaaaugagaccuuggaagucuucaacuauuaucauguuaaaucuggccuguacggaccuacucuaucugaccagucuuccauuucugauacauuacuaugcaagcggcgagaacuggaucuucggggauuuuaugugcaaauucauuagguuuuccuuccacuuuaauuuguacucuucgauccucuuccugacauguuuuucaauuuuccgguacugcguaaucauacaucccaugagcuguuucaguauucacaagacucgcugcgccguggucgcuugugcagugguuuggaucauuucccugguggccgucaucccuaugaccuuucucaucacaucuaccaaccgaacuaaucguagcgcuugcuuagaccugacauccucagaugaacuuaacaccauuaaaugguauaauuugauacugacggccacuaccuucugucuaccacucgugaucguaacacugugcuacacuaccauuauccauacacuuacccacggacugcagacggacaguuguuugaagcaaaaggcgagaaggcucacuauacuguuacugcucgcauuuuauguuugcuuccuucccuuucacauucugcgggugauccgcaucgagagcagauugcuaucuauuuccugcucaaucgaaaaccagauucaugaggccuacauagucagcaggccucuggcugcccucaauacauucggcaaccugcuucuguaugugguggucagugauaauuuucagcaggcaguuuguucuaccgugcggugcaaaguauccgguaacuuggagcaagcuaagaaaaucagcuacucgaacaauccauga

SEQ ID NO: 60268 - RNA, 2625 nt, Artificial Sequence
  derived and/or modified sequence opt3 from OXR1__Homo_sapiens__NP_001185461
augaccaaggacaaaaacagccccggccugaagaaaaagucccagucuguggauaucaaugccccuggguucaacccacucgcuggagcagguaaacaaacaccgcaggccucaaagcccccugcgccaaagacucccauuauagaggaggaacagaauaacgcugccaauacgcagaaacacccuaguagaaggagcgaacuuaagcgguuuuacaccaucgacacaggccagaaaaagacucuggauaaaaaggacgggcgccgaauguccuuccagaagccaaaaggaaccauugaguauacagucgaaucucgugauucguugaacucaaucgcauuaaaguuugacaccacucccaaugagcugguucagcuaaacaaacucuucagcagagccgugguaacaggccaggugcuguacgucccugauccagaguaugugaguuccguugaaucuagcccgucccuuucacccgugaguccucugagcccaaccucuuccgaggcugaauuugacaagacgacuaaucccgauguccauccuaccgaggcaacaccaucaagcacuuucaccgguauuaggcccgcccgggugguaaguucuacauccgaggaagaggaggcuuuuaccgaaaaauucuugaagaucaacugcaaauacauaacgagcgggaagggaacuguuucgggcgugcuccuggucacaccgaauaacaucauguuugacccucacaagaaugauccccuggugcaagaaaacggcugugaggaguaugggauuaugugcccaauggaagaggugaugucugccgcgauguacaaagaaauccucgacuccaagauuaaagagucauuaccuaucgauauagaccagcugaguggacgcgacuucugucauagcaagaaaaugaccgguuccaauacugaagagauugauucuagaaucagggacgcaggcaacgauagcgccucaacagcuccccggaguaccgaggaaucccuuagcgaggacgucuuuacggaaucugaguugucaccaauucgcgaggaacugguuaguagcgaugagcuacgacaggacaaguccucuggggccucgagcgaauccgugcagaccguaaaccaagcagagguggaaucacucacagucaagagugagucuacuggaacccccggccaccugagaagcgauacagagcauuccacuaaugaaguggguacccuuugccacaaaacagaccugaacaauuuggagauggcuaucaaggaagaucagaucgccgacaacuuccaggggauuucaggaccuaaagaggauagcaccucuauaaagggcaauuccgaccaagacaguuuucuccacgaaaacagccugcaucaggaggagucucagaaagaaaauaugccauguggcgagacugcggaauuuaagcagaagcaauccguuaacaaagggaagcagggaaaagagcagaaucaggauucacaaacggaagccgaggaguuaaggaagcuguggaaaacacacaccaugcagcagacuaagcagcaacgggaaaacauccaacaggugagucagaaggaggcaaaacauaagauuaccagcgcugacggucacaucgaaucguccgcccuccuuaaagagaagcaacgucaccgccugcauaaauucuugugccuaagagucggcaagccgaugaggaaaacauuugugucucaggcuagcgccaccaugcagcaauaugcacagcgggauaagaagcacgaauacugguucgccguaccccaggagcgaacugaccaucuguacgcuuucuucauacaguggucaccugagauuuaugcggaagauacaggggaguacacgcgcgaaccaggauuuaucguugugaaaaagaucgaggagagugaaaccauugaggacuccucuaaucaagcagccgcuagagaaugggaggucgugagcgucgccgaauaucacaggcggaucgaugcacucaacacugaggagcugcgcacacuuuguagaaggcugcagauuaccacacgugaagacauaaauuccaaacagguggccacuguuaaggcugauuuggagucagagagcuuccggcccaaccucagugacccuucugaacuguuacugccagaucagaucgaaaaacuaaccaagcaucugcccccgcgaacgauuggcuacccuuggacccucguguaugguacagggaagcacggcacuucccuuaaaaccuuguacagaacaaugacuggacuggacaccccaguacucauggucaucaaggauagcgacggccaaguguuuggggcccuggcaucggagccccuuaaaguuucagacggauucuaugguacgggcgagacauuuguguucaccuuuugcccugaguucgaagucuuuaaguggacuggggauaauauguucuucaucaaaggagacauggauucucuggcguuuggcggugggggcggagaguucgcuuuguggcucgacggcgaucuguaccacgggaggagucauuccuguaagacauuuggaaaccgcaccuuaagcaagaaagaagacuucuuuauucaggauauagaaaucugggccuucgaguga

SEQ ID NO: 60269 - RNA, 1584 nt, Artificial Sequence
  derived and/or modified sequence opt3 from OXSR1__Homo_sapiens__NP_005100
augagcgaggacuccucugcccugcccuggucaaucaacagagaugacuacgaacuccaggaggugauuggcaguggggcuaccgcagucguucaagccgcguauugcgcuccuaagaaagaaaagguggccauaaaaaggaucaaucuugagaagugucagacaagcauggaugaacuguugaaagagauucaggcaaugucccagugccaccauccaaacaucguaucuuacuauacuucguucguggucaaggacgaguuauggcuggugaugaagcuacucucaggagguagcguucuggauauuaucaaacacauaguggccaagggcgaacauaaaagugggguccuugacgaguccacgaucgcuaccauucugcgggaaguguuggagggacucgaguaccugcacaagaauggccaaauccaucgcgauguaaaagcagguaacauucugcucggggaagacggaucuguucagaucgccgauuuuggcgugagcgcuuucuuagccacaggcggggacauaacucgaaauaagguccguaagaccuuugugggaacaccguguuggauggcgcccgaggugauggaacaggucagagguuaugauuucaaagcagacauuugguccuuuggcaucaccgccauugagcuggcuacuggggccgcaccuuaccacaaguauccacccaugaaaguucuuauguugacacugcagaacgauccuccaucacuagaaaccggagugcaagacaaggagaugcucaaaaaguacggcaaaaguuucaggaagaugaucagccugugccuucagaaggaccccgagaaacggccuacggcugccgaacuguugcgccacaaguuuuuccagaaagcgaagaauaaagaguuucuccaggaaaagacucugcaaagagccccaaccaucucugagagggcaaagaaaguacggcgcgugccggguuccucagggcgauuacauaagacagaagauggaggcugggaguggagcgacgaugaguucgacgaagagagugaagagggcaaagcugccauuucucagcugagaucccccagggucaaggaaagcauaucgaacucugagcucuuuccuacuaccgauccaguggggacacuucugcagguucccgagcaaaucuccgcucacuugccucagccagccggacagauugcaacccagcccacgcaagugucacuaccgccuacugccgaacccgcuaaaacagcgcaggcacugaguagcgguuccggcucucaggagaccaagaucccaauaagccucguccugcggcuucguaauucaaagaaagaacugaacgacauucgcuucgaguuuacuccugggagagauacagccgagggagugagucaggaauugaucuccgcuggccucguagacgguagggaucugguuaucguggccgcaaauuuacaaaagauugucgaggaaccccagagcaaccggucugugaccuucaaacuggccucaggggucgagggcagugacaucccagaugacggaaagcuaauuggcuucgcucagcucagcauauccuga

SEQ ID NO: 60270 - RNA, 378 nt, Artificial Sequence
  derived and/or modified sequence opt3 from OXT__Homo_sapiens__XP_011527540
auggccggccccagccuggcuugcugucuccuugggcuguuggcauuaaccuccgccugcuacauccagaacuguccucugggagguaaaagagcggcuccagaccuagaugugaggaaaugccucccguguggccccgggggaaagggccggugcuucgguccuaauauuuguugcgccgaggaacugggguguuuugucggaacagcagaggcccuucgcugccaagaagagaacuaucugccaucucccugucagucaggccagaaggcuugcggcagugggggacgaugcgcaguuuugggucucuguugcagcccugacggcugucacgccgauccagcuugcgacgccgaagcgacuuucucccagcguuga

SEQ ID NO: 60271 - RNA, 1170 nt, Artificial Sequence
  derived and/or modified sequence opt3 from OXTR__Homo_sapiens__NP_000907
auggagggcgcccuggcugcaaacuggagcgccgaagcggcuaaugccuccgcagcucccccuggggcugagggaaacagaaccgcagguccaccgaggcggaaugaagcccucgcucgcguggaggucgccguucuuugccugaucuuguuacuggcgcuaucuggcaacgcaugugugcuccuggcccuucgaacaacucgucagaagcacucaagacuguucuuuuucaugaaacauuugaguauugcugaccucguaguggccgucuuucaagugcugccccagcugcucugggauauaacguucagguuuuacgggccugacuuacugugccggcuuguuaaguaucuucagguggucggaauguucgcaagcaccuaccugcuacuccugaugucccuugaucgcugucuggcuaucugccagccauugagaucucucaggcggcgcacagaccgacuggccguguuagcgacuuggcugggcugucucguagccucggcaccccaaguucacaucuuuucacuuagagaaguggcugauggugucuucgacugcugggccguguuuauucagccuugggggccaaaggcuuauauuaccuggaucacacuggccguguacauaguccccguuaucguguuggcagccuguuauggacuaauuagcuucaaaaucuggcagaaucugaggcucaaaaccgcugcggcagccgcugccgaggcaccugagggcgccgcugccggcgaugggggacggguagcacuggcgcgugugaguuccgucaaguugauuucuaaggcuaaaauccgcacugugaagaugacauuuauaauuguucuggccuucaucgugugcuggaccccauuuuucuucguccagauguggagcgugugggacgcaaacgccccgaaagaagccuccgccuuuauuaucguaauguugcucgcaucacugaauaguuguugcaaccccuggaucuacauguuauucacgggucaucuguuucacgagcuaguucaaagauuccucuguugcagcgcuucuuaucugaagggcaggcggcuuggggaaacuuccgccagcaaaaagucaaauaguucuuccuuuguguugagccaucgaucgucuucccagcgcucaugcagucagccuagcaccgcguga

SEQ ID NO: 60272 - RNA, 1200 nt, Artificial Sequence
  derived and/or modified sequence opt3 from P2RX1__Homo_sapiens__NP_002549
auggccagaagguuccaggaggaacuggcugcauuucucuucgaguacgacacaccccggauggugcuuguccgcaacaagaaaguuggcgugaucuuucgacugauucaauugguaguguuagucuaugugauaggguggguuuuccuguacgaaaagggauaucagaccagcuccggucuaaucucuucagugagugucaaacucaagggccuggccgugacucagcuuccugggcugggaccacagguaugggauguugcggacuacguguuuccggcucaaggcgauaauagcuucgucgugaugacgaacuuuauugugacccccaaacagacacaggguuauugcgccgagcacccugaagggggaaucuguaaggaggacuccggcugcacuccaggcaaggcaaaacguaaggcccaggggauuagaaccggaaaaugugucgcuuucaaugauacaguuaagaccugcgagaucuuugguuggugucccguggaaguagacgaugacauaccuaggccagcauugcuccgggaggccgaaaacuucacucuguuuaucaaaaauucuauuucguucccccgcuuuaaggugaacagaaggaaucuggucgaggaggugaacgcugcccauaugaagacaugccucuuccacaaaaccuuacauccucuguguccaguuuuccaacuuggcuacgugguccaggaaucagggcagaauuuuagcacguuggcggagaagggaggcgugguagguaucacuauugauuggcacugcgaccuggauuggcauguucggcacugucgcccgaucuaugaguuccacgggcuauacgaagagaaaaaccucagucccggauuuaauuuccgauuugcaagacauuucguggaaaacggcaccaauuacaggcaccuguuuaaggucuucggcauacgguuugacauucuuguggaugggaaagccggaaaguucgacaucauuccuacaaugacuaccaucgguuccggcaucgggauuuuuggagucgcuacagugcugugcgacuugcuccuguuacauauacugccaaaacgucacuauuacaagcagaagaaauucaaguaugccgaggauaugggccccggugcagcugaacgcgaccucgccgcgaccucuagcacgcuugggcugcaagagaacaugagaacuuccuga

SEQ ID NO: 60273 - RNA, 1113 nt, Artificial Sequence
  derived and/or modified sequence opt3 from P2RX2__Homo_sapiens__NP_001269093
auggccgcugcacagcccaaguacccugccggcgcgaccgcuagaaggcuggcccgggggugcuggagcgcacucugggacuaugagacaccaaaagugaucgucguucgcaaccgacgucuuggagugcuguacagagccguacaauuguuaauucugcuauauuucgugugguacgucuuuauagugcagaaguccuaucaggaaucugagacugguccggaaucaaguaucauuacgaaaguuaagggcaucaccacaagcgagcacaaagugugggaugucgaagaguacgugaagcccccugaguccauuaggguacauaaugcuacuugucucucugacgcagauugcguugccggggaacuggacaugcuuggaaacggcgcucugcaggauuugcggggugugcgccucgucccagggggaagauggggccugugucaacccaucucgggcuaugacgggccuaaguuccaccauccacaccaggagcagcauccccugccucagauaccacucuuacaaggacagcacaggcggccgcaccgccgagugcccgaagcccugcaugugccuagaggucuuaggccauugcugccccaccuacaggcgggccucuaccguggggagggauggggcgagcugcaucgggcacgcacccaggguagagggggagucaucggcguuauuaucaauugggauugcgaccuugaucugccugccucagaauguaacccaaaauacagcuuuaggcgguuggaccccaagcacgugccggcuaguuccggcuauaauuuccgauuugccaaauacuauaagauuaacgggacaaccacucgcacacucaucaaagcauacggaauaagaauugauguaaucgugcacggucaagcuggcaaguucucucugauuccuaccaucaucaauuuagccacggcgcugacuagcgucggggugggauccuuucucugcgacuggauucuucugaccuucaugaacaagaauaaaguuuauucacauaagaaauuugauaagaugguggacacacccgccagugagccagcacaggcuagcacuccuaccgaccccaaaggcuuggcccagcuauga

SEQ ID NO: 60274 - RNA, 1194 nt, Artificial Sequence
  derived and/or modified sequence opt3 from P2RX3__Homo_sapiens__XP_011543372
augaacugcaucagcgacuucuuuaccuacgagacaacuaaguccguggucguuaaaucuuggacgauuggcauaaucaauagagugguacagcugcucauuaucucauauuucguggggugggucuuucuucacgaaaaggccuaccaagugagggauaccgcuauugagaguagcguugugacaaaagucaagggauccggucuguaugcaaaccgggugauggacguaucugauuacguuacucccccucagggcaccucgguguucgucaucauaacaaaaaugaucgugaccgaaaaucagaugcagggguuuuguccagagucagaagagaaguaucgcugcgugagcgacagucaauguggaccggagcgauugcccggcggugggauuuuaacuggacguugcgucaacuacuccucuguucugagaacaugugaaauccagggcuggugcccuaccgagguggauacgguagaaacuccaauuaugauggaggccgagaauuucaccaucuuuauaaagaacagcauuagguucccccuauuuaauuucgaaaaaggcaaccuccugccuaaucuuacagcgcgggacaugaagacuugucgcuuucauccagauaaagaccccuucugcccuauccugagagugggggaugucgugaaguuugcuggacaggacuucgccaaauuggcaaggaccgguggcguucucgggauuaagaucggaugggugugugaucuggacaaggccugggaucagugcaucccaaaauauuccuucacacggcuggacucagucagugaaaagagcucuguguccccgggcuacaacuuucgcuucgcuaaauacuauaagauggagaaugguucagaguaccgaacccucuuaaaagcauuugggauuagauucgacguacugguuuauggaaacgccggcaaguuuaauauaauccccacgauuaucagcaguguggcugccuucacuucugucggcguggggacaguccuuugugauauaauuuugcugaacuuucuaaaaggagcggaccaauacaaggcaaagaaauucgaagaggugaaugagaccacucucaagaucgccgcucugacaaacccuguuuauccauccgaucagaccacggccgaaaaacagagcaccgacucgggugcauuuucuaucggccacuga

SEQ ID NO: 60275 - RNA, 1215 nt, Artificial Sequence
  derived and/or modified sequence opt3 from P2RX4__Homo_sapiens__NP_001243725
auggccggcugcugugcugcacuggccgcguuccucuuugaguacgacacccccagaaucgugcuuauuaggagccggaaggucgggcugaugaaccgcgcuguucaguuguuaauacuggccuaugugaucggaugcuaccacccucaucuagcagaaguagagauggaauccccacgacguuggguguucgucugggagaaagguuaucaagaaacagauucugugguuucaagugugacuacgaaggucaaaggcguggccguaaccaauacaagcaagcucggguuuagaauuugggacguugcugauuacgugaucccggcacaggaggagaacucccuguucgucaugacuaaugugauucuuaccaugaaccagacacagggacugugucccgaaaucccugacgccaccacugugugcaaaucugaugcuucguguacagccggcucagcggguacccacagcaauggggucaguacgggaaggugcguugcauuuaacggcuccgugaagacuugugagguagccgcuuggugcccaguggaagacgauacccaugucccccaaccugccuucuugaaggcagcugagaauuuuacacuccuggugaaaaacaauauaugguauccaaaguucaacuuuucuaaacggaauauccugcccaacauuacuaccacauaccucaagagcuguaucuaugacgccaaaaccgauccuuucugcccaauuuuucgcuuaggcaagaucguugagaaugcggggcacuccuuccaggacauggccguggaaggagguauaaugggcauucaggucaacugggauuguaaucuggacagagcagcuucacuuugcuugccgagguacaguuuucggcgccuggauacgcgagacguggagcauaacguaagccccggguacaacuucagauucgccaaguauuacagggaccuagcuggaaaugaacagcggacucucaucaaagccuauggcauucguuuugauaucaucguuuucgguaaggcagggaaauuugacauuauaccuacaaugaucaacauuggaucuggccuggcccuucugggcauggcuaccguguugugcgauaucauaguccucuacuguaugaagaaacgccuguauuacagagagaagaaauauaaguacguggaagacuacgagcaaggguuagcguccgagcuggaucaguga

SEQ ID NO: 60276 - RNA, 1266 nt, Artificial Sequence
  derived and/or modified sequence opt3 from P2RX5__Homo_sapiens__NP_001191448
augggccaggccgggugcaagggacugugucucagccuuuucgacuacaaaaccgagaaguaugugaucgcuaaaaacaagaaagucggucuguuguacagauuacugcaagcauccauucuagccuaucucguuguguggguauuucugauaaagaagggcuaccaggauguggacacaucucuucagucagcggucaucacuaaagugaaggggguugcuuucacgaauaccagugaucugggacagaggauuugggacguggccgauuaugucauccccgcacaaggcgaaaacguguuuuucguaguuacaaauuugauugugacuccuaaccagcggcagaaugucugcgccgagaacgaagguaucccagacggggcuuguagcaaagauuccgacugccacgcaggagaggccgugaccgcuggcaauggcgugaagacagggcgcugucuccgacgugaaaaccuggccagaggaaccugcgagauauuugcgugguguccgcuggagacuucuucgaggcccgaagaaccuuuccucaaagaagcagaggauuuuacaaucuucauuaagaaucauauccgguuuccaaaguucaacuuuucaaauaacgucauggacguuaaagaucgcagcuucuuaaagaguugccacuuuggucccaaaaaucauuacuguccuauuuucagacugggcuccgugaucaggugggccgggucugacuuccaggauauagcucuugagggaggcguaauugguaucaacauugaauggaauugcgacuuggacaaggccgcaagcgagugucacccacauuauuccuuuucacggcuggauaacaaacuaaguaagagcgugucuuccggguacaacuuccgcuuugcucgauacuauagagacgccgcgggagucgaguucaggacccucaugaaagccuacggcauccgguuugaugugaugguuaauggcaagggggcauucuuuugcgaccuggugcuuaucuaucugauuaagaaacgugaguucuaccgcgauaagaaauaugaagaggucagaggauuggaggacucaagccaagaagcugaggaugaagccaguggucucggccugucugagcaguuaacguccgggcccggacugcucggcaugccugaacagcaggagcuucaagagccaccggaagcuaagagggguagcucgucucagaaagggaacggcuccgugugcccccagcuguuggagccucaccggucaacuuga

SEQ ID NO: 60277 - RNA, 1248 nt, Artificial Sequence
  derived and/or modified sequence opt3 from P2RX6__Homo_sapiens__NP_001153026
augugcccccagcuggccggcgcugggagcaugggauccccuggugcaaccacaggcugggggcuccuugacuacaagacugagaaaugggcccuguuggcgaagaaaggauaucaagaaagagauuuagagccacaguucucuaucauuacgaagcugaaaggcgugucagucacccagauaaaggaacuagguaacaggcucugggacguugcugauuuugugaagccgccccagggggagaauguauucuuucuggugacaaacuuccuugucacuccugcccaagugcagggacgguguccagaacaccccaguguuccucuggcaaauugcuggguggacgaggauuguccagagggcgaaggcgggacccauagccacggagucaaaacaggucagugcgugguauuuaacggcacccaucgcacuugugagaucugguccuggugccccguugaaucugggguggucccuucgcgaccauugcucgcccaggcucaaaauuucacacuguuuauuaagaacaccgugacguucucaaaauuuaauuucagcaagaguaacgcacuggagacuugggacccgaccuacuuuaaacacugucguuaugagccccaguucuccccuuacugcccaguguuuagaaucggagaucucgucgccaaggcuggcgguacauucgaagacuuagcccugcuugggggaucuguuggcauuagggugcauugggauugugacuuggauacuggcgacagcgggugcuggccccacuauuccuuccagcugcaggagaagucauacaauuuucggaccgcgacacacuggugggaacaaccuggaguagaggcacgcacccuacucaaacuguaugguaucagauucgauauacuugugacgggccaggccgggaaguuuggacugaucccaacugcugucacauugggcaccggugccgcauggcucggggugguuacuuucuuuugugaccuguuacugcucuacguggacagggaagcucauuucuacuggcggacaaaauaugaggaggccaaggcgcccaaagccaccgcaaacagugucuggcgcgaacuugcucuggccagccaggcucgauuggccgagugccuaagaaggucuuccgcaccggccccuacggcuaccgcggcaggcucacaaacacagacucccggauggccaugcccuagcagugauacccaucugcccacacacucuggcucccucuga

SEQ ID NO: 60278 - RNA, 1788 nt, Artificial Sequence
  derived and/or modified sequence opt3 from P2RX7__Homo_sapiens__NP_002553
augcccgccugcuguagcugcuccgacguguuccaguacgagaccaacaaggucacaagaauccaaucuaugaauuauggcacuauuaaaugguuuuuccacguuauaaucuuuucauacguguguuucgcucugguaagugauaagcucuaucagaggaaagaaccugugauuagcuccguccauacgaaggugaaagggaucgcagagguuaaggaagagauuguggaaaacggagucaagaaacuugugcacucuguauuugacaccgccgauuacacauucccacugcaggguaauucguuuuucguuaugacuaacuuuuugaagaccgagggccaggagcaacgguuaugcccggaauaucccacacgccgaacccuguguucaagcgaccgugggugcaaaaagggauggauggauccucagaguaaaggcauccagacugguagauguguggucuacgaggggaaucagaagacaugcgaaguguccgcgugguguccaauagaggcuguggaggaagcccccaggccugcacuacucaacucugccgagaauuucaccguccugaucaagaacaauauugacuuuccaggacauaacuauacgacucggaauauccuucccggccugaacauuaccugcacauuccacaaaacucaaaauccucaguguccaaucuuucgcuugggcgauauauucagagaaaccggggacaacuucagcgauguugcuauucagggagguaucaugggcauugagaucuacugggacugcaaucucgauaggugguuucaucacugccggccgaaguacuccuuccgccgacuggacgauaaaacaaccaacgugucacuguaucccggguacaacuuuagauaugcaaaguacuauaaagaaaauaacguagagaagaggacgcucaucaaaguguucggcauucgguuugacauauuagucuucggaacuggugggaaguuugacaucauucagcuggugguuuacaucggaaguacacuuagcuauuucggcuuggccgcuguguuuauagauuuccugauugacaccuacucuuccaauuguugccguucacacaucuacccuugguguaagugcugucaaccaugcgucgugaacgaguauuacuaucgcaaaaagugugaaagcaucguagagcccaaaccuacucuaaaguacguuaguuuuguggaugaaucucauauuagaauggucaaucagcagcuccugggcaggucccuucaagacgugaaagggcaggaggucccacggcccgccauggauuucacagaccugagccgauugccgcucgcgcugcacgauaccccucccaucccaggacagccugaagagauucaguuacugcgcaaggaggcaacgcccagaucgagggacucuccaguguggugccaaugugguuccugccuccccucacagcuuccugaaagucaucggugucuggaggaauugugcugccgcaagaaaccaggcgccuguauaaccacaagcgagcuauuuagaaagcugguucucuccaggcacgugcugcaguuccuucuguuguaucaggaaccgcuccuggcuuuagauguagacucuacuaacagccgucugcggcacugcgccuaccgauguuaugcaaccuggagauucgggucacaagauauggcugacuuugccauccuacccaguugcuguagguggcgcauucggaaagaguucccuaaguccgagggacaguacagcggcuuuaaaucuccauacuga

SEQ ID NO: 60279 - RNA, 1125 nt, Artificial Sequence
  derived and/or modified sequence opt3 from P2RY11__Homo_sapiens__NP_002557
auggccgcuaacgugagcggcgcaaaguccugccccgccaauuuccuggcggcugccgacgauaaacucucuggguuucagggagacuuccuuuggccuauccuggucguugaguuuuugguggcaguagccucaaacgguuuagcucuguacagauucaguauuaggaagcaacggccauggcacccggcaguggucuuuagcgugcagcuagccguuuccgaucuccugugugcucuuacccugcccccuuuggccgcguaucucuacccacccaaacauuggcgcuauggcgaagcagccugccgacuggagcguuuccuguuuacauguaaucucuuagggucugugauauucaucacuugcauuucgcugaacagauaccuuggaaucguccacccauuuuucgcuaggucacauuugcggccuaagcacgccugggcagugagcgcugccggcuggguacuggcggcccuacucgcaaugcccacgcugaguuuuucccaucuuaaacgcccucagcagggugcugggaauuguucuguugccagaccagaggcuugcauuaagugucugggaaccgccgaccacggcuuggcagccuauagggcuuacagccucgugcuggcgggcuuagggugcggacugccgcuccuucugacauuggcagccuauggugcucuaggccgggccguccugcgcucccccgggaugacuguggcagaaaagcuccgaguggccgcucuggucgccucaggaguugcacuuuacgcgaguagcuacgugccuuaucacaucaugagaguacugaacguggaugcuaggcggcguuggucuacccgcuguccauccuucgccgacauagcacaagccacagcugccuuggaacucggccccuacgucgguuaucaggugaugagagggcugaugccuuuagcauuuugcguucauccacugcuauacauggcugccgugcccucacucggauguugcugcaggcacuguccgggcuaucgggauagcuggaauccugaggacgcgaaaaguaccggccaggcccugccccuuaacgcuacugcagccccaaagccuucugagccccagucccgagaauugagccaauga

SEQ ID NO: 60280 - RNA, 1029 nt, Artificial Sequence
  derived and/or modified sequence opt3 from P2RY12__Homo_sapiens__NP_795345
augcaggccguggacaaccugaccagcgcucccggcaauacaucccucugcacuagagauuacaagaucacgcaaguccuuuucccucuguuguauaccguuuuauuuuucguggggcugauuacaaacggacuagcaaugagaauauuuuuccagauccggucuaaaucaaauuuuauuaucuuccucaagaacacuguaauuagugaccugcuuaugauccugaccuuuccauucaaaauauugagcgaugccaagcucgguacaggcccgcugcgcaccuuugugugucaggucacuuccgugaucuucuacuuuacaauguauauuucuaucucguuccuggggcucauuaccaucgaccgauaccagaaaacgacucgucccuuuaagaccucaaauccuaagaacuuacugggagcgaaaauacuuagcguugugauuugggcuuucauguucuugcugagucuaccaaauaugauccucacaaacagacaacccagggauaagaaugucaaaaagugcuccuuucugaaaucugaguucggccuuguguggcacgaaauuguaaacuauaucugucagguuaucuuuuggauuaauuuccugauagugaucgucugcuacacuuugauuaccaaggagcucuaucggagcuacgugcgcacaagagguguggggaaggucccuaggaaaaagguuaacgugaaaguauuuaucauaauugccguguucuuuaucuguuucgucccauuucauuucgcacggauccccuacacccugucccagacgcgcgacguguuugauugcacugccgaaaauacauuauucuauguuaaggagucaacccuguggcucacuagccuuaacgcuugucuggacccuuuuauuuacuucuucuugugcaaaaguuuucgaaauucucuaaucuccaugcugaaguguccaaacucagcaacaagccucagucaggauaacaggaaaaaggaacaagacggaggcgauccgaaugaggagacccccauguga

SEQ ID NO: 60281 - RNA, 1065 nt, Artificial Sequence
  derived and/or modified sequence opt3 from P2RY13__Homo_sapiens__NP_795713
augaccgccgcuaucagaaggcagcgggagcugagcauucuccccaaggugacacuugaagcaaugaacacuacggucaugcaaggcuucaaucgcuccgagcgaugcccucgugacaccagaauaguucagcugguguuuccagccuuguacacaguaguguucuuaacugggauccugcuaaacacccucgcgcugugggucuuugugcacauuccgucuucaaguacauucaucauuuaucuuaaaaauacccugguugcugauuugaucaugacucucaugcugcccuuuaagauacugagcgacucccaucucgccccuuggcaguuaagggcauucgugugucgguuuucuucggucaucuucuacgaaacaauguaugugggaauuguacugcuugguuugaucgccuuugaucgcuuccugaaaauuaucagaccacuaaggaacauauuucucaagaaacccguuuucgcuaagaccgugucaauuuuuaucugguucuuccuguuuuucauuagccuuccuaauacgauccugaguaacaaggaggcaacuccauccucugucaaaaagugcgccagcuugaaaggcccccucgggcugaaguggcaccagauggugaauaacaucugucaauuuauuuucuggaccguguuuauauuaaugcuggucuucuacguugugaucgcuaaaaagguauaugacuccuaccggaagucaaaaaguaaggaucgcaaaaauaacaagaaacucgaaggaaagguguuugucgugguugccguguucuuugucugcuucgcgccuuuucauuucgcacgagugccauauacacacagccagacuaauaacaaaaccgacuguagacuucagaaucagcuguuuauugccaaggagacaaccuuguuccuagcugccacgaacaucugcauggauccgcugauauacauuuuccucuguaagaaauuuacugagaagcugcccugcaugcaaggcaggaaaacaaccgcaucuucccaggaaaaucauucaagccagacugacaacaucacacuugguuga

SEQ ID NO: 60282 - RNA, 1017 nt, Artificial Sequence
  derived and/or modified sequence opt3 from P2RY14__Homo_sapiens__NP_055694
augaucaacagcaccuccacacagcccccugacgagucuugcucacaaaaucugcucauuacucagcagauaaucccagugcuuuauuguauggucuucauugccggcauccuguugaacgggguuaguggauggaucuuuuucuaugugccgagcuccaagucuuuuauuauauaccugaaaaauaucguaauugcugauuucgugaugucguuaacguuucccuucaagauccuaggugacucaggccucgggccuuggcagcugaacgucuuugugugcagaguuagcgcagugcuuuucuaugucaauauguacgugaguauuguauuuuucggacugaucuccuuugauagguauuacaaaauaguuaagccauuguggaccucuuucauucaaagcguguccuauucaaaacuccugagugucaucguguggaugcugaugcucuuacuggccgugcccaacauuauccuuacaaaucagagcguccgggaaguuacucagaucaaguguauugaguugaagucugaacugggccgcaaauggcacaaggcguccaacuacauauuuguggcuaucuucuggauuguauuccuacuccugaucguguuuuacaccgccauaaccaaaaagauuuucaaaucacaucuuaagagcagucgaaauucuacauccgucaagaaaaagagcucgcguaacaucuuuucuaucguguucguguuuuucguuugcuuugucccuuaucacauugcaagaaucccauacacuaaaucccagacagaggcccauuauucaugucaaaguaaggaaauucugagguacaugaaagaguucaccuugcuccugagcgcugcaaaugugugcuuagaccccauaaucuacuuuuuccugugucagccuuuucgggagauucucugcaagaaacuucacaucccacugaaggcccagaacgauuuggacaucucccgcauuaagagagguaauacgacucuagaaucuaccgauacacuguga

SEQ ID NO: 60283 - RNA, 1122 nt, Artificial Sequence
  derived and/or modified sequence opt3 from P2RY1__Homo_sapiens__NP_002554
augaccgaggugcuguggcccgccgucccuaacggcacagacgcugcauuccucgccgggccaggaagcuccugggguaauucuacuguugcgucaacggcugccgugaguagcuccuuuaagugcgcacuuaccaaaacaggcuuccaguuuuacuaucugccggccguauacaucuugguguucauuauaggguuuuuaggaaacucugucgcuaucuggauguucguguuucacaugaagcccuggucgggcauuucaguuuauauguucaaucuggcacuagccgauuuucucuacgugcugacucuuccugcucugaucuucuauuacuuuaacaaaaccgacuggauuuucggugaugccauguguaaguugcaaagauuuaucuuccaugucaaucucuaugggagcauacuguuccugacaugcaucagugcgcacagguacuccggagugguauacccacucaaaucuuuaggccggcugaagaagaaaaacgcaauuuguaucagcguucuugugugguugauugucgugguggccaucucccccauacuguuuuauucaggcaccgggguccgcaagaauaaaacuauuacaugcuacgacaccacgagugaugaauaucuacgaagcuacuucaucuauucuauguguacuaccguugcuauguuuugcgugccucucguacugauucuuggauguuacggucugaucgugcgugccuugaucuauaaggaccucgauaacuccccacugagaaggaaaucaauuuacuuagucauaaucgugcugacaguuuucgcagugagcuacauucccuuucaugucaugaagacuaugaaucuccgggcucgccuugacuuccagaccccugccaugugcgcguuuaacgauagaguguaugccacauaccagguaaccaggggccuggcaagucuaaauucuuguguugacccaaucuuguauuuccuggcuggggauacguuucggcgccgacucuccagagccacuaggaaggcuagccggcguucggaggccaaccugcagucuaaauccgaagacaugacacuuaauauacugccggaguucaagcaaaacggagauaccucauuguga

SEQ ID NO: 60284 - RNA, 1134 nt, Artificial Sequence
  derived and/or modified sequence opt3 from P2RY2__Homo_sapiens__NP_788085
auggccgcugaccugggccccuggaacgauaccaucaaugggacaugggacggagaugagcucgguuacagaugcagguucaacgaagacuuuaaguaugugcuucugccugucagcuacggcguuguguguguauugggguuaugccugaaugcaguggcccuauauauuuuccucugucggcugaaaacuuggaacgcguccacgaccuacauguuucaccuugcugucucugaugcccuguaugcagccucauugccacuccugguguacuauuacgcucgcggagaccauuggccguucaguacaguucugugcaagcucgugcgauuuuuauucuacacuaaucuguauuguagcauauuguuucuuaccugcaucuccguccaccguugucugggcgugcuaagaccccucaggucucugcgguggggucgcgcaagauacgccaggcggguagcuggggccguuugggugcuuguccuggcgugccaggcaccuguguuguauuucgugacaaccucggcccgcggaggccgagucacuugucaugauacaucagcuccagagcucuuuagcagauucguugccuacaguuccgugaugcugggcuuacuguuugcaguacccuucgcugugauucucgucugcuaugugcuuauggccaggcggcuguugaaaccugcguacgggaccucuggaggucuaccacgugccaagcgcaaaagcguuagaacgaucgcagugguccuggcuguguuugcccucuguuuccugcccuuccacguaacuaggacccuuuauuacuccuuucggucacuggacuugaguugccauacacucaacgcuauuaauauggccuacaagguuacucgaccucuggcaagcgccaacucuugcuuagauccagugcuguauuuccuagcuggccaacgccucgucagauuugcgagggacgcaaagccgcccaccgggccuuccccagccacacccgcucggcgcagacugggacuuaggcguucagaucggaccgacaugcagcgaaucgaagauguguugggcagcagugaggacucuagaaggacggaauccacuccugccgguagcgagaauacaaaagacauacgccuguga

SEQ ID NO: 60285 - RNA, 1098 nt, Artificial Sequence
  derived and/or modified sequence opt3 from P2RY4__Homo_sapiens__NP_002556
auggccagcaccgaguccucucugcucagaucacuuggccugagucccgggccuggaagcuccgaaguggaguuggacugcugguucgaugaagacuuuaaguucaucuuacugccagucucuuacgcuguuguguuuguacuaggucucggccugaacgcaccgacacuuuggcuguucauuuuuagguugcggcccugggaugccacugcgacguauauguuccaccucgcucugucggacacccuguacgugcucucauuaccuacacugauauauuacuaugccgcacauaaucacuggccauuugggacugagaucuguaaauucguccgcuuucuuuucuacuggaacuuguauugcagcgugcuguuucuaaccuguauuaguguucaucgauaccucggaaucugccacccccugcgugcccuuagauggggcaggccucggcuggcugguuugcucugucuggcagugugguuagucguggccgggugccugguaccaaaucucuucuuuguuacaaccuccaacaagggaacuacagugcuuugucaugauaccacgcgccccgaagaguucgaccacuacguccacuucucuagcgcugugaugggccuguuguuuggcgugccuugccuagucacucugguuuguuaugggcucauggccagaaggcuguaccagccacuuccgggauccgcgcaaucaaguagccggcugcgcucuuugcgaaccauugcagugguacucacaguguucgccgucugcuuugugcccuuccauaucacuagaaccauauauuaccuggcuagguuacuggaggccgauugucggguucuaaauaucgugaacgucguguauaaaguaacacguccucucgcauccgcuaauucaugccuggacccaguucuuuacuugcugaccggugauaaguaucgcagacagcucaggcagcugugcggcgggggaaaaccccagccucggacggccgcgagcagucuugcccuggugucuuugccagaagacuccagcugucgaugggcagcuacuccccaagauucgucuugcuccacaccgcgcgccgacagacucuga

SEQ ID NO: 60286 - RNA, 987 nt, Artificial Sequence
  derived and/or modified sequence opt3 from P2RY6__Homo_sapiens__NP_001264134
auggagugggacaacggcaccgggcaggcccugggacuucccccuacaacuugcguguacagagaaaauuucaagcaacuccuguugccaccggucuauagcgcuguuuuagcagccggucugccccuaaacaucugugugauuacgcagauaugcaccuccaggcgggcgcucacacgcacugcuguauacacccugaaucuugcccuggcagauuugcucuaugccuguucucugccucugcucaucuacaacuaugcucagggcgaccacuggccauuuggggauuucgcaugccgauuagugcguuuucuguucuacgccaaucuucauggaucaauuuuguuucugacauguaucaguuuccagagauaucuaggcauuugccacccccucgcuccuuggcauaaaaggggugggcggcgcgccgcguggcuggucuguguggcaguuuggcuugccgugaccacucaaugccugccaacagcuaucuuugccgcaaccggaauacagagaaacaggacggucuguuacgacuugagcccucccgcucucgccacucacuacaugccauauggcauggcgcugaccgugaucggcuucuuacugccguuugccgcacuccuugcuugcuacugucuguuggccugccggcuaugccgccaggaugggcccgcugagccuguagcccaggaacgaagaggaaaggcagccaggauggcuguuguggucgcggcagccuucgcuauuuccuuucugccauuccauaucacaaaaacugccuaucucgcagugcggucuacccccggugugccuuguacaguccuggaggccuuugcugccgcauacaagggcacccguccauucgcgucggcuaauucaguucuugaccccauucuguucuauuuuacgcagaaaaaguuccgcagaaggccgcacgaauugcuccaaaagcugacugccaaauggcagcggcaggggcgauga

SEQ ID NO: 60287 - RNA, 1080 nt, Artificial Sequence
  derived and/or modified sequence opt3 from P2RY8__Homo_sapiens__XP_005274835
augcaagugcccaacagcaccggcccugacaaugccacacugcagaugcucagaaacccagcuaucgcagucgcccuuccgguuguguacucccugguagcggcugugucuauucccgggaauuuguucucauuauggguccugugcaggcggaugggaccucgcaguccaagcgugauauuuaugaucaaccuauccguuacugaucucaugcuggccucugugcuucccuuccagauuuauuaccacuguaaucgacaucacugggucuuuggugugcuguugugcaacguaguuacgguggcauucuaugccaauauguacucgucaauccucaccaugacauguauuagcgucgagcguuuucugggcgugcuguauccucucaguuccaagagauggaggcggcgcagauacgcuguggcagccugcgcugggacuugguuacugcuuuugaccgcccugucuccacuagcgaggacagaccucaccuaucccguccaugcacugggaaucauaacuuguuucgauguucuuaaguggacaaugcugccuagcguggccaugugggcuguauuuuuguucaccaucuuuauucuccuguucuuaaucccauuugugauuacggucgccugcuacacugcaaccauccugaagcuccuucggacagaagaggcucacggccgcgaacagcgaagaagggccgugggucuggcggccguuguguugcuagcauucgucacuuguuuugcuccgaacaauuucgugcugcucgcccauauaguaucccggcuguucuacgggaaaucauauuaccacguuuauaaacuuacccugugcuugaguugucucaacaauugccuggaccccuuuguguacuauuucgcuagccgugaguuucaguuacgccugagagaauaccuaggauguaggcgggucccucgagauacacucgacacccgcagagagucucuguucuccgccaggacgacuucagugcggagcgaggcaggcgcccacccagaaggcauggagggggcuacacgccccggacuucaaagacaggaaagugucuuuuga

SEQ ID NO: 60288 - RNA, 1584 nt, Artificial Sequence
  derived and/or modified sequence opt3 from P3H2__Homo_sapiens__NP_001127890
auggagaugcagcaaaacaucgaaaauuacagagccaccgcuggcguggaggcacugcagcucgucgacagggaagccaagccccacauggagagcuauaacgcggggguuaaacauuacgaagcugaugacuucgagauggccauucggcacuuugagcaggcacuucgcgaauauuucguggaggauacagaaugccgaacucugugugagggaccucagcguuuugaggaauacgaguauuuggguuacaaggccggcuuauaugaagcuauagcagaccauuacaugcaaguacuggugugccagcacgagugugucagagaacuagccacgaggccagggcggcucuccccgaucgagaauuuccugccccuucauuacgauuaucugcaguuugcuuacuaucgcgugggagaguacguuaaagccuuggaaugcgcgaaggcauaucuccugugucacccugacgaugaggacgugcuggauaacgucgacuacuaugaaucucucuuagaugacucaauugauccagccaguaucgaggcuagagaagaccugaccauguucgugaaaaggcacaaacuugagagcgaguugauuaaguccgccgcagaaggccuggguuuuucuuacacagagcccaauuacuggauccgguaugggggacgccaggacgaaaaccgaguaccuucgggcguuaauguggagggcgcugaaguccauggguucucaaugggaaagaagcuaagcccaaaaauagauagagaccucagggaggguggcccccugcuuuacgagaacaucacuuuuguguauaauagugaacaacugaacgggacccagcggguguugcucgauaauguccuguccgaggaacagugccgugaguuacacucuguugccagcggaauuaugcuggugggcgacgguuaccgcgggaagacauccccucauaccccaaacgagaaauucgaaggagcgacuguacucaaggcccuuaagucaggcuaugagggcagagugccgcugaaaagugcaagguuguuuuacgauaucagcgaaaaggcucggcgaauugucgagucuuauuucaugcuaaauuccacacuguacuuuucauacacccacauggugugucgcacggcccucagcgggcagcaagacagaaggaacgaucugagucaccccauccaugcugacaauugccuucuggauccugaagccaacgaguguuggaaagagccacccgcauauacuuuccgggacuacucugccuugcucuauaugaacgaugacuucgaaggaggugaguuuauauucaccgaaauggacgcuaagacaguuacugcguccauuaaaccuaagugcggccgcaugaucagcuuuucgucugggggagagaauccacacggcgugaaagcagucaccaaggguaagagaugugccguggcucugugguucacauuagauccccuguacagggaacuagagcguauucaggccgacgagguaaucgcaauccucgaucaggaacaacaggggaaacaugagcugaacauuaauccgaaggacgaacuuuga

SEQ ID NO: 60289 - RNA, 2211 nt, Artificial Sequence
  derived and/or modified sequence opt3 from P3H3__Homo_sapiens__NP_055077
augcugagacuccuuaggccccuguuguuacugcuacuccugccuccaccgggcagccccgagccuccagggcuuacccagcugucccccggagccccuccacaagcucccgacuugcucuacgcagauggucugcgggccuaugcggcuggcgccugggccccugcaguggcucugcuccgcgaagcauuacgaucucaggccgcucuggggcgugucagacuugacugcggagccucaugugcggcagauccaggcgccgcuuugccggccguucugcuaggugcacccgagccugacagugggccaggacccacacagggcagcugggaaaggcagcuccugcgggcugcccuucgcagagcggauugccugacucaaugugccgcaaggcgguugggcccugggggagcugcccgccuccgaguggguuccgcucugagagacgccuucaggcggcgugagccauacaacuauuuacagcgcgcauacuaucagcugaagaaacucgaucuugccgcugcggcagcccacacguuuuucguagcuaaucccaugcaucugcagaugagagaagacauggccaaguacaggcggaugucuggcgugcgaccgcaaucguuucgcgauuuggagaccccuccccacugggcagccuaugacacagggcuagagcugcucggaagacaggaagcuggccuggcccuuccaaggcuggaggaagcauugcaggguucacucgcgcagauggagagcugccgggcugauugugaggggccugaagaacaacagggagccgaagaggaagaggacggcgcagccagucagggcgggcuguacgaggcuaucgccggacauuggauucaagucuuacagugccgccagagaugugugggugaaacugcaaccaggcccggccguuccuucccaguucccgauuuucugccuaaccagcuacggcgacuccacgaggcucaugcccaaguggggaaucugucucaggcgauagaaaacguccuuagcguguugcuguucuacccagaggacgaagccgcuaaaagagcacucaaucaguaucaggcccaacugggagagccgaggcccggccuugguccucgcgaggacauccagcgguuuauucugagauccuugggggaaaagaggcagcucuacuaugcuauggagcaccugggcacaucauucaaagauccagaccccuggaccccugccgcauuaaucccagaagcgcugcgcgagaagcuacgagaagaucaggagaagcggcccugggaccacgagccgguaaaaccuaagccacucacuuacuggaaagauguucugcuuuuggaaggagugacacugacccaagacagucgucagcucaacggcagcgagagagccguccuggauggguuacugacgcccgcugaaugcggagugcuuuugcagcucgccaaggacgcagcuggugccggcgcaaggucuggguaucgcggacggagauccccucauacuccccacgagagguuugagggccugaccgugcuaaaagccgcucagcuggcgcgagccgguacagucgggucacaaggcgcaaagcuccugcuugaaguuagcgagcgcgugcggacuuugacccaggcuuacuucaguccagaaagaccucugcauuuaucuuuuacacaccucguauguagguccgccauugagggagaacaggagcaacguauggaucugagccaccccgugcaugccgacaauugcguccuugauccagacaccggcgaguguuggcgcgaaccgccugcuuauacguaccgggacuacucggggcuguuguaucucaacgaugacuuccagggaggugaucuguuuuucacugagcccaaugcacuaacagugaccgccagaguuaggccacgaugcggccggcugguggcguucucuuccggggucgaaaacccccacggagugugggcuguaacucgcggcagaaggugcgcccucgcacuguggcauacaugggccccugagcaccgggaacaggaguggaucgaggcuaaggaacuuuugcaggagucacaagaagaggaagaggaggaagaggaagagaugccaaguaaagaccccagcccugagccgccaucccgaagacaucagcgcguucaggauaagaccgguagggcaccccgugugcgggaggagcuguga

SEQ ID NO: 60290 - RNA, 1314 nt, Artificial Sequence
  derived and/or modified sequence opt3 from P3H4__Homo_sapiens__NP_006446
auggccagaguggcuuggggccugcucuggcuucuguuggggagcgcaggagcccaguacgagaaguauuccuucagggguuuucccccugaagacuuaaugccacuggcggcugccuacggccacgcacuagagcaauaugaaggggagucuuggcgggaaucagcccgcuaccucgaggcugcacugcgacuucaucgucuguugagagauagugaggccuucugccacgcuaacuguagcggaccggcccccgcggcaaaaccugacccagauggcgguagggccgacgaaugggcuugcgagcuccggcuguuugggcgcguccuggaaagagccgcaugucucaggcggugcaagcgcaccuuacccgcuuuccagguuccuuauccaccccgacagcugcuuagagauuuucaguccagguugccuuaccaauaucugcauuacgcccuauucaaagcgaaucggcucgagaaggccguggcagcugccuacacauuucugcagcguaacccaaaacacgagcuuacugcuaaguaucugaauuacuaucagggaauguuggacguagccgaugaaucucucacggaccuggaggcacagccguacgaagccguguucuuacgcgcugucaagcuguauaacucgggcgauuuuagaucaagcaccgaggacauggaaagggcgcucagugaguaccuugcaguguucgcccggugucuggcuggcugcgagggggcccaugaacaaguugauuuuaaagacuucuaucccgcaaucgccgauuuguuugcugagucccuacaguguaagguggacugcgaagccaaucugacaccuaacgucggagguuacuucguggacaaauucguagcaacuauguaccacuaucuccaguuugcguacuauaagcugaaugauguucgacaggcugcccgcucugcagccagcuacaugcuuuucgacccaaaagauuccgugaugcaacagaaccuggucuauuacagauuucacagggcucgguggggcuuggaggaagaggacuuccagccccgcgaggaagccaugcucuaucauaaucaaaccgcagagcugagagaauuacuggaguuuacacacauguaccuacagucagaugacgaaauggagcucgaggaaaccgagccuccacuggaacccgaggaugcucuuagugacgccgaguucgaaggggagggagauuacgaagagggcauguaugcggacugguggcaggaaccggaugccaagggugacgaggcugaggcagaaccugagcccgaauuggccuga

SEQ ID NO: 60291 - RNA, 1605 nt, Artificial Sequence
  derived and/or modified sequence opt3 from P4HA1__Homo_sapiens__NP_000908
augaucugguacauucugauaaucggcauucuccuuccccagagccuggcccacccuggguucuuuaccuccaucggacaaaugacagacuugauucauacugagaaggauuuagugacgucucugaaagacuauaucaaggcugaagaggauaaacuagaacagauaaagaaaugggcagagaagcucgacagacugaccucaacagccacuaaggauccagaagguuucgucggccacccgguuaacgcguuuaaacuuaugaagaggcugaauaccgaguggagugaguuggaaaaccucgugcugaaagacaugagcgauggguucaucuccaaucugacaauucagcggcaguacuuucccaacgacgaggaucaaguaggagcugccaaggcacucuuacgccugcaggacaccuauaaucuugauacugacacaaucucuaaaggcaacuugccuggugugaagcauaagucguuccugaccgccgaagauugcuuugagcuagggaaagucgcuuacacggaggcagacuauuaccacacugaacucuggauggagcaggcccugcgacagcuugacgaaggagagauuucaaccaucgauaaggugagcguucuggacuauuugaguuacgcuguguaccaacagggcgaucucgacaaagcccuguuacugacaaagaaacuccuugaacuggauccagagcaucagcgugcgaauggcaacuugaaguauuucgaguacauaauggcaaaagaaaaggacgucaauaaguccgccucugaugaccagagcgaucagaaaacuacccccaagaaaaaggggguggcuguagacuaucuaccugagagacaaaaauacgaaaugcuguguaggggagaggguauuaagaugacaccacggcgccagaagaaacucuuuugcagauaucacgauggcaacaggaaucccaaguucauccuggccccugcaaaacaagaagacgagugggacaagccacggauuauccgcuuucacgauaucauuuccgacgcugagauagaaaucguuaaagaucuugccaagccgcgacugucaagagcgaccgugcaugaccccgagacggggaaguugacuacagcccaguacagggucaguaaaagcgcauggcucucuggauaugaaaacccuguggugucccggauuaauaugcguauccaggaucugaccggcuuagacgucucaacugcugaggaacugcagguugccaacuacgguguagggggacaauacgagccacacuucgauuuugcucgcaaggacgagcccgaugccuucaaagaacuaggcacaggcaauagaauagcaaccuggcuguucuauaugagcgacgugagugccgggggagcuacgguguuuccugaggucggugcgucuguguggccaaagaaaggcaccgcaguuuucugguacaaccucuuugccuccggggaaggagauuauagcacaaggcaugcugccugucccgugcuugucggcaacaagugggugucgaauaagugguugcacgagcggggucaggaguuccgacgcccgugcacucugucugaacucgaguga

SEQ ID NO: 60292 - RNA, 1608 nt, Artificial Sequence
  derived and/or modified sequence opt3 from P4HA2__Homo_sapiens__XP_005272177
augaagcugugggugagcgcccuccuuauggcuugguucggcguccuguccugcguucaggcagaguuuuucaccucuaucgggcacaugacagacuugauuuacgccgaaaaagaguuagugcaaucacugaaggaauauauccuaguagaggaagcgaaacucaguaagauaaaaagcugggcuaacaagauggaggcccugacuuccaagucugcagccgaugcugagggauaccuugcacaucccgugaaugccuauaaacuggucaagagauugaacacggacuggccugcucucgaagaucuggugcugcaggacucggccgcggguuuuauugcaaaucucucaguucagaggcaguucuuuccaaccgaugaggacgaaaucggcgccgcuaaagccuuaaugcggcugcaagauacauaccgccuugacccggggacuauuagccgaggagaguugcccggcaccaaguaucaggcaaugcugaguguggaugacuguuucgguauggggcguuccgcuuacaacgagggagauuauuaccacacaguccuauggauggaacaggugcucaaacagcuggacgccggcgaggaagcgaccacuacaaagucucaaguacuugauuaccugagcuaugccguuuuucaguugggcgaccuccauagagcacuggaguuaaccaggcggcugcucucccuugacccuucacacgaacgcgcugggggaaaucugagauacuucgagcaguugcuagaggaagagagggaaaagacgcugacuaaccagaccgaggccgaacucgcuacaccagaggguaucuaugagcggcccguggauuaccugccugaacgcgacgucuaugagagucuuugccgaggcgaaggggugaaacugacuccaagaaggcaaaagcgguuguuuugucguuaccaucacggaaaucgcgcaccccagcuccugauagccccuuucaaagaggaagaugagugggacagcccacacaucgugagauauuacgaugucaugucugacgaggaaauugagaggaucaaggaaauugccaaaccgaaguuagcucgggcgaccguucgagaucccaaaacaggcgugcugaccguagcauccuaccgcgugucaaagagcaguuggcuagaggaggacgaugacccugucguggccagaguuaacaggcggaugcagcauaucacgggucucacugugaagacagcugaacugcuucaagucgccaauuauggggugggaggccaguacgagccacacuuugauuucucucgcaacgacgaaagagacaccuuuaaacauuugggcacugggaauaggguagcaacauuccugaacuauauguccgauguugaggccggaggugcuaccguguuccccgaccucggcgccgcaauauggccuaagaaagggacggcggucuuuugguacaaucugcuucguagcggagaaggcgauuaucggacccgacacgcugccugcccagugcuggucgguuguaagugggugucgaacaaaugguuccacgagagagggcaggaguuuuugaggcccugcggcucuacagaaguugacuga

SEQ ID NO: 60293 - RNA, 1527 nt, Artificial Sequence
  derived and/or modified sequence opt3 from P4HB__Homo_sapiens__NP_000909
augcugagaagggcccuccuuugccuggcuguggcagccuugguccgggcggacgcucccgaggaagaggaucacguuuuagugcugcgcaagagcaacuucgccgaagcacuagccgcucauaaauaccuccugguagaguuuuaugcaccuugguguggccacugcaaggcccuugcuccagaauacgccaaagcggcagggaagcugaaagccgagggauccgagauccgauuggcuaagguggacgccaccgaagagucugaucucgcacagcaauaugguguccguggcuacccgacaauuaaguucuuuagaaauggggacacugcuucacccaaagaauauacggccggaagggaggcggaugacauagugaacuggcugaagaaacggaccggcccugccgcaacaacucugccagauggugcugccgcugagagucucguugaaagcuccgagguggccgucaucggguucuuuaaggacguggaaucugauucggcaaaacaguucuuacaggccgcugaggcgauugacgauauccccuuuggaauuaccucaaauagcgacguauucaguaaguaccagcuggauaaggacggcguugugcuuuuuaaaaaguucgacgaaggccgcaacaauuuugagggggaggucacaaaagaaaacuugcuggauuucaucaagcauaaucaacuaccucucgugauagaguuuaccgaacagacugcaccaaaaaucuucggaggugagauuaagacacacauccugcuuuuccugcccaaauccgugucugacuaugauggcaaguugagcaacuuuaagaccgccgcugaauccuucaaagggaagauucucuuuaucuucauagacucagaucauacggacaaucagagaauuuuagaguuuuucggacugaaaaaggaggaauguccugccgucaggcugaucacucucgaggaagagaugaccaaauacaagccagaaagugaggagcuuacagcagaacggauuacugaguuuugccaccgcuuccuggaaggcaagaucaaaccgcacuugaugagccaggagcuacccgaggauugggacaagcaaccuguuaaagugcugguagguaagaacuuugaagauguggccuucgacgagaaaaagaaugucuuuguggaguucuacgcuccauggugugggcauugcaagcagcucgcccccaucugggauaaacugggagaaaccuauaaggaccacgaaaacauuguuauagcaaaaauggacucuacagcgaaugagguggaggcugucaaggugcauuccuuuccuacccuuaaauucuucccagccucagcagaucgaacgguaaucgacuacaacggcgaaagaacucuggauggcuuuaagaaguucuuggagagcgggggacaggacggugccggcgaugacgaugaccucgaagaucuggaggaagcugaggagcccgacauggaagaggaugacgaucagaaagccguuaaggacgaauuauga

SEQ ID NO: 60294 - RNA, 1692 nt, Artificial Sequence
  derived and/or modified sequence opt3 from P4HTM__Homo_sapiens__NP_808807
auggccgcugcagccgugaccggccagagacccgagacagcggcugccgaagaggcaagcaggccucaaugggccccaccggaccacugccaggcucaggcagccgcugggcugggagauggugaagacgcccccguccggccucucuguaagccacgcggcaucugcucccgagcguacuuccuuguucugaugguguuuguacauuuguauuuagggaacgugcuggcacuacuccuguucguccacuacucuaauggagaugagucaagugaccccggcccucagcaucgugcccaagguccagggcccgaaccuacucuuggaccacugacgagauuggagggcauuaaagugggccacgagaggaagguucagcucgugaccgaucgggaccauuuuauacgcacacugagccugaaaccgcucuuauucgaaauccccggguuucugacugaugaggaauguagacuuauuauccacuuggcucagaugaagggacugcagaggucccaaauucuaccuaccgaggaguaugaagaggccaugucuacaaugcaggucucgcagcucgaccuguuccggcuucuggaucagaaccgcgacggucacuugcaacuccgagaagugcuggcacagaccagauuaggcaaugggugguggaugacuccagagucaauccaggaaauguacgcugccauaaaagcggaucccgacggagauggcguacugagccuccaagaguuuaguaacauggaccuuagggacuuccauaaguauaugcggucccacaaggccgagucuagcgaacugguucguaauucccaucacacaugguuguaccagggugagggggcacaccauaucaugcgcgcuauuagacagagggugcuacggcugacccgacucucaccugaaaucgucgagcugagugaaccacuucagguggugcgcuauggagagggcggccacuaccaugcccacgucgauagcgggcccguuuacccggagacgauuugcucucauacuaaacugguggcuaacgaauccguaccuuuugagaccucauguagacaagugagccccaauuggggauugccaaguauccucaggccugguacacccaugacucaggcccagccaugcaccgucggcgugccccuggggaugggaccuggcgaccacuggguuauaccagugucuccgugggaacacccccaguuagguacauguuccgucccuccacugcccuauagcuacaugaccgugcuauucuaucucaacaauguaacugggggcggagagacgguuuuuccuguggcagauaaccggacauacgacgaaaugucgcugauucaagaugacgucgaucuucgcgacaccagaaggcauugcgauaagggcaauuugcgugugaaaccacagcaggggacugccgucuucugguauaacuaccugcccgacggacaggguugggugggcgauguugacgacuauucucuccacgggggaugucuggugacacggggcaccaaguggaucgcuaauaacuggauuaauguagauccgucccgagcgagacaagcacuuuuucagcaggagauggccaggcuggcucgcgagggugggacggacucacagccugaaugggccuuggaucgggcauacagagacgccagggucgagcucuga

SEQ ID NO: 60295 - RNA, 1185 nt, Artificial Sequence
  derived and/or modified sequence opt3 from PA2G4__Homo_sapiens__NP_006182
augagcggcgaggacgaacagcaagagcagaccaucgccgaagaucugguggucacaaaguacaaaaugggaggggacauugcuaacagaguucucaggucccuuguggaggcaucuucaagugguguaagcgugcuguccuugugcgaaaagggcgaugccaugauaauggaggagacugggaaaaucuucaagaaagaaaaggagaugaagaaaggaauugcguuucccacgucuaucucggucaauaacugugugugccacuucucaccuuuaaagagcgaccaggauuauauucugaaagaaggcgaccuaguuaagaucgaucucggugugcaugucgacggguuuauagcuaauguggcccacaccuucguaguugauguggcacagggaacacaagucacuggccggaaagccgacgugaucaaggcugcacaucugugugccgaggcugcccuucgccuggugaagccaggcaaccagaauacccaggucacagaggcguggaacaaaguugcacacaguuuuaauugcaccccgauugaagggauguugucccaucagcucaagcaacacgugaucgauggagagaaaacuauuauccagaaccccacagaccagcagaagaaagaucacgaaaaggccgaguucgaaguacaugagguguacgcugucgacgugcugguuucuagcggugagggcaaagccaaggacgcagggcaacgaaccacgauauauaagcgugauccuuccaaacaguacggacugaagaugaaaacuucaagagccuuuuucagugaaguggagaggcgguuugacgcuaugccauucacccuccgcgcguuugaagaugagaagaaagccagaaugggcgucguggaaugugcaaagcacgaguuacugcagcccuucaauguacuuuaugagaaggaaggugaguuuguugcucaauucaaauucacaguguugcugaugccuaacgggccaaugaggauuacuagcggacccuuugaaccugaccuauacaagucugagauggaaguccaggaugccgagcucaaagcucugcuucaguccucagccagccggaagacccagaaaaagaagaaaaagaaagcaaguaagacagccgagaaugcuaccucuggcgaaacgcuggaggaaaacgaggcgggcgacuga

SEQ ID NO: 60296 - RNA, 1911 nt, Artificial Sequence
  derived and/or modified sequence opt3 from PABPC1__Homo_sapiens__XP_005250918
augaaccccagcgccccuuccuacccaauggcuucucuguaugugggcgaccuccacccggaugucaccgaggcaaugcuuuacgaaaaguucucacccgccgggccuauccugaguauuagaguuugcagggacaugauaacacggcgcagcuugggauaugcguacgugaauuuucagcaaccagcugaugccgagcgagcauuagacacuaugaacuucgauguaaucaaagguaagcccgugcguauuauguggucccagagagacccuucucugaggaaaucgggcgucgggaauaucuuuauuaagaaccuagauaaaucaaucgacaauaaggcccucuaugauacguucagcgcuuuuggaaacauacugaguuguaaggugguuugcgacgaaaauggcuccaaagguuacggguucgugcauuuugagacccaggaagcagccgagcgggcuaucgagaagaugaacggaaugcuucugaaugaucgcaaagucuucgugggcagauuuaagucuaggaaagaacgggaggccgaauugggcgcgcgcgcaaaggaguucacaaacguauauauuaagaauuuuggggaggacauggaugacgaacgacucaaagaccuguucggaaaguuugguccagcccugagcguuaaagugaugacugaugaguccggcaagucaaaaggguucggauucgucaguuuugaaagacacgaggacgcucagaaggccguggaugaaaugaacggcaaagagcucaaugguaagcaaaucuacguggggagggcacagaagaaagucgagcggcagaccgaauuaaagcguaaauucgagcagaugaagcaagaccgcauuacaagauaccagggaguuaaccuguaugugaaaaaucuugaugacggcaucgaugacgaaagguugcggaaggaguuuagccccuucggcaccauaacuucugcuaagguaaugauggaagggggacgauccaaagguuuuggcuucguguguuuuucaagcccugaggaggccacaaaggcggucaccgaaaugaacgggcgcauuguggccacgaaaccacuguacguugcacuagcucagagaaaggaggaaaggcaggcccaucucacuaaccaauauaugcagcggauggcuagugugcgcgccgucccgaaucccgugaucaacccuuaccagccagcacccccuucuggauauuucauggccgcuauuccacaaacccagaauagagcggcauacuaucccccgucccagaucgcccagcugaggccuagcccccguuggacagcucaaggcgcccggccacacccuuuucagaacaugcccggugcaauccgaccagccgcucccagaccuccauucucgacuaugaggccggccucuucccagguaccccgcguuaugucaacccagcggguggcaaauacaaguacccaaacgauggggccuagaccagcggcugccgcagccgcugccacucccgcagucaggacagugccucaguacaaauacgcugccggcguccgcaacccacagcagcaucuuaaugcgcaaccccaggugaccaugcagcagccggccguucacgugcaaggacaggagccucugacugcuagcauguuggcauccgccccaccccaggaacaaaagcagaugcucggcgagcgacuguuuccuuuaauucaggcuaugcaccccacacuggccgggaagauaaccggaaugcuccuugagaucgauaacucugaacuguugcauaugcuagagagcccagaaucacugcggaguaaaguagacgaggcagucgcggugcuccaggcccaccaagcuaaggaggccgcacagaaagcuguuaauuccgccacgggugugccuaccgucuga

SEQ ID NO: 60297 - RNA, 1896 nt, Artificial Sequence
  derived and/or modified sequence opt3 from PABPC3__Homo_sapiens__NP_112241
augaaccccagcaccccuuccuacccaacagccucucuguaugugggcgaccuccacccggaugucacugaggcuaugcuuuacgaaaaguucucacccgcagggccuauccugaguauuagaauaugcagggacuugaucacgagcggauccucuaauuaugccuacguuaacuuucagcauaccaaagaugcggagcacgcuuuagacacaaugaauuucgaugugauuaaggguaaaccaguacggaucauguggucgcaacgcgaccccucacugcgaaagagcggcguggggaacauuuuugucaaaaaucuagauaagaguaucaacaauaaggcccucuaugacacuguguccgcauucggaaacauacugucuuguaauguugugugcgaugaaaacggcagcaaagguuacggguuuguccauuucgagacccacgaagccgcugagcgugcaaucaagaaaaugaauggaaugcuucugaacggcagaaagguguuuguaggccaguucaaauccaggaaggagcgggaagccgaguugggggcucgcgccaaggaauuuccuaauguuuauauuaaaaacuucggagaggacauggaugacgagagacucaaggaucuguuugguaaauucggcccagcgcugucagugaaggucaugacagacgaaagugggaaaagcaagggauuuggcuucgugucuuucgagaggcaugaagacgcacagaaagccguggaugagaugaaugguaaggaacucaacgggaagcagaucuacgucggacgggcucagaaaaagguugagcgccaaaccgaguuaaaacgaacuuuugaacagaugaagcaggacagaauuacaagguaccaagugguaaaccuguaugugaaaaaucuugaugacggcaucgaugacgagcgguugcguaaggccuucucccccuuuggcaccauaacgucagcaaaggucaugauggaagggggacgcagcaaagguuucggcuuuguguguuucaguucuccugaggaagcuacuaaggccguuaccgagaugaacgggagaauuguggcgacaaaaccacuguacgucgcccuagcacagaggaaggaggaacggcaggcuuaucucacuaaugaguacaugcagcgaauggccuccgugcgcgcuguaccgaaccaaagagcacccccuagcggauauuuuaugaccgccguuccacagacacagaaucacgccgcuuacuaucccccuucgcaaaucgcgaggcugcggccaucuccccgcuggaccgcacagggcgccagaccgcacccuuuccagaacaaacccuccgcuauuaggccaggugccccucgugugcccuuuucaacgaugcggccagcaaguagccaggucccccgagugauguccacucaaagagucgccaauacaucuacccagacuguggggccuaggccagcugccgcagcggcugccgcagccacaccggcuguucgcaccgugccccgguacaaguacgccgcaggcguaagaaacccucagcagcauaggaaugcucaaccacaggucacgaugcagcagcuugccgugcacguucaaggacaggaaacccugacagcgagccgcuuggccucagcucccccucagaagcagaaacaaaugcucggcgagcgacuguucccauuaauccaggcaaugcaucccacucuggccgggaagaucaccggaaugcuccuugaaauugauaacagugagcuguuguauaugcuagaguccccggaaagccugcggucuaaaguggacgaggcugucgccgugcuccaggcacaccaagcgaaggaagccacacagaaagcuguaaauucagccacuggugugccuaccguuuga

SEQ ID NO: 60298 - RNA, 1287 nt, Artificial Sequence
  derived and/or modified sequence opt3 from PABPC4L__Homo_sapiens__NP_001108206
augagagugcugcccgagcucggcgaaagcugccuuaacuccaucgccuggccucuguguggggacccagaggcuucuaccuuggaaccgggacagucaugcgauuuagucaguccccacagggacuguagcaaaaauucccggggucaaacacauucuggcaaggauaaggagaugaacguugcagccaaauaccgcauggcgucgcuguaugugggggaccuacacgcugauguaacugaagaccuccuguuccgaaaguuuucaacggugggaccuguccuuagcauucguauaugcagagaucaggugaccaggcggagucugggcuacgccuauguuaauuucuugcagcucgcagacgcccagaaagcucuggauacaaugaacuuugacaucauuaaggguaaguccauccgccugauguggucucaaagagaugcauaccucaggcggagcgggauuggaaauguguucaucaaaaacuuagacaaguccauagauaauaaaacucuguaugagcauuuuucagccuucggcaagauccuuaguagcaaagucaugucugacgaccagggcuccaagggguacgcuuuugugcacuuccagaaccagucagccgcggaucgcgcaauugaggaaaugaauggaaaguugcugaaagguuguaagguauuuguuggccgauucaaaaacagaaaggacagggaggccgaacuacggagcaaagcuagugaguuuaccaauguguauaucaagaacuucgggggagauauggacgaugagcgucucaaagacgucuuuucuaaguacggcaagacacuguccgugaaagugaugaccgauagcucggguaagucuaaaggguucggauucgucuccuuugacucacaugaagccgcaaagaaagcuguugaggaaaugaauggccgcgauauuaacggccaacuuaucuucguggggagagcccagaagaagguagagaggcaggcggaacugaaacagauguuugagcaauugaagcgggagcgaauacgcggaugccagggugugaaacucuacauuaagaaucuggacgauacuaucgacgacgaaaaauuaagaaacgaguucaguagcuuuggcuccauuucuagggucaaggugaugcaggaagaggggcaaagcaagggauucggccugaucuguuuuucaaguccagaagaugccacaaaagcaaugaccgagaugaacggucggauccucggguccaagccccuuagcauugcucuggcccagcgccacuga

SEQ ID NO: 60299 - RNA, 921 nt, Artificial Sequence
  derived and/or modified sequence opt3 from PABPN1__Homo_sapiens__NP_004634
auggccgcugcagccgcggcugccgcagccgcuggcgcagccgggggaagagguagcggccccgggaggcggcgccaccuggugccuggagcuggcggugaggccggggaaggagcgccaggcggcgcaggggacuacggaaacggucucgaguccgaagaacuugaaccggaggagcuguuguuagaacccgagccugaaccagagcccgaggaggagccuccacgaccccgugccccuccaggcgcuccggggcccggaccuggcucuggugccccagggucacaggaagaggaagaggagcccggacuggucgaaggcgauccuggcgacggggcaaucgaggauccagaacuagaggcuauuaaggccagaguuagggaaauggaggaggaagcggagaaacucaaggaacugcaaaaugagguggaaaaacagaugaacaugagucccccgccuggaaaugccggucccguaauaaugagcaucgaggagaagauggaagcagacgcucgguccauuuaugugggcaacgucgauuacggggccaccgcugaggaacuugaggcccauuuccacggaugcggcucugugaaucgcguuacaauccugugugacaaauuuucgggucauccaaagggguucgcauauauugaguuuucagauaaggaaagcgugagaacgaguuuggcccucgacgagucccuguucaggggccggcagaucaaagucauaccuaagcgcacuaaccgacccggaaucucuaccacagauagaggcuuuccaagggcucgguaccgugcgcgcacuaccaauuauaacagcuccagaucaagguucuacaguggguuuaauagccggccccgaggacgcguguauagagguagggcacgggccacaucuugguacuccccuuacuga

SEQ ID NO: 60300 - RNA, 774 nt, Artificial Sequence
  derived and/or modified sequence opt3 from PACRG__Homo_sapiens__NP_001073848
augguggccgagaaggaaacccugagccucaacaaaugccccgacaagaugccuaaaagaacaaaacuucuggcucagcaaccauugccgguccaccagccccauuccuuaguuucugagggcuucacugugaaagcaaugaugaaaaauucaguagugagggggccuccagccgcgggagcuuuuaaggaacggcccacgaagccuaccgccuuccgcaaguuuuacgagcgaggugauuucccaaucgcacuggaacacgacaguaaaggcaacaagauugccuggaaagucgagauagagaagcuagauuaucaucacuaccucccccuguuuuucgacgggcuuugugaaaugacauuuccuuaugaguucuuugcucgucagggaauccaugauaugcuggaacacggcgguaauaagauuuugccagugcucccgcagcugaucauucccaucaaaaacgcacugaaucucagaaacaggcaaguuauaugcgugacuuuaaagguccugcagcaccuugugguaagcgccgagaugguugggaaggcuuuggugccuuacuaucggcagauccugccaguccuaaauauuuucaagaacaugaaugugaacuccggagacggcaucgauuacucucagcaaaaacgcgagaauauuggcgaccucauccaggaaacccuggaggccuuugaaagauaugggggagagaacgcguucauaaauauuaaguacgugguccccacauacgaaucgugucuucugaacuga

SEQ ID NO: 60301 - RNA, 2892 nt, Artificial Sequence
  derived and/or modified sequence opt3 from PACS1__Homo_sapiens__NP_060496
auggccgagagaggcggggcuggagguggccccgggggagcaggcggugggagcggacagaggggcuccggcguggcccaaucuccucagcagccaccgccccagcaacagcagcagcaaccuccacagcagcccaccccuccaaagcuggcgcaggcuacaucaaguagcuccucuacuucggccgcagccgcuucaagcaguuccucuagcacguccaccucaauggcagucgccguugcuagugggagcgcgcccccuggagguccaggcccggggcggacacccgccccugugcaaaugaaccucuacgcaacuugggaaguagaccgcucauccucaagcugcgugccacgacuuuucagucugaccuugaaaaaguuagucaugcugaaagagauggauaaggaccuaaauucugugguuaucgccgugaaacuccagggauccaagcguauucugagaagcaacgaaauaguccuucccgcuucgggccugguggagacagaauugcagcucaccuuuucucugcaauauccucacuuccugaagagggaugccaauaaacuccagaucauguuacagcggcgcaagagauacaaaaacaggacuauucuggguuauaagacacuugcaguaggguugaucaauauggcugagguuaugcagcauccaaacgagggagcccuggugcuaggccuccacuccaaugucaaagacgugucagugcccgucgcggaaauuaagaucuacagucugagcucccaaccgauagaucaugagggcaucaagucuaaacuuagcgaccggucaccugauauugacaacuauagugaagaggaggaagaguccuuuagcucugaacaggaggggucagaugacccccugcacggacaggauuuguucuacgaagacgaggaucuccgcaagguuaaaaagacccgaagaaaacugacgaguacuagcgccaucaccaggcagccaaauauuaagcaaaaauuuguggcauuacugaagcgguucaagguauccgacgagguggguuuuggccucgaacaugucucucgugagcagauccgcgaaguggaggaagaccuugaugagcuguaugacucguuggagauguacaacccuagcgauuccgggcccgaaauggaggaaacagagucaauacuaaguacuccaaaacccaagcugaaaccuuucuuugaaggaaugucucagagcuccucacagaccgagauuggcagccucaauucuaaggguucccuggggaaagacacaaccaguccaauggagcuugcugcccuggaaaagaucaagagcacguggauuaaaaaccaagaugacucuuugacugagacagauacccucgaaaucacugaccaggauauguucggcgacgcuuccacaucacugguugugccggagaaggucaaaacccccaugaagaguagcaaaacggauuuacagggaucggccuccccuucuaagguggagggcguacacaccccaagacagaagaggagcacaccccugaaagaacggcaacuaucaaagccucucagugagcgaacuaauuccucugacagcgaacgcuccccagaccuggggcacucaacccagauccccagaaaaguuguguacgaucagcuuaaccaaauuuuggucagcgacgcagcccugccggagaaugugauacucgucaacacaacugauuggcagggacaguauguggcugaacugcuucaggaccaaaggaagccuguuguguguaccugcaguacaguagagguccaggcggugcugucugcauugcucacccggauccagcgcuacuguaacugcaauuccagcaugccaagacccguuaaaguggccgcugucgguggccagucguaucugucaucuauuuuaagguuuuucgugaagagucuggccaacaagacuuccgauuggcuaggguacaugcguuuucucaucauaccucugggaagccaucccguagcaaaauaucuuggcucuguggacagcaaguacuccucaaguuucuuggauagcgguuggcgggaccuguucucucgauccgagccaccuguuucagaacaacucgaugucgccgggagagugaugcaguaugugaauggcgcugccacgacacaccagcugcccgucgcagaggcgauguuaaccuguaggcauaaauuuccagacgaagauaguuaccagaaguucauuccguuuaucggaguugugaaagugggccugguagaggacagcccuuccacugcuggggauggagacgacucucccgucgugucgcuuaccguuccaagcacaucacccccuuccaguucugguuugagccgcgaugccaccgcaacuccacccuccucaccuucuaugagcagugcccucgcuaucgugggcuccccgaacagcccauacggggacgucauuggacugcaaguggauuauuggcuaggccaccccggugaacggagaagggagggggacaagcgcgaugccucuucuaaaaauacacugaaguccguuuuccgaagugugcagguaagccggcucccucacucgggcgaggcacagcugucuggaacgauggcuaugaccgucgugacuaaggagaaaaacaagaaagugccaacaaucuuucuuuccaagaaaccccgugaaaaggaagucgacagcaagucacaaguuauugagggcauaaguagauugaucugcucugccaaacagcagcagaccaugcugaggguguccauugaugggguagaauggagcgacaucaaguucuuucaauuagcggcccaguggccuacacaugugaaacacuucccggucggacucuuuucaggcaguaaggcuacuuga

SEQ ID NO: 60302 - RNA, 2715 nt, Artificial Sequence
  derived and/or modified sequence opt3 from PACS2__Homo_sapiens__NP_001094383
auggccgagagaggcaggcuggggcuccccggagcuccuggugcacuuaacaccccagugccgaugaaucuguucgccacaugggaagucgacggcagcucccccucuugcguuccucgguuguguucauuaacucugaagaaacuggugguauuuaaggagcucgaaaaagagcugaucaguguggucauugcggugaagaugcaggggagcaaacgcauacuucgaucccacgaaaucguucugccacccucuggacaaguggagacggauuuggcucucaccuucucgcugcaguacccucauuuucugaagcgugagggcaacaagcuccagauuauguuacagagaaggaaacgguauaagaaucgcacaauccuggguuacaaaacucuugccgcagggucaauuagcauggccgaagucaugcaacacccaagugagggaggccagguguugucccugugcucuagcaucaaggaagcucccguaaaagcagccgagauauggaucgcuucccuaucaagucagccuauugaccaugaggauagcaccaugcaggccggcccaaaggcgaagucuacagacaacuauuccgaagaggaauacgagucauucagcagugaacaagaggcaucugaugacgccguucaggggcaggaucucgacgaggaugacuuugaugugggaaaaccgaagaaacagagaagguccaucguccggaccacuagcaugacacgccaacagaauuucaagcagaaagugguggcucugcuucgaagauuuaaggucucggacgaaguucuggauucugagcaagaccccgccgaacacauuccugaggcagaagaggacuuggaucuccuguaugacaccuuagauauggagcauccauccgacucaggucccgauauggaagacgaugacagugugcugagcacgccuaaaccaaagcucaggcccuacuucgagggccuuucccacucuagcucacagacugaaaucgggaguauacacuccgcucggagccauaaggagccgccuucucccgccgauguaccagagaaaacccguucacugggaggccgccagccuagugacagcguguccgauacagucgcguugggugugcccgggccaagagaacaccccggacagccugaggacucuccagaagccgaggcaucgacucuagacguuuuuaccgaaaggcugccgcccagcggccggauuacaaagaccgagucccucgugaucccuucaacgcgaagugagggcaaacaagcugggcgcagaggaaggucuacuagccugaaggaacggcaggccgcucgcccacagaacgagagagccaauucccuugauaacgaaaggugucccgacgcacguucacagcugcaaguccaguugcagauuccucggaaaacaguguaugaucagcucaaucauauccugaucagcgacgaucaauuaccagagaacauuauacugguaaauaccucugacuggcagggucaguuccuauccgauguucuccagcgacacacucugcccguggucugcacauguaguccggccgacgugcaagcugcguuuagcaccaucgucucuaggauucagagauacugcaacuguaauucccagccuccaacgcccgugaagaucgcaguugccggcgcucaacacuaccuuucagccauauugcgccuguucguggaacagcucagucauaagaccccugauuggcugggguauaugcgguuucuuguaauuccccugggaagccacccagucgcaagauacuugggcucgguggacuauagguacaacaauuucuuccaggaucucgccuggcgcgaccuguuuaacaaauuagaggcucaguccgccguucaagauacaccugacaucgugucucgaaucacucaguauauugcgggugcaaacugcgcucaucagcugcccaucgccgaggcaaugcuaaccuacaagcagaaacggaagaaacacuuccauuuugacuucacacucagcccagaugaagagucaagucaaaaguuuauuccguucgucggggugguaaaggugggcauaguugaaccuuccucugccacuagcggagacuccgaugacgcugcccccucaggcagcgggacccugaguucuacaccacccuccgcaagcccugcugccaaagaggcgucgccaacucccccuucaucuccgagugucuccggaggucuuagcucuccaagccagggcgugggggccgaauugaugggacuacagguggauuauuggaccgcugcacagcccgccgaccguaagagagaugcugagaaaaaggaccucccugucacgaaaaauacacugaaguguaccuuuagguccuuacaaguuucacgccugccaaguagcggcgaggccgcagcgacucccaccaugucuaugacaguggugaccaaggagaaaaacaagaaaguaauguuccuuccuaagaaagccaaggauaaagacgucgaauccaagucacagugcaucgaagguauuagucgguugaucuguacugcuagacagcaacagaauaugcucagggugcugaucgaugggguugagugcagcgacgugaaguuuuuccagcuagccgcacagugguccucucacgucaaacacuuuccgauuugcauauucggccauucgaaggcuacauuuuga

SEQ ID NO: 60303 - RNA, 1335 nt, Artificial Sequence
  derived and/or modified sequence opt3 from PACSIN1__Homo_sapiens__XP_011512843
augagcuccucuuacgacgaggccucacuggcucccgaagagaccacagauaguuucugggaagugggcaacuauaagagaacugucaaaaggaucgacgaugggcaccggcucugcaaugaccuuaugaacuguguucaggagcgcgcaaagauugaaaaagccuacggacaacagcugacggauugggcgaagcgauggcgucaguugauagagaaagguccucaguauggcagcuuagagagagcuuggggagccaucaugaccgaagcagacaagguguccgagcugcaucaagaaguaaagaauaaccuacucaaugaggaucuggagaaagugaagaacuggcagaaagacgccuaccacaagcagauuaugggcggguuuaaagaaacaaaggaggcugaagaugguuucaggaaggcacagaaaccaugggccaagaaaaugaaggagcuugaagcugccaaaaaggcguaucaucuggcaugcaaagaggagaaguuggccaugacucgggaaaugaacucuaagaccgagcaaucggucacaccggaacagcagaaaaagcuccaggacaaaguggauaaguguaaacaagacguucagaagacccaggagaaguacgaaaaagugcuggaggaugucgggaagacuacaccccaauauauggagaauauggaacagguguuugagcagugccagcaauucgaagagaaacgccugguauuucucaaggaaguuuuacuggacaucaaaagacaccuuaauuuggcugagaacucaagcuacauucauguguacagggagcuggaacaggccauccggggagcagacgcucaggaggaucuacgcugguuccgaaguaccuccggcccuggcaugccaaugaauuggccccaguuugaagaguggaacccugaccucccacacacgacuaccaagaaggagaaacaacccaagaaagccgaaggggucgcgcugacaaaugccacuggagcaguggagucuaccagccaggcuggugauagaggcuccgugucaaguuaugacagggggcagccuuacgccacagaauggagcgaugacgagucuggaaacccauucggcgguuccgaaaccaaugggggagcuaacccguuugaggaugacucaaagggcguccggguucgugcccuuuaugauuacgacggccaggagcaagaugaacugagcuucaaagcaggggacgaguugacgaagcucggagaagaggacgaacaggguuggugucgcggcagacuggauagugggcaguuaggacuguaucccgccaacuacguggaggcuauauga

SEQ ID NO: 60304 - RNA, 1461 nt, Artificial Sequence
  derived and/or modified sequence opt3 from PACSIN2__Homo_sapiens__NP_001171899
augagcgugaccuacgacgauuccgucggcguugaggugucuucagacaguuucugggaaguagggaacuauaagagaacagugaaaaggaucgaugacggacaccggcugugcagcgaucucaugaauugucuucaugagcgcgcccgaauugaaaaggcuuacgcacagcaacugacugagugggcccguagauggaggcaguuggucgaaaaagguccccaguauggcacgguggagaaggcguggauggcuuuuauguccgaggccgaacggguuucugaguuacaccuggaagugaaagcaucgcuaaugaacgacgauuucgagaagauaaagaauuggcagaaagaggccuuucauaagcaaaugaugggaggguucaaagaaaccaaggaggcugaagacggcuuucgcaaagcacagaagccuugggccaagaaacucaaggaggucgaagcugccaaaaaggcgcaccaugcagccugcaaagaggagaagcuggcuaucucaagagaagccaacagcaaagcagauccaagucuuaauccggagcagcugaagaaguugcaggacaaaauugaaaaguguaaacaagaugugcucaagacaaaagagaaguacgaaaagucccugaaagagcuggaccaggguacuccccaguauauggagaacauggaacagguauucgagcaaugccagcaguuugaagagaagaggcuccgguucuuucgcgaaguuuuacuggaggugcaaaaacaccuugauuugucuaaugucgcuggguacaaggccaucuaucacgaccuggagcagagcauucgagcggccgacgcaguggaagaucuaagaugguucagggcuaaccauggaccuggcauggccaugaauuggccacaguuugaggaaugguccgcugaccucaaccggacccugucacgucgcgagaaaaagaaggccacagauggcgugacccuuacugggaucaaucagacaggagaccaaagucugcccagcaaaccuucuuccaccuugaacgucccaucaaaucccgcacagagcgcccagagucagucuuccuacaacccuuucgaggaugaagacgauacggguagcacuguuucggagaaggacgauaccaaagcuaagaaugugucuuccuacgagaaaacacaaucauauccaacugacuggagugaugacgaaagcaacaacccguuuuccucuaccgacgcgaauggcgauagcaaccccuucgacgaugacgcaacaucagggaccgaaguaagagugagggcccucuacgauuaugagggacaggagcacgacgaacugaguuucaaggcuggcgaugaguuaacgaagauggaagacgaggaugaacaggguugguguaaagggcggcuggacaauggacaggucggccucuacccugccaacuauguggaggcaauacaauga

SEQ ID NO: 60305 - RNA, 1806 nt, Artificial Sequence
  derived and/or modified sequence opt3 from PADI4__Homo_sapiens__XP_011539452
auggcccagggcacccugaucagagugacacccgagcaaccuacucacgcugucugcguucucgggacgcuuacccagcuggacauuuguagcuccgcaccagaagauugcacaucuuucucaauaaacgccaguccgggagugguaguggacaucgcgcauggucccccugcuaagaaaaagagcacuggcuccucuaccuggccauuggaucccggggucgaggugacauuaaccaugaaaguugccucgggaucaacuggcgaccagaaggugcagauuagcuacuaugguccuaaaacaccacccgucaaggcacugcuauaccucaccgggguggaucugcaagacaugagucuuaugacgcuguccacuaagaccccuaaagauuucuucacaaaucacacuuugguacuccauguugccaggucugaaauggacaaggugcgggucuuucaggcuacccgcggaaaacugagcuccaaguguucaguggugcugggcccaaaauggccgagucacuaucucaugguccccggcgggaagcauaacauggauuucuacguugaggcauuagccuuuccugacacagauuucccaggacugaucacccuuacgauuagcuugcuggacacuucuaaucuagaacuccccgaggcugugguauuucaggauuccguggucuuccgaguggccccuuggaucaugacaccaaacacccagcccccgcaagagguuuaugcgugcucaauauuugaaaaugaggacuuccucaagagcgugacuacacuugcaaugaaagccaaguguaaacugaccaucugcccugaagaggagaacauggacgaucaguggaugcaggacgaaauggagauugguuacauccaggcuccccacaagacguugccagucguguuugauaguccucguaauagaggccucaaagaauuucccauuaagaggguaauggggccagacuuuggauauguuacccggggcccccaaacaggugggaucucuggacuggauuccuucggcaacuuagaggugagcccuccagucacugugcgcggcaaagaauacccgcuggggagaauacucuucggagacucguguuaccccucuaaugauuccaggcagaugcaccaggcccuucaagacuuucugucagcacagcagguccaggcuccugugaaguuguauagugauuggcuaagcguuggucauguggacgaguuccuguccuuuguaccagcccccgaucggaagggcuuccgccuccugcuugcgucuccucgaagcugcuacaaacuguuucaagagcagcagaacgaagggcacggagaggccuugcuguucgaaggcauuaagaaaaagaaacagcaaaagaucaagaauauucugucaaacaaaaccuuaagagagcauaauaguuuugucgaaagguguaucgacuggaaccgggagcugcuaaagcgugagcucggucuggcagaauccgacaucauugauauaccacagcuuuucaaauugaaggaguuuagcaaagcugaagccuucuuucccaauauggugaacaugcugguucucgggaagcaccugggcaucccgaagccuuucggaccagugauuaacggccgcugcugucuugaggaaaaagucugcucucuguuggagccccucgggcugcagugcacauuuaucaaugacuucuucacuuaucacauaagacauggagaggugcacugugguaccaacguaaggcggaagccuuuuucauucaaaugguggaauauggugcccuga

SEQ ID NO: 60306 - RNA, 543 nt, Artificial Sequence
  derived and/or modified sequence opt3 from PAEP__Homo_sapiens__NP_001018059
augcugugccuccuucugaccuugggcguggccuuagucugugggguucccgcuauggacaucccucagacaaagcaagaucuggagcuaccaaaacucgcaggaacuuggcacagcauggccauggcgacgaacaauauuucccugauggcuacccuuaaggccccgcugagagugcauauaacaucuuugcuccccacuccugaagacaaccuggagaucguacugcacaggugggaaaauaacucaugcguggagaaaaagguccucggugagaaaaccgagaauccaaagaaguucaaaauuaacuacacaguggcaaaugaggccaccuuacuggauacugacuaugauaacuuucuuuucuugugucugcaggacacaaccacgcccauccagaguaugaugugccaguaccuagcucggguucucguggaagaugacgagauuaugcaaggcuuuauccgcgcauuccgaccucugccacgucaucuuugguaucuguuggaucucaagcagauggaagaacccuguagauuuuga

SEQ ID NO: 60307 - RNA, 1458 nt, Artificial Sequence
  derived and/or modified sequence opt3 from PAF1__Homo_sapiens__NP_001243755
auggcccccaccauccagacacaagcucagagagaggacggccacaggagcgggguggucugccggguuaaguacuguaacucccugccugauauuccauucgacccgaaauuuauaacuuaucccuucgaucagaaucgcuuugugcaguacaaggcaacgucucucgaaaaacaacauaagcacgaccuucugaccgagccugauuugggaguaacaaucgacuuaauuaacccagauacuuaucgaaucgaccccaaugugcugcuagauccugccgacgaaaaacuccuggaggaagagauucaggcgccaaccucaaguaagcguagccagcagcaugcuaaggucgugcccuggaugagaaaaacagaguacaucuccaccgaguucaacagguaugguauaucuaaugaaaagccugaaguuaaaaucggcgugucggucaagcaacaguuuacugaggaggaaauuuacaaagaucgggacucacagaucacagccauugagaagaccuucgaagaugcacaaaagagcaucagucagcacuauuccaaaccacgcgugacgccgguagagguuaugcccguguuuccugacuucaagauguggauaaacccaugcgcccaggucauuuuugacucugaucccgcuccuaaagacacuagcggggcagccgcucuugaaaugaugucccaggccaugaucagaggaaugauggaugaggagggcaaucaauucguggcguacuuucugccaguggaagagaccuugaagaaaaggaagcgggaccaggaagaggaaauggauuacgcacccgacgaugucuaugacuacaaaauugcccgcgaguauaacuggaauguuaagaacaaggcuucaaaagguuacgaggaaaauuauuucuuuaucuuccgagagggggauggaguguacuauaacgaacucgagacaagaguaaggcugaguaagcggcgugccaaagcaggcgugcagagcggcacuaaugcucugcucgucgugaagcaucgcgacaugaacgaaaaagaguuagaggcccaggaagcgagaaaggcccaacuggagaaucacgaaccggaggaggaagaggaagaggaaauggagaccgaggaaaaggaggcagggggaucuguuaugcuuaucuugaggacaaugccuacccugaugaugcggacggaagaucgacccaaaguggcugucacuaugauucagacagccgcugccauggguguggcauccggcgccggggcuaccgcggcagccccaguaccuucacccguugcugccagcacucgcccaagaaggauggcagugaagcuacagcuccugauacccgucaaacuuaucgugacagucaccgagagucagggcauucaaggaugguuccggcaccauuacugugaacagcagucuacguuucuggugguuugcuuguga

SEQ ID NO: 60308 - RNA, 1233 nt, Artificial Sequence
  derived and/or modified sequence opt3 from PAFAH1B1__Homo_sapiens__NP_000421
auggugcugagccagagacaaagggacgagcucaaccgggccaucgcugauuaccuucgcuccaauggcuaugaagaggcauacucugucuucaagaaagaagccgagcuggacguuaacgaagaguuggauaagaaauaugcgggguuacuggagaagaaauggaccucagugauucgacuacagaagaagguaauggaacucgagaguaaacugaaugaagcuaaggaggaguuuacaagcggagguccccuuggccagaaacgugacccuaaggaauggauaccaagaccgcccgagaaauacgcccuguccgggcacaggucuccugugacucgggucaucuuccauccaguguuuucgguuauggugucagcaagcgaagaugccacgauuaaggucugggacuaugagaccggagauuucgaacgcacauugaagggccacacugacagugugcaggauaucuccuuugaccauucugguaaacuccuggcuagcugcuccgcagauaugaccauuaagcugugggacuuccaaggguuugaguguaucagaacaaugcacggacaugaucacaacguaucaaguguugccauaaugcccaauggcgaccacaucgugagcgcuucuagggacaaaaccauuaagaugugggagguccagacuggcuacugcgugaaaacauucaccgggcaucgggaaugggugcgcaugguccgaccuaaccaggauggaacgcucaucgccuccuguucaaaugaccagacuguuagaguguggguaguggcgaccaaggagugcaaagcagaauuaagggagcacgaacaugucguggaguguauuagcugggccccagagaguucuuauuccagcaucucggaagcuacagguucugagacuaagaaguccggcaaacccgggccuuuucugcuuucaggaagucgggauaagaccauaaaaaugugggacguuagcacaggcaugugcuugaugacccuggugggucacgauaacuggguccguggggugcuauuccacuccggaggcaaguuuauucucucuugugccgacgauaaaacgcugcgcguaugggacuacaagaauaagagaugcaugaaaacucuuaacgcacaugaacacuucguuacaagccuggauuuucauaagaccgcuccauacguggucacuggcucaguggaccaaacagucaaagugugggaguguagguga

SEQ ID NO: 60309 - RNA, 609 nt, Artificial Sequence
  derived and/or modified sequence opt3 from PAFAH1B2__Homo_sapiens__NP_001171675
augagccagggcgacuccaaccccgccgcuaucccucacgcagccgaggauauucagggggacgauagauggaugucucagcauaauagguucgugcuggacugcaaggauaaagaaccagacguccucuuuguuggagauucaauggugcagcuuaugcagcaauacgagauauggcgggaacuguucaguccguugcacgcguuaaacuuugguaucggcggggacaccacacgccauguacuguggcgacuaaagaauggagagcucgaaaacauuaaacccaaggugaucgucguguggguuggcacuaauaaccacgagaauacggcugaggaaguggccggugggauugaggcaaucguccagcugauaaacacccgucagccucaggccaaaaucauugugcuuggaaaggcugcagccagcaaguauuccaucucugaaauuguaagacuggagcaaggcucgguuaauuggucaaucggcacauacccagaugacacucccgcuaccacaaggccugccauauugcaacucuucaccgggaaaaugagccggauuacuaugaaggagaaaagucgcuggacagaagagauccugcauuga

SEQ ID NO: 60310 - RNA, 1251 nt, Artificial Sequence
  derived and/or modified sequence opt3 from PAFAH2__Homo_sapiens__XP_011539830
augaccguggcccccagcgucuccgccucuaaguucucaaguggcaagagcuuugacuccccuggggaugagaugggaguuaaccagucuguggguuucccaccgguaacaggcccccaccugguggggugcggagacgucauggaaggccaaaaucuccaggguucguuuuucagacuuuucuacccuugucagaaagcagaggaaacuauggagcagccacuguggauccccagguaugaauacugcacgggguuggccgaguauuuacaauucaacaaacgguguggaggccugcuauuuaaucucgcggugggcucaugccgccugccuguuagcuggaacgggccauucaagaccaaagauaguggauacccccuuauuauauuuucccauggucugggcgcuuuccgaacauuguauucugccuuuuguauggagcucgcaagccguggguucguggucgccgugccugaacacagagacagguccgcugcaacuaccuacuuuugcaagcaggccccagaggaaaaucagccgacaaacgagucacugcaggaggaauggauccccuuccggcgcguagaggaaggagagaaggaauuucauguuagaaauccucaagugcaccagagggucagugagugucugcgggugcucaaaauuuuacaggaggugaccgcuggccagacugucuuuaacauccugccaggugggcuugauuugaugacacugaagggaaauauugacaugagccgcguugccgugaugggccauucuuucggcggggcgaccgcaauccuagcccucgcuaaagaaacgcaauuucgaugcgccguagcacuggaugcuuggauguucccccuugagagagacuuuuauccuaaggccaggggaccaguguucuuuauaaacacugaaaaauuccagaccauggaguccgucaaucugaugaagaagaucugugcgcagcacgaacaaucacggauuaucacaguguuggguagcguucaccguagucagacugauuuugccuucgugaccggcaaccucauugggaaauuuuucucuacagagacccgcggaucccuggaccccuacgagggccaggaagucauggugagagcaauguuagcuuuucugcagaagcaucucgaucuuaaagaggacuacaaucaauggaacaaucugaucgaagguauagggccgagcuugacgccuggcgcuccccaccaucuaucgucucuguga

SEQ ID NO: 60311 - RNA, 1299 nt, Artificial Sequence
  derived and/or modified sequence opt3 from PAG1__Homo_sapiens__XP_011515867
augggccccgccgggagccugcucggauccggucagaugcaaaucacccuuuggggcucucuggcugcaguggccauuuucuuugucauaacauucuugaucuuuuuaugcucaaguugugacagagagaagaaaccuaggcagcacagcggggaucaugaaaaccugaugaauguuccauccgacaaggagauguucucucggucggugacuucacuagcgacggaugcuccggccagcagugaacagaacggagcacucaccaauggcgacauucuguccgaggauucuacacuuacuugcaugcagcacuacgaagagguacaaaccagcgccuccgaccuguuggauucacaggacaguacagguaaacccaagugucaucagagccgcgagcucccucgaaucccacccgaaucugcuguggauaccaugcugacugcacguuccgucgacggggaucagggacugggcauggagggcccuuaugaagugcucaaagacucaagcagucaagagaacaugguugaggauugcuuauacgaaacagugaaggagauuaaggaagucgccgcugccgcgcaccuggagaaagggcauucuggaaaggcaaaauccaccagcgccucgaaggaacuuccagguccccagacggagggcaaagcugaguuugccgaauaugcaucuguggacagaaauaagaaguguaggcaguccguaaacguugagucaaucuuggggaauaguugcgacccugaagaggaagcuccaccgcccgugccugucaaacugcuagaugagaacgagaaucuccaggaaaaggagggaggcgaagccgaggaaagcgcgacugacaccacauccgagacuaacaaacgguucucuagccugucauacaagagucgcgaggaagauccaacccuuacagaggaagagauauccgccauguauagcucugugaauaaacccggucaacuggugaacaagucagggcagaguuugaccgucccugagagcacguacacuuccauccagggagacccacaaagaucucccucgagcuguaaugaucucuaugcaacaguuaaagacuuugaaaagaccccgaacuccacucugccucccgcuggcaggccaucagaggaaccugagcccgauuacgaagccauucagacauuaaaucgggaggaggaaaaggcuacccugggcacgaacgggcaccacggacucgugccaaaagagaacgacuacgaaaguaucucugaucuucagcagggucgcgacauuacccgacuguga

SEQ ID NO: 60312 - RNA, 441 nt, Artificial Sequence
  derived and/or modified sequence opt3 from PAGE1__Homo_sapiens__NP_003776
augggcuuccugagaaggcucaucuaccggcgccgacccaugauuuauguggagagcuccgaagagucuucagacgaacagccugaugaggucgaaaguccaacccaaagccaggacuccacaccggccgaggagcgugaagaugagggggcuucugcagcccagggacaggaacccgaggcggacucgcaagagcuuguucagccuaagacugguugcgaacugggcgaugggccagacacgaaaagaguguguuugaggaacgaggaacagaugaaguuacccgcugagggaccugaaccagaggccgauucacaggagcaaguacaccccaaaaccggcugcgaacggggugacgggccugaugugcaggagcugggacuaccaaauccggaagaggucaagacacccgaagaggacgagggccagagccagccuuga

SEQ ID NO: 60313 - RNA, 309 nt, Artificial Sequence
  derived and/or modified sequence opt3 from PAGE4__Homo_sapiens__NP_008934
augagcgccagagugaggucccggucucgcggccgaggggacggacaggaggcucccgaugucguugcauucguggccccuggugaaucacaacaggaggaaccaccgaccgacaaccaggauaucgagcccggccaggaacgugaggggacaccuccaauugaggaaagaaagguagagggagacugccaagaaauggaucuggagaaaacuaggagugagcggggcgacgguagcgaugugaaggagaaaacgcccccuaauccaaagcacgcgaaaaccaaggaagcuggggacggacagcccuga

SEQ ID NO: 60314 - RNA, 333 nt, Artificial Sequence
  derived and/or modified sequence opt3 from PAGE5__Homo_sapiens__NP_001013453
augagcgagcacgugaccagaucccagucuucagaaaggggcaacgaccaagagaguagccagcccgucgggccuguuaucgugcagcagccaacagaagagaagcggcaagaagaggagccgcccacugauaaucagggaauugccccuuccggugaaaucaaaaacgagggcgcuccagcaguacaggggacggacguggaagccuuccagcaagagcuggcgcuccuuaagauagaggaugcucccggagacggcccugauguccgcgaagguacccugccaacauuugaccccacuaaaguguuggaggccggggaaggacaguuauga

SEQ ID NO: 60315 - RNA, 765 nt, Artificial Sequence
  derived and/or modified sequence opt3 from PAGR1__Homo_sapiens__NP_078792
augagccuggccagaggccacggggacaccgcugcauccacagccgcgccccucucugaggaaggagaggugacuucaggucuucaggcucuggccgucgaagauacgggcgggccuagugcaagcgccggaaaggcugaggacgaaggcgagggugggagggaggaaaccgagcgggaaggauccggcggcgaggaggcacaaggggaaguuccaucugccggaggugaggaaccggcugaggaagauucggaggacuggugcgugcccuguucagaugaggaaguagaguugccugccgacggccagccauggaugcccccuccaagcgaaauccagcgcuuauacgagcugcuagcggcacaugggacacucgaacugcaggccgagauucuuccccgacguccuccaacuccggaggcucaaagugaagaggaaagauccgaugaggaacccgaggccaaagaggaagaggaagagaagccucacaugccaaccgaguucgacuuugaugacgaacccgugacaccuaaagauucucugauagacaggcggcgcaccccaggaagcuccgcaagaucacagaagagggaggcucgguuggauaaaguccucagugacaugaagcgccauaagaaacuggaggaacagauccugcgaacuggcagagaccucuucagcuuagauucugaagaccccuccccggccucaccuccccugaggagcagugguucuucccuuuuuccacggcagcguaaguauuga

SEQ ID NO: 60316 - RNA, 1359 nt, Artificial Sequence
  derived and/or modified sequence opt3 from PAH__Homo_sapiens__NP_000268
augagcaccgccgugcuggagaaccccggccucgggagaaaguuguccgacuucggacaggaaacaucuuacaucgaggauaauugcaaccaaaauggugcuauuucacugauauuuaguuugaaagaagaggucggcgcauuagccaagguucugaggcuauucgaagagaacgacgugaaucucacucacaucgagagccggccuucccgccugaaaaaggaugaauaugaguuuuucacgcaucuugacaaacgaucucugccagcguugaccaacauuaucaagauucuccgucacgauaucggggcuacaguacaugaacugucgagagacaagaaaaaggauacugugccgugguuucccaggaccauacaggagcuggaccgguucgccaaucagauccucucauacggagcagaguuagaugccgaccacccuggcuuuaaagauccagucuaucgcgcuagaaggaagcaguucgcagacauugccuacaacuaucggcauggucaacccaucccucgcguggaauacauggaggaagagaaaaagacaugggggaccguuuuuaagacucugaaaagccuuuauaagacacacgcuuguuacgaauacaaucacauuuucccauugcuggagaaauauugcggauuucaugaggauaacaucccccagcuagaagacgugagucaguuccuccagaccuguacgggcuuucgacugagaccugucgccggccuucuguccucuagggacuuccuugggggacucgcguuccggguguuucacugcacucaauacauacgucaugguagcaagccaauguauaccccggagcccgauauuugucacgaacuguuaggccacguaccucuguucuccgaccgcucauuugcacaguucagucaggagaucgggcucgccagccuuggagcuccagaugaauacauugagaaacuggccacaaucuauugguuuacuguugaguucggcuugugcaagcagggugacucuaucaaagcauacggggcuggacuacuguccucauuuggcgaacuccaauauugucugagcgagaagcccaaacuucugccuuuggaacucgagaagaccgccauucagaauuacacagugaccgaguuccagccacuguacuaugucgcggaaaguuuuaacgaugccaaggagaaagugagaaauuucgcagcuacgauacccaggccguuuucugugcgguacgacccuuauacucaacgaaucgaagucuuagauaacacacagcagcugaagauucuagccgacuccaucaauagcgagauaggcauucucugcucggcucugcagaaaaucaaguga

SEQ ID NO: 60317 - RNA, 1278 nt, Artificial Sequence
  derived and/or modified sequence opt3 from PAICS__Homo_sapiens__NP_001072992
auggccaccgcugaggugcugaacaucggcaagaaacucuacgaagggaagacaaaagaggucuaugaacuucuggacagccccggaaagguuuuguuacaguccaaagaucaaauuacugcagguaaugccgcgagaaagaaccaccuggagggcaaggcugccauaucuaauaaaaucacgucaugcauuuuccagcuacuccaggaagcagggaucaagaccgccuuuacaaggaaauguggagagacugcuuucauugcaccucagugcgagaugaucccaauagaaugggugugucggcgcaucgccaccggcaguuuucugaagcgaaacccggguguaaaagagggguacaaguucuaucccccuaagguggaacuguuuuucaaagacgaugcuaauaacgacccacaauggagcgaggagcagcuuauugccgcgaaguuuugcuucgcaggauugcucaucggccagacagaagucgauauuaugucccaugccacccaggcuaucuuugagauacuggaaaaaucuuggcugccccaaaauuguacucucguggacaugaagauugaguucggcguugaugugacaaccaaagaaaucgucuuagccgacgugauugauaacgacucguggcgucuguggccuucaggggauagaagccagcagaaggacaaacagaguuacagggaucuuaaggagguaacgccagagggauugcaaaugguuaagaaaaauuuugaauggguggcagagcgggucgaacugcuacucaaguccgagucucagugccgcguggugguccugauggguagcacuuccgaccuuggccacugugagaaaaucaagaaggcuugcgggaacuucggaauccccugugaacugagaguuaccucagcccauaaaggcccugacgagacauugaggauuaaggcggaauaugagggugaugggauaccaacuguguuuguagccguggcaggacggaguaauggccucggcccggucaugagcgggaacaccgcuuaccccgugaucucuugcccuccacugacacccgacuggggaguucaggaugugugguccucauuacgccugccuagcggucucggcuguaguaccguccuuucuccagaaggguccgcccaauucgcugcccagauuuucggacugagcaaucacuugguguggucgaaacuacgagcaucuauccugaacacguggauaucccucaagcaggccgacaaaaagauuagagagugcaaucuguga

SEQ ID NO: 60318 - RNA, 1440 nt, Artificial Sequence
  derived and/or modified sequence opt3 from PAIP1__Homo_sapiens__NP_006442
augagcgacggcuucgauagagcccccggggcuggaaggggucggucccgcggccuggggcgaggaggcggugggccugagggaggcggcuuuccaaacggggcaggaccggccgaacgugcgagacaccagcccccucaaccaaaggcucccgguuuccuccagccuccaccccuuaggcagccucggaccacaccaccgcccggcgcccagugcgaggugccugcaucuccacaacgccccucaagaccuggggcccugccagaacagacuaggcccuugcgggcuccgccuaguagccaggacaaaaucccccagcaaaauuccgagucugcaauggccaagccacaggucguuguggcuccuguauuaaugucgaaacugucagugaacgcccccgaauuuuacccaagcggauauaguuccucuuacacggagagcuaugaggauggcugugaagacuaccccacccuauccgaguauguccaggauuuccucaaucaucugacagaacagccugguucauuugagacugagauugaacaauucgcggagacccuuaacgggugcgugacaaccgacgaugcacugcaggaauugguugagcucauauaccagcaagccacaaguaucccaaauuuuagcuauaugggagcucgccuguguaacuaccugucucaccaucucacuauuuccccgcagucaggcaauuuccgacaguuacugcuucagagaugcaggaccgaauacgaggugaaggaccaagccgcaaaaggcgaugaggucacgcggaagcguuuucacgcuuucguguuguuucugggggaacuauaucucaaccuggagaucaagggaacuaauggucagguaacccgcgccgacauucuucagguuggccugagagaauugcucaacgcgcuguucagcaaucccauggaugacaacuuaaucugugccgugaaacugcucaaacuuacagggaguguccuggaggaugcauggaaggaaaagggaaaaauggacauggaggagauaauccagaggauugaaaaugugguguuggacgcuaacugcucucgggaugucaagcaaaugcuacugaagcucguugagcugcgauccagcaauuggggccgcgugcaugccacuucgaccuacagagaagcuacaccugagaacgacccaaacuauuuuaugaaugaacccaccuucuacacgucugaugguguaccuuucacugccgcagacccagauuaucaggagaaauaccaggagcuucuggaaagggaggacuuuuuccccgauuaugaagagaacgggacagacuuguccggcgccggagauccguaccucgacgauaucgacgacgagauggauccugaaauugaggaggcuuacgaaaaguuuugucuggaaucagagcggaaacgcaagcaguga

SEQ ID NO: 60319 - RNA, 384 nt, Artificial Sequence
  derived and/or modified sequence opt3 from PAIP2__Homo_sapiens__XP_011541730
augaaggaccccagcagauccucuaccucaccuaguaucauuaacgaggaugugauaaucaauggccacagccaugaagacgauaacccauucgccgaguacauguggauggaaaaugaggaagaguuuaacaggcagauugaggaagaacugugggaagaggaguucaucgaacggugcuuucaagagaugcucgaagaggaagaggagcacgaaugguucauuccggcucgcgaccuuccccagacaauggaucagauccaggaccaauuuaaugaucuggucauauccgacgggucuucguuggaggauuuaguugugaaaucaaaccugaauccuaacgcaaaggaguucguaccaggagugaaauaugguaauaucuga

SEQ ID NO: 60320 - RNA, 1638 nt, Artificial Sequence
  derived and/or modified sequence opt3 from PAK1__Homo_sapiens__NP_002567
augagcaacaauggccuggacauccaggauaagcccccugccccaccgaugagaaacaccuccacaaugauuggggcuggaucuaaagacgcagguacucucaaucacggcucaaagccccuuccuccaaaccccgaggagaaaaagaaaaaggauagguucuaccggaguauacugccuggggacaagacgaauaaaaagaaagaaaaggaacgcccagagaucagcuugcccuccgauuuugaacauaccauucacgugggauucgacgccgucacaggcgaguuuacugguaugccugagcaaugggcgcgauuacugcagaccucuaacaucacaaaaucggaacagaagaagaauccacaggcuguucuagaugugcucgaguucuauaacagcaaaaagaccucaaauagucaaaaauacauguccuuuacugacaagucugccgaagauuauaacagcuccaaugcacugaacguaaaagccgugucagagacaccggcugugcccccugucagugaggacgaagaugacgaugacgacgaugcaaccccacccccuguuauugccccacgucccgagcauaccaagagcguguacacuagaucugucaucgaaccgcuuccugugacccccacaagggacguagcuacuuccccaauaucaccuaccgagaauaacacaacgcccccagaugcccugacgcggaauacugaaaaacagaagaagaaacccaagaugagcgacgaggagaucuuggaaaaacuccgcaguauuguuucugugggggauccuaagaaaaaguauacaagauucgagaagaucggacagggcgcguccggcaccgucuacacugcaauggacguggccacagggcaggaaguggcuauuaaacaaaugaaccugcagcagcagccaaagaaagagcugaucauaaacgaaauucucgucaugagggagaauaagaacccgaauaucguuaacuauuuagauagcuaccuggugggagacgagcuuuggguagugauggaauacuuggccgguggcucgcugaccgaugucgugacggagaccugcauggacgaagggcaaauugcagcuguuugucgggagugccuacaggcccucgaauuucugcacucuaaucaggugauccaucgcgauaucaaauccgacaacauucuucugggaauggacggcucagucaaguugacagauuucgguuuuugugcgcaaauaacucccgagcagaguaagcgaagcaccaugguggggacaccuuauuggauggccccagagguaguuacuagaaaagcauacggacccaagguggacaucuggucccucggcauuauggcuaucgaaaugauagagggcgaaccuccauaucugaaugagaaccccuuaagggcccuguaccucauugcuaccaaugggacaccggagcuucagaacccugaaaaacugucugccaucuuccgggacuuuuugaaucguugccuagagauggaugucgaaaagcgcggaagcgcaaaagagcugcuccagcaccaauuccugaagaucgccaagccacuuucaagucugacccccuugauugcugcggcaaaagaagccacuaagaacaaucacuga

SEQ ID NO: 60321 - RNA, 1179 nt, Artificial Sequence
  derived and/or modified sequence opt3 from PAK1IP1__Homo_sapiens__NP_060376
auggagcugguggccggcugcuacgaacagguccucuucggguuugcuguucaccccgagccugaagcauguggagaccaugagcaauggacccuuguggccgauuucacacaccaugcgcacacugcuagccuguccgccguagcagugaacucuagauuugucgugacggguucaaaggacgaaaccauccauauuuaugauaugaaaaagaaaauagagcacggcgccuugguucaccauagugggacaaucacuugcuuaaaguucuacggaaauaggcaccugauuagcggcgcugaggacggucuaaucuguauuugggaugcaaagaagugggaaugccucaaguccaucaaagcccauaagggacaggugaccuuucugucuauacacccaucgggaaaacuugcucugucagucggcacagacaagaccuugcggacuuggaaccucguggagggccgcagcgccuucaucaaaaauauuaagcagaacgcgcacaucguagaauggaguccgcgaggggagcaguauguugugauuauccaaaauaagauagauauuuaccagcuggacacagcauccaucucuggaaccauuacgaacgagaaacguaucagcuccgucaaguuucugucagaaagugugcucgccguggcuggugaugaggaagucaucagauucuuugacugugauagcuuaguuugccugugugaguucaaagcccaugaaaauagggugaaggacauguuuucuuucgagauucccgagcaccauguaauaguguccgcaucaagcgauggcuuuaucaaaauguggaaacuuaaacaggacaagaaggucccuccaaguuugcugugcgaaauuaacacuaaugcucggcuaaccugucucgggguguggcuggacaaaguugccgauaugaaggagucucuucccccugcggccgaaccaucccccgugagcaaagagcagucgaagaucgggaaaaaggaaccuggcgacacaguccacaaggaggagaaacgcucuaagccaaacacuaaaaagagaggucugaccggggauuccaaaaaggcaacaaaggaaucaggauugauaaguaccaaaaagaggaaaaugguggagaugcucgaaaagaaacggaagaagaaaaagauuaaaacgaugcaauga

SEQ ID NO: 60322 - RNA, 1575 nt, Artificial Sequence
  derived and/or modified sequence opt3 from PAK2__Homo_sapiens__NP_002568
augagcgacaacggcgagcuggaagauaagcccccugccccaccggugagaauguccucuaccaucuucucaacagggggaaaagacccccucagugcuaaucacagccuuaagccucugccauccguccccgaggagaaaaagccuaggcauaaaauuauaucuaucuuuucggguacugaaaagggcucaaagaaaaaggaaaaagagcggccagagauuagcccaccuagugauuucgaacacacgauccauguuggguuugacgcagugaccggagaguucacaggcaugccagaacagugggcccgcuuguuacaaacuuccaacauuaccaagcuggagcagaaaaagaauccgcaggcgguacuagaugugcucaaguuuuacgacucuaacacagucaaacagaaguaucugagcuucaccccuccugagaaagaugguuuuccauccgggacucccgcucuuaaugccaagggaacagaagcacccgccgugguuaccgaggaagaggacgaugacgaagagacggcuccacccgugaucgcaccgcgaccugaucacacuaaaucaauauacacccguagugucaucgaccccgugccagccccuguaggcgauagccauguugacggcgcugccaagucucuggacaaacaaaagaagaaaacaaagaugacugaugaggaaauuauggagaaauugagaaccaucguguccauuggggaccccaagaaaaaguauacaagguacgaaaagaucggacagggugcgucaggcaccgucuucacggcaacugauguggcccucgggcaggagguggcuauaaaacagauuaaccugcaaaagcagcccaaaaaggaacugaucauuaaugagauccucgucaugaaagaguuaaagaaccccaauaucguuaacuuucuggacagcuaucuugugggagaugaauuguucguagugauggaguaccuggccggcgguagucuaacagacgucgugaccgaaacuugcauggaugaggcacagauugcugccguuugucgggaaugccuccaggcgcuggaguuucuucacgccaaucaagugauacaccgcgacaucaagucugauaacguccuguuggggauggagggauccgugaaacucacagacuucggcuuuugugcacagauuaccccugaacagagcaagagaucgacgaugguaggcaccccauauuggauggcuccggagguugugacaaggaaagccuacgggcccaaggucgauaucuggucucugggaauaauggcuauugaaaugguggagggugagccuccauacuuaaaugaaaacccccugcgggcccucuaucuuaucgcaacuaauggcaccccugagcugcaaaacccagaaaaauugucccccaucuuccgcgacuuccuaaaccgaugccuggagauggacgucgaaaagagagggucagccaaggagcuccugcagcauccguuucuuaaacuggcuaagccuuugaguagccucacaccacugauuauggcggcaaaagaggccaugaaguccaauagguga

SEQ ID NO: 60323 - RNA, 1635 nt, Artificial Sequence
  derived and/or modified sequence opt3 from PAK3__Homo_sapiens__NP_001121639
augagcgacggccuggauaacgaggaaaagcccccugccccaccgcucagaaugaacuccaauaauagggacucuucagcucuuaaccacaguagcaaaccccugccuauggcaccagaggaaaagaauaaaaaggcccgguugcgcuccaucuuccccgggggaggugauaaaaccaacaagaagaaagagaaggaacgaccugagauuucuuuaccaucggacuuugagcauacaauacacgugggcuucgaugcggucacuggggaauuuacgggaauccccgagcagugggcucgucugcuacaaaccucaaauauuacaaaacucgaacagaagaaaaacccucaggccguucuggacgugcuuaaguucuacgauagcaaggagacuguaaauaaccagaaauauaugaguuuuaccuccggcgacaagucugcacaugguuacaucgccgcucacccaagcuccacaaaaaccgcaucagagccgccccuggccccuccagugagugaagaggaagaugaggaagaggaggaagaggaagacgagaaugaacccccuccagucauugcucccagaccggagcauacuaagagcaucuauacaaggucugugguugaguccauagccagcccugcggugcccaacaaagaagucaccccaccuucagcagagaaugccaacaguucuacguuguaccggaauacugaucgccaaagaaagaaauccaagaugaccgacgaagagauccucgaaaagcugaggagcauugugucgguaggggaucccaaaaagaaauauacacgguucgagaagaucggacagggcgcuucuggcacuguuuacaccgcccuggacauugcaacagggcaggagguggcuaucaaacagaugaaccuccaacagcagccaaagaaggaauuaauaauuaacgagauccuggucaugcgcgaaaauaaaaaccccaauauugugaacuaucuugacuccuacuuggugggagaugagcugugggucguuauggaguaccuagccgguggcucacucaccgacgugguaacggaaacuugcauggaugaggggcagaucgcggccgugugucgagaaugccugcaagcacuugacuuucugcacaguaaucaggucauccacagagauauuaagagcgacaacauauugcucggaauggauggcuccgugaaacugacagacuucgguuuuugugcucagaucaccccugagcaaucuaagaggagcacuaugguugggacaccauauuggauggccccggaaguggucacccggaaggcuuacggacccaaaguggauauuuggucauuaggcaucauggccauagagaugguagagggcgaaccuccauaucugaaugagaacccccuccgugcacuuuaccugauugccacgaaugggaccccugaauugcagaacccagagcgccuaagugcuguuuucagagacuuucugaauaggugccucgaaauggauguggaccggcgaggauccgcgaaggagcugcuucagcaucccuuccugaaauuggcaaagccgcucagcucucugacaccuuuaaucaucgccgcuaaagaggccauuaagaacucaagucgcuga

SEQ ID NO: 60324 - RNA, 1776 nt, Artificial Sequence
  derived and/or modified sequence opt3 from PAK4__Homo_sapiens__NP_001014832
auguucggcaagaggaaaaagagaguggagaucagcgcccccuccaacuuugaacaccggguccauaccggguucgaccagcacgagcaaaaauuuacaggacugccucgccaguggcagucucucauugaagagucagcucgacguccaaagccgcuuguugaucccgcaugcauaacgaguauccagccuggugccccaaaaacuauugugagaggcagcaagggggcgaaggacggagcucugaccuuguuacuggaugaguucgagaauauguccguaacaaggucuaacucgcuacggcgcgacucacccccuccacccgccagagcaaggcaagagaauggcaugccugaagaaccagccacuaccgcucggggugggccgggaaaagcaggcagccgcggccgauuugccgggcauagugaagcuggagguggcuccggggauagaaggcgggccggacccgagaagcguccuaaaucuagccgcgagggcuccggugggccacaggaaucaaguagagacaagaggccccucagcggaccugaugugggcacaccacagcccgcgggccuggcaucuggggccaaacuugcugccggacggccguucaacaccuacccucgagcagacacugaucaccccucccgcggugcucagggcgagccacaugacgucgccccuaaugggcccucagcgggaggccuggccaucccacaaagcaguucuuccagcucgagacccccuacaagggcacggggugcuccaucuccggggguguugggcccccacgccuccgaaccucagcucgcuccacccgccuguaccccugcagccccagcuguucccggaccgccuggcccacgcucaccccagagagagccucagagggugagucacgaacaauuucgugcggcacugcagcuggucguggaucccggggacccacggagcuaucucgauaacuucauuaagaucggagaggguuccacgggcauaguaugcaucgccacuguucgaucuagcgggaaguuaguggcugucaaaaagauggaccugagaaaacagcaaaggcgcgagcuuuuguuuaaugaaguggugauuaugcgggacuaccagcaugagaacgucguugaaauguauaauucauaccuggugggagaugagcuauggguagugauggaguuccucgaaggcggugcccugaccgacaucgucacacacacuagaaugaacgaggaacagauugcagccgugugucuugcuguucugcaggccuugagugugcuccaugcacaaggggucauccacagggauauaaaguccgacagcauucuguuaacccacgauggccgcgugaaacugucugacuuuggauucugcgcgcagguaucaaaggagguuccucgacggaaaagucucgugggcacacccuauuggauggcuccagaacuuaucagccgucugccguacgggccugaggucgauauuugguccuugggaaucauggugaucgaaauggucgacggugagcccccauauuuuaaugagcccccucuaaaggccaugaagaugauuagagauaaccugccacccaggcucaaaaaucugcauaaggugucuccuucgcuuaaaggcuuccuggaccgcuugcucguucgggauccggcacagagagccaccgcugccgaacuguuaaagcacccauuccuggcaaaagcugggcccccugccagcauagugccacuaaugaggcagaaccgaacgcgcuga

SEQ ID NO: 60325 - RNA, 2046 nt, Artificial Sequence
  derived and/or modified sequence opt3 from PAK6__Homo_sapiens__NP_001263646
auguucagaaagaaaaagaaaaagaggcccgagaucagcgccccucagaacuuucaacaccgggugcauaccuccuucgacccaaaagaaggcaaguuugucgggcugccgccccaguggcagaauauucucgauacccuucgccgaccuaagccaguuguggaccccucucguauaacuagaguacagcugcaaccuaugaaaacgguggucaggggaucagcuaugccaguggaugguuacaucaguggcuuguuaaacgacauucagaagcugagcguuaucuccucuaauacccuacgggggcgcucgcccacaucaagaaggcgggcacagagccucggacugcuuggcgaugagcacugggccacugacccugauauguaucugcagaguccacaauccgaacgcaccgacccgcaugguuuguaccucucuugcaacgggggaacacccgcgggccacaaacagaugccuuggccagagccccagagcccucgagugcugccaaauggccuggcugccaaggcacagucccucgggcccgccgaguuccaaggagcuucacagagauguuuacagcugggugcaugccuucaaaguagcccgccuggcgccucucccccaaccgggacuaacaggcauggaaugaaagcugccaagcacggcuccgaggaggcgcggccucagucauguuuggucgguagcgcaacagggcgucccggaggcgaaggcaguccaucucccaagacccgcgaguccagccugaaaagaaggcuauuucggucgauguuccucucuacggccgcuacugccccuccauccucaaguaagccggggcccccuccacagagcaaacccaauuccucuuuucgaccuccacagaaggauaaucccccgagccugguggcaaaagcucaaucacuuccuagugaccagccaguaggaaccuucagcccccugacaacuuccgauaccucuucaccucagaagaguuugcgcacagcccccgcgaccggucagcucccaggcagaagcuccccugccgggucucccaggacguggcacgcacaaauuucgacuagcaaccuguauuuaccacaggacccgacaguugcuaaaggagcccuggcuggcgaagauaccgguguggucacucaugagcaguuuaaggccgcacuccggauggugguggaccagggggacccucgccuucuguuggauuccuacgucaagaucggcgagggaucaacaggcauaguuugccuagccagagaaaaacacagugggaggcaaguggcuguaaagaugauggaccugcguaaacagcagcggcgagagcuccuguucaacgaaguggucaucaugagagauuaucagcauuuuaaugugguugagauguacaagucuuaucuugugggagaagaacugugggucuugauggaguuccuccaagguggcgcgcugaccgacauugugagccagguaagguuaaacgaggaacagaucgcaacgguuugugaagccgugcugcaagcucuagccuaccuccacgcacagggggucauucaccgcgauaucaaauccgacucaauacugcuuaccuuggauggacgggugaagcugagcgacuuuggcuucugcgcccagauuucuaaggauguccccaaaagaaagucccucguggguacaccauacuggauggcucccgagguuaucaguaggagccuguaugccacugaaguggacauuuggucucuugggaucaugguaaucgagauggucgauggcgagccuccauacuucuccgacucacccgugcaggcaaugaaacgccugcgagacaguccuccgccaaaguugaaaaauagccauaagguuucgcccgugcuccgggauuuucuggaacguauguuagucagagacccucaagagagggcgaccgcucaggaacugcuagaucacccauuccuccugcagacaggacuucccgaguguuuggugccucugauucagcucuaucgcaagcaaacuuccacaugcuga

SEQ ID NO: 60326 - RNA, 2160 nt, Artificial Sequence
  derived and/or modified sequence opt3 from PAK7__Homo_sapiens__NP_065074
auguucggcaagaaaaagaaaaagaucgagauuagcggccccuccaacuuugaacacagagugcauaccggauucgacccucaggagcaaaaauuuacaggucugccacagcaguggcacucucuccuugccgauacugcuaauaggccgaagcccauggucgacccuucaugcauaacgccaauccagcuggcacccaugaagaccauuguucggggcaacaaaccuuguaaggaaacaaguaucaauggguuguuagaggauuucgacaacauuagcgugacucgcuccaauucucugcgaaaagaaucgccacccaccccugaucaaggagccucaagccauggcccaggucacgcggaggagaacggguuuaucacauucagucaguacuccucugaaagcgacaccacugcugauuauacaaccgagaaguaccgugaaaaaucccuauauggagacgaucucgacccguacuauagaggcucacaugccgcaaagcagaauggccacguaaugaagaugaaacacggggaggccuacuauagugaggugaagccccugaaaagcgauuuugcuagguucucugcagacuaccauucccaccuugauucacugagcaagccuagugaauacucugacuugaaaugggaguaucagcgggccuccagcucgucuccacucgacuacuccuuucaauucacgcccucacgcacugcuggaaccagugguugcagcaaggaaucccuggccuauucugagagcgaauggggcccuucacuggaugacuacgauagaaggccaaaaaguuccuaucucaaccagacaagcccccagccgacuaugcggcagcgcucucgaucagggaguggauuacaagagccuaugaugcccuuuggcgcgagcgcauucaagacccauccacagggucacuccuacaauucuuauacauacccuagacugucggagcccaccauguguauaccaaaggucgacuacgauagggcccagauggugcuuucucccccuuuguccgggucagacacguauccacggggaccggcuaaacugccccaaagucagucuaagagcggcuacuccucaagcucucaccaguauccuuccggcuaccauaaagccacucuauaucaccauccaagucuccagagcagcucccaauacaucucaacagcaaguuaucugagcucgcuuucccugucuagcucaaccuaucccccuccaaguuggggguccucuagcgaucagcagcccucccguguuucacacgaacaguuucgcgcugccuugcaacucguggucagcccgggagacccuagagaguaccuggcgaacuucauuaagaucggugaaggcaguacugggauugugugcaucgccacagagaaacauaccggaaagcagguagcaguuaagaaaauggauuuaaggaagcagcagcggcgagaacuccuguucaaugagguggucauaaugcgcgacuaccaccacgauaacgugguggacauguacucuuccuaucuugucggcgacgagcuguggguugugauggaauuuuuggaggguggggcucuaacggauauuguaacccauacaagaaugaaugaggaacaaaucgccacugugugucugagcguccucagggcucugucguaccuucacaaccagggcgugauucaucgggacaucaaaucagauucuauccuguugaccagugacggacgcauuaagcucuccgauuucggcuuuugcgcccagguuagcaaagaagugccaaagagaaagucucuggucgggacacccuauuggauggcaccugaggugauaagcagguuacccuacggaacugagguagacaucuggucccuggguauuaugguuaucgaaaugauagauggcgagccaccuuauuucaaugaacccccacuacaggccaugcgucggauucgagacucacucccgccuagagugaaagaucugcacaaggucaguagcgugcuuaggggguuuuuggaccugaugcucguccgcgagcccucucaacgggcuaccgcgcaggagcugcuuggacacccauuccugaaauuggcagggcccccuuccuguaucgugccacucaugagacaguacaggcaucacuga

SEQ ID NO: 60327 - RNA, 3561 nt, Artificial Sequence
  derived and/or modified sequence opt3 from PALB2__Homo_sapiens__NP_078951
auggacgagcccccuggcaagccacugagcugcgaagagaaagaaaagcucaaagagaaacuugccuuccugaaaagagaauacuccaagaccuuggcuagguuacagcgggcacaacgcgccgagaagaucaaacacucuauuaagaaaacaguggaggaacaggauugucugucacagcaggaccuaaguccgcaacucaagcauagcgagcccaaaaacaagauaugcgucuaugauaagcugcacaucaaaacucaucuugacgaagagacgggggagaagaccuccauuacacuggauguuggaccugaaucuuuuaauccaggugacggccccgggggauugccuauccagcgaacugaugacacccaggagcacuucccacaucgugugucggaucccucaggcgaacagaaacaaaagcucccuagcagaaggaaaaagcagcagaaacggacauuuauuagucaggagcgcgacuguguauucgguaccgauucccugagacugucugggaagaggcucaaggaacaagaggagaucagcuccaaaaacccagcgcggucaccggugacugaaauacgcacacacuuacugagucuuaagagcgaguugcccgacucuccugaaccagucaccgagaucaaugaagauuccgugcugauucccccuacggcucagccagagaaaggaguugacacuuuucuacgaagacccaacuucaccagggccacaacugugccgcuccagacccugucagacagcggcaguucucaacaccuugagcauaucccucccaagggcuccagcgaacugacaacccacgauuugaaaaauauucgguuuacgucgccagucucucucgaggcacaggggaagaagaugacuguguccacagacaaccuguuaguaaauaaagccaucucaaagaguggacagcugccuaccagcuccaaccucgaagcuaauauaucuugcagccuuaacgagcugacuuacaauaacuugcccgcaaaugaaaaccagaaucuaaaagagcaaaaccagacagagaagucacugaaaaguccauccgauacccucgacggucguaacgaaaaucugcaggagagcgaaauucuuucucagcccaagucacugaguuuggaggccacgagcccucucuccgcugagaagcauucuuguaccguuccagaaggccuguuauucccggccgaguauuacgugcgcacaacuagaucgaugagcaacugccaaaggaaagucgcgguggaagcagugauccagucccaccuggaugucaagaaaaagggguuuaaaaauaagaacaaggacgccucaaagaaucuaaaccucaguaaugaggaaaccgaucagucugagauucggaugagcggaacauguacuggccagcccuccucacgaaccagccaaaagcugcuuucuuugacaaaaguuuccaguccugcugguccaaccgaggacaacgaucugagccgcaaggccguggcacaggcucccgggagaagguauacuggaaaacggaagucugccugcacgccugcguccgaccacugugaaccacuccugcccacaucaagucuuagcaucguaaaucgcucgaaagaggaagugaccucccauaaguaccagcacgagaagcuguucauccaggucaaaggcaagaaaucuagacaucaaaaggaagauagcuugucauggaguaacuccgccuaucucucucuggacgacgaugcauuuacugcuccguuccacagggacggcauguuaagccugaaacagcuacucuccuuucugucaauuaccgauuuccagcuuccugacgaggauuucgggccauugaagcuggagaaggugaaaagcugcagugaaaagcccguugagccuuuugaaucuaaaauguucggagagcgucaucucaaggaagguuccuguauauuucccgaggagcugagcccaaaacggauggacacagaaauggaggauuuagaagaggaccugaucgugcuuccuggcaagucgcaccccaagcgaccaaauucacaaucucagcacaccaaaacuggguugaguuccagcauucuccuguacacaccgcuaaacacggucgccccugaugacaaugauagacccaccacugacaugugcucuccagcuuuccccauccugggaacaaccccugccuuuggcccacaggguagcuacgagaaggcauccacagaaguggccgggaggacuugcuguacgccccagcucgcucaucugaaagauucaguaugccuugcgagugacaccaagcaauucgacagcucuggcuccccugcaaaaccgcacaccacauugcagguuucaggacgccagggccagccaacuugugauugcgacagugugcccccugggaccccacccccuauagagagcuuuacauucaaggaaaaccaacugugucggaauacuugccaggaguuacauaagcacuccgucgaacagaccgagacggccgagcucccggcuucugauucgauuaaccccggaaaccugcagcuugugagcgaacugaaaaauccaucagguuccuguagugucgacgugucugccauguuuugggagagagcaggcugcaaggaaccuuguaucaucacagccugcgaggauguugugagcuuguggaaagcucucgacgccuggcaaugggaaaagcuguauaccuggcacuucgcagagguacccguccuacagauugugccaguuccugauguguacaaccuggucuguguggcgcucgggaaucuggagaucagggaaauucgcgcucuguuuugcuccucagacgaugagucugaaaaacagguauugcuuaagagcggaaacauaaaagccguguuaggccucacuaagcgacggcugguuaguuccagcgguacacuuucugaccaacaggucgaggugaugaccuucgcagaagaugggggcggaaaggagaaucaguuucugaugcccccagaggaaacuauccuaaccuucgccgaggugcagggcaugcaagaagcucuccuggggacaacgauuaugaacaauaucgucaucuggaacuugaaaaccggacagcuguuaaagaaaaugcauauugacgauucauaucaggccuccguuugccacaaggcauacagugagaugggucuccuguucauagugcuuagccauccgugugcuaaagagucggaaucucugcguuccccuguguuucaguugaucguaauuaaucccaagacuacacucagcgucggcgugaugcuguauugccuaccacccgggcaagccggaagauuccuggagggcgacguuaaggaccacugugcggccgcuauccuuaccucagguacaauugcaaucugggaucuccuguuggggcagugcacugcccuguuaccuccagugagugaccagcauuggucuuuugucaaaugguccggcaccgauagccaccuccuggcuggacagaaggacggcaacauauucguguaccacuauucauga

SEQ ID NO: 60328 - RNA, 2571 nt, Artificial Sequence
  derived and/or modified sequence opt3 from PALD1__Homo_sapiens__NP_055246
augggcaccacagccagcacugcucagcaaacgguguccgcagggacccccuucgagggacugcaggguucuggcacaauggacucaagacacagugucagcauccauuccuuucagucuacuucgcuccacaacucaaaggccaaaagcauuauaccuaauaagguugcgccagugguaaucaccuacaacugcaaagaagaguuccagauucaugaugaacuucugaaggcucacuauacauuggggagguuaagugacaauaccccggagcauuaccuggugcaaggacgguauuuucuaguccgcgaugugacugagaaaauggacguucucggcacaguggguuccuguggggcccccaacuuccgacagguccagggaggccugaccguguuuggcauggggcagccuucucuuagcggauuccguagaguacugcaaaaguugcagaaggauggucacagggagugcguuaucuuuugugugcgggaggaaccaguccucuuccugcgcgcagacgaggauuuuguguccuacacgcccagagacaaacagaaucugcacgaaaaccuccagggcuuagggccuggagugagggucgagucacuggagcuugccauucggaaggaaauccaugauuucgcucaauugagugagaauacuuaucacguuuaccauaacaccgaagaccuguggggcgagccacacgcaguggccauacacggugaagaugaccuacauguaacagaggagguguauaaacgcccccucuuucugcagccuacuuaccgauaccacagacuuccacugccggaacaggggagccccuuggaggcucaacucgaugccuucgucucugugcugagggaaaccccuuccuuacugcagcuccgggacgcgcauggaccacccccugcacuuguuuuuaguugccagaugggcgugggccguacaaaucuggggauggucuugggaacccuaauccugcuccaccgcagcgguacgacuucacagccagaggccgcucccacacaagccaagccgcugccuauggaacaguuccaggugauucagucuuuccuuagaaugguaccccaaggcaggcggaugguugaggagguggaccgagcaaucaccgcuugugccgaacugcaugauuugaaagaggucgugcucgaaaaccagaagaagcuggaggggauucgcccagaauccccugcgcagggaagcggcucgagacacucugucuggcagagggccuuauggucccuggagcgguauuuuuaccuaauccucuucaauuauuaccugcacgagcaauauccccuugcauuugcuuugucauucagucgcuggcugugcgcccauccagaacucuacagacugcccgugacucuuagcuccgcugguccuguugccccaagggaccugauagcacgugggucuuugcgggaggaugaccucgugagcccggaugcccugucaacaguacgagaaauggacgucgcuaacuuuagaagggugccccgcaugccuauuuauggcaccgcgcagccaagugcaaaagccuuaggauccauccuggcuuaccuaacggaugccaagcggagacucaggaaaguugugugggucagccugcgcgaggaggcagugcuugaaugugacggccacaccuacucuuugcgauggcccgggccuccaguagcccccgaucagcuggagacacucgaagcucagcugaaggcccauuuaucagagccgccuccaggaaaagaagguccccugacuuaucgguuccaaaccugccuuacaaugcaggagguguuuagucagcaccguagagcauguccuggcuugacuuaccacaggauucccaugccagacuucugcgcgccucgcgaggaagauuuugaccaacuccuggaggcucuacgggccgcacugagcaaggaccccgggaccggauucgucuuuuccugucucucuggccaggguagaacaaccacugccaugguuguggcugugcuggccuucuggcauauccagggguuuccagaagucggcgaggaagaacuuguuucggugccggaugcaaaauucacgaagggagaguuccaggugguaaugaaggucgugcaauugcugccugacggccacaggguuaaaaaggaaguggaugcugccuuagacacagucagcgagaccaugacucccaugcauuaucaccuccgagaaaucauuauaugcaccuaccgccaggcgaaagccgcuaaggaggcacaggaaaugcggagacugcagcuuaggucccugcaauauuuggagcguuacgugugccucauccuguuuaaugccuaucuacaucuggagaaagcugauucauggcagcgcccauucaguacauggaugcaggaaguugccucuaaggcagggauuuacgagauccucaacgaacugggauuucccgagcuugagagcggugaagaccagccuuucucccgguugagauacagguggcaagagcagucauguagccuggaaccaucugcgcccgaggauuuacucuga

SEQ ID NO: 60329 - RNA, 3372 nt, Artificial Sequence
  derived and/or modified sequence opt3 from PALLD__Homo_sapiens__NP_001159580
augagcggcaccuccucucacgagucauucuacgacagucugagcgauaugcaggaagaguccaagaacacagacuuuuuccccgggcucucugccuuucuuucgcaagaagagaucaauaaaucacuggauuuggcuagaagggcaauugccgacagcgaaacugaggauuucgacagugagaaggaaauaucccagaucuuuucuacgagcccugcguccuuaugcgagcauccaucacacaaagaaaccaagcugggagagcaugcuagucggcgcccgcaggauaaccgaagcacacccgugcagccucuagccgagaaacaaacuaagucuauuuccucaccagucagcaagcguaaacccgcaaugaguccucuccugaccagaccaucuuauaucaggucccuucggaaggccgaaaaacgcggugcuaagacacccagcaccaauguuaaaccuaagacuccacaccagagaaagggcgggccgcagucgcagcugugugacaaagcagccaacuugauugaggaacucacaucuaucuucaaggcugccaaacccaggaaucgguccccuaacggagagucaaguagcccagauuccggcuaccugucucccaagaaucaaccuagcgcgcugcucucagcaagugccucccagagcccaauggaagaccagggugagauggagcgcgaagugaaaucucccggggcucgacauugcuaucaggauaaccaagacuuagccguaccgcacaauagaaagucacacccucagccccauagugcacugcacuuuccagcugccccuagguucauacagaaacuucggagccaagagguggcggaaggaucccgugucuacuuggagugucgcgugaccggcaaccccacgccaagaguuaggugguuuugcgaaggcaaggagcugcauaauacucccgauauccagauucacugugagggcggagaccuacacacccucaucauugccgaagcauucgaggacgauacaggucgguauacuugccuggcuaccaacccuucuggcucggacacaaccagcgccgaaguguuuaucgagggggcuuccucaacggauagugacucugaaagccuugccuucaagucccgagcaggagccaugccacaggcucagaaaaagacuacaucagucagccugaccauagggucuuccaguccgaaaacuggugugacaaccgcgguaauucaacccuugagcguuccugugcagcagguccauucuccaacguccuaccucugucgccccgaugggaccacaacugcauauuuuccuccaguguucaccaaggagcugcagaauacagccguggcugagggacaagucguuguguuagaaugcagaguaaggggcgcacccccgcuucaggugcagugguuccggcagggcucagagauccaagacaguccugauuuucgcauucuccagaaaaagccaagaagcacugccgaacccgaggagaucuguacccuugucaucgccgaaacauucccugaggacgcugggauuuuuaccugcucggccaggaacgauuacggauccgcaacuucuacggcgcagcuggugguuacaagcgcuaauaccgaaaacuguucauacgagaguaugggugaauccaacaaugaccacuuccagcauuuucccccaccucccccaauauuggagacuucuagccuagagcuggccuccaagaaaccgucagaaauccaacaggugaacaauccugagcucggccugagccgugcagcccuucagaugcaauucaacgcugccgaacgggagaccaaugggguccaccccagucgaggagugaacggccugauuaaugguaaggcaaacucuaauaaauccuugccaacacccgcuguacuccugagcccuaccaaggaaccacccccuuuacuggccaaaccgaagcuaggguuuccaaagaaagcgucgagaacugccaggaucgcuucagaugaggagauacagggcacaaaggacgcaguuauucaggaccucgaacgcaaacugcgguucaaggaggaucuuuugaacaauggacagcccagacugacguaugaagagaggauggcccgccgacuccugggcgcugacucugccaccguguuuaacauccaagaaccugaggaggaaacugcaaaucaggauaucgggaguccacaugcguccgucggaagcccccuugacggucagaaagaguacaaggugucuagcugcgaacagcggcugauuuccgagaucgaguaucguuuggaaagaucaccugucgaugagaguggcgacgaagugcaauacggggauguuccgguggagaacggaauggcccccuucuuugaaaugaagcucaaacacuauaagauuuucgagggcaugccaguaacauuuaccugcagggucgcugguaauccuaaacccaagauauacugguucaaagacgggaagcagaucagcccaaaaucugaucacuauacaauucagcgcgaccuggauggcacuuguuccuuacauaccacggccucaacccuggacgaugacggaaacuacacaaucauggcagcuaacccucagggccggaucaguugcacugggagacuaauggugcaagccguuaaucagaggggacgaagcccccgcuccccaucuggucacccgcaugugcggagaccuaggucgcguagccgcgacucaggcgaugagaacgaacccauucaggagcgguucuuuagaccacacuuccuccaagcacccggggaccugaccguccaggaaggaaagcuguguaggauggauugcaagguguccggcuugccuacaccagaccugaguuggcagcucgaugguaaacccguacgaccugacucugcccacaagaugcuggugcgggagaaugggguucauagcuuaauaaucgaaccggucacuucccgcgaugcuggcauuuacaccuguaucgcgacgaacagagccggacaaaauucauuuucucuggagcuugugguggcagcuaaagaggcccacaagccacccgucuucauugaaaaauugcagaacacaggcguugccgacggguauccugugaggcucgagugccgggugcugggaguacccccaccucagaucuuuuggaagaaggaaaaugagagccuaacccauaguacugaucgagucuccaugcaccaggacaaccauggcuacauaugucugcucauccagggugcuacaaaagaagaugcagggugguauaccgugagcgccaagaaugaggcgggaauuguuucuugcacugcuagacuggacguguacaucucacgccacuga

SEQ ID NO: 60330 - RNA, 3312 nt, Artificial Sequence
  derived and/or modified sequence opt3 from PALM2-AKAP2__Homo_sapiens__NP_009134
auggccgaggcugaacugcacaaggagagacuccaggcaaucgccgagaaaaggaagcggcaaaccgagauugaaggcaaacgccagcagcuugacgagcagauacuguuguuacaacauagcaaguccaaagugcugcgagagaaguggcuacuccaggggaucccagcgggaacagcugaagaggaagaggcccguagaaggcagucugaggaagaugaguuccgggucaagcagcuggaagacaacauucaacgccuugagcaggaaauccagacucuggagucagaggaaagucagauuagcgcaaaagagcaaaucauauuggaaaagcucaaagagacggaaaaguccuuuaaagauuuccagaaggguuuuucuucgaccgacggcgaugccguuaauuacaucucaagccagcugccugaccugccaauucucugcaguagaacagcugagccgucccccgggcaagauggaacuucuagggcagccggcguggguugggagaacguauuacugaaggaaggggagagcgcuuccaaugccaccgaaacaucaggaccugacaugaccaucaaaaagccaccccagcuuagugaggaugacauuugguugaaaagcgaaggcgauaacuauucugcgacucugcuagagccugcagccuccucacucagcccagaccacaagaauauggagaucgaagugagugucgcugaguguaaaucugugcccggcauaacauccaccccucauccaauggaucacccgagcgccuucuacucgcccccucauaacgggcugcuuacggaccaccacgaaucucuggacaaugauguugcacgggagauucgcuauuuggacgaggugcucgaagcuaacugcugugauuccgccgucgacggaacuuacaaugguaccucaaguccagagcccggcgcggugguacugguugggggauuaagcccuccagugcaugaagccacacagcccgagccgacugaacgaaccgcauccagacaggcuccuccccacaucgagcugucuaacagcucaccagauccuauggccgaggcugaaaggacaaauggccauagucccucccaaccacgggacgcccucggugauagccuucagguccccgugucuccuucaaguaccacgagcucccguugcagcucgcgcgacggggaguuuacucugacaaccuugaagaaagaagcaaaguucgagcuaagagccuuucacgaagauaagaaaccaagcaagcuguucgaggacgaugagcacgaaaaagagcaguauuguauuaggaaggugcggccguccgaagagaugcucgaacuggagaaagagcgacgcgaacuuaucagaucacaggcugucaagaagaaccccggaaucgcggcaaaaugguggaauccuccacaagagaagacuauugaggaacagcuggacgaggaacauuuggagagucacaaaaaguacaaagaaaggaaggagcggcgcgcccagcaggaacaacuccuguuacagaagcagcugcagcaacagcagcaacagcccccuucucagcuaugcacagcuccagccagcucccaugagagagcaucaaugauagacaaagccaaggaggauaucguuaccgaacagauugacuuuagcgcugccaggaaacaauuccagcucauggagaacucucgucaggcaguggcgaagggccaguccacgccccggcuguuuaguaucaaaccguucuaucgaccucuuggcagcguaaauucugauaagccauugaccaaccccagaccucccuccgucgggggaccaccugaagacucaggugcuagugccgcaaagggccaaaaaucucccggggcccuggagacaccaucggcugccggaucccagggcaacacugcaucucaggguaaggaagggccguacagcgagccuucaaaaaggggcccccucaguaagcugugggcugaggauggagaauuuaccuccgcccgcgcggugcuuacagugguuaaagacgaugaccacggcauacuggaucaguucucucggagcgugaaugucuccuugacucaagaggaacucgacucagggcuggaugaguuaagcgugagaagucaggacaccacaguacuggaaacccuaucuaacgauuucuccauggacaauauuagcgacucgggagccucaaacgagacuacgaaugcucuccaggagaacucucuggcagauuuuagucuuccacaaacaccccagaccgacaauccuuccgaagguaggggcgaggggguuagcaagucuuucagcgaucauggauuuuacuccccaucaaguacuuugggcgacagcccccugguggaugacccucucgaauaucaggccggucuguuaguccagaacgcuauccaacaggccaucgcagaacagguggauaaagcggucucuaagaccucccgcgacggggccgagcagcaaggcccggaagcuacaguggaggaagccgaggcagcugccuucggaucagaaaagccacagaguauguuugagcccccucagguuagcuccccagugcaggagaaacgagauguacugcccaagauucuuccugcagaagaccgggccuugcgugagagaggcccgccccaaccacucccugcuguccagcccucugggccaaucaauauggaagagaccaggccugaaggaucguacuucagcaaauauucagaggcggccgagcugcgcuccacugcaagucuacuggcuacacaggaaucugaugugaugguuggucccuuuaagcuccggagcagaaaacagaggacgcuguccaugauugaggaagagauacgagccgcccaagaacgcgaggaggaacuuaagcggcagagacagguguugcaaucaacccagucuccaaggacuaagaacgcuccgagccugccuagucguacauguuacaaaaccgcacccggcaagaucgagaaagucaagccacccccuuccccaacaacugaagggcccagcuuacagccugaccucgccccggaggaggcggcuggaacccagcgccccaaaaaucugaugcaaacgcuuauggaagauuaugagacccacaagucuaagcggagagaaaggauggacgacucauccuacacaaguaaacuguugagcugcaaggugacuucggagguacucgaagccacccgagugaaccggcgcaaaucugcacuggcccuaagaugggaggcuggcauuuaugcaaaucaggaggaagaggauaacgaauga

SEQ ID NO: 60331 - RNA, 378 nt, Artificial Sequence
  derived and/or modified sequence opt3 from PAM16__Homo_sapiens__NP_057153
auggccaaguaccuggcucagaucauugugaugggcguccaaguuguggggagagcauucgccagggcgcuccggcaggaguuugcugccagccgcgcagccgcugacgcacgaggacgugccggucacagauccgcugccgcgucuaaccuuucaggccugaguuugcaggaagcacagcaaauauuaaauguaagcaaacugucccccgaggaagugcagaagaacuaugagcaucuauucaaagucaaugauaagucuguugggggaucguuuuaccuccagucaaaaguggugagggccaaggaacggcuggacgaggagcuuaagauccaggcucaagaagaucgcgagaaaggccagaugccucacaccuga

SEQ ID NO: 60332 - RNA, 2664 nt, Artificial Sequence
  derived and/or modified sequence opt3 from PAM__Homo_sapiens__NP_620177
auggccggcagagugcccagccugcucguccuucugguuuucccuuccucuugcuuggcuuuuaggucaccauuaaguguguucaagcgguuuaaagagaccacacgcccguucagcaacgaaugucuggggacuacgcgacccguagugccuaucgacuccucugauuuugcacuagacauucguaugccaggagucacccccaagcagucggauacauacuucugcaugucaaugagaauaccuguggacgaggaagccuuuguuaucgauuucaaaccaagggcgagcauggacacugugcaccauaugcuccuguuugguuguaauaugcccaguuccaccggcucuuauugguucugcgaugaggggacauguaccgacaaggcuaacauucuuuacgccugggcacggaaugccccuccaacucgccugccgaaaggagucggcuuuagaguggguggggaaacaggaagcaaguauuucguauugcaaguucacuacggcgauaucuccgcuuuuagggacaacaauaaggauugcucaggcgugagucuccaucugacccggcugccccagccucucauugcagggauguauuuaaugaugagcgucgacacggugaucccagccggagagaaaguggucaacucugauauauccugucacuacaagaauuaucccaugcauguuuucgcuuaccgcgugcacacucaccaucuggguaaaguagugucaggcuaccgagucagaaacgggcaguggacccuuaucggaaggcagagcccucaauugccacaggccuucuaucccgugggccacccgguugacgugaguuuuggugaccugcuagcggcacggugcgucuucacaggggagggacguacugaagccacccauauuggcggcacaucuuccgaugagauguguaaucucuacaucauguauuacauggaagcuaagcacgccgugagcuuuaugaccugcacgcagaacguagcaccugacauguuccgcacuauucccccagaggcuaauaucccuauacccguuaaaucggauauggugaugaugcacgagcaucacaaggaaacagaguauaaggacaaaauuccacugcuucagcaacccaagagagaagaggaagagguccuggaucagggggacuuuuacucuuugcucuccaaacuguuaggagagagggaagaugugguccaugugcacaaguauaacccuaccgagaaagccgaaucagagagugaccugguugcggaaaucgccaaugugguacagaagaaagaucucggucggagcgacgcacgagagggcgcugagcaugaacgcgggaacgccauucuugucagagauaggauccacaaguuccaccggcugguguccacuuugcgcccaccggagucuagaguuuuuagccuacagcaacccccuccaggagaaggcacaugggagcccgaacauaccggugacuuccacauggaggaggcucuggacuggccugggguguaccuccugccaggccaggucucaggaguggcccuugaucccaagaauaaccugguaaucuuucauaggggcgaccacgugugggaugggaacaguuucgacuccaaauuuguuuaccagcaaauuggauuggguccgauagaagaggauacgauccucgucauugacccuaauaacgcagccgugcugcagagcucuggcaagaauuuauucuaucugccacacgggcuaucaaucgauaaagacggaaacuacugggugaccgaugucgcucuccaucagguuuuuaagcuggaccccaauaacaaagaaggcccugugcuuauauugggucguaguaugcagcccgggagcgaucaaaaucacuucugucagccaacagacguggcgguagauccuggcacuggagcaauuuaugucuccgacggcuacugcaacucucggaucgugcaguucucgcccagcgggaaguuuaucacccaguggggagaggaguccucagguaguucuccacugccgggccaauucacaguuccucauagccucgcccuggugccccuucuggggcaguugugcgucgcugaccgagaaaauggaaggauucaguguuuuaagacugauaccaaagaguucgugagagaaaucaagcacuccucauuuggccgcaacguuuucgccauuagcuauauaccaggucuccuguuugcagugaaugggaaaccccauuucggcgaccaggagccuguacaaggauuugucaugaacuucucuaauggcgaaaucauugauaucuuuaagccagugcggaaacacuucgacaugccccacgauaucguggccuccgaggacgggacagucuacauuggagaugcucauaccaacacuguuuggaaguuuacguuaacagagaagcuggaacacagaagugugaaaaaggccggcauagagguacaggaaaucaaagguaaggggagcggaggccuaaaucucgguaacuucuucgcaucuaggaaaggcuauucccgcaagggguuugaccgacugucaaccgagggaagugaucaggaaaaggaggacgauggcagcgagucggaagaggaauacuccgcgccucuuccggcuuuggccccaucuagcucauga

SEQ ID NO: 60333 - RNA, 2163 nt, Artificial Sequence
  derived and/or modified sequence opt3 from PAMR1__Homo_sapiens__NP_001001991
auggagcugggcugcuggacccagcucgggcuuacauuccugcaauuguuacugaucagcucccuacccagagaauacacugugauuaacgaggccuguccuggagcugaauggaauauaaugugcagggaguguugcgaauaugaccagaucgagugugucugcccagguaagcgggagguugugggcuacacgauuccguguugccgcaacgaagagaaugaaugugauucuugccucauccaccccggguguaccauuuuugagaacugcaaaucaugccgaaauggaaguuggggcgguacacuggacgauuucuauguaaagggguuuuacugugcagagugccgugccggaugguauggcggcgacuguaugagaugcggacaggugcuuagggcgccuaaagggcagauccuguuggaaagcuacccacucaacgcucauugugaguggacuauacacgccaagcccgguuucgucauccaacugcgguuugugaugcugucccucgaauuugauuauaugugccaguacgacuacguugaggugcgcgauggcgacaauagagaugggcagauuaucaaaagggucuguggaaacgaacggccugcaccaauucagucuaucggcucgucauuacaugugcuguuucacagcgacgguaguaagaauuucgauggguuucaugccauauaugaggagauuaccgcuugcuccucuagccccuguuuccacgacggaacaugcguacuugauaaggcaggcuccuacaaaugugccugcuuggcuggcuauaccgggcaacgcugcgaaaaccugcuagaggaacgaaauuguucagacccuggagguccaguuaacggcuaccagaagaucacugggggaccgggccucauuaaugguagacacgccaaaaucgggacaguggucaguuucuucugcaacaauagcuaugugcugucuggcaacgagaagaggaccugucagcagaacggagaaugguccggcaaacaacccaucugcauuaaggcgugucgggagccuaagauaucagaccuugugcgucgcagaguccugccaaugcagguucagagcagggagacgcccuugcaucaacucuacagugcagccuuuucuaaacagaagcugcaguccgcuccuacuaaaaagccagccuuacccuucggggaucugccgaugggauaucagcaccuccauacccaacuucaguacgaaugcaucagcccuuucuaccggcgacuggguucgucucgcagaacauguuugaggacuggcaaaugguccgggcgggcacccucaugcauuccaaucuguggaaagauagagaauauuaccgcuccuaaaacacagggccuacgcuggcccuggcaggccgcgaucuauagaaggaccaguggugugcacgacgggagccugcacaagggcgccugguuucucguaugcuccggagcacuggugaacgaacguacggucgugguugcugcccauugugugacugaucuuggcaaggucacaaugaucaaaaccgcugaccugaaggugguauuggggaaauucuaccgggaugacgaucgagacgagaagacuauucaaucucuccagaucagcgccauuauacugcacccaaauuaugaucccaucuuacuggacgcagauauugccauccuaaaacuccuggacaaggcuagaaucucaacaaggguucagccuauuugccuugcggcaagucgcgacuuguccaccagcuuucaggaaucucauauaacgguggccggauggaacguccuggcugaugugcggucaccagguuucaagaaugacacccucagaaguggcgucgugagcguuguggauucccugcuuugcgaggagcaacacgaagaccaugggaucccgguaucugucacagauaacauguuuugugccucgugggagcccacugcaccuagcgacauuugcaccgccgaaacaggaggcaucgcugccguguccuucccagguagggcaucacccgagccucgcuggcaccugaugggguugguuaguuggucuuacgauaaaacuuguagccaccgacucuccaccgcguuuacaaaggugcugccauucaaagacuggauugagcggaauaugaaguga

SEQ ID NO: 60334 - RNA, 3609 nt, Artificial Sequence
  derived and/or modified sequence opt3 from PAN2__Homo_sapiens__NP_001120932
augaacuucgagggccuggaccccgggcucgccgaauacgcuccugcaaugcacagcgcccuugauccagugcuggacgcgcauuugaauccguccuuacugcagaacgucgagcuagaucccgaaggaguugcucucgaggcccugccugugcaagaaucuguacacaucauggaggguguguauucagagcuucauagugucguggcagaaguuggcgugccagucagcgugucccacuuugaccugcaugaggaaauguuguggguagggucucacggaggccacgccaccucguucuuuggucccgcucucgagagauacaguagcuuccagguuaaugggagugaugacauuaggcagauacagucccuggagaacggaauccuguuucucacaaagaauaacuuaaaauauauggcacggggcggccugauuaucuucgauuaccuuuuggacgaaaaugaggauaugcauucucugcuacucacugacagcuccacgcugcuugucgggggacugcaaaaccacauuuuggaaaucgaucucaauaccgugcaggagacacagaaguaugccguggaaacuccuggugugaccauaaugcgccagacaaaccgauuuuucuuuugcggccauaccucagggaaagucagucugcgugacuuaagaacuuucaagguugagcacgaguuugaugcuuucagcggaucucuguccgacuuugacgugcacggcaaucuccuugccgcgugugguuucucaagcaggcugacaggguuggcaugcgaucgguuccuaaaaguauacgaccugcgcaugaugagagccaucaccccacuccaagugcaugucgaucccgcuuuucugagguucauuccuacguauacuucacggcuugccaucauuucucaguccggacagugucaguuuugcgaaccaaccggccuggcaaacccggcugacaucuuccacgugaaucccguuggcccuuugcucaugacauuugaugugagcgccucgaagcaagcgcuggccuucggggacucugagggauguguccauuuauggacugauuccccagaacccucauuuaacccuuacagucgcgagaccgaguucgcacugccaugccuaguggacagcuugcccccgcuggauuggucccaggaccuuuugccucugucucucauacccguaccacugacaaccgauacgcuucugagcgacuggccugcugccaauucagcucccgccccaagacgagcacccccuguugacgccgaaauuuugaggacuaugaagaaaguggguuuuaucggcuacgcuccaaacccgcggacacgucuccgcaaccagauucccuauagacugaaggagagugauuccgaguucgacagcuuuucucaagucaccgaaucaccuguggggagggaagaggaaccacacuuacauauggucaguaaaaaguaccggaaagugacuaucaaguauagcaagcugggacuagaggauuucgacuuuaaacacuacaauaagacacucuucgcgggccuggagccccacaucccuaacgcauauuguaauugcaugauucagguucuuuacuucuuggaaccagugcgaugucugauacagaaccaucucugccagaaagaguuuugucuggccugcgaauuagguuuccuguuucacaugcuugauuugucccgcggggaccccugccaaggcaauaacuuccucagagcuuuuaggaccaucccggaggccucugcacugggacuaauucuggccgauucggacgaggcuagcggcaaggggaaucucgcccggcugauccagcgcuggaacagauucauacuuacgcaguugcaucaggauaugcaagaacuggagauuccucaggcauauaggggagcggguggcuccucauuuuguaguucuggggacagcguaaucggacaguuauucuccugcgaaauggagaauuguucacucugccguuguggcagcgaaaccguccgggcuucuuccacacugcuuuuuacucugaguuacccagaugguagcaaaucugacaagaccgggaaaaacuacgauuucgcccagguguugaagcgauccaucugccucgaccaaaauacacaggcauggugugacacuugcgagaaguaucagcccaccauucagacaagaaacaucaggcaucugccugauauucuaguuauaaauugugaggugaacucaaguaaagaagccgacuuuuggcgcaugcaagcugaggucgccuucaagauggcagugaaaaagcacggcggagaaaucagcaaaaauaaggaguuugcucuggccgauuggaaggaacucggcucgcccgaggggguacuggugugcccauccauugaggaacuuaaaaacguuugguugccuuucucuauccggaugaagaugaccaaaaacaagggacuggacgucuguaauuggacugauggugacgagaugcaguggggccccgcgagagccgaagaggaacacgggguguacguguaugauuuaauggcuacggucguucacauccucgacagcaggacaggaggcucacugguggcacauauuaaagugggugagaccuaccaccagcgcaaggaggggguaacucaucaacagugguaucuuuucaacgauuuucugauagaaccaaucgacaagcacgaggccguccaguucgauaugaauuggaaagugccggcuauucuauacuauguuaagcgaaaccucaauagucgguacaaccugaauaucaaaaacccuauugaagccuccguguugcuggcagaggcgucuuuagcccguaagcagagaaaaacccacacaaccuuuaucccccucaugcugaaugagaugccacaaauaggcgaccuugucggacuggaugcugaguucgugacuuugaacgaagaagaggccgaacucaggagcgacggcacaaaguccacgaucaagcccucacagaugagcguugcacgcauuaccugcgugcgggggcagggaccuaaugagggcaucccauuuauugacgauuacaucaguacucaggagcaaguagucgacuaucugacacaguacucugguauaaaacccggggaucuagacgcuaagauuuccagcaaacaucugaccacacuuaagucgacuuaucucaaacugagauucuugaucgauauuggagugaaguuugugggccacggucugcagaaagacuucagggucaucaacuuaaugguuccuaaggaucaggugcucgacaccguauaccuguuucauaugccgcgaaagcgcaugauaucacuucgguuccuggccugguauuuucucgaucucaaaauccaaggcgaaacgcacgacucuauugaggaugcaagaaccgcccugcagcuauacaggaaguaucuggaacuuaguaaaaaugggacagagccagaauccuuccauaaggugcucaaaggacuguacgagaagggccguaagauggacuggaaaguccccgagccugaagggcagacuagcccaaagaacgcugcgguguucucuagcguuuuggccuuauga

SEQ ID NO: 60335 - RNA, 2664 nt, Artificial Sequence
  derived and/or modified sequence opt3 from PAN3__Homo_sapiens__NP_787050
augaacagcggcgggggacugcccccuccauccgccgcugcaucuccgucaaguagcucccucgccgcggcuguggccgucguugcacccccuggugugggcgggguaccaggaggcgccgcugugggugucaaacuuaaauacugcagauauuacgcaaaggacaaaaccuguuucuauggggaggaaugccaguuucugcacgaggaucccgccgcuggagccgcgccuggcuugggcuuacauucuaauucggugccacuggcacuagccggggcucccguugccggauucccuccaggugcaguggcuggcgggggagccggcccgcccccugguccaaagaaacccgaccucggggauccuggaacaggcgcggccgcaggcgggggagguucaagcggcgggcuggacggaccaaggcuugcuauccccggcauggaugguggggcccugacugacacgaguuugaccgauuccuacuuuucuacuagcuucauuggcgucaacggauuuggcuccccgguggaaacaaaguauccucucaugcaacggaugaccaauucaaguagcucucccucccugcugaacgacucagcuaagccauacagcgcccacgauccucucacaagucccgcaucuuccuuauucaaugacuuuggggcccugaacauaagccagcgccgaaaaccacguaaguauagacuuggaauguuggaggaaaggcugguacccauggguucgaaagcucggaaggcgaaaaauccuaucggcugucuagcagaucgcugcaagucugggguuccaauuaacauggugugguggaauagagucaccgagaacaaucuccagacuccgaaccccacagccuccgaguucaucccuaagggaggcucaaccaguaggcugagcaaugugucccagucuaacaugagcgcuuuuucacaaguguucagucauccauccauggguagccccgccacggcagggcuugccccuggcaugucucugucagcuggaaguagcccauugcacucccccaaaauuacuccgcauaccucuccugccccacggcgccgaucgcacacacccaauccugcaagcuacaugguccccuccucagcgaguacuucuguuaacaacccagugagccagaccccuuccucaggccagguaauccagaaggaaacagucgggggaaccacguacuuuuauacugacacaacccccgcuccacucacugguaugguguucccgaauuaccacauauauccucccacagccccacauguggcauacaugcaacccaaagccaacgcuccuagcuuuuucauggccgaugagcugagacaggaauuaaucaauaggcaccugauuaccauggcacagaucgaccaggcugacaugccagccguucccacggagguggauucuuaucauucccucuucccucuugagccgcugccacccccuaaccggauucaaaagaguagcaauuuuggcuacaucaccucuuguuauaaagcggucaacuccaaggacgauuugccauacugccuacgucgcauacacggguucagacuggugaauacaaaauguaugguacucguugacauguggaagaagauucagcacucaaacaucgugacucugagggaagucuuuaccacaaaagccuucgcugagcccagucuuguguuugcauacgauuuccaugccggaggcgaaacuaugaugagccggcacuuuaaugacccuaacgcugaugccuauuucaccaagcgaaaauggggucagcaugaggggccgcugccccgccaacacgcaggcuugcucccagaaucgcugauuugggcguacaucguccaguuauccucugcccugagaacaauccauaccgcuggacuagccugcagggugauggacccuacuaagauucucauaacgggcaaaacacggcugcgcguuaauuguguggggguauuugauguccuuaccuucgacaacagccagaauaacaaucccuuggcacugauggcucaguaucaacaggccgaucucaucucacugggaaaggugguucuugcacuggccugcaacaguuuggcuggcauucagagagagaaccuccagaaggcgauggagcuggugacuaucaauuacuccucugacuuaaagaaccugauacuauaucuccugaccgaccaaaauaggaugcguagcgucaacgauauuaugccaaugaucggugcccgguuuuacacacagcuugacgcagcucagaugcgaaaugaugugaucgaagaggacuuggccaaggaaguacagaacgggagacuguucaggcuccuggccaaauuaggaaccauuaaugagcgcccugaauuucaaaaggaucccacuugguccgagacaggcgaccgguaucugcuuaaauuguucagagaucaccucuuccaccaggugacggaggcuggugcaccauggaucgaccugucacauauuauaagcugucuaaacaagcuggaugccggcguuccggaaaagaucagucucauuucuagggacgagaaauccguccugguggugaccuacagcgaucuuaagcgcugcuuugaaaauacuuuccaggaguugaucgcggcugccaacgggcagcuguga

SEQ ID NO: 60336 - RNA, 945 nt, Artificial Sequence
  derived and/or modified sequence opt3 from PANK1__Homo_sapiens__NP_612189
augaagcugaucaacggcaaaaagcagaccuuccccugguuugggauggacauuggagguacacucgugaaacuugucuacuucgagccuaaggauauaacugccgaagaggaacaagaggaaguugagaaucugaaaagcaucagaaaguauuugacguccaacaccgcuuacggcaagacagggauuagggacgugcacuuagagcugaaaaaucuaacuaugugcggacggaagggcaaccuccauuuuauccgcuucccaucuugugcaaugcaccgauuuauucagauggguucagagaaaaauuucaguagccugcauaccacacuuugcgccaccgggggaggcgcguuuaaguucgaagaagauuuucguaugaucgcugaccugcaguugcacaaacucgaugagcuggacugucugauacagggccucuuauauguagauuccgugggguucaacggaaagccggagugcuacuauuuugaaaaucccacuaacccugagcugugucaaaagaaaccauacugccuugacaaucccuauccuauguugcuggucaacauggguucuggcgugucgauccuagccguuuacucaaaggauaauuacaaaagagugacagggaccagcuucggaaacaugaugaguaaggagaaaagggacuccauuucuaaggaagaucucgcacgggccacgcuggucacuaucaccaauaacauuggcagcaucgcucgcaugugugcacuuaaugaaaacauagacagagugguauuuguugguaacuuccugaggauuaauaugguguccaugaaauugcucgccuaugcuauggauuucuggucaaaggggcagcugaaggccuuauuucuggagcaugagggauacuucggcgcggucggcgcacuccuugaacuguuuaaaaugacagacgacaaguga

SEQ ID NO: 60337 - RNA, 1713 nt, Artificial Sequence
  derived and/or modified sequence opt3 from PANK2__Homo_sapiens__NP_705902
augagaaggcugggccccuuccacccucgggugcauugggccgcuccaccgagccucuccucugggcuucaccgccuguuguuuuuacgaggaacccguauccccucaaguacaacucugagcccuccaagacaugacucccuaucucucgaugguggcacggucaaucccccuaggguucgggagccaaccgggcgcgaagcauucggacccucgccugccucaagcgacuggcugccagcgagauggaggaacggccggggugggcgcccgcgagcuagacuuugcaguggauggacagccgcagaggaagccaggcggaaccccacucugggcggcuugcucgggcgucagcgccugcugcucagaaugggagguggcagguuaggggcuccuauggagcggcacggacgagcauccgccaccucugugagcuccgcuggcgaacaagccgcgggugauccagaggggcgcagacaggagccccugaggcggcgcgcaucaagugccagcguaccugcugugggagccucugcagaaggcacaagaagggaccgucuuggcuccuacucagggccaaccagcgucagucggcagcgaguggagucuuugagaaagaaaaggccccuguuuccgugguucggacuagauauugguggcacucucguuaagcugguguauuuugaaccuaaagacauaacagcugaggaggaagaggaagaggucgaaucccuuaagagcauccgcaaauaccugaccucgaauguggccuaugggucuacgggcauucgggauguacauuuggagcucaaggaccugacuuuauguggaagaaaggguaaccugcacuucaucagguuucccacccacgauaugccagcguucauucagauggggcgcgacaaaaauuuuuccucacuccauacaguuuucugcgccacuggcggaggcgcauacaaguuugagcaagauuuccuuaccaucggggaccugcaguuguguaaacuagaugaacuggacugccucauaaagggaauccuguauauugacaguguggguuuuaacggccgaagccaguguuacuauuucgagaauccugcugauuccgaaaaaugccagaaacuucccuucgaccugaagaacccauaccccuugcuccuggucaauaucgggucuggagugagcauuuuagccguguacucaaaggauaacuauaagcgggucacaggcaccagucugggugggggcacguuuuucggacuauguugccuccugacuggcuguacaaccuuugaggaagcucuugagauggccucccguggggacagcacuaaaguugauaaguuggugagagacaucuacggaggugauuaugagagguucggccugccugggugggcaguagccucuucauuuggaaauaugaugaguaaagaaaagcgcgaggcugugagcaaagaagaccucgcgcgggcaacacugauaaccauuacgaacaauaucggcuccauugccagaaugugcgcucuuaacgagaauaucaaccaagucguguucguugguaacuuucugaggaucaauaccauugccaugcgauugcucgcauacgcccuggauuauuggucuaaggggcaguuaaaggcucuguucucggaacacgagggcuacuuuggagccgugggcgcacuacucgagcugcuuaaaauaccauga

SEQ ID NO: 60338 - RNA, 1281 nt, Artificial Sequence
  derived and/or modified sequence opt3 from PANX1__Homo_sapiens__NP_056183
auggccaucgcucagcuggcaaccgaguacguguucagcgacuuucuccuuaaggaacccacagagccuaaauucaagggccugagauuggaauuagccgucgauaaaaugguuacuugcauugcgguggggcugccacuacuccugauaucccuugcuuuugcccaagagaucucuauuggaacgcagaucucauguuucaguccgagcuccuuuucuuggaggcaggcagccuucguagacucguauugcugggcugcagugcagcaaaagaacucacugcagagcgaaagugguaauuugccccucuggcugcacaaauuuuucccuuacauucugcucuuauuugccauccugcuuuauuugccaccccuguucuggcgguuugcugccgcgccucauauauguuccgaucuaaaguucaucauggaggagcucgacaaggucuacaaccgcgcaauuaaagccgcuaagucugcccgagaucuggacaugcgugauggcgcaugcagcgugccagggguuaccgaaaaucuuggacagucccugugggaggugucagaaagucacuuuaaauaucccaucgucgagcaguacuugaagacuaaaaagaacagcaauaaccucauuaucaaguauauaucuuguagacuguuaacacugauuaucauucuccuugcuugcaucuaccugggcuacuauuucuccuugucaagccuaagugacgaguucguguguucuaucaaauccgguauucugaggaaugauagcaccguaccugaccaauuucagugcaagcucauagccguugggaucuuccagcugcuuucggugauuaaccuggucguguacguguugcucgcgccagucguuguguauacacuguuuguaccguuccggcagaaaaccgauguguuaaaggucuacgaaauccugcccacuuuugacgugcuacauuucaaaucugagggauauaaugaucucucccuguacaacuuguuucuugaagagaauauaucagaaguuaagaguuauaaaugucugaaggugcucgagaacauuaagagcuccggccaaggcaucgacccuaugcugcuucugacaaauuuggggaugaucaaaauggacgucguggauggaaagaccccaaugucugccgagaugcgcgaggaacaggguaaccagacggcagaacuccaaggcaugaauauugacagcgagacuaaagcuaacaacggggaaaagaaugccagacagaggcuguuagauucaaguugcuga

SEQ ID NO: 60339 - RNA, 2034 nt, Artificial Sequence
  derived and/or modified sequence opt3 from PANX2__Homo_sapiens__NP_443071
augcaccaucugcucgagcagagcgccgacauggcuaccgcacuucuggccggcgaaaaguugagagaguuaauccugcccggggcgcaagaugacaaagcuggagcccuagcagcccuccugcuucagcugaaguuggaacucccuuucgauaggguggucacaauugguacuguucuggugccaauacugcucguaacguuaguguuuaccaaaaacuucgcugaggaaccgaucuacugcuauacaccccacaauuuuacucgggaccaggcacuguacgcccgcggcuauuguuggaccgagcuucgagaugcuuugccuggggucgacgccucccuguggccaucucuauucgagcauaaguuucuccccuacgcgcugcuugcauucgccgcuauuauguaugugccugcccugggaugggaauuuuuggcaucaacacgucucaccagugagcugaacuucuuacugcaggaaaucgauaauugcuaccacagagcugccgagggcagggcgccaaaaauugagaagcaaauccagagcaagggucccgggauaacugaacgggagaaacgcgaaaucauugagaacgccgaaaaggagaaauccccugagcagaaucucuuugaaaaguaucuugagagaaggggacggucuaacuuccuggcaaaauuguaccuagcucgccauguucugauccuccugcuuucggccgugccaauuucauaccuguguacauauuacgcuacccagaagcaaaaugaauuuacgugcgccuugggcgcaagcccggacggcgccgcuggggcgggacccgcaguccgagugaguuguaagcucccuuccguacagcugcagagaaucauagccgguguugauauuguguuacugugcgucaugaaccuaaucauucucgugaaucugauccaccuuuucaucuuuaggaaaucuaacuucauuuucgacaaguugcacaaagugggcauaaagacucggcgucaguggcgcagaagccaauuuugugauaucaauauucuggcuauguucugcaacgagaauagggaccauaucaaaucccucaaccggcuggauuuuauaaccaaugaaucagaccuuauguaugacaacgucguucgacagcuguuggccgcacucgcccagaguaaccacgaugcuacaccaacugugcgcgacagcgggguacaaaccguggaucccucugccaauccugcagagccagacggagcggcugagcccccggucgugaagagaccuaggaaaaagaugaaguggauucccacauccaacccacugccucagcccuucaaagaaccauuagccaucaugcggguugaaaauucaaaggcagagaaacccaagccugcccgcagaaaaaccgcuacggauacucugaucgccccacuacucgacaggagcgcacaucacuacaagggcggugggggagauccgggccccggcccugcuccagcccccgcgccuccacccgccccggacaagaaacacgcucgucauuuuagucuggaugugcacccuuauauucuugggacaaagaaagcaaaggccgaggcugucccagccgcauugcccgcgucucggucccaggaaggagguuuccugagccaggccgaggacuguggccucgggcuggcuccugcccccaucaaagaugcaccauuaccugagaaggaaauucccuacccaaccgagccggcucgagccggacugccuucgggcggucccuuucaugugagaucuccacccgcagccccugcuguagcgccacuuacucccgccuccuuggggaaggcagaaccucucacaauacugucaaggaacgcuacccacccgcuacugcauaucaauacgcucuaugaggcccgcgaggaagaggacggcggaccacggcugccccaagacguuggcgaucuuauugccaucccugcuccacagcagaucuugauugcaaccuucgacgaacccagaacaguggucaguacuguggaguuuuga

SEQ ID NO: 60340 - RNA, 1536 nt, Artificial Sequence
  derived and/or modified sequence opt3 from PAOX__Homo_sapiens__NP_690875
auggagagcaccggcuccgugggggaagcccccggagguccuagaguccugguugugggcgggggaaucgcuggccucggugcagcccagaggcuuugcgggcacucugcguucccacaucugcggguauuggaggcuacagcccgcgcaggaggccguauucgaucagaaagauguuuuggcgggguggucgaggugggagcccacuggauacaugguccgaguaggggcaaccccguuuuccaauuagcugcagaauacgggcugcuaggagagaaggagcucagccaggaaaaucagcugguggagacuggcggucacgucgggcuuccuuccgugucuuaugccucgucaggagcuagcguaagucugcaguugguugccgaaauggcgacgcucuuuuacggccugaucgaccaaacccgggaguuccugcaugcagccgagacaccagugcccuccgucggcgaauaucucaaaaaggagauugggcagcacguggcuggauggacugaagaugaggaaacccgcaaauuaaagcuggccgugcuuaacucuuucuucaauuuggagugcugugucagcgguacacacuccauggaccugguugcacuagcuccuuuuggcgaguacaccgugcucccagggcuggauugcacuuucucaaaaggauaucagggccuuacaaacuguaugauggccgcgcugcccgaagacaccguaguguuugagaagccugucaagacgauccauuggaaugguaguuuccaggaagccgcauuuccaggggagacuuucccggugagcguugaaugcgaggauggcgacagauuucccgcucaccaugugauugucaccgugccuuugggauuccucagggagcaccuggauacauucuuugacccacccuuaccugccgaaaaagcugaggccauccggaagauaggcuucgggacuaacaauaaaaucuuucuggaauuugaggaaccauuuugggagcccgauugucaacucauucagcuuguaugggaggacaccucuccgcuggaagaugcagccccugaguugcaggacgcuugguuccgcaagcuaaucggauuuguugugcugcccgcguucgcauccguccacgugcucugcgguuuuauugccggccuggaaucagaguucauggagacacuuagcgaugaagagguccuguugugucucacccaggugcugcgaagaguuacggggaacccaagguuaccugcucccaaaagugugcugcggucucguuggcauuccgccccauacacucgcggaagcuauucguacguagcagucggcucuacagguggggaccuagaccuccuggcccaaccccuuccugcugauggcgccggagcacaguugcagauccuguuugcgggcgaagcuacccacagaacuuucuacuccacaacccauggggcccuccugucaggauggagggaggcagaccggcuucugaguuugugggccccacaagugcagcagccgcgaccccgccucuga

SEQ ID NO: 60341 - RNA, 2379 nt, Artificial Sequence
  derived and/or modified sequence opt3 from PAPD7__Homo_sapiens__XP_005248291
auggaccccagaguggccuggauccagccugagcaaaagggcccagcuaacgcacuguggaugcagauuugggaaaccagccagggggucggaagggguggcuccggguucgccucuuacuuuugccucaauucaccggcgcuugauacagcugccgcagccggagcugcaggccgggguagugggggacugggccccgccuugccugcugccagcccacccccuccaggccccacugcgccugcagccuuaccaccggcucugcuaacggcccucgggcccgcagcugagggagcccgccgacugcacaaauccccuucucuuucgucaagcaguuccucuagcuccucaaacgcggaaagugguaccgagagcccaggcuguucuuccucaagcaguucuuccgccagccuggggcgucccggaggcgguagagggggagcauucuuuaauuucgcugacggcgccccuucggcuccaggcacagccaacgggcaucccggaccgagggguccugcacccgccggcucuccaucccagcaccaauuucauccugggcggcgcaagagagaaaauaaggcuucaacuuauggauugaacuaccuccugaguggcagcagggcggcagcccuguccggugggggcggacccggcgcucaggccccacggcccgggaccccuuggaaaucucgcgcauauagcccaggaauacagggucuccacgaggagaucauugauuucuacaauuuuaugucaccgugccccgaagaggccgcuaugcgaagagaaguugugaaaaggaucgagacaguagugaaggacuuauggccuaccgccgauguccagauuuucggcaguuuuuccacugggcuguaucuuccaacaagcgacaucgauuuggugguuuucggaaagugggagcggcccccucugcaacuacucgaacaggcacugcguaaacauaacguggcggagccauguucuauaaagguccuugacaaagcuaccgugcccaucauuaagcugacggaucaggaaacugagguaaaaguugacaucucauuuaauauggaaaccggcgugcgcgccgcagaguucauuaagaacuacaugaagaaauauaguuugcucccguaccugaucuuaguccugaagcaguuucuccuucaaagagaucugaaugagguguucacaggugggauaagcuccuacucuuugauucuaauggccaucucguuccugcagcuccacccuaggauugacgcucggcgagccgaugaaaaccugggcaugcuucugguggaguuuuucgaauuguauggacgcaauuuuaacuaccucaaaacuggcaucagaaucaaggaagggggagcauauauugcuaaagaggagauaaugaaggccaugaccagcgguuacaggccauccaugcugugcaucgaggaccccuuacugccuggcaaugacgucgggcggucaaguuauggagcgaugcagguuaaacaaguguucgauuacgccuauauuguacuaucucacgcugugagcccccucgcacgcuccuacccaaacagagacgccgaaucaacacugggcaggaucauaaaggucacccaggaggugauugauuaccgucgguggaucaaggaaaaaugggguagcaaggcucauccuucucccgggauggacucccgaaucaaaauuaaggagagaaucgccacguguaacggcgaacagacucagaauagggagccagagaguccguauggacaacgccuuacauugagccugucuuccccucagcuccugucaaguggcagcucggcauccucuguuagcucacuuaguggguccgauguggacucugauacucccccaugcaccacacccagcgucuaccaguuuucccugcaggcgccugccccauugauggcuggacuccccaccgcccugccuaugccgucaggcaaaccacaacccacgaccagccggacauuaauuaugacuaccaacaaucagacaagauucacuauaccuccacccacccuggguguggcaccuguaccguguaggcaggcugggguugaaggaacagccagucuaaaggcagugcaccauaugucuucccccgccaucccaagcgcuucgccuaacccccucucaucuccacaccuguaucacaagcagcauaauggcaugaaacuuaguaugaaggguucccacggccauacccaagggggaggcuacagcucugucgggagcggaggcgugcgcccucccgucgguaaccgagggcaccaucaguauaaucggacuggauggcguaggaaaaagcacacgcacacaagagacuccuugccagugucacugagucgcuga

SEQ ID NO: 60342 - RNA, 1317 nt, Artificial Sequence
  derived and/or modified sequence opt3 from PAPL__Homo_sapiens__NP_001004318
augcacccccugccuggcuacuggagcugcuauugucuccuucuguuguucuccuuaggggugcagggaucucugggugccccaucagcugcaccggagcaaguccaucuaaguuaccccggcgaaccugggagcaugaccguuacauggacuacgugggugccaaccagauccgagguacaguuuggacuccagcccucuggcccucugccacuuagggcccaggguacauucgugcccuuugucgacgggggaauccugcggcgcaaguuguauauucaccgagugacucuccguaaacugcugccuggcguucaauacguguauagaugcggcucggcgcagggguggucaaggcgguuccgcuuuagagcucucaagaacggagcccauuggagcccaagguuagcagucuucggugaucugggcgccgacaauccgaaagcugugccccggcuucgccgagauacccagcaggggauguacgacgcaguauugcacguuggagauuuugccuauaaccuggaccaagauaaugcuagagugggcgacagguucaugcggcuaauagaaccugucgccgcgagucucccauacaugacaugucccgguaaccaugaggaacguuacaauuuuuccaacuauaaggcacgcuucucuaugccuggggauaaugagggacugugguacagcugggaccuuggcccagcccacaucauuuccuuuucaaccgagguguauuucuuucugcacuacggcagacauuuggugcagaggcaguuccgguggcucgaaagugaucugcagaaagcuaacaagaaucgagccgcacgccccuggaucauuacuauggggcacagaccgauguauugcagcaacgcugacuuagaugacuguacaaggcaugagucuaagguccggaaaggacugcaagguaagcucuacggccuugaagaccuguucuauaaauacgggguugauuugcagcuaugggcccacgagcacuccuacgagcgccuguggccuaucuauaauuaccagguguuuaacggaucaagagaaaugcccuauaccaauccaaggggcccuguacauauaaucacggguagcgcggggugcgaggaacgucucacucccuucgccguguuuccacggcccuggagugcaguccgagugaaggaguacggcuauaccagacugcacauucuuaacggaacacauauccacauucaacagguuucugacgaucaggacggcaaaaucguggaugacgucugggugguaaggccucuguucgggcgccggauguacuuguga

SEQ ID NO: 60343 - RNA, 858 nt, Artificial Sequence
  derived and/or modified sequence opt3 from PAPOLA__Homo_sapiens__NP_001238935
augcccuucccugugaccacacagggcagccaacagacucagccaccgcagaagcacuacgggaucacgucccccauuucucuggccgcuccuaaagagaccgacugcguccucacacaaaaacuuauagaaacucugaagccauuuggaguuuucgaggaagaggaagaguugcagagaaggaucuuaauucuggguaagcuaaacaaucucgugaaagaguggauccgggaaauuucagagaguaagaaccugccccagagcguaaucgaaaaugugggcgggaagauauuuaccuucggauccuaucgccuuggcguccauacaaaaggugcagauaucgacgcccuguguguggcgccucgacacguugaucguucugacuuuuucaccucguuuuacgauaaguugaaacuccaggaggaggugaaggaccugagagcugucgaagaggccuucgugccaguaauuaaacugugcuuugaugggaucgaaauugacauccucuucgcaagguuagcccugcaaacuauacccgaggaucuugacuugcgggaugacucacugcuaaagaaccucgauauucgcuguaucagaagccugaauggaugcaggguuacagacgaaauucuucaucuggugccuaacaucgacaauuuucgguugacccuccgcgcuaucaagcugugggcaaaacgacacaacauuuauaguaauauauuaggcuuccugggcggggucuccugggccaugcucguggcuagaacgugucagcuuuacccaaacgccaucgcgucuacucuggugcauaaguuuuucuuggucuucagcaaaugguauguuuuuaggcuauacuga

SEQ ID NO: 60344 - RNA, 2211 nt, Artificial Sequence
  derived and/or modified sequence opt3 from PAPOLG__Homo_sapiens__NP_075045
augaaggagaugagcgccaacaccgugcuggacucccagagacaacagaaacacuacggcaucacaucucccauuucacucgcuaguccuaaggaaauagaucauaucuauacucagaaacuuauugacgcaaugaagccauucggggucuuugaggaugaagaggaacugaaucacagguugguuguguuaggaaaacugaacaaucuaguaaaggaguggaucagcgacguguccgagucuaagaaccucccgcccucggucguggccacgguugguggcaaaauuuucaccuuugggucauaccggcugggagugcauacaaagggcgcggauaucgacgcucuuugcgucgccccucgccacguggaacgaagcgauuucuuucagaguuucuuugagaaacugaagcaucaagacgguauacguaauuugagagcaguagaagaugccuucguuccagugaucaaauuugaguucgacgggauugagaucgaucucgucuuugcuaggcuggcaauucagacuaucuccgacaaccuggaucuccgggacgacucucgcuuaagaagccuggauauaagguguauucggucccuuaauggaugccgcgugaccgacgaaaucuugcaccuggugcccaacaaggagacauuccgacuaacccucagagccgucaagcugugggcuaaaaggcggggcauuuauucaaauaugcuuggcuuucugggagggguuaguugggccauguugguggcgcguacuugucagcucuacccuaacgcagccgcuagcacacugguacacaaguucuucuuaguguuuucuaaaugggaauggccaaaucccguccugcucaagcagccugaggaauccaaccuuaaucugccagugugggauccgcgcguuaaccccucagacagauaucauuugaugccuaucaucaccccagccuacccccaacagaauagcacguauaacgugaguacuucuaccaggacagucaugguggaggaguucaaacagggucuagcaguaacugaugaaauucugcagggcaaguccgacuggagcaaacuccuggagccuccaaacuuuuuccaaaaguaccggcacuacauaguucuuaccgcuucggccucuacagaagagaaucaucuggaaugggugggguuggucgaguccaagauccgagugcucgucggaaaccuggagcgcaaugaauuuauuaccuuagcgcacgugaacccccagucauucccgggcaauaaagagcaccauaaggauaacaauuauguuaguaugugguuucuggguaucauauucagaaggguggaaaacgccgagagcguaaauauugaccuaacguacgauauccaguccuuuacugacacagucuaucggcaagcaaacaauaucaacaugcucaaagaagggaugaagauugaggcuacccacgugaaaaagaagcagcugcaucacuaccuuccugccgagaucuugcagaaaaagaaaaagcagucucugagcgauguuaaucgcucaaguggaggccuccaauccaaaagacugagccuugacucuucaugccuggacaguagcagggauacugacaacggcacacccuucaauuccccagcuucuaagucggauagcccuuccgugggggaaaccgagcguaacucagccgaacccgcagccgucauuguggagaagccauugaguguacccccugcucagggacucucuauaccagugaucggugcgaaaguugacagcacggucaagaccguguccccgcccacaguguguacuauuccuaccgucguuggccggaacgugaucccacgaaucacaacuccccauaauccugcacaggggcagccacaccugaacggaaugucaaauauuaccaaaacagugacccccaagagaagccacucuccguccauagauggcacuccuaaaagguuaaaggacguagagaaguuuauccgccuggaaaguacguucaaagauccacggacagccgaggaaagaaagaggaaaagcgucgacgcuauugguggggagucuaugcccaucccuaccauugauacuucccgcaagaaacgacuacccucaaaggaacucccagacaguagcucgccugugcccgccaacaauauccggguuaucaaaaacuccauacgucugacccuuaauagauga

SEQ ID NO: 60345 - RNA, 2484 nt, Artificial Sequence
  derived and/or modified sequence opt3 from PAPPA2__Homo_sapiens__NP_068755
augaugugccugaagauccucagaauuagccuugccauacuggcuggcugggcauuguguuccgccaacucugaguuaggguggaccaggaaaaagucacugguggaacgggagcaccuaaaucagguccuccuggaaggagagcgcugcuggcuuggugcgaaaguucgacgucccagagcuaguccucaacaucaccuguucggcguguacccaagcagggccgggaacuauuugcggccguaccccguaggagaacaggagauccaucacacaggccgcuccaagccugacacugaggguaaugcagugucucucgucccacccgaucugacggaaaacccugccgggcugagaggagcuguggaggaaccagcagcccccuggguuggcgacucgccuauuggccagucagagcucuuaggggaugacgaugcuuaucugggaaaucagaggagcaaagagagucuuggugaagccggcauccaaaagggguccgcgauggcagccaccacaacuaccgcuauuuuuacaaccuugaacgagccaaagccggaaacucagcggcgcggaugggccaaaucucgacagagaaggcaaguguggaagcggcgugcagaggacggccagggugauagcgggaucuccucacauuuccagcccuggccuaaacacagucugaagcaccgcgucaaaaagagcccacccgaagagucuaaucagaacggaggcgagggcuccuacagagaagcugagacauuuaauucacagguggggcuaccuauacucuauuucagcggaaggcgggaacgacugcuucugcgcccagagguauuggccgaaauccccagagaggcguuuaccguugaggccugggugaagccggaagguggccaaaacaauccugcaauuaucgcuggggucuucgacaacuguagucauacggugucugauaaaggaugggcccucggcauuagguccgguaaggacaaagggaagcgggaugcucgcuuuuucuuuagccugugcacugacagagugaaaaaggccaccaucuuaauaucgcacucuagguaccagcccggcacauggacucaugucgcagccaccuaugauggacgucacauggcucuguacguugacggcacacagguggcguccucacucgaccaaagugggccacuuaauagcccuuucauggcauccugucggucucuguugcuaggaggugauagcucagaggacggccacuacuuucgagggcaucugggaacccucguauucuggaguacggcccugccccagucccacuuucagcauagcucucagcacucaaguggcgaagaggaagcuacugaucuugugcugacagccagcuucgagccagucaacaccgagugggugcccuucagagacgaaaaauauccuagguuggagguucuccaagguuuugaaccagagccggagauucugucccccuuacagccuccacugugcgggcagacugugugugauaaugucgaacuaaucucucaguacaacggcuauuggccccuccgcggagagaaggugauucgguaccaaguaguuaacaucugcgacgaugaaggccugaauccuaucgugucggaggaacagauuagacuucagcaugaggcauugaacgaggccuucagcagguauaauauauccuggcagcugucaguccaccaagugcacaacaguacacuccgccaucgagucgugcugguuaauugugaaccaucuaagaucgggaacgaccacugcgaucccgagugugaacauccgcuuaccggauacgacgguggcgauugccggcugcaggggcguugcuauagcuggaauagaagggacggauugugucacguggagugcaacaauaugcucaacgacuuugaugacggcgauuguugcgacccucagguagcugauguccgcaaaacguguuucgacccagauucccccaagcgggccuacaugucagugaaagaacugaaggaggcauuacagcugaauagcacccacuuucuaaacauuuacuucgcgucuuccguuagagaggaccucgcuggugccgcaacauggccuugggauaaagacgccgugacucaucuugggggcaucguccugagucccgcuuauuacggaaugccaggccacaccgauacaaugauacaugaaguggggcacguauugggacuguaucauguguuuaagggcguuagcgagagggaaucuugcaaugacccuuguaaggagacuguccccuccauggaaaccggugaucucugcgccgacacagcaccaaccccgaaaucagagcugugucgagagccugaacccacgagugacacuugcggguucacacgcuuuccaggagcucccuucaccaacuacaugagcuauacuggcauuaccacaguguuauuuuguuuccugcuucggauccacgguggcuuguga

SEQ ID NO: 60346 - RNA, 4884 nt, Artificial Sequence
  derived and/or modified sequence opt3 from PAPPA__Homo_sapiens__NP_002572
augagacuguggagcugggugcuccaccuuggccuguuguccgccgcuuuagggugcggacuggcagagaggccccggcgcgcccgacgugacccuagagcggguaggccaccgcggcccgcugccggcccugcaaccugugccacacgcgcugcaagagggaggcgggccucuccacccccuccacccccuccaggaggcgcuugggaagccguccgcguuccgcgaagaaggcagcaacgggaggcgcguggugcaacugaggaacccucaccuccaagucgcgcccuauacuucagcgggagaggagaacagcucaggcugcgggcugaucuugagcugccccgagacgccuuuacgcuucagguguggcuccgcgcagagggcggccagagauccccugcuguaaucaccgggcuguaugauaagugcucuuacauuucgagggaccggggauggguggucgguauacauacaaucucagaucaagacaacaaagauccacgcuauuucuuuagccugaagacugacagagcccgucaggugaccacaauuaaugcgcacaggaguuaccuccccggccaguggguuuauuuagccgcaaccuacgaugggcaguucaugaaacuguaugugaacggagcucaagucgccacuuccggcgaacaggugggugggaucuuuucuccgcuuacacagaaguguaaaguauugaugcugggaggcagcgcucuaaaucauaacuaccggggcuacauugagcacuucucccucuggaagguugcccgaacccagagagaaauccugucagacauggagacgcauggggcacacacugcccuuccucaacuguugcuccaggagaauugggauaacgugaagcacgcuuggagucccaugaaagacggaagcucuccaaaggucgaauuuuccaaugcgcaugguuuccuguuagauaccucacuggagccuccccucugcggccagacacuuugugacaacacugaagugauagcaagcuauaaucaacugaguucuuuuaggcagccaaaagugguccgcuaccggguugugaacuuguaugaggacgaucacaagaaucccaccguaacaagagaacagguggacuuccagcaucaccaacuagccgaggcuuuuaaacaguacaacaucuccugggagcuggauguccucgaagugagcaauucgucucugaggcgccgacuuauucuggccaacugcgacaucuccaagauuggggaugagaauugugacccugaaugcaaccacaccuugacgggacaugauggcggugacugucggcaccuccgucauccagcauucguuaagaaacagcacaacggggugugcgauauggacuguaauuaugagagauuuaacuucgauggcggagaaugcugcgacccggagaucacuaaugucacacagaccuguuucgaccccgauucaccucauagggccuaccuggacgugaacgaguuaaagaauauacugaaacuagauggcaguacucaccucaacaucuuuuucgcuaagagcuccgaagaggaacuggccgggguagcaacauggccaugggacaaagaggcgcuuaugcacuugggagguauuguucugaaucccucuuuuuauggcaugccugggcauacccacacgaugauucaugaaaucggacacagccucggccuguaccacguguuccgcgguaucucagagauucaaaguugcuccgauccauguauggagaccgaacccagcuuugagacaggggaccuuugcaacgauacuaauccggcuccuaagcauaaaucuuguggcgacccaggacccggcaacgauaccugcggguuccacucauuuuucaauacaccuuacaacaauuuuaugaguuaugccgacgaugacuguacugauagcuucacccccaaccaggucgcacggaugcauugcuaccuggacuugguguaucagggauggcagccauccagaaagccugcccccgucgcucucgccccacaagugcugggucacacaaccgacucuguuacuuuagaaugguuuccgccuauagauggccauuucuuugagagggagcuggggucggcaugucaccuaugccucgaaggacgaauccuggugcaguacgcuagcaaugccuccucacccaugccauguagucccucuggccacuggagcccucgcgaggcggaaggucauccagacguagagcagcccugcaaguccucaguccggacguggagcccuaacucugccgugaacccgcacacaguuccacccgcuugcccugaaccacagggguguuaucuugaguuggaguuccuguacccccucgugccugaaucccugaccauuugggucacuuucgugaguaccgauugggacagcucuggcgcaguaaaugauaucaaauuacuggccguguccggaaagaacauaucacuuggcccgcaaaaugucuuuugcgacguucccuugacaauuagacucugggaugugggggaggaaguguauggaauccagaucuacacccuggacgagcaucuagaaauugaugcugccaugcugacaaguacagcagacacgccacucugucugcagugcaaaccucuuaaguacaaagucguuagggaucccccauugcaaauggacguggcgagcauccugcacuuaaaccguaaguucguggauauggaccucaaucugggcucgguauaucaguacugggucauuaccauauccgguacugaggagucugaaccuagccccgccgugacauauauccaugggucaggauacuguggcgacgguauuauccagaaggaucagggcgagcaaugcgacgauaugaacaaaaucaauggggacggauguaguuuguuuugccgccaggaaguuuccuucaacuguauugaugagccaucucggugcuauuuucacgacggcgauggggugugugaagaguucgagcagaagaccagcauaaaagacugcggagucuacacaccgcagggcuuucuggaucaaugggcuuccaaugccucagugagccaccaggaccagcagugcccugguuggguuaucauugggcaacccgcagcuagucagguguguagaacuaagguaaucgauuugucugaaggaauuucccagcaugccugguauccaugcaccaucagcuaccccuacucgcaacucgcacagacgaccuucuggcugagggccuauuuuucacagccuauggucgcugcggccgugauagugcaccuagucacagacggcacuuacuauggugaccagaaacaagagaccaucucuguucagcugcucgauacaaaggaccagagucaugaucugggccuucacguguuguccugucgaaacaauccacugauuauccccguagugcacgacuuaagccagccuuucuaccauucucaagcaguccgggugagcuuuuccucaccgcucguugcuauuagugggguggcccugcgcagcuucgauaacuuugacccagucacucuuucuuccugccagagaggagaaaccuauucacccgccgagcagaguugugugcacuucgcuugcgagaagacggauuguccugaacuggcaguugagaaugccagccuaaacugcuccucuucggacagguaccauggcgcgcaguguacagugagcugccggaccggguauguccuccaaauccgaagagaugacgaacugauaaaaucacagacuggacccuccguaacagugaccuguacugagggcaaguggaauaaacagguugcuugcgaaccaguggauugcaguauuccugaccaccaucaggucuacgccgcaucuuucagcugucccgaggguaccacauuugggucccaaugcucauuccagugucgccacccagcccaguugaagggaaacaacucucuguuaacgugcauggaggauggccucuggagcuuuccugaagcucugugugagcuuaugugccuggcaccgcccccagugccuaaugccgacuugcaaaccgcgaggugucgugaaaacaaacacaagguagguaguuucugcaaguacaaauguaagcccggcuaucaugugccaggguccagccggaaaucuaagaaaagagcuuuuaagacucagugcacacaggacggaucauggcaggagggcgccugugucccuguuaccugcgaucccccgccaccuaaauuccacgggcucuaccaaugcacaaauggauuucaguucaacuccgaauguaggaucaagugcgaggacagugaugcaagccagggccuggguucgaaugugauucauugucgcaaggacgggacuuggaacggaucuuuucacgugugccaggagaugcaaggccaguguuccguccccaaugaacuaaacagcaaucugaaacuucagugcccagauggcuaugccaucgggucagagugugcuaccaguugccucgaccacaacucugaauccauaauccugcccaugaaugugacgguucgagauauuccucauugguugaacccgacaagaguagagcggguggucuguaccgccggacugaagugguacccccacccagcauuaauccauugcgugaaagguugugaaccuuucaugggcgacaauuauugcgaugcuauuaacaauagggccuuuugcaacuacgacgggggagauuguugcacuagcaccguuaagacuaaaaaggugacucccuucccuaugucaugugaccuccagggcgauugcgcgugucgcgacccacaagcccaggagcacagucguaaggaccugagagguuauagccauggguga

SEQ ID NO: 60347 - RNA, 1875 nt, Artificial Sequence
  derived and/or modified sequence opt3 from PAPSS1__Homo_sapiens__NP_005434
auggagauccccggcagccugugcaagaaagugaagcucuccaacaaugcccagaacugggggaugcaaagagcuaccaaugucacauaccaggcacaccauguuucuaggaacaaacggggacaggugguagguacucgcggcggguuccgaggauguacgguguggcuuaccggccugucaggugccgggaagacaacugucaguauggcguuggaagaguauuuagugugccacggcauuccuuguuacacccuggacggagauaauauacgucagggccuaaacaaaaaucucggguuuagcccagaagacagagaggaaaacguuaggcggaucgcugagguggccaagcuguucgcagaugccggacuugucugcauuacauccuuuaucucuccguauacccaagaccgcaauaacgcuagacagauucaugagggugcaucgcugcccuucuuugaaguguucguagaugccccuuugcacguuugugagcagagggacgugaagggccucuacaaaaaggcucgggccggggaaaucaaaggauuuacuggcauagauucagaguaugagaagccagaagcgcccgagcugguccugaaaacagacagcugcgaugugaaugacugugugcagcaagucguugaacucuuacaggagcgcgauaucgugccuguagacgcaaguuacgaagugaaggagcuguaugucccagagaacaaacuucauuuggccaagaccgaugcugaaacgcugcccgcccuaaagauuaauaaaguggacaugcaguggguucaggugcucgcagaggguugggcuacuccucugaacggguucaugcgagaaagagaguaccuucaaugccugcacuuugacuguuugcucgauggaggcgucaucaaucuguccgugccaauuguauuaaccgccacacacgaagacaaggagaggcuggauggcugcacugcguucgcccucauguacgaggggcggcguguugcaauccuucgcaacccggaauuuuucgagcauagaaaagaagagaggugugcucggcaguggggaaccacaugcaagaaccaccccuauauaaaaauggugauggaacagggugacuggcugauuggcggggauuugcaaguccuagaccgaguguacuggaaugauggacuggaccaguaucgccucaccccuacggagcugaagcagaaguuuaaagauaugaacgccgacgcugucuucgccuuccagcuuagaaauccagugcauaacggccacgcacuguugaugcaagauacucacaagcagcuccuggagagggguuaccggcgccccguuuuacugcuacauccucucgggggcuggacaaaagacgacgaugugccacugauguggagaaugaagcagcacgccgcuguacuugaagagggagucuugaaucccgaaaccacugugguugcgaucuuuccgucuccuaugauguaugcaggccccacagaggugcaguggcauugcagggcccguauggucgcuggggccaacuucuacauugugggacgggacccagcagguaugccucaccccgagaccggcaaagaucuguaugaaccaagccauggggccaagguacucacgauggcucccggacugaucacccuugagaucgugccuuuucgaguugccgcauacaauaagaaaaagaaaagaauggacuacuaugauuccgaacaccacgaggacuucgaauuuauuucaggcacaaggaugcgcaagcuggcgcgggagggucaaaaaccaccggagggguucauggcucccaaggccuggacugucuugaccgaauacuauaagagucucgagaaagcauga

SEQ ID NO: 60348 - RNA, 1860 nt, Artificial Sequence
  derived and/or modified sequence opt3 from PAPSS2__Homo_sapiens__NP_001015880
augagcggcaucaagaaacagaagaccgagaaccaacagaaauccacaaauguggucuaccaggcccaccauguuucuagaaacaagaggggacaggugguagggacucgggguggcuuccgcgggugcacgguguggcugaccggacucucaggcgcugguaaaacaacuauuaguuuugcacuugaagaguaucuggucagccacgccauacccuguuacuccuuggacggggauaaugugcgacauggauuaaaccguaaucugggcuucucuccuggcgacagagaagagaacaucaggcggauugcggaaguugcuaagcuauuugccgaugcagggcucgugugcaucaccucguucauuucaccauuugccaaggaccgcgagaaugcuagaaaaauccacgagagcgcaggacugccguucuuugaaauauucgucgaugcuccccuuaacaucugugagaguagggacgugaagggucuguauaaacgggcucgcgccggcgaaauuaagggguuuacaggaaucgauuccgacuacgagaaaccugagaccccagaacgaguauugaagacuaaucucucuacaguuagcgauugcgugcaucaagucguggagcugcugcaggaacagaacauugugcccuauaccaucauaaaggacauucacgaacucuucgucccugaaaauaaauuagaucacguuagagcggaggcagagacgcugccaucccuuucaaucacuaaguuggaccugcagugggugcaaguacuaagugaaggcugggccacaccccucaaagguuuuaugagggagaaggaauaccuucaggugaugcauuucgauacccugcuggacgggauggcuuugccugacggagucauuaacaugagcaucccaaucgugcucccgguuucugccgaggauaaaacucggcuggaaggcuguuccaaguuuguguuagcacacggcgggcgucgcgucgcuauucugagagacgccgaguucuaugagcauaggaaagaggagcggugcucacgaguguggggaaccacauguaccaagcacccccacauaaagaugguaauggaaagcggugauuggcucguuggcggggaccuucaggugcuggagaaaauccgcuggaaugauggauuggaccaguacagacuaacgccucuggaacucaagcaaaaaugcaaggagaugaacgcggaugccgucuucgcauuucagcugaggaauccagugcauaacggccacgcccuucugaugcaggacacucggcgcagauugcucgagagggguuacaaacaucccguccuguuacugcacccucuagggggcuggacaaaggaugacgaugugccacucgacuggcguaugaagcaacaugccgcuguucuggaagagggagugcuugaccccaaaaguaccauuguagccaucuucccgucuccuauguuguaugcaggccccacugaaguccaguggcacugucggucccgaaugauagccggggcuaacuuuuacauugugggaagagauccagcggguaugccucaccccgagacaaagaaagaccuguaugagccaacccauggcgggaagguucucagcauggcacccggacugacgucgguggaaaucaucccuuucagggucgccgcuuacaauaaagccaagaaggcaauggauuuuuaugacccagcccgccacaacgaguucgauuuuauuucuggcacccggaugagaaaacuugcuagggaaggugagaauccgcccgacggguucauggccccuaaggcauggaaagugcugacagauuacuaucgcuccuuggaaaagaacuga

SEQ ID NO: 60349 - RNA, 936 nt, Artificial Sequence
  derived and/or modified sequence opt3 from PAQR3__Homo_sapiens__NP_001035292
augcaccagaagcugcucaaaagcgcccauuacaucgagcuuggcuccuaucaauacuggcccgugcuggucccuagagggauuagguuguauaccuacgaacagauaccaggaucuuuaaaggacaacccguauaucacagaugguuaccgggcuuaucugcccucacgccuaugcauuaaaagucucuucauccugagcaaugagacuguuaacauuuggucccaccuucugggcuuuuucuuguuuuucacgcucgggaucuacgacaugaccucugugcugccuucggcaucagccagccgagaagauuuuguaauauguaguaucugccuguucuguuuucaggugugcaugcucuguuccgucggauaccauuuauucucuugccaccguagcgagaagacauguagaagguggauggcgcuggacuaugcuggcauuuccaucgguauucuugggugcuacgugucaggaguguuuuaugccuucuacuguaauaacuauuggcggcagguuuacuugaucacuguccuggcaaugauacuagccguguuuuucgcucaaauucauccaaauuaucucacccagcaguggcagcgccugagaaguaucaucuuuugcagcguaucuggcuacggcguuauucccacacuucacuggguguggcugaacgggggaaucggugcaccuauuguccaagauuucgccccaagggugauagugauguacaugaucgcuuugcucgccuuccuguuuuauauuuccaaaguccccgaacgguacuucccuggccaguuaaauuaucuggggucaagccaccagaucuggcauauacucgcgguugugaugcuuuacugguggcaccagaguaccguauaugugaugcaauaccgccauucuaagccauguccggacuaugucucccaccuguga

SEQ ID NO: 60350 - RNA, 993 nt, Artificial Sequence
  derived and/or modified sequence opt3 from PAQR5__Homo_sapiens__NP_060175
augcugagccucaaacuucccagacuguucuccaucgaccagauuccucaaguguuucacgagcagggcauauuguucggguacaggcauccacagucuucagccaccgcuugcaucuuaagucuguuucagaugacaaacgaaacucuaaauauuuggacgcaccuccugccguucugguuuuucgcauggcgguuugucaccgcccuuuauaugacagauaucaagaacgacagcuacuccuggcccaugcugguuuauauguguacuucuugcguguacccuuugguaucgucaugugcgcauaccuucagcaguauguccaagaaugcucgccacauuugcuauuuucucgauuacggagccgugaaccuguucucucuggguagcgcaaucgccuauuccgcuuacacauuuccagacgcacucauguguaccacuuuccaugauuacuaugucgccuuagcugugcugaauacaauacuuucaaccggcuugaguugcuacagccgauuucuggagauccaaaaaccccgucuauguaagguuauuagagugcucgccuucgcguauccuuacacgugggacucucugccaaucuucuauaggcuuuuucuguuccccggggaauccgcacagaacgaggccacuucauaccaccagaaacacaugauuaugaccuugcucgcuagcuuucuguauagugcccauuuaccugaacggcuggcaccaggacgcuucgauuacaucggccacucucaucagcucuuucacgucugcgugauacuugcuacacacaugcaaauggaggccauucuguuggacaagacucuaagaaaggaguggcugcucgcgaccuccaaaccguucagcuuuucgcagaucgccggugcaauucugcuuuguaucaucuucucucuguccaauauuauauacuuuucagcugccuuguauaggauccccaagccugaacuccauaaaaaggagacauga

SEQ ID NO: 60351 - RNA, 1041 nt, Artificial Sequence
  derived and/or modified sequence opt3 from PAQR7__Homo_sapiens__XP_011539164
auggccauggcucagaagcugagccaccuccuucccucccugagacaagugauccaggagccucaguugucuuuacagccagaaccggucuucaccguugacagggcagaggugcccccucuguuuuggaaaccauacauuuaugccggcuaccggccccuacaucaaacauggcgcuucuauuuucgaacucucuuccagcagcacaacgaagcgguaaauguguggacgcaucugcuugcugcccuggucuugcuccugcgucuggcacucuuuguggagaccguugauuucuggggagacccucacgccuuaccacuguuuauaaucgugcuugcuucauucacauacuugaguuuuagcgcacuggcccaucuacuccaggcuaaguccgaauuuuggcacuauucuuucuucuuucuggauuacgucgggguggccguauaucaauucgguucggcgcuugcacacuucuacuacgccauugagcccgcuuggcaugcccagguucaggcaguguuucugccuauggcugccuucuuggcguggcucucaugcaucggcagcuguuauaacaaauacauucagaagccagggcuguuaggaagaacuugccaagaggucccgagugugcuggccuaugcacucgacaucucccccgugguccacaggauauuuguuucuagcgauccuaccacagacgauccagcccuucuguaccauaaaugucaggugguauucuuuuugcuagcugcugccuucuuuuccaccuucaugcccgaacggugguuuccuggcucaugccacguguucggucaggggcaccaacuguuucauaucuuccucguccuguguacucuugcacagcuggaggccguggcuuuggacuaugaagcgcgcagaccaauuuacgagccccuccacacacauuggccgcacaauuuuaguggacuguucuuacugaccguuggcagcucuauccuaacggcauuccuccugucccagcuugugcagaggaaguuggaucaaaagacuaaauga

SEQ ID NO: 60352 - RNA, 3618 nt, Artificial Sequence
  derived and/or modified sequence opt3 from PARD3B__Homo_sapiens__NP_001289698
augaaggugaccgucugcuucggcagaacagggaucguugugcccuguaaagagggacagcugaggguaggugaacucacucaacaggcccuucagcgguaccugaagacgcgcgagaaaggcccuggguauugggugaagauucaccauuuggaauacaccgacggaggcauauuagauccagacgauguccuggcugacgugguugaggauaaagacaagcuaaucgcaguguuugaagaacaggagccgcuccacaagauugaaagccccuccgguaacccugccgaucgacaaucuccagacgcguucgagacagaagucgcugcccagcuggcagccuuuaaacccaucgggggagagauugaggugacuccuucagcucuuaagcugggcaccccauugcucguacguagaaguagcgaucccguuccuggcccaccggcagacacacagcccuccgccucucauccugggggacagucgcugaaacugguggucccagauucaacccaaaaucucgaagacagggagguguuaaacggugugcagacugaacugcuuacaagcccccggaccaaggauacguugagugacaugacucgcaccgucgagaucuccggcgaagggggaccucugggcauacacguugugccauucuuuucuagccuauccgguagaauccucgggcuguucauuaggggaaucgaggacaauucacggaguaaacgcgagggccuuuuucaugaaaacgagugcauuguaaagaucaauaacguggaucuggucgacaagacauucgcucaggcccaggauguguuucgacaagcgaugaaaagccccucuguuuugcuccacgugcugccgccucagaauagagaacaguaugagaaguccgucauaggcucauuaaacauuuucgggaauaacgacggagugcugaaaacuaagguacccccaccuguucacgguaaaagcggccucaagaccgcaaaucuuacagggaccgauagucccgaaacggacgccucugcuucccugcaacagaacaaaagcccaagggugccccgguugggaggcaagccuucgucuccaucccuaucaccgcugauggguuuugggaguaauaagaacgccaaaaagaucaaaauugaucucaagaaaggccccgagggacugggcuucacugucgugacacgugacagcuccauccaugggccuggaccaaucuuugucaagaauauucuucccaagggugcagcuauaaaagauggccgccugcagucuggggacagaaucuuggaggugaacggaagggauguuaccggccggacucaggaagaacucguggccaugcugcgaagcacaaagcaaggugaaaccgcgucauuaguaauugcccgccaggaggggcacuuccugccuagagaacuaaaaggcgagccagacuguugcgcacucagucuggagacguccgaacagcuuaccuucgagauccccuugaacgacagcggaucugcuggccugggggucucacucaagggaaauaaaaguagggaaacagguacugaucugggcauauuuauuaagagcaucauccaugggggagccgcuuucaaggacggccggcuucgcaugaacgaucagcugauugccgugaauggugaguccuugcucgggaaaucuaaccacgaggcaauggaaacccugagaaggucgaugagcauggagggcaauauccguggaaugauucaauuaguuauacugcggcgaccggaaagaccuauggaggacccagccgaauguggcgcuuuuuccaagcccugcuucgagaacugucagaaugcggugacaacuucaaggcgcaacgauaauaguauccuacacccucucgggaccugcucuccccaggacaaacagaagggacugcuuuugccaaacgauggcugggcagagagcgaagucccucccuccccaacaccgcauucagcccugggucucgggcuggaggacuacagccacucuuccggaguggauagugcuguauauuuuccugaccaacauauuaauuuccggagcgugacccccgccagacagccagaaucuaucaacuuaaaagcauccaagucaauggaucugguucccgacgagaguaagguccacagccuugccggccagaaaucggaauccccuucuaaggauuuugguccaacuuugggccucaaaaagagcucaagucuggagucccuacagacggcuguggccgaggugaggaaaaaugaccugcccuuccaucgcccucgaccgcacaugguccgggggcguggauguaacgaaucuuuuagagcagcgaucgacaagagcuacgauggcccagaggaaauugaggcugacgggcucuccgauaaaucaagccacaguggacaaggcgcccugaauugcgaaucugcaccccaggguaacuccgagcuugaggacauggaaaacaaggccaggaagguuaaaaagacaaaagagaaggagaaaaagaaggagaaagggaaguugaaagugaaggagaaaaagcgcaaggaagagaaugaagauccugagcggaaaauaaagaaaaagggauucggcgcuaugcugagauuugguaaaaagaaggaagacaaaggcgggaaggccgagcagaaaggaaccuuaaagcauggcgggcucagggaggaggagcuggagaaaaugaaggaagaacgagagcgcaucggagcaaaacaccaagagcuucgggaaaagcaggcuagaggccuguuggauuaugccacuggugcgauugggagcguguacgacauggaugacgaugagauggacccaaacuacgccaggguaaaucauuuccgugaacccuguaccucggcuaacgucuuucgcucaccuucuccgccccgggcaggaccauucggcuauccuagagauggucacccccucaguccagagagggaccaccuggaaggccuauacgccaaggugaauaaaccuuaucauccccugguuccagcugacuccgggcgaccgacaggaggcagcaccgaucggauccagaagcuccgcaaagaguacuaucaggccagaagggagggguucccucuguacgaagacgaugagggacgggcacgacccucugaauaugaccuuuugugggugccaggcagaggucccgaugggaacgcgcacaaucugcgcuuugagggaauggagaggcaauacgccagcuuaccucguggcggcccagcugaccccgucgauuaccucccugccgcaccgcgggggcuguauaaggaaagagagcuuccauacuaucccggagcucauccuaugcaucccccaaaagguuccuacccuaggcccacugaacugcgcguggccgaccuacgauauccacagcacuacccuccgcccccagcaccucagcacaagggccccuucagacaggauguuccaccuucacccccgcaacaccagcggaugccagccuaucaggagacagggaggccuggaccccgcggcgguaguccagaccaguaccccuaccguacgcaagauagcagacagaagaacccuaugaccgcugcgguguga

SEQ ID NO: 60353 - RNA, 4062 nt, Artificial Sequence
  derived and/or modified sequence opt3 from PARD3__Homo_sapiens__NP_001171714
augaaggugaccgucugcuucggcagaacaaggguugugguacccuguggggacggacacaugaaaguguuuagccugauccagcaagccgucacucgguaccgcaaggcuauugcaaaagauccuaacuauuggauacaggugcaucgacucgagcacggugacggcgggauccuugaucuggacgauauuuugugcgacguugccgaugacaaggaucguuuaguggcggucuucgacgaacaggauccacaucacggaggcgacgguacguccgcuucuucaaccgggacacagaguccggagaucuuuggaagcgaacugggcacuaauaacguguccgccuuccaacccuaccaggcaaccucugagauugaaguaacaccuucgguucuaagagccaauaugccacuccaugugaggcggucaagcgaucccgcucugaucggccuuaguaccuccgucucugacagcaacuuuuccucagaggagccuagucgcaaaaauccaacuagauggagcacaaccgcaggguuccugaagcagaacacggccggaucucccaagacuugugacaggaaaaaggaugaaaauuaucgguccuugccucgcgacaccucaaacuggagcaaucaguuucaacgagauaacgcuagaaguucucucuccgccagccacccaaugguggguaaauggcuggagaagcaggaacaggacgaggauggcacagaggaagacaauucgaggguggagccggucgggcacgcggauacuggacuggaacauauacccaacuucucucucgacgauaugguuaaauuaguggagguaccuaaugacggcgguccacuggggauccacgugguccccuuuuccgcacggggaggccguacccuuggcuugcuggugaagcgccuagaaaaagggggaaaagccgagcaugagaaccucuucagagaaaaugauugcauuguuaggaucaacgacggugaccugcggaaccgacgcuuugagcaggcucaacacauguucagacaggccaugaggacaccuauuaucugguuucacguggucccagcagcuaauaaggaacaguacgagcaacuuucacagagugaaaagaacaauuauuacagcucccgguucucucccgauagccaguauauagacaaccgcucagugaauagugccggccugcauaccguacagagagcgccgagguugaaccacccucccgagcaaauugauucccauagccgucucccacacucugcccauccuucagggaagcccccaagugcacccgcuagcgccccucagaauguuuucuccacgacugugucuucgggauacaacaccaaaaagaucggcaaacggcugaauauucaguuaaagaaggguacagaggggcugggcuuuagcaucacuucccgagacgucacaaucggaggcucagcuccaauuuacgugaaaaacauacucccgagaggggccgcaauccaggauggaaggcuuaaggccggugaccgccugauugaagucaauggcguggauuugguugggaaaagucaagaggaagugguaucucuacugcggagcaccaagauggagggaacggucucccuccugguguucagacaggaagacgcuuuucaccccagggagcuuaacgcggagccuucacagaugcagaucccaaaagaaaccaaggcagaggaugaagacauaguucugacacccgauggcacucgcgaguucuugaccuuugaggugccucucaaugacagcgguucugccgggcugggcgucuccgugaagggaaaccgaaguaaagaaaaucacgcugauuuaggcauuuucguaaagagcaucaucaacgggggagccgcaucuaaagacggucggcugcgugugaacgaccaacuaauugccguuaauggcgagucccuccuggggaagacaaaccaggaugcuauggaaacucuuagaaggucaaugaguaccgagggaaauaaacgcggcaugauccaguugauugucgcccggagaauaagcaaguguaacgaacugaagucgccagguucucccccggggccugagcucccaaucgagacagcacuggacgauagggaacgacgcauuucccauagccuuuauucaggcaucgagggacuggacgaaagucccucccggaaugcggcuuugucuagaaucaugggcaaauaccagcucagcccuaccgugaacaugccccaagaugacacugugauuauagaggaugacaggcugccagucuuaccuccccaccuguccgaucagucaagcaguucuucccaugacgauguuggguuugugacggccgacgcaggaacaugggccaaggcugccaucagcgauucggcagacugcucacuaucuccagacguggauccgguacucgcuuuccagcgugaaggcuuuggucgccaaaguauguccgagaaacggaccaagcaguucagcgacgccucucagcuggauuuugucaaaacuagaaagagcaaguccauggaccuugggauugcggaugagaccaaauugaauacaguggacgaucagaaggccggaucaccuaguagggacguuggccccagccugggucucaaaaagucuuccucacuggaaaguuuacaaaccgcuguggcagaggucacucugaacggcgauaucccauuccaccgaccccggccucgcauuaucagagggaggggauguaaugagagcuuucgggccgcuauagacaaauccuaugauaagccagccguggacgacgaugacgaaggcauggaaacacuugaggaggauacggaagagucuucgcgaagcgggagagaaucaguuuccaccgcaagugaccagcccucucacagcuuggagcgccagaugaacggaaaucaggagaaaggcgauaagacugacaggaagaaagauaagacagguaaagaaaagaaaaaggaccgugauaaggagaaagacaagaugaaagcgaagaaagggaugcucaagggacugggcgauauguuccgguucgguaagcauagaaaagacgauaagaucgagaaaaccggcaagauuaaaauccaagaauccuuuacaucagaagaggagaggauucgcaugaagcaggaacaggagcgaauccaggccaagacuagagaguuccgggaaaggcaagcucgcgaacgugacuacgccgagauacaggacuuucacagaaccuucgggugcgaugacgagcuaauguauggaggcgugucuagcuacgaagggaguauggcacugaacgcucggccucaguccccgagggagggacauaugauggaugcccucuaugcacaagucaaaaagccacgcaauagcaaacccucuccugucgacucaaaccgauccacgccaaguaaucacgaucggauucagagacugaggcaggaauuucagcaagccaagcaggacgaggauguggaagaccgcagaaggaccuacagcuucgagcagcccuggccuaacgcucggccggcgacacagucgggccgucauucuguguccgucgagguucaaaugcagcgccagcgacaggaagagagagaaagcucacaacaggcccagaggcaguacaguucucuuccccggcaaucccgcaaaaacgcaagcucagugagucaggauagcugggagcagaauuauuccccaggugagggguuucaaucugcuaaggaaaacccuagauacagcuccuaucagggaucaaggaauggcuacuuggguggccacggguucaacgcccggguaaugcuggagacucaggaauuacuccgacaggagcaaagacgcaaagaacagcagaugaagaagcagcccccaucugagggaccuaguaauuaugacucguacaaaaaggugcaagaucccagcuaugccccaccgaaaggcccuuuuaggcaggacguacccccaucccccucucagguggcucggcugaaccgucuucagaccccugagaaggggagaccauucuacucauga

SEQ ID NO: 60354 - RNA, 1038 nt, Artificial Sequence
  derived and/or modified sequence opt3 from PARD6A__Homo_sapiens__NP_001032358
auggccagaccccagaggaccccugcucggagcccagacuccaucguggaggucaagucuaaauucgaugcagaauuucgccgauucgcccugccgcgugcgucaguuaguggcuuucaagaguucagcagacuccuuagggcugugcaccagauucccgggcuggacguauuguuaggauacacagaugcccauggugaccugcuaccucucacuaacgaugacucccugcaccgggcacuugccucuggcccacccccucugcgcuugcucgugcagaagagagaagcugauucgucagggcuggcauuugccagcaauagucugcagaggcggaaaaagggacucuuacugcgcccagucgcuccccuucgaacgagaccuccauugcugauaucccuaccgcaagacuucaggcaagugucuagcguuaucgauguggaccuccugcccgagacccaucggcguguccgccuucacaaacauggcuccgauagaccucuggguuuuuauauuagggacgggaugucagugcggguagccccacagggauuggaacgaguucccggcaucuucauuagucgccucgugagaggcgggcuggcggagagcacaggauuacuggcagucucugaugagauccucgaagugaacgguauagagguggccggcaagacucuugaccaggucaccgacaugaugguugcuaauucccacaaccugaucgugacaguaaagccugccaaucagaggaacaaugugguccggggcgcaucaggacgcuugaccggcccacccagcgcugguccggggccugccgaacccgauagugacgaugacucuuccgaucuagugauugagaacagacagccaccuagcucgaauggacugucucaggggcccccaugcugggaccuccaccccggcuguaggcauccugggacucguuccucacugccaagucuugaugaccaggagcaagcgagcuccggaugggguucucggauccgaggcgaugggagcggauuuucacuguga

SEQ ID NO: 60355 - RNA, 1119 nt, Artificial Sequence
  derived and/or modified sequence opt3 from PARD6B__Homo_sapiens__NP_115910
augaacagaagccacaggcauggcgccggguccggaugccuggguaccauggaggugaagucuaaauucggcgcugaauuucggcgcuucucacucgagcgaaguaagcccgggaaauuugaagaguucuacggacuucugcagcacguccauaagaucccuaauguugacguguugguaggcuaugcagauauucacggugacuuacugccaauaaacaaugaugacaacuaccauaaagccgugagcacagcgaauccgcuacuccguaucuuuauucaaaagaaggaagaggcugauuauuccgccuucgggacugacacgcugaucaaaaagaaaaacguccuuaccaaugugcugagacccgauaaccacaggaagaaaccucacauuguuaucucuaugccacaggacuuucggcccgugucgucaauaaucgaugucgacauuuugccugagacacaucgcagagugaggcucuacaaguauggaacugaaaagccacugggcuucuacauccgggauggcagcaguguacgcguuacaccccacgggcuggagaaagugccuggaauuuuuaucucccgacucgucccagguggcuuagcacagucuaccgggcugcuugccgugaaugacgaaguguuggaggucaacggaauagagguuagcggcaagucccuggaucaggugaccgacaugaugauugcuaauucaagaaaccuaaucauuacuguaaggccggcaaaucaacggaacaaugugguccguaacagucgcacaagcgguucuuccgggcagucaaccgacaacagccuccugggauauccccagcagaucgaaccuaguuucgagccagaagaugaggacucugaagaggaugacaucauuauagaggauaauggcgugccccaacagaucccuaaagccguuccaaacacggaaucccuugagagccugacucagauugaauugucguuugagucuggccagaauggguucauccccuccaacgaagugucacucgcugccauagcgaguagcuccaauaccgaguuugagacacaugcaccggaccaaaagcuguuagaagaggauggaacuauuaucacccuguga

SEQ ID NO: 60356 - RNA, 2685 nt, Artificial Sequence
  derived and/or modified sequence opt3 from PARG__Homo_sapiens__NP_001290415
auggacaccaagggcaucaaaacagccgagagcgaaucccuggauucuaaggagaacaauaacacuagaauugaaucaaugaugaguagcgugcagaaagacaauuucuaccaacacaacgucgagaagcucgaaaauguuucccagcuuucucuggauaaaucgcccacggagaagucaacccaguauuugaaccagcaucaaacagcugcaaugugcaaguggcagaaugaggggaaacacacugaacaguuacuggagagcgaaccucagaccgugacccuaguaccagagcaauuuaguaacgccaauauagacagguccccgcagaacgaugaccauucugauacagacagcgaggaaaaucgggauaaccagcaguuccucacuacagugaagcuggcgaaugcuaaacaaaccacggaggacgaacaggcccgcgaggcaaagucccaccagaaauguucaaagaguugcgaucccggagaagacugugccagcugccaacaggaugagaucgacgucgugccugagucuccacuuuccgacguugguucagaagaugugggcacugggcccaagaacgacaauaaacugacccgacaggagagcuguuugggaaacaguccuccauuugaaaaggagucugaacccgaguccccuauggaugucgacaacagcaaaaauucgugccaggauucugaggcugacgaagagacauccccaggcuucgaugaacaagaggacgguucaaguagccagacugcaaacaagccgucccguuuucaggccagagaugcugacauugaguucaggaaacgguacucuaccaaagggggagaagugcgccuccauuuucaguucgagggcggcgaaagcagaacagggaugaaugaucugaacgccaaacugcccggaaauaucucaagucucaacguagaguguaggaacuccaagcaacacgguaagaaagacagcaagauuaccgaccacuuuaugcgguuaccuaaagcggaagaucgccgaaaggagcagugggagacgaaacaucagagaacugaaaggaagaucccaaaguauguucccccucaccugucuccagacaaaaaguggcuuggcacacccauagaggaaaugcggcguaugccgcgcugcgggaucagauugccucugcuaaggcccucagcaaaucauaccgugacuauucgggucgaucuccugcgagccggagaggugccaaaaccuuuccccacacacuacaaggaccuuugggauaauaaacacgugaagaugccauguagugaacagaaccuguaucccgucgaggacgagaauggcgaacgcaccgcugguagcagaugggaguugauccaaacggcccuccugaacaaguuuaccaggccucagaauuuaaaagaugcaauucugaaguacaacguugcuuauuccaaaaagugggacuucacagcccucaucgauuuuugggacaaagugcuugaagaggcggaagcccagcaucuguaccagucuauauugccagauaugguaaagauugcacuaugccugccgaauaucuguacucaacccauuccucuccugaagcagaaaaugaaccacucgaucaccaugagccaggagcaaaucgcuucccuucuggccaacgcuuucuucugcacauuuccacggcgcaaugccaagaugaaaucagaguacaguucuuaucccgacauuaacuucaauagauuguuugaagggaggagcucccguaagccugagaaacucaagacucuguucugcuacuuucggcgagugaccgaaaagaagccaacaggauuagucaccuucacuagacagucacuggaggauuuucccgaaugggagaggugugagaagccgcuaacgcgccuccaugugacauaugaaggcaccauagaggaaaacggccaggggaugcugcagguugacuucgcaaaucgguuugugggagguggcgucacuagcgccgggcuugugcaagaggagaucagauucuugauuaacccugaacugaucauaucuaggcucuuuaccgagguacuggaccacaaugaaugccuuauuaucacaggaaccgagcaguacuccgaauauacuggcuacgcugagacauaucgcuggagucgaagccaugaggaugguucugaacgggacgauuggcagcguagauguacggagaucguugcgauugacgcacugcacuucaggcgcuacuuggaucaguuugugccagagaaaaugcggagagaacucaacaaggccuacugcggguuccugaggcccggcgucuccucagaaaauuuaagugcuguggccaccggaaacuggggcuguggggcauucggaggugacgcccgacugaaagcucuaauccaaauucucgccgcagcggcugccgagcgcgaugucguguauuuuacuuucggcgacagcgagcugaugcgggauauauacucgaugcacaucuuucuuacagaaagaaaguugaccguuggggacguguauaaacugcuccugagguacuauaaugaggaaugccguaacuguuccacaccuggacccgauauuaaguuauacccauucaucuaucaugcaguagagucuugcgccgaaacugcugaccacagcggccagcgcaccgguacguga

SEQ ID NO: 60357 - RNA, 1398 nt, Artificial Sequence
  derived and/or modified sequence opt3 from PARK2__Homo_sapiens__NP_004553
augaucguguucgucagauuuaacagcucccacggcuuccccguugagguggacucugauaccucaauuuuucagcugaaggaaguaguggccaaaaggcaaggggucccugcugaccagcuccgggugauauucgcaggaaaggagcuucgcaaugauuggacaguucagaacugcgaccuggaucagcaaaguaucgugcauauuguccagcgaccauggcguaaaggucaggaaaugaaugccacuggcggggacgauccgagaaacgcggcuggaggcugugagagggaaccccagagcuugacgcggguggacuuauccucuucgguacugccuggugauucaguugggcuagccgugauccuccacaccgacagccgcaaggauaguccacccgcaggauccccugccggcagaucuauuuacaauagcuuuuaugucuacugcaaaggcccaugucaaagggugcagcccgggaagcugcgggugcagugcuccacaugucgccaggcuacucuuacccugacacaaggaccuucaugcugggacgaugucuugaucccaaaccgaaugaguggugagugucagagcccgcauugccccggcaccucugcagaguucuuuuucaaguguggggcccacccuacuuccgacaaagaaacaucaguugcucuccaucugauagccaccaauagcagaaacaucacgugcauuacuuguaccgacgugaggaguccaguacugguguuucagugcaauucucggcacgucaucugccucgauuguuuccacuuauauugcgugacacgucugaacgaccgccaauuuguucaugauccccagcuuggauacuccuugccuuguguggcgggcugcccaaauagccugauuaaggagcuacaccauuucagaauccucggugaagaacaguauaacagguaccagcaauauggggcagaggaauguguccugcagaugggaggcgugcuuugcccccggccgggcuguggggccggacuguugccugagcccgaccagcgaaaaguaacuugcgaagguggcaaugggcucggauguggcuuugcuuucugccgcgaguguaaggaagccuaccacgagggugagugcucggcaguuuucgaggcuucugggaccacaacccaggccuacagaguggaugagagggcggccgaacaagcacggugggaggcugccuccaaagaaacgauaaagaagacuacaaaaccaugcccucgcugucacguccccguggagaagaacggcggaugcaugcauaugaaauguccacagccccagugcagacuggagugguguuggaauugcggcugugaauggaacagggucugcaugggggaccacugguuugauguguga

SEQ ID NO: 60358 - RNA, 990 nt, Artificial Sequence
  derived and/or modified sequence opt3 from PARL__Homo_sapiens__NP_001032728
auggccuggagaggcugggcucagaggggguggggaugcggucaagcauggggcgccagcgucgggggacgguccugugaggaacugaccgcggugcucacacccccucagcuucugggccgccgauucaacuuuuucauccagcagaagugcgguuuucguaaagcuccaagaaagguugagccgaggcggucugaccccgggacuucaggagaagccuacaaacgcagugcauugauuccuccaguggaggaaacgguauucuaucccagcccuuacccaauaagauccuuaaucaagccccuguuuuucaccgugggcuuuacaggcugugccuucgggucugcugcaauuuggcaauaugagucgcuaaaaucaaggguccagagcuacuuugauggaaucaaggccgacuggcucgauaguauucggccucagaaggagggugacuuccgcaaagaaaucaauaagugguggaacaaucuguccgauggccagcgaacugugaccgggauaaucgcugccaacguucuuguguuuugccuguggagagucccaucuuugcaaaggacaaugauucgguauuucaccagcaauccggcguccucagugaucaguaacuuuguaagcuacguuggaaaaguggcaacuggccguuauggucccucucucggggccuccggagcuauuaugacaguccuggccgcaguguguaccaagaucccugagggccgccuggcuauaauuuuccucccaauguucacguuuacugccggcaaugcguuaaaagccaucauugcaauggacaccgcugggaugauccugggauggaaguucuuugaucacgccgcucaucuugguggcgccuuguucgggaucugguacgugacauacggacacgaacugauuuggaagaacagagagccccuagucaaaauauggcaugagaucaggacuaauggcccuaagaaaggugggggcucaaaguga

SEQ ID NO: 60359 - RNA, 933 nt, Artificial Sequence
  derived and/or modified sequence opt3 from PARM1__Homo_sapiens__NP_056208
augguguacaagacccuguucgcccucugcauccuuacagcuggcuggagaguccagagccugcccacuuccgcaccuuugucuguuucauuaccaacgaacauugugccgcccaccacaauauggaccaguagcccucaaaauacugacgccgauacagcguccccaucuaacgggacccacaauaacucgguacugcccgugacugcuucagccccuacaagccuacuccccaaaaauaucaguauugaguccagggaagaggaaaucaccucuccaggaagcaacugggaggguacgaauacugacccuuccccaucaggcuuuaguagcaccucugggggaguccaucugacaacuacccuugaggaacacuccucaggcacaccggaggccgguguggcagcuacccugagccagagugcagccgaacccccuacguugauuucuccacaggcucccgccuccagcccuucgucucucuccacuucaccacccgagguuuucagugcgagcgugacaaccaaccauuccucuacugucacaagcacccagccgacgggggcaccuaccgcccccgaaucaccaacagaggagaguuccagcgaucacacuccuaccucucaugcuacagccgaacccgugccacaagagaagacucccccuaccacaguaucaggaaaaguuaugugugaacugaucgacauggagaccacuacgacauuuccacgggugauaaugcaggaagucgagcacgcacugaguagcggcuccaucgcugccauuaccgugacugugaucgcggucguucucuuaguguucggcguagccgcauaucugaagauucgccacucuucguacgggcgacuuuuggaugaccaugauuauggaagcugggguaauuacaacaauccgcuguaugacgauuccuga

SEQ ID NO: 60360 - RNA, 1737 nt, Artificial Sequence
  derived and/or modified sequence opt3 from PARN__Homo_sapiens__NP_001127949
auggacuuccugcucuuucaguucggccuuugcaccuuuaaguacgauuauacagacagcaaauacaucacuaaguccuucaacuuuuauguguuccccaaaccuuuuaauagaucuucaccagaugucaaguucguuugucaaaguagcuccauugacuuucuggccucucagggguucgauuuuaacaaaguguucaggaauggaauaccguacuugaaccaggaggaagaacggcaguuacgcgaacaauaugacgagaagcgaucgcaggcuaauggugcaggcgcccugucauacguaagccccaacacgaguaagugcccugugaccaucccagaagaucagaaaaaguuuauugaccaggucguggagaaaaucgaggaucuacuccaauccgaagagaauaagaaccuggaccuugaacccuguacaggguuccagcguaaacugauuuaucagacuuugucuuggaaguacccuaagggaauccacguugagacccucgagacagagaaaaaggagagauacauagugaucagcaaagucgaugaagaggaaaggaagcggcgcgagcagcaaaaacaugcgaaggagcaggaagaacugaaugacgcugugggcuucuccagaguaauucacgccaucgcaaacucagguaaacugguuauugggcauaauaugcucuuagaugugaugcacaccguccaucaguuuuauugcccacugcccgccgaccuuagugaguucaaggagaugacuacauguguguuuccuagguugcuggacaccaagcuaauggcuagcacgcaaccauucaaagauaucauaaacaauacuucucucgcagaacuggagaagcggcuuaaagagaccccguuuaaucccccuaagguggaauccgccgagggauucccaucauacgacacagcuagcgaacagcugcacgaggccggcuaugaugcguacauuacuggcuugugcuuuaucaguauggcaaacuaucucgggucuuuccuguccccucccaaaauucacgucagcgcccgcucgaaguuaaucgaaccauuuuucaacaagcuguuucucaugcgaguuauggacauccccuaccuuaaccuggagggaccggauuugcagccuaaaagagaccaugugcuacacguaaccuuccccaaggaguggaaaacaucugaucuguaucagcucuuuuccgcuuucgguaauauucaaauaucauggaucgacgauaccagugccuucgugagccugucccagccagaacaggucaagauugcagugaacacgucuaaauacgcugagagcuacaggauccagacuuaugccgaauacaugggccggaagcaagaggagaagcagauaaaacguaaguggacagaagacucauggaaagaggcggauaguaagcgccuuaauccucaguguauucccuauacccugcagaaccauuacuauagaaauaacuccuuuacugccccaagcacaguugggaaaaggaauuugucucccucacaagaagaggcaggacucgaagacggcgugaguggugagaucagcgacaccgagcuggaacagacggauuccugcgcugagccuuuaucugaagggcggaagaaggccaaaaagcugaaacgaaugaagaaagagcuaucgccagcuggaagcaucuccaagaacucaccggccacccucuucgaaguccccgacacaugguga

SEQ ID NO: 60361 - RNA, 2106 nt, Artificial Sequence
  derived and/or modified sequence opt3 from PARP12__Homo_sapiens__NP_073587
auggcccaggcuggcguggucggggagguuacccaagugcugugcgcagccggaggugcgcucgaacuucccgagcugagaaggcgguugcgcaugggcuuaagcgcugacgcccuggaacgacuacuccgucagagagggagguucguaguggcaguccgggccggaggcgcugcagccgcuccugagcgcgugguucuggccgcguccccacuuagacuguguagggcacaccaggguucuaagccggggugcgugggauugugugcccagcuccaucugugccgguuuauggucuacggcgcuuguaaauuccugcgcgccggcaagaacugccgaaauucacacagucucacaacugaacauaacuuaagcgugcugagaacgcacgggguagaucaucuuuccuauaaugaguugugucaacugcuauuucagaacgaccccuggcuccugccugagaucugccagcacuacaauaaaggagaugguccacacggcucuugugcauuccagaagcaaugcauuaaacuucauauaugucaguauuuucugcagggggaaugcaaguucggaaccucgugcaagaggucacacgacuuuagcaacagugagaauuuggaaaaacucgagaagcugggcauguccucugauuuaguuagccggcugcccacaaucuaccguaacgcucaugacauuaaaaauaaguccucagccccuagucgcgugccaccccucuucgucccucaggguacuagcgagagaaaagauucuuccgggucagugagcccaaacacccuuagucaagaagagggagaccagaucugucuguaucacauuaggaagucuugcuccuuucaggauaagugucaccgggugcauuuccacuugccguaccgauggcaauuucuagaccgcggcaaaugggaagaucuggacaauauggagcucaucgaagaggcguauugcaaccccaagauagagagaauccuguguagcgaaucggccucuacauuccauucccacugccuuaauuuuaacgcaaugaccuacggcgcuacucaggccaggcggcugucaacagcuaguagcgucaccaaaccuccacauuucauuuugacgacugauuggaucugguacugguccgacgaguucgggucuuggcaggaauauggacgccaggguaccguucaccccgugacaacuguaagcucaagugacguggagaaggccuaccucgcauauuguaccccuggcuccgaugggcaagccgcuacacugaaauuucaggcgggaaagcacaauuacgaauuagacuucaaagcauuuguccagaagaaccugguguauggcaccacgaagaaaguuugcagaaggccaaaguacgugagcccccaggaugucacuacaaugcaaaccuguaacacuaaauucccggguccuaagucuauucccgacuauugggauucaagugcccuaccagacccuggguuucagaaaaucacacucagcuccucuucggaggaguaccagaagguguggaaucuguucaaccguacccuucccuuuuacuucguacagaagauagaacggguucaaaauuuggcucugugggagguguaucaguggcagaaaggccagaugcaaaagcagaacggaggcaaagccgucgaugaacgacagcucuuucaugggacgagcgcaauuuucguggacgccaucugccaacagaauuuugauuggagagucuguggagugcacgguaccuccuacggcaaggggucauauuucgcuagggacgccgcauacagucaucacuauucuaaaagcgauacacagacucacaccauguuucuggcgcgcguucuugugggagaguucguacggggcaacgcuuccuucgucagaccacccgccaaggaagguuggucaaaugcauuuuacgacagcugcgugaacucuguuuccgacccuaguauuuucgugaucuuugagaagcaucaggucuauccagaguacgugauccaauacacaacuagcucuaaaccguccguaacccccucaauucuguuggcccucgggagucuguucagcucgaggcaguga

SEQ ID NO: 60362 - RNA, 5406 nt, Artificial Sequence
  derived and/or modified sequence opt3 from PARP14__Homo_sapiens__NP_060024
auggccgugcccggcagcuucccucugcucgucgagggguccuggggaccagacccgcccaagaaccuuaauaccaaacugcagauguacuuucaaucuccuaagagaucagguggcggggaaugcgagguuaggcaggauccacggagucccagccgcuucuugguguuuuucuauccugaagacguacgacagaaaguguuagagcguaagaaccacgaacuggucuggcagggaaaaggcacauuuaagcuaacugugcaacucccagcuacgcccgaugagaucgaccauguuuucgaggaagagcugcuuaccaaggaauccaaaacaaaggaggaugugaaagagccugacgucucugaagagcuggauacuaaguugccacucgacggugggcuggauaaaauggaagacauuccggaggaaugugagaauauaucgucacugguggcauuugagaaccucaaggccaauguaaccgauaucauguuaauucugcuuguugaaaacaucagcggauugaguaaugacgauuuccagguggagauuaucagagacuuugacgucgcgguggugacauuccagaagcacauagauaccaucagguuugucgacgauugcacuaaacaucacuccauuaagcagcugcaacuaucuccccggcuccuggaaguuacaaacaccauccgcguggagaaucuuccuccaggcgcugacgauuacagccugaaauuguucuuugaaaaccccuauaauggcgggggaagaguagccaacguggaguacuucccugaggaauccucagcacucauugaguucuuugacaggaagguccuggauacgaucauggccacuaaauuagacuucaauaagaugccacugaguguguuucccuauuacgcuagccucgguaccgcacuuuauggcaaagaaaagccgcugauaaaguugccugcccccuucgaggaaucucuagaucugccacucuggaaauuucugcagaagaaaaaccaucuuauugaggagaucaaugacgaaaugcggcgcugucacugcgagcugacauggucccaguugucagggaagguuacuauucgaccugcugccacccucgugaacgaaggaagacccaggaucaaaacauggcaggcggauaccagcacgacucugaguucuauccgguccaaguacaaggucaacccaauuaaaguggaccccacaaugugggacaccauaaagaaugauguaaaagacgaucguaucuuaauugaguucgacacucugaaggagaugguuauccuagcaggcaaaagcgaagaugugcaaucgauagagguccaggugcgcgaacucauugagucuacaacccagaagaucaagagagaagagcaaucccugaaagagaagaugaucauuucaccugguagguacuuucuuuugugucacaguagccugcucgaccaucugcuuacggaaugcccagagaucgaaauuuguuaugaucgggucacccagcaccugugcuugaaagggccguccgccgacguguacaaggcuaaaugugagauacaggaaaagguuuauacaauggcccagaagaacauccaagugucucccgagauuuuccaguuucuccagcagguaaauuggaaagaguucagcaagugccuguuuaucgcacaaaaaaucuuagcucuguacgaacuagagggaacuaccguccuccugacaucauguaguuccgaagcccuuuuggaggcggaaaagcagaugcugagcgcccucaacuauaaacgaauugagguggagaauaaggaaguucugcauggcaaaaaguggaagggcuuaacucacaaccugcuuaaaaagcagaauucuucaccuaacaccgugauaaucaaugaguugacaagugaaaccacugcagaggucauuaucacggggugcgugaaagagguaaacgaaacauacaagcuccuguucaauuuuguggagcagaacaugaaaauugaacgccuaguugaggucaagccaagccuggugaucgauuaucucaagaccgaaaaaaagcuguucuggcccaaaauaaagaaagugaauguccaaguuuccuucaacccugagaauaagcagaagggaauccuuuugacugguucuaaaaccgaggugcugaaggcuguggacauuguaaaacaggucugggauucggugugcguuaagagcgugcacacagacaaaccaggcgccaagcaguuuuuccaagauaaggcuagauuuuaccaguccgaaaucaaaagguuauucggguguuacauugagcuccaggaaaacgaggucaugaaggaaggaggcucacccgccggucaaaaaugcuuuagucggaccgugcuggcaccggggguugugcuuaucguacagcagggcgaccuggcccgcuugccugucgacgugguggucaacgcuucuaaugaggaucucaagcauuauggaggccuggcggcagcccuaagcaaagcugccgggccagagcugcaggcagacugugaucaaauaguuaagagagaaggaaggcuccugcccgguaacgccacuauuuccaaagcuggcaagcuuccuuaccaccaugugauccacgccguagggccccguuggucaggauaugaggcaccacggugcguguacuugcugcgaagagcgguccaguuaagccucugucuggcugaaaaguauaaauacaggucuauugccaucccugcaauauccaguggcguguucgguuuuccccuugggcgcugcguugagacaaucgugagcgccauuaaggaaaauuuccaguuuaaaaaggacggccauugucugaaagagaucuaucuagucgaugugucugagaagacgguugaagcuuucgccgaggcagugaagaccgucuuuaaagcuacucucccagacacagccgcgccgccuggacugcccccagccgcugcaggccccgggaagaccuccugggaaaaaggaucauugguaaguccugguggccugcagauguuacucgugaaggaggggguucaaaacgccaaaacagauguggucgugaauagcguaccacuggaccuugugcugucgcggggacccuuguccaagucucuccuggagaaggcuggcccugaacuacaggaggaacuggauacugucggucaggggguugccgugagcaugggcaccgugcuuaaaacgucaaguuggaaccucgacugcagauacguccugcacgugguugcaccggaguggaggaauggauccaccucuagcuugaagauuauggaagauaucauacgcgaguguauggagauuacagaaucccugucauuaaaaagcaucgcguucccagccaucggcacugggaaccucggauuucccaagaauauuuucgcugagcugaucauuagugaaguauucaaauuuucuuccaagaaccagcuuaagacccugcaagaggugcacuucuugcuccauccuagcgaccacgaaaauauacaggccuuuucggaugaguucgcacgacgggcuaacggcaaucuggucucagacaaaaucccaaaggccaaagacacacaggguuuuuacgggacugugucuagucccgauuccggaguuuaugagaugaagauuggcagcaucauuuuccaaguggcaucuggugacaucaccaaagaagaggccgaugucauagugaacagcacguccaauucauuuaaccuaaaggcuggcguaaguaaggcgauccuggaaugcgccgggcagaacgucgagcgugaauguagccagcaggcacaacagagaaaaaaugacuacauuaucacaggaggcggguuccuuaggugcaagaacauuauccaugugauaggaggcaaugauguuaaaucuuccgugucaaguguccuccaggagugcgagaagaaaaacuauagcuccauuugucugccugcuaucgguaccgggaaugccaagcagcacccggacaaaguggccgaagcuaucauugaugcaauagaggacuuuguucaaaagggaucugcccagucggugaagaaagucaaggugguaaucuucuugccccagguguuagauguuuuuuacgcgaacaugaaaaagcgcgaaggcacucagcugagcucacaacaguccgucaugaguaaacucgcuucuuuccuggguuucagcaagcaguccccacagaagaaaaaucaccuugugcuggagaagaaaacagagucagccaccuuucgggugugcggcgaaaacgucacuuguguagaguaugcaauuucuugguugcaagaccuaaucgaaaaggagcagugcccuuacaccagcgaagaugaguguauuaaagacuucgacgagaaggaauaucaggagcugaaugaacuccaaaagaaacugaacaucaauauaagucuugaucauaagagacccuuaaucaaagugcuggggauuuccagggacguuaugcaggcccgagaugagaucgaagcuaugauuaagcgcgugcggcucgcaaaagagcaggagagcagagccgacugcaucucugaauuuauagaguggcaguacaacgauaauaacacaucacacuguuucaauaagaugacgaacuugaagcuggaagacgcgaggcgugagaaaaagaaaaccgucgaugugaagauuaaccaucgccacuacacuguuaaucucaacacauauaccgcuacagacacuaaaggacauucccugagugugcaacggcuuaccaagagcaaagucgauaucccagcccacuggucggacaugaagcagcagaauuuuugcgugguagaacuguugccuucugaucccgaguacaacacgguggcauccaaguucaaucagacauguagccacuuuagaaucgagaaaauugaaaggauccaaaacccagaccuauggaauucauaucaggccaagaaaaagaccauggaugcuaaaaacggccagacuaugaaugagaagcagcuguuccaugggaccgacgccggaaguguuccgcacgucaaccgaaauggcuuuaaccggucuuacgcagguaagaaugcuguggccuaugggaaaggaacauacuucgcggugaacgccaauuauuccgcaaacgacacuuacagccgcccugaugcuaauggcagaaagcaugucuacuauguuagggugcucaccgguauauacacacacggcaaccauucauuaauuguacccccaaguaaaaacccccaaaauccuacggaccuguaugauaccgugacugacaacguccaccacccaagccuuuuuguggccuucuacgauuaucaggcuuaccccgaauaucugaucacauuucggaaguga

SEQ ID NO: 60363 - RNA, 2037 nt, Artificial Sequence
  derived and/or modified sequence opt3 from PARP15__Homo_sapiens__NP_001106995
auggccgcucccggcccucugccagcagccgcgcucagcccgggggcucccaccccuagagagcuuaugcacggaguggccggugucacauccagggcaggccgggaccgcgaagccgggucuguucugccagcuggaaaccgaggcgcacguaaggccucaagaaggaguagcucccggucuaugucgcgcgauaauaaauucucaaagaaagacugcuugagcaucagaaacgugguagcuaguauucagacuaaggaggguuuaaaucugaaacuaauauccggggaugugcucuacaucugggccgacgucauugugaacucuguucccaugaaucugcaacuuggaggcggcccucugagcagggcguuuuugcagaaggcagggccaaugcuccagaaggaacuggaugaccggcgccgagagacggaagagaaagugggaaacaucuucaugaccuccgguuguaaucuggauugcaaggccguccuccaugcuguggcccccuauuggaacaauggcgcagagacaucauggcagauuauggcuaacaucaucaaaaaguguuuaacuaccguagaaguucugaguuuuagcucuauaacauucccuaugauugggaccggaucccuucaauuuccaaaagccguguucgcgaaguugauccugucagaggucuuugaauacagcaguucuacuagaccgauuacaucuccccuacaggaggugcacuuccucguguauaccaaugacgaugagggcugccaggccuuucuggacgaguucacgaacuggagcaggaucaauccuaacaaggcacggauaccaauggcuggugauacucagggggucguuggaaccgugucgaaacccuguuuuacagccuacgaaaugaagauuggcgcuaucacuuuccaaguagccaccggcgacauugcaacagaacagguggaugucaucguuaauucuaccgcccguacguuuaaccgcaaauccggggugucaagagcuauccuugagggagcgggucaggcaguggaaagugagugcgccguccuggcugcccagccucauagggacuucauuauaacuccaggcggguguuugaagugcaaaaucauuauccacgugcccggaggcaaggacguacggaaaacaguuaccagcgugcucgaggaaugugagcaacgaaaguauacuuccgucucucugccggcaauagguacagggaacgccggcaagaauccuauuaccguggcugauaacaucaucgacgccauugucgauuucagcucacagcauaguacgcccuccuuaaaaaccgugaagguugugaucuuucagccagaacugcucaauauuuucuacgacagcaugaaaaagcgcgaucuuucugcaucacugaacuuucaaaguacauucagcaugacuaccugcaauuugccugagcacuggacagacaugaaccaccagcuauuuuguaugguacagcuggaacccggacaguccgaguauaauacuauaaaagauaaguucaccagaacaugcuccucguacgcgaucgagaagauugaaaggauccaaaacgcuuuucucuggcagagcuaccaggucaaaaagcggcagauggacaucaaaaaugaucauaagaacaaugagcgccugcuuuuccacggcaccgacgccgauuccgugccauauguuaaccaacauggguuuaauagaucaugcgcagguaaaaacgccgugaguuacggaaagggcacuuauuucgcugucgacgccucuuacagcgcaaaggacacguauuccaaacccgauucaaaugggaggaagcacauguacgugguacgugugcugacaggaguuuuuaccaaaggccgggcugguuuggucacuccuccaccgaagaacccccacaacccuaccgaccucuucgauagcgugacaaauaacacccgaucuccaaaacuguuuguggucuucuucgacaaucaggccuaucccgaauacuuaauuacuuuuacagcguga

SEQ ID NO: 60364 - RNA, 3045 nt, Artificial Sequence
  derived and/or modified sequence opt3 from PARP1__Homo_sapiens__NP_001609
auggccgagagcuccgacaagcuguacagaguggaauaugcuaaaucuggcagggcaucaugcaagaaauguagugagagcauccccaaggauucccuccggauggccauuaugguccagucuccuauguucgacgggaaaguuccacacugguaccauuuuucgugcuucuggaaggugggacacucaauacgccauccggauguagaaguggacgguuuuagcgagcuucgaugggaugaccaacagaaggucaaaaagaccgcggaagcuggcggggugacaggaaaaggccaggaugguaucgggaguaaggccgagaaaacucugggagacuucgcagccgaguaugcuaaguccaaccguucuacguguaagggcugcauggaaaagauugagaagggccagguuagauugagcaaaaagaugguggaucccgaaaaaccucaauuagggaugaucgacaggugguaccacccaggauguuuugucaagaaucgggaggagcuggguuuccgccccgaauauuccgcaucacagcuaaaaggcuuuagucuccuggccaccgaggauaaggaagcucuuaagaaacagcugccuggggugaaaagcgagggaaaaagaaagggcgacgaaguagaugguguugacgagguggccaaaaagaagucuaaaaaggagaaagacaaggauuccaaauuggaaaaggcgcucaaggcacagaacgaccugauuuggaauaucaaagaugagcugaagaaagucugcucaacaaacgaccucaaggaauuacugauauucaauaaacaacaggugccaagcggggagagugccauccuugauaggguggcugacggaauggucuuuggcgccuugcugcccugugaagagugcucuggccagcuaguuuucaaguccgaugcauacuauuguacuggggacgugaccgcuuggacaaagugcaugguaaaaacccagacuccuaaccggaaggagugggugacaccaaaagaauuucgcgagauuagcuaccucaagaaacugaaggucaaaaagcaagaucgaaucuucccgcccgaaaccucggccucuguggcggccacgccuccacccuccacugcaucagcuccugccgcuguuaauaguagcgccuccgcagacaagccacuuucuaacaugaaaauucugaccuugggaaagcucagcagaaauaaagaugaggugaaggccaugaucgaaaaacuggguggcaaguuaacagggacugcuaacaaggcgucacuguguauaaguaccaaaaaggaggucgagaaaaugaauaagaaaauggaagaggugaaggaagcaaacauuaggguaguuuccgaggacuuucuccaggacgugagcgccucuacaaagucacuucaggagcuguucuuggcucauauccuaagucccuggggagccgaagucaaagcagagccgguggaagucguggccccucggggcaagagcggugcugcccuguccaaaaagucuaaagggcaaguuaaggaggaaggcauuaauaagucggagaaacguaugaagcucacccugaaaggaggcgcagcgguggaucccgacagcgggcuugagcacuccgcucacguacuggaaaagggagguaaagucuucucagccacguugggccucguggauaucguuaaggggacuaacaguuacuauaaacugcaguuacuggaggacgauaaggaaaaucgcuacuggaucuuuagaucuuggggaagggugggcacagucauugguagcaacaagcuagagcagaugccauccaaagaagacgcaauagagcauuucaugaagcucuaugaggagaaaaccgggaacgccuggcacucaaagaauuuuacuaaauacccuaagaaguucuauccccuggaaaucgauuacggccaggacgaagaggcugugaaaaaguugacaguaaacccaggaaccaaaagcaaguugcccaaaccugugcaagaucugauuaagaugaucuuugacguugaaucuaugaagaaagccauggucgaguaugagauagaucuccagaagaugccacugggcaaacuuuccaagcggcagauucaggcagcuuacaguauccugagcgaagugcaacaggccgugucucagggguccucagacagucagaucuuggaucucagcaaucgauucuacacgcugauuccgcaugacuuuggaaugaaaaagcccccuuuacugaacaaugcggacucgguccaagccaagguugagaugcuagauaaccuccuggacaucgaaguggcuuauucccuuuugcgcgguggcucugaugacagcucaaaagauccaauugacgugaauuacgagaagcugaaaaccgauauaaagguagucgacagagauagugaggaagcagagaucauuaggaaauaugugaagaacacacacgccacuacccacaaugcuuacgaccucgaaguuaucgauaucuucaagauugagcgggaaggggagugccagcgcuauaaacccuuuaagcagcugcauaacagaagguuacuguggcacggaucccguacaacuaauuucgccggcauacuuucucaggguuugcggaucgcaccuccagaggcgcccgugaccggguacauguuuggcaaaggaauuuauuucgccgacauggucagcaaguccgcuaacuacugccauacaucacaaggcgauccgaucgggcucauucugcuaggagaaguggcccugggcaauauguacgagcucaaacacgcaagccauaucaguaagcugccuaaagguaagcacucuguuaaggggcuuggaaaaaccacuccagaccccuccgcuaacauaagccuugacggcguggauguaccucuggguacgggcaucucgucaggggucaaugacacaucuuuacucuauaacgaauacauuguguaugauaucgcccaggugaaccugaaguaccuucugaaauugaaguuuaauuucaaaaccagucucugguga

SEQ ID NO: 60365 - RNA, 1713 nt, Artificial Sequence
  derived and/or modified sequence opt3 from PARP2__Homo_sapiens__NP_001036083
auggccgcuagaaggcggcgcagcaccggcgggggacgagcacgugcccugaacgaguccaagagagugaauaacgguaauacagcgcccgaagacucuucaccagcuaaaaagacuaggcggugccagcgccaagagaguaaaaagaugccugucgccggcgggaaagcaaacaaggauagaacggaagacaagcaggaugagagcguuaaagcccuccuucugaagggaaaagcuccgguggaccccgaauguaccgcaaagguaggcaaagcccacguguacugcgaggguaaugaugucuaugacgugauguugaaccagacaaauuuacaguucaacaauaacaaguacuaucugauccaacuacucgaggaugacgcucagaggaauuuuuccguuuggaugcggugggggcgcgugggaaagaugggccagcauucucuggucgccuguucgggcaaccuuaauaaagcgaaggaaauuuuccagaaaaaguuucuggauaaaacuaagaacaauugggaggaccgagaaaaauucgagaaggugccugggaaguacgauauguugcaaauggacuaugcaaccaacacacaggaugaggaagagaccaaaaaggaagagucacucaaaagcccacugaagcccgaaagucagcuggaccucagaguacaggaguuaauaaaacugaucugcaacguucaagccauggaggaaaugaugauggagaugaaguacaauacuaagaaagcuccucuuggaaaguugacaguggcccagauuaaagcagguuaucagucccugaagaaaaucgaagacuguauuagggcuggccaacacgggcgggcccuaauggaggcgugcaacgaauuuuacacccguaucccacaugauuucggacuccgcacgcccccucugauaagaacucagaaggagcuuucugagaagauccagcuguuggaagcccucggcgacauugagaucgcaauuaaacuggucaagaccgaauuacagagcccagagcacccgcuggaucaacauuacaggaaucuccacugugcccuucggccccuggaccacgaauccuaugaguuuaaagugaucucacaguacuugcagaguacacaugcuccuacucacagcgauuauaccaugacacuacuggaccucuucgagguggaaaaggauggugagaaagaggcuuuucgagaagaccugcauaaccgcaugcuucuguggcacgggucuagaauguccaauugggucggaauauugucacacggccucaggauugccccacccgaggcaccuaucaccggcuacauguucgggaagggaauuuauuuugccgauaugagcaguaagucugcuaacuacugcuucgcgucccggcugaaaaauacggguuuacugcuacucagcgaaguugcacugggccaguguaacgagcuuuuggaagccaauccaaaggcugaggggcugcuccaaggaaaacauucgacuaagggccuggguaaaauggcccccucuuccgcacacuuugugacacuuaacgggucaaccguaccgcugggcccugccagugacacuggaaucuugaaucccgauggcuauacacucaacuacaaugaauacaucguguauaacccaaaucagguccgcaugagauaccuguuaaaggugcaguucaacuuccugcagcuaugguga

SEQ ID NO: 60366 - RNA, 1623 nt, Artificial Sequence
  derived and/or modified sequence opt3 from PARP3__Homo_sapiens__NP_001003931
augagccuccuguuccuugccauggcucccaagccuaaaccaugggugcagaccgagggcccggaaaagaaaaaggggagacaagcaggaagggaggaagaccccuuucgguccacagccgaggcgcugaaagcuaucccugccgaaaagcgcauuauacgagucgauccaacuugccccuugucuucaaacccugguacgcagguuuacgaggacuauaauuguaccuuaaaccagacaaauaucgagaacaauaacaauaaguucuacauuauccagcugcuacaagauaguaacagauuuuucacuugcuggaaucguuggggcagggugggggaaguaggacagagcaaaauuaaccacuuuacccggcucgaggacgcaaagaaagauuucgaaaagaaauuucgcgagaagacaaagaauaacugggccgagagagaccauuucgugucccacccaggcaaauauacccugaucgaaguccaggcugaggaugaagcacaggaggccgugguuaagguggacaggggucccguccggacugugacaaaacgcguacaaccuuguucucuugauccagcuacccagaagcugauaacgaauaucuuuucgaaagaaauguucaagaacacuauggccuugauggaccucgauguuaaaaagaugccgcuggggaagcugucaaaacagcagauugcgcgaggauuugaggcacucgaggccuuagaagaggcucugaagggccccaccgacggcgggcaaagccuugaagaguugaguucccauuucuacacagugaucccucacaauuuuggacauucucagccacccccuauuaacagcccagaacugcuacaggccaaaaaggauaugcuccugguccuugcagacaucgagcuggcucaagccuugcaggcgguguccgagcaggagaaaacuguggaagaagucccccacccgcucgacagagauuaucagcuguuaaagugccaacugcagcuccuugacucaggugccccugaguacaagguuauacagaccuaucuggaacagacaggcaguaaccacaggugucccaccuugcaacauauuuggaaagugaaucaggagggggaggaagaucgguuccaggcacacagcaagcuaggaaaccguaaacugcucuggcauggcacgaauauggcuguaguggccgcuauccugacuucuggucuucgcauuaugccacacuccgggggaagagucggcaagggcaucuacuucgccucagagaacagcaaaagugcaggguacgugaucggaaugaagugcggugcccaccauguuggcuauauguuucugggggaaguggcuuugggaagggagcaccauauuaauacagacaacccuucucucaagagcccaccucccggcuucgauuccgucauagcgcggggucacaccgagcccgacccaacucaggauacagaacuggaguuagacgggcaacaggugguaguuccgcagggccagcccgugccuuguccagaauuuucgucuuccaccuucucacaaagugaguaccugaucuaucaggaaagccagugccgacuacgcuaccuccuggagguccaucuuuga

SEQ ID NO: 60367 - RNA, 5175 nt, Artificial Sequence
  derived and/or modified sequence opt3 from PARP4__Homo_sapiens__NP_006428
auggugaugggcaucuucgcaaauugcauauuuugucugaagguaaaauaccucccccagcaacagaagaaaaagcugcagaccgacauaaaagagaaugggggaaaguucagcuuuucccuuaacccucagugcacacacaucauuuuggauaaugcugacguuuuaucucaauaucagcugaacucaauccagaagaaucaugugcacauugcaaacccagauuucaucuggaaaaguauuagagaaaagaggcuacucgacgucaaaaacuacgauccguauaagccccuggacaucacuccuccacccgaucagaaagccagcuccucugaagugaagacggaaggucuuuguccugacucggcgaccgaagaagaagauacagucgagcugacugaauuuggcaugcaaaacguggagauuccacauuugccccaggacuucgaaguugcuaaguacaauacccucgagaaaguggggauggagggaggccaggaagccgucgugguagagcugcagugcucacgggauagccgcgacuguccuuuucugaucaguucccacuuccucuuagaugacgguauggaaacacgacgucaauuugcaauuaagaaaaccucugaggacgccagcgaauauuucgagaacuacaucgaggaacugaagaaacagggguuucuuuugagagagcauuucacuccagaagcuacacagcuggcauccgagcaacuacaggcccuccugcuugaagagguuaugaacucaaguacccugagccaggaggugucugauuuggucgaaaugauaugggcugaggcccucggacaccuggaacacauguuacugaagccggugaacaggauuucccucaaugacgugucaaaagcggagggcauccuucuguuggucaaggcagcccuaaagaacggcgaaacggcugagcagcugcagaaaaugaugacugaguuuuaucggcucauuccccauaaggggaccaugccuaaagaaguuaaucugggacuucuggccaagaaagcagauuugugccagcucauccgcgacauggugaacguaugugagacaaaccugagcaagccaaaucccccuaguuuagcuaaguacagagcccugaggugcaaaaucgaacacguggagcagaacacugaggaguuccuacggguccgcaaggaggugcuccagaaucaucacucuaaauccccaguugaugugcugcaaauuuuccgagucgguagagugaacgaaaccacagaguuucuuagcaaguugggcaauguaaggccccugcuccacgggucgccgguucagaacauagugggaauccugugucggggccuucuguugccuaaagucguggaagaccgugguguccagcgcaccgauguggggaaucucggaucuggcauuuacuucuccgacucacugaguacgagcaucaaguauucccaucccggcgagacugaugggacaagauuacugcuaauaugcgacguugcgcucggaaaguguauggaucugcacgagaaagacuuuucucuuaccgaagccccaccugguuacgacagcgugcauggcguaucacagacugcaagugucacaaccgauuucgaggacgaugaauuugugguuuauaagacgaaccaagugaaaaugaaguacauuaucaaauucuccaugcccggggaccagaucaaggauuuucacccaagcgaccauaccgaguuggaagaguauaggcccgaguucucuaauuuuucaaaggucgaagauuaccagcugccugacgcuaaaacaaguagcuccacuaaggccggacuccaggaugcuucuggcaaccuggugccauuagaggacguacacauuaaaggucggaucauugauaccguggcccaaguuauagucuuccagacauauacuaauaagucgcacgugccgaucgaagcaaaauacauuuuuccccuggacgauaaggccgcugugugcggguucgaggcguuuaucaacggcaaacauaucgucggagaaauuaaggagaaggaggaagcacagcaagaguaccuugaagccguuacccagggccacggggcuuauuugaugagccaggacgccccugacguguucacaguguccguaggaaaucucccacccaaagcaaagguccugauaaaaaucaccuacauuacugagcuaucaauccuggguacggugggcguuuucuuuaugccugccacaguggcuccauggcagcaagauaaggcccucaacgagaaucugcaggacaccgucgagaaaauuugcaucaaggagauagggacuaagcagaguuucucucuuaccaugagcaucgaaaugcccuaugugauugaguuuaucuucuccgauacacaugaauugaaacagaagcgaaccgacuguaaagcaguuauuucaacuauggagggaagcucucuggauuccaguggcuuuagcuuacacaucggucucucugcggcuuaccugccgcgcauguggguggagaagcacccugaaaaagaguccgaagccugcaugcuuguauuccaaccagaccuggaugucgacuugcccgaucucgcaucagagagugaagugauaauuugucuggacugcagcucguccauggagggggugacauuucuacaggccaagcagaucgcucugcaugcccucucucuggucggcgagaagcagaaaguuaacauuauccaauucggaacgggcuauaaggaacuuuuuagcuacccuaaacacauaaccucaaacacuauggcagcugaguucaucaugagugccacacccaccauggggaauacagauuuuuggaagacuuugagauaucuguccuuacucuacccagcgaggggaucucggaacauucugcuugugagcgacggucaucugcaggaugaaucccuaacccuccagcugguaaaacgcucaagaccucacacgagguuguucgccuguggcaucgggagcaccgcuaaucgucaugugcugcggauuuuaagucaaugcggagcaggcgucuuugaguacuucaacgccaagucuaagcacuccuggcgaaaacagaucgaagaccagaugacaagacucuguagccccucgugccacucagugucuguuaaguggcagcaacugaauccagacgugccggaggcccuucaagcuccugcacagguccccagucuguucuugaacgauaggcuccugguguaugguuuuauaccacauuguacucaggcgacccuaugcgcccugauucaagagaaagaguuccgcacaaugguuuccacuaccgagcuucagaagacgacagggaccaugauccacaaacucgcugcccgggcacugaucagagacuacgaagauggcauuuugcaugagaaugagacuagccacgaaaugaagaaacagacacugaagucuuuaaucauuaagcucagcaaagagaacucccugauaacccaguuuacuucauucguggcugucgaaaagagggacgagaaugaaagucccuuuccugauaucccaaaaguaagcgagcuuauugccaaggaggacguggauuuccugcccuauaugucuuggcaaggagaaccucaggaggcaguucgcaaccaguccuugcucgccucaagugaauggccggagcugcgacuaagcaaacggaagcaucguaagaucccauuuuccaaaagaaagauggaacugucucagcccgaggugucggaggacuucgaagaggauggccuugggguccucccugcuuuuaccagcaaucuggaaaggggaggcguggagaaauuguuagaccugucauggacagaauccuguaagccaacggcgaccgagccccucuucaaaaagguaaguccuugggagacuucuacaagcuccuuuuucccgauucuggcccccgcaguggguucauaccuuccaccuaccgcucgcgcccacucucccgccagccugaguuucgcuuccuaucggcaagucgccagcuuugggucugccgcgccaccuagacaguucgaugcuucacaguuuucccaaggacccguuccaggcacaugcgccgacuggaucccgcagagugcaagcugcccuacuggucccccacagaaucccccuucgucuccauacuguggcauaguguucuccgggagcucauugaguucugcccaguccgcuccccuacaacacccuggaggcuuuaccacgaggccgagcgcagggacauucccagaacuggacucaccccagcuccauuuuagucugccuaccgaucccgacccaauccgaggauucggcagcuaucacccuuccgccucuagccccuuucauuuccagccauccgcggcuucacuuacugccaauuuacgccugccuauggcaucugcccucccggaggcuuugugcagucagucgcggaccacacccguggaucugugucuccuggaagagagcgucgguucccuugaggggucuagaugcccaguguuugccuuccaaucaagcgacacugaauccgaugagcugagugaaguuuugcaggacucuuguuuucuacagauuaagugcgauaccaaagacgauagcauccuguguuuccucgagguaaaggaagaggacgagauugugugcauccagcacuggcaagaugcagucccuuggacagaauuacugucacuucagacggaggacggauucuggaaacugacccccgaacucggcuugauacugaaccucaauacuaacggucugcacuccuuucuuaagcagaaaggcauucaaagucuaggggugaagggaagggagugucuguuggauuuaaucgcuacaaugcugguucuccaguucauccguacccgccuggaaaaggagggcauuguguuuaaaagccuuaugaagauggacgacgccucuauaucccggaacaucccaugggcguucgaggccauuaaacaggcaucagaaugggucagaaggacugaggggcaguacccuagcaucugcccccgacuggaacucggaaaugauugggacucggcuacaaagcaauugcugggccuacagccgauuucuaccgugaguccacugcaucggguacuccacuacucccaggguuga

SEQ ID NO: 60368 - RNA, 1893 nt, Artificial Sequence
  derived and/or modified sequence opt3 from PARP6__Homo_sapiens__NP_064599
auggacaucaagggccaguucuggaacgaugacgauagcgagggggacaaugaauccgaggaauuucuguacggagugcaagguucuugcgccgcugaucucuauagacacccccagcuugacgcagauauugaggccgucaaagaaauauacucagagaacaguguuagcaucagggaguauggcaccauugacgauguggacaucgaucugcauauuaauaucuccuucuuggacgaagagguaucuacagcguggaagguguuacggacugaaccuauaguccugcgccuacgauuuucgcucucacaguaccuggaugggccagagccgagcaucgagguguuccagcccaguaacaaagaaggauuuggccuuggucugcaauugaagaaaauucucgggauguucacgucccagcaguggaagcaccugucuaaugacuuucugaagacccagcaagagaaacgucauagcugguucaaggcuuccggaacaaucaaaaaguuuagagccggccucucaauuuucaguccuaucccaaaaagccccucuuuuccuauaauucaggacuccauguuaaagggcaagcuggggguuccagaacuuagggugggacgguugaugaaccgcucaaucagcuguacuaugaaaaaucccaaggucgagguguucgguuauccuccaaguccgcaggcaggccugcuaugcccccagcacguagggcucccuccacccgccagaaccucuccucugguuuccggacauuguaaaaacauuccaacacuugaauacggcuuucuggugcaaaucaugaaguaugcugagcagaggauccccaccuugaaugaguacugcgucgugugugaugaacagcacguguuccaaaacgguagcaugcucaaaccggcagucugcacucgggagcuguguguuuucucguuuuacacauuaggggugaugucuggagccgcugaagagguagccaccggcgcggaaguggucgaccugcucguggcaaugugccgcgccgcucuugaguccccucgaaagucaauuauauucgagcccuauccaaguguuguggauccuacggaccccaaaacucuggccuuuaauccaaagaagaaaaacuacgaaagauugcagaaggcacuagauagcgucauguccaucagggagaugacccagggcucuuaucuggaaauuaaaaagcagauggacaaacucgauccccuggcucacccucuucugcaauggaucauaagcucaaaucggagucauauugugaaguugccacucucccgucugaaguucaugcacacaagccaucaguuuuuacugcuaucuucaccgcccgccaaagaggcgcgcuucagaacugccaagaaacucuacgggaguaccuuugcauuccacggaagccacaucgaaaacuggcauuccauccugaggaauggucuuguaaacgcuucuuauacaaaguugcagcugcacggcgccgcuuacgggaaaggaauuuaucucucgccuaucagcuccauuucauuuggcuacagugguauggggaagggccagcaucggaugccaucuaaggacgagcugguucaacgauacaaccgcaugaauaccauaccccagacgagaagcauccaguccagguuccuucagucacggaaccugaauuguauugccuugugcgaggugaucacuagcaaagaucuccaaaagcacggaaacaucugggucuguccugugucugaccaugucugcacacgcuuuuucuuuguguaugaagauggccagguuggggacgcaaauauuaacacccaggacccaaaaauacagaaggagaucaugagagugauuggaacucaaguauacacaaauuga

SEQ ID NO: 60369 - RNA, 2565 nt, Artificial Sequence
  derived and/or modified sequence opt3 from PARP9__Homo_sapiens__NP_001139574
auggacuucagcaugguggccggcgcugcagccuacaacgagaaguccgggagaaucaccucucugucacuccuuuuucagaaagucuucgcgcaaauuuuuccccaguggaggaagggaaauacagaagagugccugccuuauaaauguagugaaacuggugcuuugggcgagaacuacagcuggcagauaccaaucaaucacaacgauuucaagauucugaaaaauaacgaacggcagcugugcgagguucuacaaaauaaguuuggguguaucuccacgcucgugucuccgguacaggagggaaacucgaagucauuacagguguuccgcaaaaugcuuacaccccgaauugaacugagcgucuggaaggacgauuugaccacucaugccguggacgcaguugugaaugccgcuaacgaggaucuccugcacggcggugggcuggcacucgccuuagucaaagcuggaggcuuugaaauccaggaggagaguaagcaauucguggcccguuauggcaaaguauccgcgggggaaauagcaguuaccggagccgguagacugccuugcaagcagaucauucaugcugugggcccaagguggauggagugggacaagcagggguguacaggaaaacuucagcgggccaucgucucuauuuugaauuacgugaucuauaagaacacccacauaaaaacuguggcaauucccgcucugagcuccggcaucuuucaauucccucuaaaucucugcacaaagaccauugucgaaacgauccgcguuucacugcaggguaaaccaaugaugaguaaccuuaaggagauccaucuggugagcaaugaagaucccacuguagccgcguuuaaagccgcaucugaguucauuuuggggaaguccgagcucggacaggaaaccacaccuucauuuaacgcuaugguggucaacaaucugacuuuacaaauagugcagggccacaucgaguggcagaccgccgacguuauugugaacagcgucaauccacacgauaucacagugggcccgguagcuaagaguauacugcagcaagccgggguugaaaugaaaucugaguuccucgcaaccaaggccaaacaguuccagagaucccagcuugugcuggucacgaagggauuuaacuuguucuguaaauacauuuaucaugugcuauggcacagcgaauuucccaagccucaaauccugaagcaugcuaugaaagagugccucgagaaguguaucgaacagaauauuacuucgaucucuuucccagcgcuggguacaggcaacauggagauuaaaaaggaaaccgcagccgagauacuuuuugacgaaguccugacuuucgcuaaagaucacgugaagcaccaguugacaguuaaguuugugaucuuccccaccgaccucgagauuuacaaagccuuuuccucagagauggcaaagaggaguaaaaugcugagcuuaaauaacuacuccguaccucagucuacgcgggaagagaagcgcgaaaaugggcuggaggcccgaagcccagcuaucaaccuaaugggauucaaugucgaggaaauguaugaggcccaugcauggauccaaaggauucucucacugcagaaccaccauauaaucgaaaauaaccacauucuuuacuugggcagaaaagagcaugauauccugagucagcuccagaagaccuccagcgugucuauuacagaaaucauaucacccggucggacugagcuggagaucgaaggggcgcgugcugaccuuauugagguugugaugaauaucgaagacaugcugugcaagguccaagaggaaauggcccgcaaaaaggagagaggcuuguggaggagucucggacaguggaccauucagcaacagaaaacacaggaugagaugaaggaaaacaucauauuucugaaauguccggugccucccacucaggaguuacuggaccaaaagaaacaguucgaaaagugcggccuacagguacucaagguggagaaaauugauaacgaaguucugauggcagccuuucagcggaagaaaaagaugauggaggagaaacuucaccgacaaccagucagccaccgcuuguuccaacaggugccuuaucaguucugcaauguggucuguagaguuggguuucagaggauguacuccacccccugcgacccaaaguauggagcugguaucuacuucacaaagaaccugaaaaaucucgccgaaaaggcuaaaaagauuucugcagccgauaaacugaucuauguguuugaggcggaaguguuaaccggcuucuuuugucaggggcauccccugaacauaguaccuccaccgcuuucgcccggagccaucgacggccacgauagcgucguggacaauguuuccucaccugagacuuucgugauuuuuagugguaugcaggcuaucccacaauacuuguggacgugcacacaggaguacguccagucucaggauuauagcuccgggcccaugcggccuuucgcacaacauccauggcgcggcuuugccucaggaagccccguggacuga

SEQ ID NO: 60370 - RNA, 1752 nt, Artificial Sequence
  derived and/or modified sequence opt3 from PARPBP__Homo_sapiens__XP_011536808
auggagcugaucauggccguguucaaccagaagucagucuccgacaugauuaaagaauuuagaaagaauuggagggcucucugcaacucugagcggaccacacuuuguggcgcagauucaaugcuguuggccuuacaacugaguauggcggaaaauaacaaacagcacagcggggaguucacuguuucccuaucugacgugcuccugacguggaaguaccuucugcaugaaaaauugaaucuccccguagagaacauggaugugaccgaccacuaugaggauguccgcaagauauacgacgauuuucugaagaauagcaacaugcuggaccucaucgauguguaucagaaaugccgagcuuuaacaucaaauugugaaaacuacaauacuguuagcccuagucagcugcuugacuucuuguccggaaagcaauaugccgugggugaugagaccgaccugucuauuccaacaagcccgaccuccaaauacaaccgugauaaugaaaagguccagcuacucgcaagaaaaaucauuuuuagcuaucugaaccuucuggugaauaguaagaacgacuuggccguagcuuacauccucaacauacccgacaggggccuggggcgggaggcauucacugauuuaaagcaugccgcucgcgagaaacagaugagcaucuuucugguugccacaucuuucauuagaaccaucgaacucggaggcaaggguuacgcgccuccacccuccgacccucuuaggacgcacgugaaagggcugucaaauuuuauuaacuucaucgauaaguuggacgagauacuaggagaaauuccaaaucccagcaucgcaggcggccagauucugagugucaucaaaaugcaacucaucaaggggcagaacucucgggauccuuuuugcaaagccauugaggaaguggcucaggaccuggaucuucgcauaaagaauaucauuaacucccaggagggaguggucgcccugagcacuaccgacaucucgccagcacgaccgaagucucaugcuauaaaucacgguacagccuauuguggcagagauacuguuaaagcguugcucgugcuguuagacgaggaagccgcaaacgcucccaccaagaauaaagccgagcugcuauacgaugaagagaacacaauucaccaucacgggaccuccauccucacgcuguucaggucaccuacucaaguaaauaacaguaucaagccacuucgggaacguauuugcgugagcaugcaggagaaaaagaucaagaugaaacagacauugauucgcucccaauuugcuuguaccuauaaggacgacuacaugauaucuaaagauaauuggaacaaugucaaccuggccagcaagccccucugcgugcuguauauggagaacgaccuuucagaaggaguuaauccuagugugggcagauccacuaucgguacaucguucgggaacguccaucuggauaggucuaaaaaugagaaggugucacggaagaguaccagccagacgggaaacaaauccucuaagcgaaaacagguagacuuggauggcgaaaauauucucugugacaaccgcaaugagccaccccagcacaagaacgcaaaaaucccgaagaagucgaaugauagccaaaacagacuguacggcaaauuagccaagguugcuaaauccaauaagugcaccgcgaaagacaagcugaucucagggcaggcaaaacuaacacaguucuuuaggcucuga

SEQ ID NO: 60371 - RNA, 1605 nt, Artificial Sequence
  derived and/or modified sequence opt3 from PARS2__Homo_sapiens__XP_011539505
augagagccgcucugcccggccucagccuugggaggcgggagucccacaccgugcuggaagucccugcauuggagcgcccaugggaccauuuacugccggaacccgccuucccuuuuuacguuggagagaacgguggcccagggcgaucugcgugcgcuucacguugucagggagugauggaaggccuacucacaagaugcagggcccugcccgcacuugccacuuguagucggcaacugagcgguuauguaccuugccgcuuccaccauugugcuccaagaagggggcggcgcuugcuccugucccgaguguuucagccccagaaucugagagaggauaggguccucucuuuacaggacaagucggaugaccugacgugcaaaucacaacggcuuaugcuucaggugggacugaucuacccugcaagcccaggcuguuaucaccuacucccguacaccguucgugccauggagaagcuggugcgcgucauugaucaggaaaugcaggcuauaggcgggcaaaaagugaacaugcccagucuuuccccugccgagcuguggcaggcgacaaauagaugggacuugaugggaaaggaacuccugagguuacgggaucgacaugguaaagaguauugccugggcccaacucacgaggaagcaaucaccgcccucauugcuucucagaagaaguugagcuacaaacagcugcccuucuugcuauaucaaguaacacgcaaguuuagagacgagccuaggccacgguucgggcugcuccgcggaagagaauuuuacaugaaagauauguacaccuucgacuccucacccgaggccgcacagcagacuuauagucugguuugugaugcuuacugcagccuuuuuaacaagcugggcuugccguucgugaaaguccaagccgacguggguacaaucgggggaaccgugucucacgaauuucagcucccugucgauauuggcgaggacaggcuggcgaucuguccccguugcuccuucucagccaauauggagacguuagaccugagccagaugaacugcccagcaugucagggcccucuaacuaagaccaaggggauagaaguuggacauacauuuuaucucgguacuaaauacaguucuaucuucaaugcucaauucaccaacgugugcggcaagcccacacuggccgagaugggguguuauggacuuggcguaacccggauuuuggcugccgcaaucgaagugcuguccacggaggauugcguccgauggccaagccuccuggcccccuaccaggcuugucuuauuccuccgaaaaaggguucgaaagaacaggcggcaucugagcugaucgggcaguuguaugaccacauaacugaggccgugccacaacuccauggcgaaguucuguuagaugacagaacacaccugaccauuggaaauaggcuaaaggaugcuaacaaauuuggcuaccccuucgugaucauugccgggaagcgcgcacucgaggacccugcccacuuugaagucuggugccagaauacuggagagguggcuuuccugacaaaggaugguguaauggaccuuuugaccccaguucagacgguguga

SEQ ID NO: 60372 - RNA, 1239 nt, Artificial Sequence
  derived and/or modified sequence opt3 from PARVA__Homo_sapiens__NP_060692
augcugggcaucauuccccucccuuucgggaagccacagccgcaaagcagaaggcggccccuucgcccuccauccgccucuucagcuagucgacccgcacguggaagccugagaagggccauggcgaccuccccucagaaaucuccaucggugcccaagucaccuacaccaaaaagcccgcccagucggaagaaagacgauuccuuuuuggguaaguuaggcgggacucuggcucgcagaaagaaagccaaggaggucucugaacuacaggaggaaggaaugaacgcaauaaaucucccucugagcccaauccccuucgagcuugacccugaagauacgaugcuggaggagaacgaaguuaggaccaugguggacccaaauucccggucagaucccaaauugcaggagcucaugaagguacugauugacuggaucaacgaugugcuggucggcgaacgcauuaucgugaaagaccucgccgaggauuuauacgacggucaaguucugcagaaacuuuuugagaaguuggaaagugagaagcugaauguggcugaagucacacagagcgagauagcacagaagcaaaaacuacagacugugcucgaaaagaucaacgagacccugaaacuuccgccucgaucuauuaaguggaauguagauuccguucacgccaaaucacugguggcuaucuugcaucuccuggucgccuuaagccaguauuucagagcgcccauuaggcugccagaccacgugaguauccagguggucguugugcaaaagcgggaggggauacuccagucucgucagauucaagaagagaucacaggaaacaccgaagcacuuuccggccgccaugagagagaugccuuugacacucuguucgaccacgcuccugauaaguugaauguagugaaaaagacacuaauuaccuuugucaacaaacaucugaauaagcucaaccuggaagugacggagcuugagacucaguucgccgacggcguuuaccugguguugcucauggggcuguuagaaggauauuuugucccccugcacagcuucuuucuaaccccagauucguucgagcagaaagugcucaauguaucuuuugcauucgaacugaugcaggacgguggccuugagaagcccaagccuaggccagaagauaucguuaacugcgacuugaaauccacacugcgggugcucuacaaucuguucacuaaguaucgaaacgucgaguga

SEQ ID NO: 60373 - RNA, 1194 nt, Artificial Sequence
  derived and/or modified sequence opt3 from PARVB__Homo_sapiens__NP_001003828
augcaccauguguucaaggaccaccagagaggcgagaaaaggggguuucugagccccgaaaacaagaauugccggcgccucgagcuucgacguggauguuccugcucuuggggucuguguucacaagccuugauggcuaguuuagcaggcagccugcuaccuggguccgauagaucuggagucgaaaccucggaguacgcccagggcgguguuucagaccuccaggaagaggggaaaaacgcgaucaauagcccaaugaguccggcucugguggauguacaucccgaggacacacagcuugaagagaacgaagagaggacuaugauugauccuacguccaaggaggacccaaaauucaaggaacuggugaaggucuugcucgauuggauaaaugacgugcugguugaggaacggaucauugugaaacaacuggaggaagaucucuaugacggacaggucuuacagaagcugcuugagaaauuggccggcugcaagcugaacguggcagagguaacccagucugaaaucggccaaaaacagaagcuacagacaguucucgaggccgugcacgaucugcuucgccccagagggugggcucugagguggagcgucgacuccauucauggaaagaauuugguggcaauccuccaccuguuagugucacuggccaugcacuuucgggcuccuauacgccucccagaacaugucacuguucaggugguagugguccgaaaaagagagggucuucugcacaguagccauaucucugaagaguugaccacaaccacugagaugaugaugggcagguucgaacgggaugccuuugacacacuauucgaccacgcgcccgauaagcuguccgugguuaaaaagucacucauuaccuuugugaacaaacaccugaauaaacuuaaccuggaggucacggaauuggagacucaauucgcagacgggguguaccucguacuguuaaugggacugcuagaagauuauuuuguuccucuccaucacuucuaccugaccccagagagcuuugaccagaaggugcauaaugucaguuucgccuuugagcuuauguuggauggcggucugaagaagccgaaagcucgucccgaagacguggucaaccucgaucugaagucuacacuucgcgugcuguauaauuuguucacuaaauacaagaacguugaguga

SEQ ID NO: 60374 - RNA, 996 nt, Artificial Sequence
  derived and/or modified sequence opt3 from PARVG__Homo_sapiens__NP_001131077
auggagcccgaguuccuguacgaccuccuucagcugccuaagggcguggaaccaccggccgaagaggaauugagcaaagggggaaagaaaaaguauuuacccccuaccuccagaaaagauccaaaguuugaggagcugcaaaagguccuaauggaauggaucaacgcuacacuccugcccgagcacauuguugugaggucucuugaagaggacauguucgauggucugauauugcaucaccucuuucagcggcuggcagcccugaaacucgaggcggaagacaucgcuuuaacugccacgucacagaagcauaaacugaccguagugcuugaggcagucaaucgcaguuugcagcuggaagaguggcaagccaaguggagcguggaauccauuuucaacaaagaucuacucucuacacugcaccuucugguugcuuuggcaaagcgauuucagccugaccucucgcugccaacuaaugugcaggucgaggugaucaccauugagucaacaaagagcggcuuaaaaagugaaaagcugguagagcagcucaccgaauacuccacugauaaagacgagcccccuaaggauguuuucgacgaacuuuuuaaacuggccccagagaaggugaacgcugucaaagaggccaucgugaauuucgugaaccaaaaguuggaucgucuagggcugucuguccagaaucucgacacacaguuugcggauggaguuauacugcuucuguugaucggccagcucgaagguuucuuucugcauuuaaaggaguucuaucugaccccgaacagccccgcagaaaugcuacacaaugugacgcucgcccuggagcuuuugaaagacgaagggcugcucuccugcccuguaucaccagaggacauugugaacaaggaugcuaaaaguacucugagaguccuuuacggacuguuuuguaagcacacccaaaaagcccauagggaccggacaccccacggcgcaccuaauuga

SEQ ID NO: 60375 - RNA, 2322 nt, Artificial Sequence
  derived and/or modified sequence opt3 from PASD1__Homo_sapiens__NP_775764
augaagaugagaggcgagaaaaggcgggacaaggugaaccccaaaagcucccagcgcaagcugaauuggaucccuucuuucccaaccuacgauuauuuuaaccaagucacacuccagcuucuggacggguucaugauuacuuugucaacggauggaguuauaaucugcguggccgaaaauauuaguagcuuacugggucaccuaccggcugagaucguaggcaaaaagcuccugucccuucugcccgacgaagagaaggaugaaguguaccagaaaauuaucuugaaguuuccucuccugaacucugagacccauauagaguucuguugccaccugaaacgagggaaugucgaacauggagacucgucagcauaugagaacgugaaguuuaucguuaaugugcgugauauuuguaacgaguucccagucguguuuagcggccucuucaguucccacuuaugcgccgacuuugcggcuuguguaccccaggaggauagacuguaccuuguugguaaugugugcaucuugaggacacaacugcuacagcagcucuauacuucuaaagccgucagcgacgaggcagugcugacccaggauuccgacgaagaaccuuucgugggggaacuuucaaguagccaaggacagcggggccauacaucuaugaaggccgucuacguugagccagcugcagccgcugccgcggcagccauuuccgaugaccagaucgacauagcugaaguggagcaguauggcccccaagagaacguacacauguuuguggauucagacagcaccuacuguaguucuacugucuuccuggauacaaugccugaauccccagccuugagccuccaggacuuucgcggggagccggaagugaauccccuguacagagcagauccuguugacuuagaguucucgguggaucaggucgacucuguggaucaagaaggaccaauggaccagcaggaucccgagaacccuguagcuccacuggaccaggccggucucauggaccccguugauccggaggacuccguggaucuuggcgcggccggggcaucagcucaaccucugcagcccaguagcccagucgccuaugacauuaucucccaggaauuggagcuaaugaagaaacugaaggaacagcucgaggaaaggaccuggcugcuucacgaugcuauucaaaaucagcagaacgcccuggaguugaugauggaccaucuccagaaacaaccuaauacgcugcggcacguggucauccccgauuuacagucuagcgaggcagugccaaagaaacagcagaagcaacaugccggacagguuaaacgcccccugccucacccaaaggacgugaagugcuucuguggccuaucacucaguaacucccugaaaaacacuggugaacuucaggagccgugcguagcuuuuaaucaacagcaguugguccagcaagaacagcaccugaaggagcagcagcgacaacucagagagcagcugcagcagcuuagggaacaacggaaagugcagaagcagaaaaagaugcaagagaagaaaaagcugcaggaacagaaaaugcaggagaagaaaaaguugcaagaacagcgucgccagaagaaaaagaaacuccaggagagaaagaaauggcaagggcagaugcugcagaaggagcccgaagaggaacagcaaaagcagcaguuacaggagcaaccucugaaacauaacguuaucgugggaaaugaaaggguccagauuugucuacagaacccacgggaugugagcguaccccucugcaaucacccugugcgauuccugcaagcgcagccaauaguucccguccagcgcgcagccgagcagcaaccgucuggcuuuuaccaggacgagaacugcggccagcaggaagaugagucacaaaguuucuauccugaggcuuaccaggggccacccgugaaucagcuuccuuugaucgacaccagcaacuccgaagccauuucuucgagcuccaucccccaguuuccaauaacaucagauaguacuauuucuacccuggaaacaccucaagacuauaucagacucuggcaggagcugagcgacuccuuaggacccgugguccagguuaauaccuggucaugugaugagcaagguacgcugcauggccagccaacuuaccaccagguacaggugagcgaagugggggucgagggaccgccugacccccaagcauuccagggcccagccgcuuaucagcccgaucagaugaggucugccgaacaaacacggcuuaugccugcagagcagcgcgacuccaacaagccaugcuga

SEQ ID NO: 60376 - RNA, 3993 nt, Artificial Sequence
  derived and/or modified sequence opt3 from PASK__Homo_sapiens__NP_001239048
auggaggacggcgggcugaccgccuucgaagaggaucagagaugccucagccaaucccuuccccugccugugucugcugaaggaccagcagcccagacaacugcggagccgucaaggaguuuuagcuccgcucaccggcauuugucucgccgaaacgguuuaucgcgucugugucagucaagaacggcccuaagcgaagacagguggaguuccuacugccucucuagccuggcagcccagaauaucuguaccuccaagcugcacugccccgcugcaccugagcauacagauccaucagagccccggggcagugucagcuguugcucucuguugcgcgggcucuccucaggauggagcaguccucugcugccagcccccguuuguaacccuaauaaagcuauuuucacuguggacgccaagaccacagaaauacucguagcgaacgauaaagcaugcggcuuacuggguuauucuucccaagaccuuaucgggcagaaguugacccaguuuuuccugagaagcgauucggacguggucgaggcccuaucugaagaacacauggaggcugauggacaugccgcagugguuuuuggcacuguggucgacauuaucuccaggucaggcgaaaagauuccagugaguguauggaugaagcggaugcgccaggagcgaagacucuguugcguugugguccuggaaccgguggagagggugagcacaugggucgcuuuccaauccgaugggaccguuacgucuugugacagccuuuuugcccaccuucacggauacgugucaggugaagauguagcgggccagcauaucacugacuugauacccagugugcagcucccuccauccgggcagcacauccccaagaaucugaaaauucaacggagcgucggacgugcccgcgacggcaccacauucccuuuaucucugaagcucaaaucacagccaaguagcgaggaggcaacuaccggugaagcugcccccguguccggguauagagcuucuguuuggguguuuugcacaaucucgggacuuauuacccuguugccggauggcacgauccauggcauaaaccacagcuucgcccuaacucuguuuggguacggaaagacagagcuccuggguaaaaauauuaccuuccuuaucccuggcuuuuauuccuacauggaccuggcauauaacucaaguuugcagcuccccgaucuggccucuugcuuagacgucgggaaugaaagcggauguggcgagaggacucuggauccauggcaaggucaggacccugcugaagggggccaggauccccggauuaacgugguacuagcgggaggccacguugugccacgagacgagauccgcaagcucauggagucccaggauaucuucacagggacccaaacggaacugauugcaggaggucagcuuuugucaugccugagcccccagccugccccaggcgucgacaaugugccggaggggucucuccccguccauggagaacaggcucugccuaaggaucaacagauaaccgcccuuggcagagaggaaccaguggcaaucgagucccccggucaggaccuguugggggagaguaggagcgaaccuguugacgugaaaccauucgccucuugugaggauuccgaagcucccguaccggccgaggacggcggaucagaugcaggcaugugcgggcucugucagaaggcgcaacuggagcggaugggagucagugguccuagcggcucggacuuaugggcuggggccgcaguggccaaaccacaggcuaagggacagcuggccggcgguucccuacucaugcacugccccuguuacgggucugaauggggccugugguggcgcagccaggaucuugcaccuucacccaguggaauggcuggcuuguccuuugggacaccaacucuggacgagccuuggcucggaguugaaaacgauagagaggaacugcaaaccugcuuaauuaaagagcagcugucucagcuuagcuuggccggcgcgcucgacgugccccaugccgagcuggucccaacagaaugucaagcugugacugcaccgguauccucaugcgaucuaggugggagggaccuguguggaggcugcaccgguagcaguucugccugcuacgcucucgccacagaucugccuggcgggcuugaggcaguggaagcgcaggagguugacgucaauuccuucagcuggaacuugaaggaacuguuuuucucggaucagaccgaccagacuucaucuaauuguaguugcgccacguccgaguuacgugagacacccagcucucucgcugugggaagcgacccagaugugggcucccugcaagaacaggggucauguguccuugacgaucgggagcuguugcuccugaccggaacuugcguugaccuaggccagggucgaagauuuagggaaaguuguguggggcacgaucccaccgagccucuggaagugugccucguaagcucugagcauuaugccgcauccgaccgcgagucaccaggacacguccccaguacacuggaugcuggcccugaagacaccuguccgagcgccgaggaaccacggcuuaacgugcagguuacuuccacacccgugaucgucaugagaggugcagccggcuugcaaagggagauacaggagggggcuuacucuggaucgugcuaucaccgcgauggccugcgauuaagcauucaguucgaagugcggcguguugagcuccaggggccuacgccacuguuuuguugcuggcuugugaaagaccugcuacauucacaaagagauuccgcggccaggacccgccucuuccuggcaaguuugcccggaucuacucacagcacagcugccgaacugaccggcccuuccuuaguagagguccuccgggccagaccgugguuugaggagcccccaaaggcuguggagcuggaaggucuugcagccugugagggggaauacucacagaaguauucuacaaugagcccucugggaaguggcgcguucgguuuuguguggacugcugucgacaaagagaagaacaaagaaguugugguaaaguucaucaaaaaggagaagguguuggaggauugcuggaucgaagaccccaaacucggcaaggucacccuggagauugccauccuauccaggguggaacaugcaaauauuauaaaaguucuggacaucuuugagaaccagggguucuuccaacuugugauggaaaagcacggaagcggccucgaucuguuugccuucauugaccgacacccacgcuuggaugagccucuggcuucuuacaucuuucggcaggucagagcagggcagucaagguuaguguccgccguuggauaucuccgucugaaagacaucauucaucgcgauauaaaggacgagaauaucgugauugcggaagauuucacgaucaaacuuauugacuuuggcagugcugccuaccuggagcgggguaaauuguucuacaccuuuugcgggacaaucgaauauugugcacccgagguccucaugggaaacccauacagaggcccggagcuggaaauguggagccuaggcguaacucuguauacccuuguguucgaggaaaauccuuuuugcgagcucgaagagacaguugaggccgcuauacaucccccauaccuggugucgaaggaauugaugucuuuagucuccgggcugcuccagcccgugccugagaggcgaacuacccuggaaaaacuuguaacggauccaugggugacacaacccgucaaccuggccgacuauaccugggaggaaguuuuccgggugaauaagccugagagcggaguguugucagcagcuagucuagagauggguaaccgcucucuguccgaugucgcccaggcgcaggaacucuguggcgggccggugccaggagaggcccccaauggccaggguugccugcacccuggggaccccagacuuuuaacuagcuga

SEQ ID NO: 60377 - RNA, 381 nt, Artificial Sequence
  derived and/or modified sequence opt3 from PATE1__Homo_sapiens__NP_612151
auggacaagagccugcuccuugagcugcccaucuuguuaugcuguuucagagcccuguccggcucucuaucaaugaggaacgaugcugugaaugaaauugucgcaguuaaaaacaauuuuccugugauagagaucguacagugccggaugugucaccuccaauucccaggggaaaagugcagucgcggacgagguauuuguaccgccacaacugaggaagcgugcauggugggccguauguuuaaaagagacgggaacccguggcugacguucaugggaugucuuaagaauugcgcugaugucaaaggcaucagguggagcguguaccugguuaacuuucgguguugccgcucccaugacuuguguaaugaggaucucuga

SEQ ID NO: 60378 - RNA, 2064 nt, Artificial Sequence
  derived and/or modified sequence opt3 from PATZ1__Homo_sapiens__NP_055138
auggagagagugaacgacgccagcugcggccccuccggguguuacaccuaucaggucucuaggcacucaacagaaaugcugcauaaucucaaccaacagcggaagaauggaggucgcuucugcgauguucuucugcgagugggcgacgagaguuuuccugcucaccgugcaguauuggccgcguguagcgaauacuucgaguccguguuuucugcucaguuaggggauggaggcgccgcagacggugggccagccgaugucggaggcgcuacugcagccccgggcgggggagcugguggcucgagagaacuggagaugcauacgaucucaagcaaaguguucggggacauucuagauuuugccuauaccaguaggauaguugugcggcucgaguccuuccccgaacugaugacagcggcaaaguuucuucugaugcgcucugucaucgagauuugccaggaagugaucaaacaaagcaacguacagauuuugguuccuccagccagagcugacaucaugcuguucaggcccccuggaacuuccgaucugggcuuuccacuggacaugaccaauggugccgcacucgcugccaacucaaaugggauagcgggaaguaugcagcccgaggaggaagccgcacgggcugccggcgcugccaucgcaggccaggccagcuuaccugugcugccaggggucgaucgccuuccgaugguggcuggacccuugucuccucaacugcuaacauccccauuccccucaguggcgagcagugcaccuccacucaccgguaagcgaggcagagggaggccccggaaagccaaccugcuugacucuauguuuggauccccgggcggucugcgugaggcugggauuuugccuuguggccucugcggaaaggucuucacugaugccaaucgccugagacagcacgaagcacagcauggcguuacauccuuacagcugggguacaucgaccucccaccaccuaggcuuggagagaacggucugcccauuucggaagacccagauggcccccggaagcgaucucgcaccagaaaacaaguggccugugagaucugcgggaagauauuuagggacguauaucacuugaaucggcacaaacuaucccauucaggagagaagccuuacaguuguccagugugcggccugcgcuucaaaagaaaggauaggaugagcuaucacguccguucccaugacgguucuguggggaagccguacauuugucagagcugcggcaaaggauucucacggcccgaucaccucaacggccacaucaagcagguucauacgagugaacgaccucacaaaugccaaacuuguaaugcuuccuuugccaccagagacaggcugcgcagccaucuugcaugccacgaggauaaggugccaugucaggucugcgggaaauaccugcgggcggcuuauauggccgaccauuugaagaaacacucugaaggacccucaaacuucuguaguauuugcaauagagguuuuagcuccgcaucuuaccucaaggugcacguaaagacacaucacggcguuccucugccacaggugucgaggcaucaggagcccaucuuaaacgggggagccgcuuuccacugugcccgcacuuauggcaacaaagaaggucaaaagugcagccaccaggauccgaucgaguccucagacaguuacggggaucugucugacgcaagcgaccuaaaaaccccugagaagcaguccgcuaauggcucauuuagcugugauauggccguccccaaaaacaagauggaaucugacggagagaagaaauaucccugcccugaauguggcuccuucuuucgaaguaagagcuaccucaauaaacauauucagaaggugcacguccgggcgcucgggggaccccuuggcgauuuggguccagcccuggggucuccuuucagcccccaacagaacaugucacuccuggagaguuuuggauuccagauagugcagagcgcuuuugcaucgucccuuguugacccagaaguggaucaacagccgaugggcccugaggguaaauga

SEQ ID NO: 60379 - RNA, 1023 nt, Artificial Sequence
  derived and/or modified sequence opt3 from PAWR__Homo_sapiens__XP_006719498
auggccaccggcggguacagaacaagcuccggacuggguggcucuacuacggacuuccucgaggaauggaaggcuaaaagggagaagaugcgggcaaaacagaaucccccugggccagccccgcccggaggcgguucaagugaugcggcugggaagccuccagccggagcacuuggcacccccgccgcugcagccgcuaacgaacugaacaauaacuugccuggcggggccccagcggcacccgccgugccuggaccagguggcgucaauugcgcuguugggagcgccauguuaacacgcgcagcuccgggaccccgacguuccgaggacgaaccuccagccgcgucugccucggcagcucccccuccacaaagagaugaggaggaacccgacggcgugccggagaaagguaagucaagcgggccuagugccaggaagggaaaaggccagaucgaaaagcggaaacugcgcgagaagagaagguccacuggcguagugaacauucccgcugccgagugucuagaugaauaugaggacgaugaagcagggcagaaagagcggaagcgcgaagacgccauaacccagcaaaauacaauccagaacgaggcugucaaucuccuggauccaggaucuagcuaccuucugcaggagccuccccgaaccguguccgguagauauaagucaacuacaaguguuagcgaagaggacgugucuuccagguacucacggaccgaucguagcggcuuuccacgcuauaacagagacgcgaaugucagugggacguuggugucuuccagcacucucgagaaaaagauugaagaucuggaaaaagagguaguuagggagcggcaggaaaaccugcgacucgugcgcuuaaugcaagacaaggaggaaaugaucggaaaacugaaggaggaaauugaccuuuugaauagagaucuggacgauaucgaggacgagaacgaacagcuaaaacaggagaauaagacccuccugaaggucgugggccagcuuacaagguga

SEQ ID NO: 60380 - RNA, 1605 nt, Artificial Sequence
  derived and/or modified sequence opt3 from PAX1__Homo_sapiens__NP_006183
augaaguucacccugggccucgggagcagagccuggaggguguccugggagggagcugcagccgcggcugccggucccggcgcagggggaucugcccuucggugccgcgcucagcgagucucaaguccucgucugggcagaagggguagccgguuguccggggcauuaccacugugucuaucucgcggaggcggcggggcccaagcucucccggacugcgccggacccucgccuggucacccaggccaucccggggcgagacagcuggcaggaccucuugccauggaacagacauacggcgagguuaaccagcugggugggguguuuguaaauggaaggccauugcccaacgcuauccggcuccgcauuguggaacuggcccaacugggcauacgaccuugugauaucucaagacagcucagggucagccacggcugcgugaguaaaauuuuagcacgguauaaugagacuggguccauccugccaggagcuauugguggcucuaagccgcguguuacgacccccaacguggucaaacauauccgcgacuacaagcagggggauccuggaauauucgccugggaaaucagagacaggcuuuuggcggauggcgugugugacaaauauaauguaccaagcguuuccucaauuagucggauccugcgaaacaagauugguagccuagcccagcccgggccuuacgaggcaucuaagcaaccacccucccagccgacacucccuuauaaucacaucuaccaguaucccuacccaucaccugugagccccacuggcgcuaaaaugggaagucauccaggcguccccgggaccgccggacacgugucuauaccucgcuccuggccaagcgcucacucggugucuaacauucuggguaucagaacauuuauggagcagaccggcgcccuugcaggguccgaaggaacugccuacucaccgaagauggaggauugggcuggcgucaauaggacagcguuccccgcaaccccugccguuaacggucuggaaaaaccagcuuuggaggccgacauuaaguauacgcaaagugcaagcacucucuccgccgugggcggcuuucugcccgcuugcgccuacccugcaucuaaucagcauggaguauauagcgcgccaggcgggggauacuuagcucccgguccgccuuggccacccgcccagggcccuccccuggcaccaccuggggccggaguggcuguccacggcggugagcucgccgcagcuaugaccuucaaacaucccucacgggaagggagucuuccagccccggcggcccgcccuagaacacccuccguggcuuauacugauuguccaagcaggccccguccuccacgggggucuucaccccgaaccagagcaaggcgcgagcggcaagccgacccuggagcucagguuugcgccgcagcgccggccaucggcacagggagaaucggaggccuggcugaagaggaagccagugcagguccacgcggggcuaggcccgccagcccucaggcacagccauguuuguggcccgauccuccgcacuuucuauacugguccggauuccugggcuuuucugagcucgguuucuga

SEQ ID NO: 60381 - RNA, 1185 nt, Artificial Sequence
  derived and/or modified sequence opt3 from PAX2__Homo_sapiens__NP_000269
auggacaugcacugcaaggccgaucccuucagcgcuaugcauccuggccacgggggagugaaccagcuggguggcgucuuuguuaaugggagaccacucccggacgugguaaggcaacggaucguggagcuugcacaucagggaguccgccccugugauauuucccgacagcugcgugugucucacggcugcguuucaaaaauauuggguagauacuaugaaaccgggaguaucaagccuggagugauuggcggcagcaaaccaaaggucgccacacccaaagugguagacaagaucgcggaguacaagaggcagaacccuacuauguucgcuugggaaauucgggaucgcuuacuggccgaggggaucugugacaaugauacgguuccauccgugucuucgauaaacagaaucauuaggaccaaaguccaacagcccuuucauccuacaccagacggagcagguacuggcgugaccgccccggggcacacaaucgugcccucaaccgcuagcccuccagucaguuccgcaucuaaugaucccguuggaagcuauuccauuaacggcauccuagguauaccucggucaaauggggaaaagcgcaaacgagacgaggaugugagugagggaagcguaccaaacggcgacucucaguccggcguggauucacucagaaagcaccugagggccgacacuuucacacagcaacagcuugaagcucuggaccgggucuuugagcgucccagcuacccggauguguuccaggccagugaacauauuaaaucugagcaggggaaugaguauuccuugccugcgcucacccccggacuggacgaaguuaagagcucgcugucugcauccacgaacccagagcucgguucaaaugugaguggcacucaaaccuacccugucgugacagggcgcgauauggccagcacuaccuuacccggauauccaccccacguaccuccaacaggccaggguuccuacccgaccucuacgcuggcugggaugguucccggcagcgaauuuucaggaaacccuuacagucauccacaguauacugccuacaaugaggcauggagauucuccaaccccgcucuuuugagcucuccuuauuacuauucagccgcgccaaggggcagugcccccgcagcugccgcugccgcauacgaccggcacuga

SEQ ID NO: 60382 - RNA, 648 nt, Artificial Sequence
  derived and/or modified sequence opt3 from PAX3__Homo_sapiens__NP_000429
augaccacacuggccggcgcugugcccagaaugaugaggccugggccaggacagaacuacccgcggagcgguuucccccucgaggucuccacuccucuuggccaagggcgcguuaaucagcugggaggcguguuuaucaacggucgaccauugcccaaucacauucgucauaagauaguagaaauggcacaccaugggaucagaccuugcgugauuucuaggcaguuacgggucucacacggaugugugaguaaaauccugugccgcuaucaggagacgggcagcauuagaccaggcgccaucgggggauccaagcccaaacaaguuaccacaccugacguggaaaagaaaauagaggaauacaagagggagaacccagguauguucucuugggagauccgggauaagcuacucaaagacgcggucugugaucgcaauacugugccgucgguaucaagcauuagucgaauccugagauccaaguuuggcaaaggggaagaggaagaggcugaccuugagaggaaggaagccgaggaaucugagaaaaaggcaaagcauagcauugauggaauccuguccgaacggggcaaacguuggcgcuuggguagaaggaccugcuggguuacauggcgggccucagcuaguuga

SEQ ID NO: 60383 - RNA, 1032 nt, Artificial Sequence
  derived and/or modified sequence opt3 from PAX4__Homo_sapiens__NP_006184
augaaccagcugggcggacucuucgugaaugggagaccccuuccucuggacaccaggcaacagaucguccgguuggccguuagcgguaugcgcccaugcgauauuucccgaauauuaaaggugucuaacggcuguguaucaaaaauccuggggcguuacuauagaacaggagugcuagagccgaagggcauuggugggaguaaacccaggcucgcuacuccuccagucguggcacggaucgcccagcugaagggagaaugccccgcgcuuuuugcuugggagauucagcgccaacugugugccgaaggcuugugcacgcaggacaaaaccccuagcguuuccucuaucaauagagugcucagggcacugcaggaggaucagggccugccauguacacggcuccgcucgcccgccgucuuagcuccugcagugcugacuccacacucagggagcgaaaccccgcgaggaacacaucccgguaccggccacagaaacaggacuauauucaguccuucccaagccgaggcucuugagaaggaauuucagcgggggcaguacccagacucuguagcccguggaaaguuggcgacagcaaccagccugcccgaggauacgguucgcgugugguucuccaauagaagggccaaauggcggcgacaggaaaagcuaaaaugggagaugcaacucccuggcgcuucacagggucugacugucccacgcguggcccccgggaucauuagugcacagcaaagcccgggaucugugccuaccgcugcccuucccgcgcuggagccauugggcccuuccugcuaucagcucuguugggccacagcacccgaaagaugccugucagacacuccacccaaggcuuguuuaaaaccuugcuggggccaucugccaccgcagcccaacagccucgauagugggcuucuguguuugccuugcccaucuucccacugccaucuagccagccugucgggaucucaggcucuccuguggcccgguuguccucuucuguacggcuuggaguga

SEQ ID NO: 60384 - RNA, 1074 nt, Artificial Sequence
  derived and/or modified sequence opt3 from PAX5__Homo_sapiens__NP_001267476
auggaccuggagaagaacuaccccaccccuagaacaagcaggacuggccacgggggagugaaucagcucgguggcgucuucguuaacgggcggccacuuccggaugugguacgccaacgaaucguggaacuggcccaucagggaguccgucccugcgacauuuccagacaguugagggugucucacggcuguguuucaaaaauauuaggucgguauuacgagacggggaguaucaagccuggagugauuggcggcagcaaaccaaaggucgcuacccccaaagugguagaaaagaucgcagaguauaagcgccagaauccuacaauguuugccugggaaauuagagauaggcugcuagcggagcggguuugcgacaacgauacugugccauccgucucuucgaucaaucgcauaauccgaaccaaagugcaacagcccccuaaccagccagugccggcuucaagccauaguauugucuccacagggucuguuacccaggugagcuccguaucaacugacagugccggaagcucuuacuccaucucagguauucucggcaucacaagccccagugcagauaccaauaagagaaaaagggacgaggggauacaagaaucuccugugccaaacggacacucccugcccggccgggauuuccuucguaagcagaugcgcggugaccuguuuacgcagcagcaauuggagguccucgauagaguguucgaaaggcagcauuauagcgacauuuuuacuaccacagagccuaucaaaccagagcagacuaccgaauacucggccauggcuucucuggcagggggacuggaugacaugaaggccaaucucgcuucccccacaccggccgacauuggcucaaguguuccuggcccccaaagcuauccaaucgugaccggguccgaguucucuggaagcccuuacucacacccccaguacaguuccuauaacgauagcuggcgguuuccaaaucccgguuuacugggcucuccuuacuauuacucagcggcagcccgaggggcugccccaccggcagcugccacggcguaugaccgccacuga

SEQ ID NO: 60385 - RNA, 1311 nt, Artificial Sequence
  derived and/or modified sequence opt3 from PAX6__Homo_sapiens__NP_001245391
augcagaauagccacuccggcgugaaucaacuugggggagucuucguuaacgguagaccccucccugacucuaccaggcagaagaucguggagcuugcccauucaggcgcucggccaugcgauauuagucgcauacugcagacacacgcagacgccaaaguacagguguuggauaaucaaaacgucagcaauggguguguguccaagaucuuaggacgauacuaugaaacuggcucuauucguccgagagcgaucggugggucgaaacccaggguugcuacgccugagguggucucaaagauugcccaguacaaacgggaaugcccaagcaucuuugcaugggagauacgcgacagacugcuaagugaaggaguguguaccaacgauaauauccccuccguaucuagcauuaacaggguucuccggaaucuggccuccgagaagcagcagaugggcgcugacggcauguaugauaagcugcgcaugcugaacgggcaaacaggaucaugggguacucgaccuggcugguacccagggaccagugugcccggacagccuacacaggacggcugccagcaacaggagggugggggagaaaauaccaacagcaucucuuccaauggcgaggauucagacgaagcacagaugagauugcaacucaaaaggaagcugcagcggaaccguacuagcuucacacaggagcagauugaggcccuggaaaaagaguuugaacgcacccauuauccagaugucuucgcuagagagaggcucgccgcgaagaucgacuuaccggaagcacggauacaagugugguuuaguaaucgacgcgccaaauggagaagggaggagaagcugcggaaccagcgcagacaggcuucuaacacgcccucccacauuccuaucagcucgucuuucuccacuucaguguaccagccaauuccccaaccuaccacaccagucaguagcuuuacuuccggcucuaugcuugggaggaccgauacagccuugaccaauacguauagcgcacugcccccgaugccuucauucacuauggcuaacaaucuacccaugcagccaccuguucccagucagacauccagcuacucuuguaugcucccaaccucacccagugugaacggacguagcuacgacacuuauacaccuccacauaugcagacccacaugaacucccaaccgauggguacgucuggcaccacaucgacugggcugaucagccccggaguauccgugccuguccaggugccaggcucagaacccgacaugagucaguacuggccucggcuucaguga

SEQ ID NO: 60386 - RNA, 1353 nt, Artificial Sequence
  derived and/or modified sequence opt3 from PAX8__Homo_sapiens__NP_003457
augccccacaacagcaucagauccggccaugggggacugaaucagcucgguggcgccuucgugaacgggaggccucuuccagaggucguucggcaacgcauuguggaccuggcucaccagggaguacgaccgugcgauauaucucgucaguugagagugucacauggcugugucaguaagaucuuagguagguacuaugaaaccgggagcauucggcccggagugaucggcggcuccaaaccuaagguugcaacaccaaaaguggucgagaagauuggggacuacaaacgccagaaucccacuauguuugccugggaaaucagagauaggcugcuagcggagggagugugcgacaacgauacgguaccuucuguuucgucaauaaaucggaucauucgcaccaaggugcaacagccauucaaccuccccauggacagcugugucgcuacaaagagucuguccccuggucacacucuuaucccaucuagcgccgugaccccgcccgaauccccucagucagauagucugggcagcacauauucuauuaauggguugcucggaaucgcacagccaggcuccgacaaacgaaagauggaugacucagaucaagacagcugcagacugaguauagauucucaguccagcucgucuggucccaggaaacaucugcggaccgacgccuuuucccagcaccaccucgagccuuuagaguguccauucgaacgucagcauuaccccgaggcuuaugcaucaccgagucacacuaagggggaacaaggacuguacccucuucccuugcugaacagcacacuagacgauggcaaagccacccucacgccauccaauacuccucugggccgcaaccuuucuacccaucagacauaucccguggucgcugacccacacagccccuuugccauuaagcaggagacuccugagguuucaaguuccagcucuaccccaucaagucugagcuccucugcguucuuggaucuccaacagguggggucgggaguaccgcccuuuaaugcauucccucacgccgcuagcguguacggucaguuuacaggccaggcccuguuauccgggagagaaauggucggaccaacccugcccggcuacccuccacauauccccacgucaggucaagggaguuaugcaucuagcgcuauugccggcaugguggcgggauccgaguacucaggcaacgccuaugggcacacuccguacagcucuuauuccgaagcauggagguucccuaauaguagccuccuuucuuccccauacuauuacucaaguacaagccggcccucggcuccucccaccacugccacagcuuuugaccaucuguga

SEQ ID NO: 60387 - RNA, 1026 nt, Artificial Sequence
  derived and/or modified sequence opt3 from PAX9__Homo_sapiens__NP_006185
auggagcccgccuucggcgaagugaaccagcucgggggagucuuuguuaaugguagaccucugccaaacgcuaucaggcuucggauuguggagcuggcacaauugggcauacgcccgugcgacaucagccgacaguuacguguaucccacgggugugugucuaagauucuggccagauacaaugaaaccggaucaauccuacccggcgcgauuggugggaguaaaccuagggucacaacuccaacggugguuaagcauauccggaccuauaaacagcgcgaucccggaauauucgcuugggagaucagagacaggcuccuggccgauggcgugugcgacaaguacaacgucccuagcguguccucuauuucgcggauccuucgcaauaaaauuggcaaccuggcacagcaagggcacuaugauucauacaagcagcaucagccaacaccccagccugccuugccauauaaucacaucuacagcuauccgagucccauaacugcugcagccgcuaagguaccuaccccacccggaguuccugccauuccagguuccguggcgaugccccgaacauggccgucuagccauuccgucaccgacauccucggcauuagaucaaucacugaucaagugagugacagcucuccuuaccacucccccaaaguggaagaguggucaagccuggggaggaacaauuuuccagcagccgcuccucacgccgucaacggacuggagaagggcgcacucgaacaggaggcuaaauacggucaggcccccaauggguuaccagcgguuggaaguuucgugucugccuccagcauggcacccuauccuacaccagcucagguaucgccguacaugaccuauucugccgcucccuccggcuacguggccggccauggguggcaacacgcaggagguacgucacugaguccucauaacugugauaucccagccagccuugcuuuuaagggcaugcaggcggcacgggaagggucccacucugucacugccagcgcuuuguga

SEQ ID NO: 60388 - RNA, 3210 nt, Artificial Sequence
  derived and/or modified sequence opt3 from PAXIP1__Homo_sapiens__NP_031375
augagcgaccaggcccccaaggugccugaggaaauguucagagaggucaaauacuaugcuguuggcgauaucgacccacaagugauucagcugcucaaggcagggaaagccaaggaaguauccuacaacgcgcuugcuucucacauaaucucagaggauggagacaauccggaagugggugaggccagggaggucuuugaucugcccgugguuaaaccuaguugggugauuuugagcguccagugcggcaccuuacugccagugaacggguucucccccgaaucuugucagaucuuuuucggaauuacagcaugccuaucgcaaguaucaagcgaggaccggagugcccucugggcucugguuacuuuuuauggcggugauugucagcuuacgcugaauaagaagugcacccauuugaucgugccugaaccaaaaggggagaaguacgagugugcacucaaacgcgccuccauaaagaucgucacacccgacugggugcuggauugcgugucugaaaagacuaaaaaggacgaggcuuucuaucacccucgacugauuaucuacgaagaggaagaggaggaagaggaagaggaagaggaggucgaaaacgaggaacaggauagccagaaugagggauccaccgacgaaaaaucaaguccagccagcucucaagagggcuccccgucaggcgaucagcaguuuagccccaagaguaacacagagaaaucuaagggggaacucauguucgacgacuccagcgauucgucuccugagaaacaggaacguaauuuaaacuggaccccagcggagguuccccaacuggcagccgcuaagagaaggcuuccucagggaaaagagccagguuugauuaaucugugugccaacgugcccccgguaccuggcaauauccuacccccagaagugcgggggaaccucauggcagcuggacagaaucugcaauccucagagcgcagugaaaugauagccacuuggagcccugcggucagaacacuuaggaacauuaccaauaacgccgacauccagcagaugaaccggcccuccaauguggcacauauucugcagacguugucugcuccaacuaagaaccucgagcaacagguuaaucacagccagcagggccauaccaacgccaaugcugugcuguuuucacaagucaaggugacacccgaaacucacauguuacagcagcagcaacaggcccagcagcaacagcagcaacacccuguacugcaucuccagccacagcagaucaugcaacuucagcagcagcaacagcagcagaucagucaacagccguauccccagcaaccuccacaccccuucucccagcagcagcaacagcagcagcaagcacauccucaccaguuuagccagcagcaacugcaguucccacagcagcaauugcaucccccgcagcagcuacaccgcccucaacagcagcugcagccauuucaacagcagcacgcccuccagcaacaguuccaucagcugcagcaacaccagcuucagcaacagcagcuggcucaguugcaacagcagcauucucuccugcagcaacagcagcagcaacagauucagcagcaacaguuacagcgaaugcaccaacagcagcagcaacagcagaugcagucacaaaccgcgccccaccugagucagacaagccaggcacuacagcaucaaguuccuccccagcagccaccucaacagcagcagcaacagcagcccccaccguccccucagcaacaccaacucuucggucaugaucccgccguggagauaccagaggaaggguuucugcuuggaugcgucuucgcuaucgccgacuaccccgagcagaugucugauaaacaguugcuggcaaccuggaagagaauuauccaggcccacggcggcacgguggacccuacuuuuacaucgagguguacccaccuccugugcgaaagccaggucuccucagcuuacgcccaggcaauacgggagcguaaacgcugugugacugcgcauuggcuuaacacaguucugaagaaaaagaagauggugccaccccacagagcuuugcauuucccuguagccuuuccgccagggggaaaacccugcagucaacacauuaucucugucaccgguuucguggauagcgacagggaugaccucaagcugauggcauauuuagccggcgcuaaauacacgggguaucugugccgguccaauaccguucuaaucuguaaggaaccuacaggacucaaauacgagaaggccaaggaguggcgcauuccaugcgugaacgcacaguggcugggcgauauccuuuuggguaauuuugaagcucugcgacagauucaguauucaagauacacugccuucagccuccaagaccccuuugcgccuacccagcaucuggucuuaaaccugcuugacgccuggagggugccguugaaaguaucugcugagcuccugauguccauacggcuacccccaaagcugaaacagaaugaaguggcaaacguucagccuaguagcaagcgcgccagaaucgaggaugugcccccaccuacuaaaaagcucacacccgaacugaccccauucguccuuuuuacaggguucgagccggugcaaguccagcaguauauuaagaaauuguacauccugggcggagagguugcugaaucugcccagaaguguacccacuuaaucgcauccaaagugacuaggacggugaaguuucucacagcgauuucaguagucaaacacauagugaccccugaguggcuggaagagugcuuccguugucaaaaguucaucgacgagcagaauuacauucuucgggaugccgaagcugagguucuguuuaguuucagcuuggaagagucgcucaaacgagcccaugugucuccccuguuuaaggcaaaguauuucuacaucacuccaggcauuugccccucccuaagcaccaugaaagcuaucgucgaaugugccgggggaaaggugcugucaaaacagccuaguuuuagaaagcucauggagcacaaacagaacuccucucugagcgagauaauccuuauuuccugcgaaaaugacuugcaucuguguagggaguauuucgcacgcgguaucgauguucacaacgccgaauuuguguuaacaggcguacucacccaaacucuggacuacgagucauauaaguucaacuga

SEQ ID NO: 60389 - RNA, 969 nt, Artificial Sequence
  derived and/or modified sequence opt3 from PBK__Homo_sapiens__XP_006716431
auggagggcaucagcaacuucaagacccccuccaaacugucugaaaagaaaaagucagugcucugcaguacaccuacuauuaauauaccagccagcccguuuaugcagaaacuuggguucggaacgggugucaacguuuaccugaugaagagaucccccaggggcuugucucacucgccuugggcugugaagaaaaucaauccaauuuguaacgaccauuaucggucaguauaccaaaagcgcuuaauggaugaggcaaaaauccuaaagagccugcaccaucccaauauugugggguaucgagccuuuaccgaagcgaacgacggaagucucugccuggcuauggaguacggcggugaaaaaucccuuaaugaucugaucgaggagcguuauaaggccucucaggacccuuucccagcagccauaaucuugaaggucgcucucaacauggcaagagggcugaaauaccugcaccaggaaaagaaacucuuacauggagauauuaagagcuccaaugugguuaucaaaggcgacuuugagacaauuaagaucugugaugugggcgucucacugccccuugacgaaaacaugacugugaccgauccugaggccugcuauauagggacagagccauggaaaccgaaggaagcuguagaggaaaauggaguuauuaccgacaaggccgauaucuucgcguuugguuugacucugugggagaugaugacacuaaguauuccccacaucaaccucagcaaugacgaugacgacgaagauaaaaccuucgacgagucugauuuugacgaugaggcauacuacgccgcucugggcacgaggccuccaaucaacauggaggaacuugacgaauccuaucagaaggugauugagcuguucucagucuguacuaaugaagaucccaaagaccggccuagcgccgcacacauaguggaggcuuuggagaccgauguguga

SEQ ID NO: 60390 - RNA, 843 nt, Artificial Sequence
  derived and/or modified sequence opt3 from PBLD__Homo_sapiens__NP_001028255
augaagcugcccaucuucauugccgacgcuuuuaccgcaagagccuucaggggcaacccugcggcugugugccuccuugagaaugaacuggaugaggacaugcaccagaagauagcccgggaaaugaacuugagcgagacagcauuuauccgcaaguuacauccaacugauaauuucgcccaauccucuuguuuugggcugcgaugguucacgccggcuucagaagucccccuaugcggacacgcaacccucgccagugcugccguucuguuucauaaaauuaagaacaugaauagcacacuuacuuucgugacccuguccggugaguugcgugcgagaagggcagaggacggcaucguacucgaucugccucuguacccagcccacccccaggacuuucaugaaguggaggaucucauuaaaacagcuaucgggaacaccuuaguccaggacauauguuauucuccugauacucagaagcugcuugugcgguugucggacguuuacaaucgcucauuccuggaaaaccuaaaggugaauacagagaaccuccugcaagucgagaauaccggaaaagugaagggccuuauccugacguugaaaggugaaccagggggacagacucaggccuuugauuucuauagcagauacuuugcacccuggguaggcguugcugaggacccugugaccggcagugcccacgcgguccucuccucuuauuggagccagcaccuggggaagaaagaaaugcauggaaggacagccuuauaccaauuccuguucuaucucccaaacuccaaacuuguguuucuguugauuugcacuaucccgcuaaagauguga

SEQ ID NO: 60391 - RNA, 408 nt, Artificial Sequence
  derived and/or modified sequence opt3 from PBOV1__Homo_sapiens__NP_067648
augagagccuuccugaggaaccagaaguacgaggacaugcacaauaucauucauauacuccaaauccggaaacuucgccaccgacugagcaacuuuccccguuugccuggcauuuuagcuccagaaaccgugcugcuaccguucugcuauaaggucuuuaggaaaaaggagaaaguuaagagaucccagaaggcaacagaguucaucgauuacucuauugaacagucacaucacgccauccucacuccccugcagacgcaucuuaccaugaaagggaguagcaugaaguguuccucucugucgucagaagcgauauuguuuacacucacucugcaacugacccagacacucggauuagagugcugucugcuuuauuugagcaaaaccauccacccucagauuaucuga

SEQ ID NO: 60392 - RNA, 4749 nt, Artificial Sequence
  derived and/or modified sequence opt3 from PBRM1__Homo_sapiens__NP_060783
augggcagcaagagaaggcgggccaccucccccucuucaagugugagcggggacuucgaugacggacaccauuccgucucuacaccugguccaucgcgcaaacgacguagacugucaaaccucccgacuguugaucccaucgcugugugccacgagcuuuacaauacgauuagggacuauaaggaugaacagggccggcuguugugugaguuauuuauacgcgcaccuaaaagaaggaaccaaccagacuacuaugaaguagugagccagcccaucgaucugaugaagauucagcagaaacuaaagauggaggaauacgacgaugucaaucuccugaccgccgacuuccaacuucuguuuaacaaugcgaagaguuauuacaaaccugauuccccagaguauaaggcugccugcaaauugugggaccucuaccugcggacacgcaacgaguucgugcagaagggggaagcagaugacgaggacgaugacgaagauggacaggacaaucagggcacuguuaccgaggguucuagccccgccuaccugaaagagauccucgaacaauuacuggaggcuauuguggucgcaacaaacccuuccgggcgacuuaucucagaauuguuucagaagcugccaaguaaggugcaguauccggauuacuaugccauaaucaaagagcccauugaccuaaagaccaucgcucagagaauacaaaauggaagcuacaaaucuauccaugccauggcgaaggauauagaccuccuggcaaagaacgccaagacuuauaaugaaccuggcucccagguauucaaagaugcuaacucaauuaagaagaucuuuuacaugaaaaaggccgagauugagcaccaugaaauggcaaaaagcagucuuaggaugcggacaccaucuaaucuggcugccgcgcguuugaccggccccucccacagcaaggggucgcucggagaggaacgcaacccuacgucuaaauauuacagaaauaagagggccguucaggguggccggcuguccgcaaucacuauggcuuuacaauacgggucagagagugaagaggacgccgcucuggccgcagcccgauaugaggaaggagagagcgaagcugaguccaucaccucuuucauggaugugagcaacccauuuuaccagcucuaugacacaguccgcucauguagaaacaaucagggccagcuuauugcggaacccuucuaccaucugccgaguaagaaaaaguauccugacuacuaucaacagauaaaaaugcccaucuccuugcagcagauuaggacuaagcuaaagaaccaagaguacgagacccuggaucaccucgaaugcgaccugaaucuuauguuugagaacgcaaagcgguacaaugugccaaacagcgccaucuauaagcgcgugcugaaauugcagcaggucaugcaggcuaagaaaaaggaacucgccagaagggaugacauagaggauggugacucuaugauuucaagugcaacaagcgauaccggguccgccaaacguaagucuaagaaaaauauccggaagcaacgaaugaaaauccuguucaacguuguguuagaggcuagagaaccuggaucgggcaggcgccugugugaccuauuuaugguaaagcccagcaaaaaggauuacccagacuauuacaaaauuauccucgagcccauggaucugaagauuauagaacacaauauccggaacgacaaguaugccggcgaggaagggaugauugaggauaugaaacuuauguucagaaaugcaaggcauuacaacgaggaaggaucccagguguauaaugacgcgcacaucuuggagaagcugcucaaagaaaagcgcaaagagcuggguccucuuccagacgaugacgauauggcuucaccgaagcugaaguugagucgaaaaucuggcaucagccccaagaaauccaaguacaugacgccuaugcagcagaaacucaacgaagucuacgaggccgugaagaauuauacugacaagcgggggcguagacugucagcaauuuucuuaaggcugccaagccgcucugagcuacccgauuacuaucucacaauuaaaaagccuauggacauggagaaaauccggucccacaugauggccaacaaguaccaagauauugacaguaugguugaagauuuugugaugauguucaacaaugcuugcaccuauaacgaaccagagagccugaucuacaaagacgcccuugucuugcauaaggugcugcucgaaacuagaagggaucuggagggagacgaggauucucacguacccaauguuacauuacugauucaggaacuuauccauaacuuguuuguguccgucaugucacaccaggacgacgagggccgauguuauagugauagccucgcagaaauaccggcuguggacccuaauuucccaaacaagcccccucugaccuuugauaucauucgcaaaaaugucgagaacaaucgguacagaaggcuagaccuguuccaagagcauauguuugaagugcucgagcgugcccgccggaugaacagaacggauucggaaaucuacgaggacgcgguugaacugcagcaguucuuuauuaagaucagggaugagcuuugcaaaaauggugagauauugcugucccccgccuuaucuuauaccacaaagcaccuccacaacgacguggaaaaagagcgaaaggaaaaacugccaaaggagauugaagaggauaaacuuaaacgggaggaagagaagcgcgaagcugagaaaagcgaagacucaaguggggcagccggccuguccggauugcauagaacuuacucucaggauuguagcuucaaaaauuccauguaucacguaggcgacuacgucuauguggagccugcugaggccaaccuccaaccccauaucguuugcauugaaaggcugugggaggacucagcagaaaaagagguguuuaagagcgauuacuauaauaaggucccagugaguaaaauccuagggaaguguguagugauguucguuaaagaguacuuuaagcugugcccggaaaacuuccgggacgaggaugucuucgugugcgaaucucgauacuccgcgaaaaccaagagcuuuaagaaaauaaagcucuggacaaugccuaucucgucagugagauucgucccccgcgacguuccacugcccguggugaggguagccucugucuuugcuaacgccgauaaaggagacgaugagaagaauacugacaacagugaagauucccgugcagaggacaauuucaaccuugagaaagaaaaggaggaugugccuguugaaaugagcaauggugagccaggcugucacuauuuugaacaguugcacuacaacgacauguggcugaaggugggggauugcgucuucauuaaaucucauggauuagugcggcccagaguuggcaggaucgagaagguguggguacgcgacggugcugccuauuuuuacgggccuauuuucauccacccggaggaaaccgagcaugaaccaacaaaaauguuuuauaagaaagaggucuuccucagcaaucuggaagagaccugucccaugacuugcauacuuggcaagugugcagugcuguccuuuaaggacuuccuaucaugccgaccuacggagauuccagaaaacgauauccuccugugugagaguagauacaaugaaagcgacaaacagaugaagaaauuuaagggauugaaacgguucucucuguccgccaagguggucgaugacgagaucuauuacuucaggaaacccauuguuccucagaaggagccgucacccuuacucgaaaagaaaauccaacugcuugaggcuaaguuugcggaacuggagggcggggaugacgauauugaagagaugggagaggaagacagugagagcacaccaaaauccgccaaggguucugcuaaaaaggaaggcucgaagcgcaaaauaaacaugagcggguacaucuuguucucauccgagaugcgugcagugauuaaggcccagcacccugauuauaguuuuggagaacucucuagacugguaggcaccgaguggcggaaucuagagacugccaaaaaggcugaauacgaggguaugaugggcggcuaucccccaggacugccuccccuucagggcccaguggacgggcucgucagcaugggauccaugcagccgcugcauccuggcggucccccaccccaccacuugccuccaggggugcccggacugccuggcaucccgccacccgguguuaugaaccaaggcguggcaccuauggucgggacccccgccccaggaggcucaccuuacgggcaacaggugggaguuuuagggcccccaggucagcaggcgccuccgcccuauccagggccucaucccgcuggaccaccugugauucagcagcccacaaccccgauguucgucgccccaccucccaaaacucaaaggcuccugcacucugaagcauaccuuaaguauaucgagggccugagcgccgaaaguaauuccauaagcaagugggaucagacauuggcugcacgccgaagagacguacaucucucuaaagagcaggagucacggcugccaucccacuggcuaaagaguaaaggugcccauacgaccauggcggaugcucuguggaggcuucgcgaccucaugcugagagacacuuugaacaucaggcaggccuacaauuuagaaaacguguga

SEQ ID NO: 60393 - RNA, 1044 nt, Artificial Sequence
  derived and/or modified sequence opt3 from PBX1__Homo_sapiens__NP_001191890
auggacgagcagcccagacugaugcacagccaugccggcguggggauggcuggacacccuggucucucccaacaucuucaggauggcgcagggggaaccgaaggcgagggugggaggaagcaggacaucggagauauucugcagcaaauaaugacaaucacugaccagucuuuggaugaagcccaggcgcggaaacacgcuuuaaacugccaucgcaugaagccagcccuguucaauguccuaugugagauuaaagaaaagacgguucucucaauccgaggcgcacaggaggaggaaccgaccgacccccaacugaugcgucuugauaacaugcuguuggccgagggcguggcugggccugaaaaaggagguggcagugcagccgcugccgcggcagccgcugccagcgggggagcaggcuccgacaauucuguagagcacucggauuacagagcuaagcucucacagauuaggcagaucuaucacacagagcuggaaaaguacgagcaggccugcaacgaauuuacuacccaugugaugaaucugcuccgggagcaaagccgcacaagaccaauaagucccaaagaaaucgagaggauggucuccauuauccaccggaaguucucuagcauucagaugcaguuaaaacaauccaccugugaggcggugaugauccugcgcucacgauuucuugacgccagaaggaagcggcguaacuucaauaaacaggcaacugaaauauugaacgaguauuuuuacagucaucugagcaauccuuauccaucugaagaggcuaaggaggaacuagccaagaaaugcgguauuacaguuucccaggugucaaacugguucgggaauaagcgcaucagauacaaaaagaacauuggaaaauuucaggaggaagcuaauaucuaugccgcaaagaccgccgucacggcuacuaacgugagcgcgcacggcagucaagcaaauucucccuccaccccuaacagcgccggcggguacccaucgccguguuaccagcccgauaggcggauccaguga

SEQ ID NO: 60394 - RNA, 1293 nt, Artificial Sequence
  derived and/or modified sequence opt3 from PBX2__Homo_sapiens__NP_002577
auggacgagagacugcucgggcccccuccacccgggggagguaggggcgggcuuggacuggugagcggcgaacccggugggccuggagagccacccggcggcggggauccuggagguggcuccgggggagucccaggcggucgggggaagcaggacaucggagauauuuugcaacagauaaugaccaucacagaccagucuuuagaugaagcccaggcuaaaaagcacgcacugaacugccaucgcaugaaacccgcccuauucucaguucucugugagauuaaggagaaaacuggccugaguauccgaagcucccaagaggaggaaccuguggacccacagcuuaugcgucuggauaauauguugcucgcggagggcguagcugggccggaaaagggagguggcucugccgcagccgcugcagccgcugccgcgucgggcggaggcgugucacccgacaacagcauugagcacagugauuacagauccaagcuggcacagaucaggcauauauaucacucugagcuggaaaaauacgagcaggccugcaaugaauuuacgacccaugucaugaaccucuuacgggagcaaagccgcacaagaccuguggcuccaaaggaaauggagaggaugguuuccaucauucaccggaaauucucagccauccagaugcagcugaagcagaguacuugugaggcagugaugauucuucgcagccgauuuuuggacgcuagaaggaaacggcguaauuucucuaagcaagccaccgaaguccugaacgaguauuuuuacucccaccuaucaaaucccuauccuagcgaagaggcgaaggaagaacucgccaaaaagugcgguaucacagugagucagguaucuaacugguucgggaauaaacgcauaagauacaagaaaaacauuggcaaguuucaggaggaagcaaauaucuaugcuguuaaaaccgccguguccgucacucaaggaggccauagcaggacaucgucuccaaccccgccguccucagcugggaguggagguagcuucaaccuguccggcucuggggauauguuucuuggaaugccuggccugaauggugacagcuacucagccagucagguggaguccuugcggcacagcauggggcccggcggauacggcgauaaccucgggggaggucagauguauucuccacgagaaaugcgcgcaaauggcucauggcaggaggccgugacgccuaguagcgucacuucccccaccgaagggccaggaucuguucauucggacacaagcaacuga

SEQ ID NO: 60395 - RNA, 1080 nt, Artificial Sequence
  derived and/or modified sequence opt3 from PBX3__Homo_sapiens__NP_001128250
augaagcccgcccuguucagcgugcucugcgagaucaaagaaaagaccggccuuuccauuagaggggcucaggaggaagacccuccagauccgcaacugaugagguuggacaacauguuacuggcagagggagucucuggucccgaaaaaggcgggggaucagccgcggcugccgcagccgcugcagccaguggcgguagcuccgauaauucuauagagcacucggacuaccgggcuaagcuaacacagauccgccagauuuaucauacugagcucgaaaaauacgagcaggccuguaacgaauuuacgacccacguuaugaaucugcuucgagagcaaucacguacaagaccuaucagcccaaaggagauugaaaggaugguggggaucauacaucggaaguucaguuccauccagaugcagcugaaacagucuacuugcgaggcgguaaugauuuugcgcagcagauuucucgaugcaaggcggaagcgccgaaacuucuccaaacaagccaccgaaauccugaaugaguauuuuuacucacaccugaguaaccccuauccuagcgaagaggcuaaggaggaacucgccaaaaaguguucuauuacagugucccaggucucaaauugguucggaaacaagagaaucagguacaaaaagaauauaggcaaauuucaggaggaagcaaacuuauaugcugccaagaccgcggugacugccgcacaugcuguugccgcugccgugcagaauaaccaaacaaauagcccaaccacgcccaacagugggucuuccgggagcuucaaucugccuaacucgggagacauguuuaugaacaugcagucucuuaauggugauuccuaccagggcucacaagucggggcaaacgugcagagucagguagacacuuugcggcacguuauuaaucagaccggaggcuacagcgauggucugggcggaaacucccuauauucuccacacaaucucaacgccaauggcggcuggcaagacgcuacaacuccgagcucagugaccagucccacagaggggccuggauccguccauagcgauaccucuaacuga

SEQ ID NO: 60396 - RNA, 1125 nt, Artificial Sequence
  derived and/or modified sequence opt3 from PBX4__Homo_sapiens__NP_079521
auggccgcucccccuagaccagcaccgagcccucccgccccaaggcggcuggacaccuccgaugugcuccagcaaaucauggcgauuacagaccagucucuugaugaggcucaggcccgcaagcacgcacugaacugccaucgaaugaaacccgccuuguucucagucuuaugugaaauaaaggagaaaacuguugugaguauccguggcauucaggacgaagauccuccagacgcucaacugcuaagacucgauaauaugcugcuugcagaggggguaugcaggcccgaaaagcggggacgcgguggcgccguggcuagagccgggacggcgaccccuggaggcuguccaaacgacaauagcaucgagcacuccgauuacagggcaaaacugucucagauucggcagaucuaucauucggaguuggaaaaguacgagcaggccugccgcgaauuuacaacucacgucaccaaccuccugcaagagcagucacgaaugagaccggugagccccaaggagauagaaaggaugguuggugcuauccaugggaaauucagugccauucagaugcagcugaagcaauccacaugugaggcagugaugacccuccggucucguuuacuggacgcucgcagaaaaaggcggaauuuuagcaagcaggccacugaaguccuuaacgaguauuucuacucccacuugaauaacccuuauccaucagaagaggcgaaagaggaacuggcccgaaagggaggccuaacaaucagucaggugagcaauugguuuggcaacaagcgcauuagauacaaaaagaauauggggaaauuccaagaggaagcaaccaucuauacgggaaagacugcuguagauaccacagagguuggugugcccggcaaccacgccucuugccucuccacuccuucaagcgggaguucuggaccauuuccccugccguccgcuggcgacgccuuccuuacccugaggacauuggcaagccuccagccucccccaggugggggaugucugcagucgcaggcccaaggcucuuggcagggcgcuaccccucagcccgcgacggcauccccagccggggaucccggaucaauaaauaguagcacuuccaacuga

SEQ ID NO: 60397 - RNA, 315 nt, Artificial Sequence
  derived and/or modified sequence opt3 from PCBD1__Homo_sapiens__NP_000272
auggccggcaaggcucacagacugagcgcagaggaaagggaccagcuccuucccaaccugcgggccgugggguggaaugaguuggaaggacgcgaugcgaucuucaaacaauuucauuucaaggacuuuaaccgagcuuucgguuuuaugacccgugucgccuuacaggcagagaaacuggaucaccauccugaaugguucaauguuuacaacaaggugcacauuacacuauccacucaugagugcgccggccucucugagagagacauaaaucuggcuucauuuaucgaacagguagcagugaguaugacguga

SEQ ID NO: 60398 - RNA, 393 nt, Artificial Sequence
  derived and/or modified sequence opt3 from PCBD2__Homo_sapiens__NP_115527
auggccgcugugcugggcgcacucggggccaccagaaggcuucuggcggcuuugcggggacagagcuuaggucuggccgcaauguccucuggcacacaccgccuaacugccgaggaacgaaaccaagcuauccucgaccugaaggcagccggguggucagagcuuagugaacgugaugcuauuuacaaagaguucagcuuucauaauuucaaccaggccuuuggauucauguccagagucgcgcugcaggcagaaaagaugaaucaccaucccgagugguuuaacguuuauaauaaagugcagauaacguugaccucucacgacugcggcgagcucacaaagaaagauguaaagcuggccaaguucaucgaaaaagcugccgcaucgguguga

SEQ ID NO: 60399 - RNA, 1071 nt, Artificial Sequence
  derived and/or modified sequence opt3 from PCBP1__Homo_sapiens__NP_006187
auggacgccggcgugaccgagagcgggcugaacgucacacucacuaucagacuucugaugcacggaaaggaaguugguuccauuauaggcaaaaagggggagucugugaaaaggauccgggaagagucaggagcucgcauuaauaucagugaaggcaacugccccgagcgaauuaucacguugaccgguccuacaaaugcaauauucaaggccuuugcgaugaucauugauaaauuagaggaagacaucaacagcuccaugacuaauucuaccgcugccucgcguccaccgguaacacugaggcuagugguccccgcaacccagugugggucacucauuggaaagggcggcugcaagaucaaagagauaagagaaagcacuggggcccaagugcagguugcuggagauaugcugccuaacaguacagagcgggcaauuaccaucgccggugugccacaguccgucacggagugugugaagcagauuugccuuguaaugcuggaaacuuugucucaaagcccccagggccgcguuaugaccaucccuuaccagccaaugcccgcuuccucaccugugaucugugccgggggacaggacagaugcagugaugcggcaggcuauccacaugccacacacgaccucgaggguccgccccuggaugcuuacagcauucaagggcagcauacuauaucuccucuggaccucgccaaauuaaaucaggucgcaaggcagcaaucccacuucgcuaugaugcauggaggcaccggcuuugccgggaucgauucaagcaguccagaagugaagggauauugggcgucucuggacgccuccacacagaccacgcacgagcuuacuauucccaacaauuugaucgguuguauaauuggccggcagggggcaaacaucaaugaaauccgccaaaugagcggagcucagauuaaaaucgccaacccuguggagggcucgucuggucgacaggucacaauuaccggguccgcugccucaauaagucuggcacaguaccuaaucaaugccagacucagcuccgagaagggcaugggaugcucuuga

SEQ ID NO: 60400 - RNA, 996 nt, Artificial Sequence
  derived and/or modified sequence opt3 from PCBP2__Homo_sapiens__NP_001092090
auggacaccggcgugaucgaagggggacugaacgucacacucacuauuagacuucugaugcacgguaaggagguuggcagcauaaucgggaaaaagggagaguccgugaaaaagaugagggaagagucuggcgcccggauuaauaucucagaagguaacugccccgagcgcauuaucacguuggcugggccuaccaaugcaauauucaaagccuuugcgaugaucauugauaaguuagaggaagacaucaguagcuccaugacaaacucuacugcugccucgcgaccaccgguaacccugcgucuagugguccccgcaucacaguguggaagccucauuggcaagggcgggugcaaaaucaaggagauaagagaaaguacaggagcccaagugcagguugcuggugauaugcugccuaauuccaccgagagggcaauuacuaucgccggcauuccacagucuaucaucgagugugugaaacagauuugcgucgugaugcuugaaagcccucccaaggggguaacaauaccauaccggcccaaaccuuccucaaguccaguuaucuucgcuggaggccaagccuauaccauucagggucaguacgcgaucccgcagcccgaccugacgaaguugcaucaacucgcaaugcagcagagccacuuuccuaugacucaugggaacaccggauucucuggcauagaguccucaagcccagaagugaagggcuauugggccgggcuggaugcuagugcccagacaacuucucacgagcugaccauucccaaugaccucaucggauguaucauuggucgccaaggcgcaaaaaucaacgaaauuagacagauguccggggcucagauaaagaucgccaauccugucgagggaagcacagauaggcaagugaccauuacgggcucggcggccucuaucuccuuagcacaguaccugaucaacgugcggcuuucaagugagacuggugggaugggcagcuccuga

SEQ ID NO: 60401 - RNA, 1038 nt, Artificial Sequence
  derived and/or modified sequence opt3 from PCBP3__Homo_sapiens__NP_001123613
augggcgagggggacgccuucugggcucccagcgugcugccucacuccacccucucuacacuuucacaucacccacagccgcaauuuggaagaaggauggaaaguaaggucagcgaggguggccugaacguuacuuugacgauccgguuacugaugcaugggaaagaagugggauccauuauaggcaagaaaggugagaccguaaagaaaaugcgcgaagagucuggggcacgaaucaauauuucggagggaaacugccccgaacguaucgugacaauuacuggcccuaccgaugccaucuucaaggcguuugcuaugauagccuacaaguucgaggaagacaucauuaauucaaugagcaacaguccagcaacauccaaacccccugucacccuaagacucgugguuccagccucucaguguggcagccugaucgggaagggagguuccaaaauuaaggagaucagggagucaacuggcgcucaggugcaggucgcaggggauaugcuucccaauaguacagaacgggccgugaccauaagcggaacgccugacgcuauuauccaaugcguaaaacagauuuguguugugaugcuggaggccuauacuauccagggccaguacgcgaucccacacccggauuugaccaagcuccaucaacuggcaaugcagcagacacccuuuccuccacugggucagacuaaccccgccuucccuggggaaaagcucccauuacacucuuccgaggaagcucaaaaucugaugggacagucaagcggccuugacgccagucccccggcaucuacccacgaguugacaauuccuaacgaucugauaggcugcaucauugggcgccagggaaccaaaaucaaugagauaagacaaauguccggugcucagauuaagaucgccaacgcgacggaaggcagcucggagaggcagaucacuauuacagggacccccgccaauaucucucuagcacaguaucucauuaacgcucggcugacuuccgaagucacaggaaugggcacccuuuga

SEQ ID NO: 60402 - RNA, 1281 nt, Artificial Sequence
  derived and/or modified sequence opt3 from PCBP4__Homo_sapiens__XP_005265387
auggaggccggccagguggcugcaagaacccacagccaagucgccguugcgcccgcuuccccugacaggaugucugggucagauggaggucuggaagaggaaccagagcucaguaucacacuuacucugcggauguugaugcauggcaaggaaguggggagcauuauaggcaaaaagggagagacgguaaaacgcauccgagagcaguccucugcccguauuaccaucucggaagguucaugcccggagagaauuacaacuaucaccgggagcacagcagccguguuccacgcugucaguaugauagcauuuaaguuagacgaagaucugugugccgcucccgccaacggaggcaauguguccaggccuccaguuacccuacggcucgugauccccgcgucucagugcggcagccugauugggaaagcaggaacuaagaucaaggagauucgcgagacaaccggugcccagguccaaguggcuggcgaccuucugccuaacuccacggaaagagccguaacuguuucaggggugccagaugcaaucauauugugugucaggcagauuugcgcugugauccucgagagucccccuaaaggagccaccauuccauaccauccgagccugucucugggcacagugcucuuauccgcgaaucaggguuucucaguccaggggcaauauggagccguuacucccgcagaagugaccaagcugcagcagcuuagcagucacgcuguaccuuuugccacaccaucugugguccccggcuuggacccuggcacccagacguccagccaagaguuccuggugccaaacgaucuaaucggguguguuaucggacggcaggguucgaaaauuucugaaauacgccagauguccggcgcucauaucaagauugggaaucaagccgagggagcaggcgagcgacacgugacuaucacagguucacccgucaguauagcccucgcucaguaccugauuaccgcgugccuugaaacugcaaaaagcacauccgggggcaccccgucuagcgccccugcugaccugcccgccccauuuucaccucccuugacggcacucccaaccgcucccccuggacuguuaggcacaccauaugccaucagucuguccaacuucaucgggcucaagccgaugcccuuucuugcccugccuccagcaagccccggaccuccacccgguuuggcggcuuacacugccaagauggcagccgcuaauggcucuaaaaaggccgagagacagaaauucucaccguauuga

SEQ ID NO: 60403 - RNA, 2187 nt, Artificial Sequence
  derived and/or modified sequence opt3 from PCCA__Homo_sapiens__NP_000273
auggcaggcuucuggguggggaccgcuccccuggucgcagccggaagaaggggucgguggccuccacagcaacucaugcuuagcgcggcucugcgcacauugaagcacguuuuauacuauucccgacagugccugauggugucucguaaccuaggcucaguaggguacgacccgaaugagaaaacuuuugauaagauccucguggccaacagaggagaaauugcauguagggucauacggacgugcaaaaagaugggcaucaaaaccguggccauucauagugacguugaugcuagcuccgugcacgucaagauggcagacgaggccguguguguaggucccgcuccuacaucuaagucguaucugaauauggaugccaucauggaagcgauuaaaaagacucgcgcacaggccguucauccaggguacggauuccuuucagagaacaaagaauuugcuagaugccuggccgcagaggacguggucuucaucggccccgauacccacgcuauacaggccaugggcgacaagaucgagagcaaauugcucgcgaagaaggccgaagugaauacaauuccuggguuugauggaguggucaaagacgcagaggaagcuguuaggaucgcccgggagauugguuauccagugaugaucaaggcuagugccggcgggggaggcaaagguaugcgcauagcaugggaugacgaggaaacccgagauggguucagacuguccucucaagaggccgcuagcuccuuuggagacgacaggcugcucauugaaaaguucaucgauaacccccggcauauugagauccagguauuaggcgacaaacacggcaaugcgcuguggcuuaacgaacgugaguguucaauccagcgcagaaaucagaagguggucgaggaagcaccuaguauuuuucuggaugccgagacuaggcgggcuaugggggaacaagccguggcacuggcccgagcuguuaaauacagcucugccggaacaguggaguuccuagucgacuccaagaagaacuuuuauuuccucgaaaugaauacccgccugcaaguggagcacccaguaacggagugcauaacuggucuugaucugguucaggaaaugaucagaguggcaaaaggcuacccguugaggcauaagcaggcggacauucggaucaacgggugggcugucgagugucgcguguacgccgaagaucccuauaaaucauuuggacucccuagcauaggcagacugagucaguaccaggagccauuacacuugcccggugucaggguggacucugggauucagccuggcuccgauaucagcaucuauuacgacccaaugauuucgaagcucaucaccuauggaucugaucguacagaagcacuuaaacggauggccgacgcucuggacaauuacguuauucgaggcgugacucauaacauagccuugcuaagagagguaaucauuaauuccagguucgucaagggggauaucucaaccaaguuccugagugacguguaucccgauggauuuaaaggucacaugcucacaaagagcgagaaaaaccaacugcuugcaaucgcuuccucucuguucguugccuuucaguugcgcgcgcagcacuuccaggaaaacagccggaugccggugauuaagccugacauagccaauugggagcucucagucaaacugcaugauaaggugcacaccguaguggcuaguaacaauggcuccguuuuuagcgucgaaguggacgggucuaaguuaaacgugacgucaacuuggaaucuggcaaguccccuacucagcgucuccguugauggaacacaaagaaccgugcagugccugucuagggaggccggcgguaacaugucgauccaguuccuugggacuguguacaaaguaaauauuuugacacgccuggcugccgagcucaacaaguuuaugcuggaaaaagucaccgaggacacgagcuccgugcuucgaucaccaaugccuggcguuguggucgcagugaguguuaagcccggagaugcgguggccgaaggccaggagaucuguguaauugaagcuaugaaaaugcaaaauucuaugaccgccgggaagacaggaacugucaagagcgugcauugccaggccggugacaccgugggcgagggggaucuguuggucgagcucgaauga

SEQ ID NO: 60404 - RNA, 1620 nt, Artificial Sequence
  derived and/or modified sequence opt3 from PCCB__Homo_sapiens__NP_000523
auggccgcugcacugagaguggccgcggucggcgcuaggcucagcguucuugccuccgggcugcgggcagccgugcgcucuuugugcucacaggcuaccaguguaaacgagcgaaucgaaaauaagcguagaacagcauuacugggagguggccaaaggcggauugacgcccagcacaaacgcgggaagcuaacugcuagagagaggauaagccuccugcuugaucccggauccuucguggaaucugacauguuugucgagcaucggugugccgauuucggcauggcggcagacaaaaacaaguuuccuggugauucggugguuacggggcgcggacgaaucaauggcagacugguguacgucuucucacaggacuuuaccguguucggcgggagcuugaguggagcccacgcucagaaaauuugcaagaucauggaucaagccauuacaguaggugcaccaguuaucggccucaacgacuccgggggagcuaggauacaggaaggcguggagucucuggccgguuaugcggauaucuuucugcggaaugucacugccagcggggugauuccgcagaucucccucauuaugggacccugugcaggcggcgcuguguacaguccugccuuaaccgacuucacauuuauggucaaggauaccucauaucuguucaucacugggccagacguugugaaaagcguaacaaacgaggaugugacccaggaagaacuuggaggugcuaagacgcauacuaccaugucuggcgucgcccaccgugcauuugaaaaugacguggacgccuugugcaaccugcgcgauuucuuuaauuaccuaccccucuccucacaagacccugcuccaguuagagagugucaugaucccagcgacaggcuggugccugagcuugauacaauagucccacuggaaaguacuaaagcguauaacaugguggacauuauccacucuguaguugaugagcgggaguucuucgagauuaugccgaauuacgcaaagaacaucaucgugggguuugcccgaaugaauggacgcaccgucggcauuguggguaaccagcccaaagucgcuuccgggugcuuggacauaaauagcucggugaagggcgccagauucguuagguuuugugaugcauucaacaucccucucauuacauuuguggacguaccaggauuccugcccggcaccgcccaggaauaugggggaaucauacggcacggugcuaaguuacuguacgccuuugcagaggcgacggucccuaaagugacuguuauuacacgcaaggcuuacggcggggccuaugaugugaugucuuccaaacaucucugcggagacaccaacuacgcauggccaacugccgagaucgcugucaugggcgccaagggugcaguggaaaucauuuucaaagggcacgagaauguagaagcugcccaggcggaguauaucgaaaaguuugccaaccccuucccggcugcagugagaggcuuuguugacgauauuauacaaccuucaaguacaagggcccguaucuguugcgaccuugauguccuggcuagcaaaaaggugcagcggcccuggcgaaagcaugccaauauuccauuguga

SEQ ID NO: 60405 - RNA, 3123 nt, Artificial Sequence
  derived and/or modified sequence opt3 from PCDH10__Homo_sapiens__NP_116586
augaucgugcugcuccuuuucgcccuguuguggauggucgagggcguuuuuagccaguuacacuacaccgugcaagaggagcaggaacaugggacauucguaggaaacauugcugaggaccugggucuagauauaacuaagcucuccgcaagaggcuuucagacggugcccaauucuaggaccccuuaucuggaccuuaaccuggaaacaggggucuuguacgugaaugagaaaaucgaucgggagcagauuugcaagcaaucaccaaguuguguucuccaccuggaaguguuccuggagaacccgcucgaauuauuucaggucgagaucgaggugcuggacauuaaugauaaucccccuagcuucccagaacccgaccuuacuguagagaucuccgaaucugccaccccuggaacacgcuuuccauuggagucggcguucgaucccgacguuggcaccaacucacugcgagauuaugaaauaacuccuaacagcuacuuuagucuagacgugcagacacagggugaugggaaucguuucgcugagcucguccuggagaaaccacuugacagagaacaacaggccgugcauagguaugugcugaccgcagucgauggaggcggcgggggagguguuggcgaagggggaggcggugggggaggcgccggcuugccgccccagcagcaacggacggggacugcucuccugaccauccgcguguuagacuccaacgacaauguaccugcauuugaucagccaguguacacagucucucugcccgaaaacagcccuccaggaacucucgugauucagcuuaaugccaccgaccccgaugagggucaaaacggcgaaguuguguauuccuucucaagucacaucagcccgagagcuagggagcuguuuggguugucuccucggacaggacgccuagaggucuccggcgaacuggacuacgaggaaucacccguguaccagguauauguucaggccaaggaucucgguccaaaugcggugccugcacauugcaaaguccuggugcgaguccuugacgccaacgauaacgcucccgagauuagcuucaguaccgugaaggaagccguuucugagggggcagcuccaggcacggugguagcccuguucuccgucacugacagagauagcgaggaaaauggacaggugcaaugugaguugcucggcgacguucccuuuaggcugaagucgucuuucaaaaacuacuauacaaucgugaccgaagcgccuuuagaucgggaggccggggacuccuacacucugacagucguggcacgugaccgcggagagccagcucuaucaaccaguaagagcauacagguacagguguccgauguuaaugacaacgccccgagauuuucucagcccgucuaugauguguacgugacggaaaauaacgucccuggugcuuauauuuacgccguuagcgcaaccgacagggaugagggcgccaaugcucaacucgcguacucaauccuggaaugccagauucaggggaugaguguguucacauauguguccaucaacagcgagaauggauaccuuuaugcauugcggucuuuugacuacgaacagcugaaagauuucucauuucaaguagaggcccgagacgcuggcaguccacaggcccucgcagguaacgccacugucaauauccugauuguggaucagaacgacaaugcucccgccauaguugcaccucuuccagggcgcaacggcacccccgcgagagaggugcugccgaggagcgcugaaccuggauauuugcucacacgggucgccgcaguggaugccgacgauggcgagaaugcucgccugacuuacuccaucguuagagggaacgaaaugaacuuauucaggauggacuggcguaccggagagcugcggacagcccgaagagugccagcaaagagggacccccagcgcccuuaugagcuaguaauugaaguccgggaucacggucaacccccacucucuucgaccgcuacucugguggugcagcuugucgacggcgccguugagccucaagggggaggcgguagcgggggcggaggcuccggggaacaccagagacccucaaggaguggaggcggugagacgucuuuggaucugacacucauccugauaauugcguuagggagcguguccuuuaucuuccugcuugccaugaucguauuggcugugcgcugucagaaagaaaagaagcucaauauuuauaccugccuggcaucagacuguugccuauguugcuguugcugcggaggcgguggcagcacuuguugcgggcgacaggcccgggcucguaaaaagaaacugucuaaguccgauaucaugcucguccagaguagcaacgugccaucuaauccggcccaaguuccuauugaggaauccggaggcuuugggucacaucaccauaaccagaauuacuguuaccaggugugccugacccccgagagugcaaaaacagaccuuauguucuugaagccauguagccccucgagauccaccgauacugagcacaacccuugcggagcgauagucacaggcuacacggaccagcaaccagauaucauuucuaaugguagcauccugucaaacgaaaccaaacaccagagggccgaguuaaguuaucucguggaccgcccccggagaguuaauuccucugcuuuucaggaagccgauaucgugagcuccaaggacucagggcauggagauagcgagcagggcgacagugaccacgaugcaacuaacagggcucaaucugccgguauggaccuguucuccaauuguacagaggaaugcaaggcacuuggccauagcgaucgauguuggaugccuucguucgucccgucagacgggcgccaggccgcugauuaccggucuaaccugcacguaccaggaauggacagugugcccgauaccgagguuuuugaaacaccugaggcgcagccaggcgccgaaagauccuucagcacuuuugggaaagagaaggcauugcauucuacccucgagaggaaagaacuggacggacuacugacgaauacccgugcucccuauaagccuccguaccucacacgcaaacggauuugcuga

SEQ ID NO: 60406 - RNA, 4020 nt, Artificial Sequence
  derived and/or modified sequence opt3 from PCDH11X__Homo_sapiens__NP_001161832
auggaccugcucagcggcaccuacaucuucgccgugcuucuggcuugcgucguuuuucacuccggggcacaggagaagaacuauacaauuagagaagagaugcccgaaaauguguugauaggagauuuacugaaagaccuaaaccucucucugaucccuaauaagucacuuacuacggccaugcaauucaaacugguauacaagaccggugaugugccauugauuaggaucgaggaagacacaggcgagauuuuuacuaccggggcgcggaucgaucgcgagaaacucugugcuggaauaccgcgagacgaacauugcuucuaugaggucgaaguggccauccugcccgaugagauuuuucgucugguuaagaucagauuccucauugaggacaucaacgauaaugcaccuuuauuuccagccacagugauaaacauuaguauccccgaaaauagcgcuauuaacuccaaguacacccugccugcagccgucgacccagaugugggcaucaaugguguacagaacuaugagcuuaucaaaucucagaauauuuucggguuggacguuauagaaacucccgagggagauaagaugccucagcugaucgugcaaaaagaacuagacagggaggagaaggacacauacgucaugaaagugaagguggaagauggcggcuuuccacagcggucgucaaccgcuauucuccaggucagcguuacggacacuaacgauaaucacccgguguucaaggagaccgaaaucgagguaaguauacccgaaaacgccccuguggggacauccgucacucagcugcaugcgaccgacgcagauauuggagagaaugccaaaauccacuuuucuuucagcaaccuuguguccaacaucgcucgcagacuguuucauuugaaugccacaaccggucucauuacgaucaaggagccacuggacagggaagagacucccaaccacaaauuacugguucucgcaucagauggcgggcuuaugccugcucgggccauggugcuggucaaugugacagacguaaacgauaauguuccaaguauugacauacgcuauaucgugaaccccgucaaugauaccguggucuugagcgaaaacauuccgcuaaauacuaagaucgcgcugaucacagugaccgacaaagacgccgaucacaacggacgaguuacguguuucaccgaccaugagauuccuuucagacucaggcccguguuuucuaaucaauuccugcuugaaacagcagcuuaccuggauuacgaguccacuaaggaguaugccauaaaauugcucgcugccgacgcaggcaagccaccucugaaccagucagccauguuauuuaucaagguaaaagaugaaaaugacaacgcucccgucuucacccagagcuuugugacaguuaguauuccagagaauaacucucccgguauccagcugacuaagguguccgcgauggaugcagacagcgggccuaacgccaaaauuaauuaccuacucggaccagaugcuccgcccgaguucucgcuggacugccggaccggcaugcuuacagucgugaagaaauuggaucgugagaaggaggacaaguaucuguuuaccauccucgccaaagauaacggcguaccuccacugacuucuaaugugacgguuuucgucuccauaaucgaccaaaacgacaauucacccguguuuacacacaacgaauacaauuucuaugugccugagaaccuuccacgccaugggaccgucggacugauuacuguuaccgaucccgacuacggugauaauagugcagugacauugagcauccucgacgaaaacgaugacuuuaccauugauucccagacuggcgugaucagaccgaauauaucuuucgacagggagaagcaggaaagcuauacauuuuacguaaaagccgaggaugggggacgggucucacgaaguuccagcgcuaaggugacgauuaacguuguggacgucaaugauaacaaaccuguguucaucguuccacccucuaauuguucauacgagcugguguuaccuaguaccaaccccggcacuguagucuuccaagugauugccguggacaacgauacagguaugaaugcagaaguccgcuauagcaucguugggggcaacaccagagaccuguuugcgauagaccaggagacaggaaauaucacucuaauggaaaagugcgaugugaccgaccucggccugcacaggguacuugugaaggcuaacgauuuggggcagccagacucccuguucucugucgugauuguuaaucucuuugugaacgagucggucacgaaugccacccugaucaacgaauuagugcggaaaagcacagaggcaccuguuacucccaauaccgagauugccgauguguccucaccaacaagugacuacgucaagauccugguagcugccguggcaggaacuauaaccguuguggucgugauuuucaucacggcuguagugcgcuguagacaggccccgcaccuuaaagcggcccaaaagaacaaacagaauagcgaaugggcuacaccuaaccccgagaauaggcagaugaucaugaugaagaagaaaaagaaaaagaaaaagcauagccccaaaaacuugcuccugaauuuugucaccauugaagagacuaaggcagaugacguugauuccgacgguaaccgugugacacuagaucugcccaucgaccucgaagaacagaccaugggcaaguauaacugggugacuaccccuacaacguucaaaccagacucacccgaucuggcccggcacuacaagagcgcuucuccucaaccggccuuucagauucagccagagaccccacuuaauuccaaacaucacauaauccaggaauugccucuggacaacacuuucgucgcaugcgauaguauuagcaaguguucuuccucaaguagcgacccauauucgguguccgauugcggguaccccguuacaaccuuugagguaccugugucuguccauacacgaccgcccaugaaagaagugguuagaagcuguacuccaaugaaggagucaaccacgauggagaucuggauucacccucaaccccagaggaagagugaaggaaaaguggcgggcaagucccagcgccgggucacauuccacuuaccagaggguucucaggaaagcuccucagacgggggccucggagaucaugacgccggcagccugaccaguacuucucacgggcuuccucugggauauccccaagaggaauacuuugauagagcuaccccauccaauaggacagagggugacggcaacagcgauccggagucgacugccgaaaucaccgugcagccuacaguagaggaagcaucagacaauugcacgcaggagugcuugauauacgggcauucugaugcuuguuggaugcccgccagucucgaccacuccagcucuagccaagcacaggccuccgcucugugccacucaccaccccuaagucaggcgagcacccagcaucacucuccucgcgucacucaaacaaucgcccugugucauuccccacccgugacccagacuauugcacucugccacucaccuccgccaauccagguuagugcucugcaucacucucccccucuugugcaggccacagccuugcaccauucucccccauccgcucaagcaucggcccuguguuauagcccucccuuagcgcaggcugccgcaauuucacacuccaguccacucccucaggucaucgcccugcaucgaucucaggcucaaagcuccgugucacuucagcagggauggguucaaggcgcagacggucugugcucuguggaucaggggguccagggcagcgccaccagucaguucuacacgauguccgaacggcuacacccgagcgacgauucuauaaaagugauuccccucacuaccuuuacaccacgucaacaggcgagaccuucaaggggagacucccccaucauggaggagcauccacuguga

SEQ ID NO: 60407 - RNA, 3114 nt, Artificial Sequence
  derived and/or modified sequence opt3 from PCDH11Y__Homo_sapiens__NP_116753
augaccgugggcuucaacagcgacaucuccucugucguuagagugaauacaacuaacugccacaagugucugcucucagggacguacauuuuugccguacuucuggugugcgucguguuccauaguggagcucaggagaaaaauuauaccauaagggaagagauccccgaaaacguuuugauugguaauuuacugaaggaucuaaaccucagccugaucccuaauaaaucccuuacaacuaccaugcaauuuaagcugguguacaaaacaggcgacgucccauugauucggaucgaggaagauaccggggagauauucacuacaggagcacgcaucgaccgagagaagcucugugccggcauuccgcgugaugaacacugcuuuuaugagguggaaguagcgauccugcccgacgagauuuucagacugguuaagaucagguuucucauagaggauauuaacgacaaugcuccuuuauucccagccaccgugaucaacauuucuauccccgaaaauucggcaaucaacucaaaauacacgcugccugccgcugucgauccagacguggguauuaauggggugcagaacuaugagcuuauaaagagccagaauaucuuuggauuggaugucauugaaacucccgagggcgacaaaaugccucagcugaucguucaaaaggaacuagaucgggaggagaaagacaccuacgugaugaagguaaagguggaagacggcggguucccacagcgcaguuccacagcaauacuccaggucucugugacugauaccaacgacaaccauccgguuuuuaaagagacagaaauugaggugagcauccccgaaaaugccccugucggaaccuccgugacgcagcugcacgcuacugaugccgacaucggugagaacgcgaagauucauuucucauuuaguaaucuuguaagcaacaucgcaagaaggcuguuccacuugaaugccacaaccggccucauuacuauaaaagagccacuggaucgggaagagacacccaaccacaaguuacugguucucgcuucugacgggggacuuaugccugcccgcgcaauggugcuggucaaugugaccgaugucaacgacaaugugccauccaucgauauucgauauaucguuaaccccgugaaugacacgguagucuugucagaaaacaucccgcuaaauaccaaaauugcucugauaacagugacugauaaggacgccgaccauaacggcagaguuaccuguuucacagaucacgagaucccuuuuaggcuccggcccguguucagcaaucaauuucugcuugaaaacgcggccuaccuggacuacgagaguacuaaagaguaugcaauuaaguugcucgcugccgaugcugguaagccaccucugaaccagucugccauguuauucaucaaagucaaggacgaaaaugauaacgcacccguguuuacccaguccuucguaacagugagcauuccagagaauaacucgcccgggauccagcugaugaaaguuucugccaccgacgcugauuccggaccuaaugcggaaauaaacuaccuacucggcccagacgcaccgcccgaguuuucacuggaucgucgcacuggcaugcuuacggucgugaagaaauuggacagagagaaggaagauaaguaucuguucacaauccucgccaaagacaauggggugccuccacugaccaguaacgucacuguuuuugugagcauuaucgaucaaaaugacaacucccccguguucacccauaaugaguacaaguuuuauguaccugaaaaccuuccaaggcacggaacagucggucugauuaccgugacugaccccgauuacggcgacaauucugcuguuacauugagcauccucgaugagaacgacgauuucacgauagacucacagaccggggugauucggccgaauaucaguuuugaucgagaaaaacaggaguccuauacuuucuacgucaaggccgaggacggaggccgcgugagcagaucuucaagugcaaaaguuacaauuaacgugguagaugucaacgacaauaagccuguguucaucgugccacccuacaacuauagcuacgaacuggucuuaccuuccaccaaucccgguacaguuguguuucaaguaauagccguggauaacgacacugggaugaaugcugaggucagguauucuaucgugggcggaaacacccgggaucuguucgccauugaccaggaaacgggcaauaucacccuaauggagaagugcgacguuacagaucucgggcugcaccgcgugcuugucaaagcaaacgacuugggacagccagauucgcuguuuagcgugguuauugugaaucucuucgucaacgaauccguaacuaaugcgacccugaucaacgaguuagugagaaagucaauagaggcuccuguuacacccaauacugaaauugccgacgugaguucuccaaccagcgauuacgucaaaauccugguggcagccguagcugguacgaucacaguggucguugugauuuuuaucaccgccguggucaggugucgucaggcaccgcaucuuaaggcugcccagaaaaacaugcaaaauuccgagugggcgacuccuaaccccgaaaaccggcagaugauuaugaugaagaagaaaaagaaaaagaaaaagcacucacccaaaaauuugcuccugaacgugguuacaauagaggaaaccaaggccgacgauguagacagcgauggcaaucgagugacucuagaccugccaaucgaucucgaggagcagaccauggggaaguauaacugggucacaacgccuaccacuuucaaaccagacucucccgaccuggcuagacauuacaaguccgcaaguccucaaccggccuuucagauucagccagaaacaccccuuaauuugaaacaccauaucauucaggagcugccuuuagauaacaccuucguggcuugcgacagcaucucuaauuguuccucaaguagcucggauccauauuccguuucugacugcggauaccccgugacaacuuuugaagucccugugagcguacacaccaggccgacggauucacgcacauga

SEQ ID NO: 60408 - RNA, 5889 nt, Artificial Sequence
  derived and/or modified sequence opt3 from PCDH15__Homo_sapiens__NP_001136235
auguuccgccaguuuuaccuguggaccugccucgccagcggcaucauucuugggucccuguucgagauauguuugggccaauacgacgaugacuggcaguacgaagauugcaaguuagcuagggguggacccccugcaacaaucguggccauugacgaggaaucucggaacgggacuauccuggucgauaauaugcucauuaaaggaacggcgggcgguccagacccgaccaucgagcucucacugaaggauaacguugacuauugggugcuuauggaucccguuaaacagaugcuguuuuugaauagcaccgggcgcgugcucgaccgagauccuccaaugaacauacacagcaucgucgugcagguucaauguauuaauaagaaagugggaacuaucauuuaccaugaaguccguaucgugguacgagacaggaacgauaauucccccaccuucaagcacgagucuuauuacgcuacaguuaacgagcugaccccugugggcacuacaauauuuaccggcuucucgggggacaauggagccacggacauugaugacgguccaaacggccagaucgaauaugucauucaguacaaucccgaugacccuacuucaaacgauaccuuugagaucccacugaugcucacagggaauaucguguuacggaagcgccugaacuacgaagacaaaacuagauauuucgugauuauacaggccaaugauagggcccaaaaccuuaacgagcggcgcaccacaaccacgacuuugacagucgacguucuggauggagacgaucuaggcccgauguuucuccccugcgugcugguaccuaauacccgagacuguagaccacuuacuuaccaggcugcaauccccgagcugaggacaccugaagaguugaacccaauuaucgugacacccccgauacaggccauugaccaggaucggaauauccaaccucccagcgaccguccagguauccucuauagcauucuggucgggacgccugaagauuacccccgcuucuuucauaugcacccaagaaccgcugaguuaucccugcucgaacccgugaacagggacuuccaucagaaguuugaucuuguuaucaaagccgagcaggacaauggacacccucugccagcguucgcaggcuugcacauugagauacuagaugaaaacaaucaaucuccguauuucacaaugcccagcuaccagggcuauauccuggaguccgccccugugggggcuacuauuucagacagucucaaccugaccagcccacuucggaucgucgcccuggauaaggacaucgaagauacaaaagaccccgaguugcaucucuuucugaaugauuacacuucuguguucaccguaacacagaccggaauuacucgauacuuaacgcugcuacagccuguugaccgcgaggaacaacagacauauaccuuuuccauaacugcauucgacggugugcaggagucagaaccagucaucgugaacauucaggucauggaugcuaaugacaacacccccacauuuccggagaucagcuacgauguguauguuuacaccgacaugagaccuggcgauagugugauucaacucacugccguagacgcggaugaagggucuaauggagagaucacauaugaaauacuggucggcgcccagggugacuucaucauuaacaagacgaccgggcuuaucacuauugcaccaggcguggagaugaucguuggaaggacauacgcuuugaccgugcaggccgcugauaaugcacccccugcagagcggcgcaacuccauaugcacagucuauauugaagugcugcccccaaacaaucagagcccucccagauuuccacaacucauguacucgcuggagaucucugaagccaugaggguaggcgcugugcuucugaacuugcaggcgacugaccgugagggggauuccauuaccuacgcaaucgagaauggagacccgcagcggguuuucaaccucucagaaacgaccgguauacugacauuaggcaaggcccuggaucgagagaguacugacagauauauccuaauuaucaccgcuagcgacgggaggccugauggaacauccacugccaccgucaauauuguggugacggacgucaacgauaaugcacccguuuuugacccauaccucccccgcaaccugucugugguggaagaggaagccaaugcuuucguaggccaggucaaagccacagauccugacgcagguaucaacgggcaagugcacuauagccuuggcaauuuuaacaauuuguuccggauaaccucaaacggaaguauuuacacugcgguuaagcugaauagagaggugagggauuauuacgagcucgucgugguugcuacagacggcgccgugcauccacgccacuccacccugacuuuagcaaucaaaguacuggauaucgacgauaacagccccgucuuuaccaacucuacauauacggugcuuguggaagagaauuugccugccgggaccacuauucuccagaucgaagcuaaggacgucgaccugggagccaacguuucauaccggauuagaaguccggaggugaaacacuucuucgcacuacauccauuuacaggugaacugagccuccugcguucccuugauuacgaggcuuuccccgaccaggaggccucuauaaccuuuuugguagaagcguucgauaucuauggcacaaugccuccagggauugccacugugaccgucaucgugaaggacaugaaugauuaucccccuguauuuucgaaaagaauuuauaagggaaugguggcuccggacgcagucaagggcacgcccaucacaaccguguacgccgaggaugcugacccaccuggucugcccgccagcaggguucgcuaucggguggaugacguccaauucccauacccugcauccauauuugaaguagaggaagauucagggagagugaucacuaggguuaacuuaaaugaggagcccaccacaauuuucaaacucguggucguggcguuugacgauggcgaaccaguaaugaguucuagcgccacugugaagauccugguccuucacccgggagagauuccucgauucacccaggaagaguauagacccccacccguuuccgagcuggcuacaaaaggcacgauggugggggugaucucagccgcagcuauaaaccagagcauugucuacucuaucguguccggaaaugaagaggacaccuuuggcaucaacaauauuacugguguuauauacguaaacgggccuuuggacuaugaaacacggaccaguuacgugcucagaguccaggccgauagccuggaggugguucuagcaaaucugagggugccaucuaaguccaacacugccaaagucuauaucgaaauucaagacgagaauaaccaucccccuguguuccagaagaaguuuuacaucggaggcguaucagaggaugcucguauguucacaaguguccuccgcgugaaagcgaccgacaaggauacggguaauuauagcguuauggccuaccggcugauuaucccgccaauaaaagaaggcaaggagggguucguggucgaaacuuauaccggacuuaucaaaacagcaauguuguuucacaacaugagaaggucguacuucaaguuucaggugauugcuaccgacgauuacggcaaggggcuguccggaaaagccgacguuuuagugucugucgugaaccagcucgauaugcaaguaaucgugagcaauguucccccuacucuggucgagaagaaaauugaagaccuuacagagauccuggaucgauaugugcaggagcagauacccggcgccaagguggucguagaaucaauuggugcucggcgccauggggacgcauucagucuagaggauuacaccaaaugugaccucacaguguaugccaucgacccacagacuaacagagcgaucgauaggaaugaacuguuuaaguucuuggacggaaagcuguuagauauuaacaaagacuuucaaccuuacuauggcgaggguggccggauccucgaaauacgaacccccgaggcuguuacguccauuaagaaaagaggggagucucugggauacacagaaggcgcccuucuggcauuggccuucaucauuauccucugcuguauaccagcuauucuggugguccuagugagcuaucgccaguuuaagguuaggcaggcagagugcaccaaaacugcccguauccaagcggcucugccugccgcaaagccggccgugcccgcuccagccccugucgcagcucccccaccucccccgccaccucccccaggggcccaccuuuacgaagaacucggagauuccucaaugcacaaucuguucuugcuguaccauuuucagcagagccggggcaacaauagugugucugaggacagaaaacaccagcaaguagugaugcccuucuccagcaacaccaucgaagcgcauaagucggcccacguugaugguucauuaaagucuaauaaacucaagagugcaaggaaauucacauuucuguccgacgaggaugaccuuagcgcucacaacccucuguauaaggaaaauauuucucaggucagcacuaacuccgauaucucacagcgcaccgacuucguggacccguuuagucccaaaauucaggccaagagcaagucuuugcgagggccaagagagaaaauacaacggcucuggucccagucagugagucugccuaggcgccuaaugcguaagguccccaauagaccugaaaucauugaucugcagcaguggcaaggaacgcggcagaaagcugagaacgagaauacaggcaucuguaccaacaagagggguagcuccaauccacuucucacuacagaagaggcaaaccugaccgaaaaagaggaaauccgccagggcgagacuuugaugauugaggggacagaacaguuaaagucucugucgagcgacucauccuucugcuuuccccgaccucauuucaguuuuucuacccucccaacgguuagcagaacuguggagcugaaguccgaacccaacguaauaucaucuccggccgagugcagccuugaacugaguccuucccggccauguguguugcacagcucucuaucaaggcgcgagacccccaucugcaugcugccuauugagacagaaagaaauaucuucgagaacuuugcccauccacccaauauuuccccgagugcuuguccucuacccccaccucccccaaucagucccccuucgccaccgcccgcgccugcaccacuggcucccccuccagauauaucucccuucuccuuauuuugcccuccgccaagucccccuucaaucccccuuccacugccucccccaaccuucuuuccgcucagugucucuacauccggaccucccacuccacccuugcugccuccauuccccaccccucucccgccacccccuccaagcauucccuguccucccccaccgucagccaguuuccugagcacggaaugcguguguaucacaggcguuaaaugcacuaccaaccuuaugccugccgagaagauuaaauccucuaugacacaacugagcaccacuaccguguguaagacagacccccagagggagccaaaagggaucuugcggcacgucaagaaucuagcagaacuggagaaguccguagccaacauguacucacagauagagaaaaauuaucuccguacgaacgugucugaguuacaaacuaugugcccuagugaaguuaccaauauggagauuacaucggagcagaacaagggaagccugaauaacaucguggaaggcaccgagaaacagucccauucucagucaacuagccuuuga

SEQ ID NO: 60409 - RNA, 3480 nt, Artificial Sequence
  derived and/or modified sequence opt3 from PCDH17__Homo_sapiens__XP_005266414
auguaccugagcaucugcuguugcuuccuccuuugggcccccgcucugaccuugaagaacuuaaauuauuccgugccugaggaacagggcgcagggacagucauuggaaacauagguagagacgccaggcugcaaccaggccuaccgcccgcggagcgcgggggaggcggucggucuaaaucagggaguuaccgaguucucgaaaauagcgcuccucaucugcuugauguggacgccgauuccggacuguuguauacuaagcagcguaucgacagagagucucucuguaggcacaacgcaaaaugccagcugucgcuggaaguauuugccaaugauaaggagauuuguaugaucaaaguggagauucaggacaucaacgauaaugcuccaucauucagcagugaccaaauagaaauggauaucuccgagaacgcagcccccggcacgcgguuuccucucaccucugcucacgacccagaugccggcgaaaauggguuacgcacauaccugcuuacuagagacgaucauggauuguucggucuggacgucaagagcaggggcgacgggaccaaguuucccgagcuagugauucagaaagcgcucgaucgggagcagcagaaccaccauacacugguucuuaccgcacuggacggaggcgaaccuccacgcuccgccacugugcaaaucaaugucaaggugauugauucaaacgacaauaguccgguauucgaggcucccagcuauuugguugaacucccugagaacgccccacuggguacaguggucaucgauuuaaaugcaaccgacgcugaugaagggcccaacggagaggugcuguacucuuuuuccucauaugugccugaccgagucagagaacucuucagcauagauccaaaaacgggccuuauuaggguuaagggcaaccuggacuacgaagagaaugggauguuggaaaucgaugugcaggcccgggaccuaggacccaacccgauuccugcgcacugcaaaguaacugugaagcugaucgaccguaaugauaacgcccccaguaucgguuuugucucugugcgccagggcgcacucuccgaggcugccccaccugggaccguuauugcucuggugagagucacagacagggauagcggaaagaauggccagcuucaaugucgggugcugggugggggcggaacuggcgggggagguggcuugggaggacccggcgguucgguaccauucaaacucgaagagaacuacgacaauuuuuauaccguugugacagaucgaccccuggaccgcgagacccaggaugaauacaacgucacgauaguggccagagacgggggcucuccuccauuaaauuccacuaagucauucgcaaucaaaauucuggaugagaacgacaauccgcccagguuuacaaagggacuauauguccuccaggugcacgaaaacaauaucccuggcgaguaccuggggaguguucuugcccaagauccagacuugggacagaacgguaccgugagcuauuccauacugcccucucauauuggcgauguaagcaucuacacuuaugucucagugaauccuacaaacggggcuaucuacgcgcuccggaguuucaacuucgaacagaccaaagcauuugaguucaagguucuggccaaagacuccggagcuccagcccaccuugagagcaaugcaacggugcgcgucaccgugcuggacguaaacgauaaugcccccgugauuguuuugccgacacuccagaacgacacugcugaacugcaagucccuagaaaugccggcuuagguuaccuggugucuaccgugagggcacuagauucagacuuuggggagaguggccgucucacauaugaaaucgucgauggaaacgacgaucaucuguucgagauugacccaagcuccggcgagauacggacucuucaccccuuuugggaagauguuaccccugugguggaguugguagucaaggugacagaccacgggaagcccacccugucugcgguugcuaaacucaucauucgaucggugagcggaucccugccagaaggcgucccuagagugaauggugagcagcaucacugggauaugucauuaccccugaucguuacucuuaguacgaucucuauuauauugcucgccgcaaugaucacaauugccgugaagugcaaaagggaaaacaaggagauccgcaccuacaauugucggauugcugaguauagccauccacagcuagggggaggcaaagguaagaagaaaaagaucaacaaaaaugacauaaugcugguacaguccgaagucgaggaaagaaacgccaugaaugugaugaacguggucucaagcccgucucuggcaacuuccccuauguacuucgauuaucaaaccaggcucccccugaguagcccacgcucugagguuauguaccuuaagcccgcuuccaauaacuugacagugccucagggccacgccgggugccauaccucauuuacuggacagggcacaaacgcgagugaaacgccagccacccgaaugagcaucauucagacugacaauuuccccgcugagccuaacuauauggggucgcggcaacaguuuguacaguccucuagcacauucaaagacccggagcgugcaucacugagagauaguggacacggcgacuccgaucaggccgacucugaucaagacaccaauaaggguagcuguugcgauauguccgugagggaggcuuuaaagaugaaaacaacuucaaccaagagccagccacucgagcaggaacccgaggaaugcgucaacuguacggacgagugccgcgugcuggggcacagugaucgguguuggaugccucaauuuccagccgcaaaucaggcggagaacgccgacuacagaaccaaucuuuucguucccacaguggaagcuaacgucgagacugaaaccuacgagacagugaauccuacugggaaaaagaccuuuugcacguucggcaaagauaagagggagcauacaauccugauugccaacguuaagccguauuugaaagcaaagcgagcucucucuccccugcuacaggaagugccauccgccagcucgucaccuaccaaagcauguaucgagcccugcacuucuacaaaggguagucuggacggcugugaagccaaaccaggggcucucgcggaggccuccagccaguaccugccuaccgacucucaauaucuuagccccuccaagcagccacgcgauccgccuuucauggcaucagaccagauggcucgggucuuugccgauguacacaguagagccagcagggacucuuccgaaaugggagcuguguuggagcagcuggaucaucccaaucgugacuuaggccgcgagucaguugaugcagaagaggugguccgggaaauagacaaacuccugcaagauugcagagggaacgacccaguggccguaaggaaguga

SEQ ID NO: 60410 - RNA, 3405 nt, Artificial Sequence
  derived and/or modified sequence opt3 from PCDH18__Homo_sapiens__NP_001287757
augcaccagaugaacgccaagaugcauuucagauuuguguucgcucugcucaucgucagcuuuaaucacgacguucuuggcaaaaaccugaaguacaggauuuaugaggaacaacgggugggguccguaauagcacgcuugucugaggauguggccgacgucuuacugaaacuacccaauccuucaaccgugcgauuccgugcgaugcagagaggaaacaguccacuccugguugugaaugaagauaacggugagaucagcauuggcgcuacaaucgacagggaacagcuuugccagaagaaucugaacuguuccauugaguuugaugucaucacuuugccgacggagcaucuccaacuguuccacauagaaguggagguacuggacaucaaugauaacucuccccaguuuucgcggucacucauuccuaucgaaauuagcgagagugccgcaguugggacccgcaucccauuagacuccgccuucgaucccgacgugggagagaauagccugcauacauacagccuuuccgcuaacgauuucuucaauauagaagucagaacuaggaccgacggcgcaaaauaugccgaguugauuguggugcgggaacuggaucgcgagcuaaagucaaguuacgaacuccagcugacagcuagcgacaugggugucccucagcgaucuggguccucaauccuuaagauuagcaucagugacucuaacgauaauuccccagccuuugagcaacagagcuauaucauucagcuguuggagaacucgcccguuggaacccuccuguuagaccugaacgcgacugauccugacgaaggcgcaaauggcaaaauaguguacucuuucuccucacacguaaguccaaagaucauggagacauuuaaaauugauagcgaaagagggcaccucacccuuuucaaacagguggacuaugagaucacgaaguccuacgaaauagauguccaagcccaggaccugggaccgaacucuauucccgcucauugcaagaucaucauuaaggugguugaugugaaugacaacaaaccugagaucaauauuaacuugaugagcccagguaaggaggaaauaucauacaucuucgagggcgaucccauugacacuuuugucgcccuagugaggguacaggacaaagauagugggcugaauggagaaaucguuuguaagcuccacggccauggucacuucaaacugcaaaagaccuaugagaacaauuaccuuauccugacaaacgcaacuuuggaccgggaaaaacguuccgaguauagccucaccgugauugcugaggaucgcgggacaccuucucugucaaccgucaagcacuuuacggugcagauaaaugacaucaacgauaauccaccccauuuccagagaaguagguacgaauuugucauuagcgagaacaauuccccgggagccuauaucacuacagugaccgcgacugacccugauuuaggcgaaaacggccagguuacauacaccauucuggagucuuucauccuagggucgagcauaacgaccuaugugacaaucgaccccuccaacggagccauuuacgcacuccggaucuuugaucacgaggaaguaucacaaauuacuuucgucguggaggcucgagacgguggcaguccaaagcagcugguuucuaauaccacagugguccuuacuaucauagaugaaaacgacaaugugccuguagugauugggcccgccuugcgcaacaauaccgcugagaucacaauuccaaaaggagccgaaagcggcuuucauguuaccagaaucagggcaauagaucgggacuccggugucaacgccgagcugucaugcgcuaucguggcggggaaugaggaaaacauuuucaucauugacccccgcagcugugauauccacacuaaugugucuauggacuccgucccuuacacggagugggaacucaguguuauaauucaggauaagggcaacccacagcugcauacaaaagugcuucugaagugcaugaucuuugaguaugcagaaagcgugaccucuacugccaugaccuccguaucacaagcuaguuuggacgucagcaugaucauuaucauuucgcucggagccauaugugcagugcuguuaguuaucauggugcuguucgccacaagaugcaauagggagaaaaaggauacccguuccuacaacugucgggucgcugagucuacuuaucagcaccacccgaagcgacccagcagacagauucauaaaggcgacaucacucuagugccuacgauuaaugggacccucccaaucaggucacaccaucgcaguucccccucuagcuccccuacucuggaacggggacagauggguucaagacaaagccacaacagucaccagucucuuaauuccuugguuacaauaagcucgaaccaugugccagagaacuuuucacuggaacucacccacgccacacccgcaguagaggucucucagcuguuaaguaugcugcaucagggccaauaccagccgaggccuuccuuccgcgggaauaaguauagccgaucuuaccgguaugcgcuucaggauauggacaaauucagcuugaaggauuccggacguggcgacucagaagcuggugauagugacuacgaucucgggagagacagcccaaucgacaggcugcuaggcgagggauuuucugaucuguuccucacugacggccgcauucccgccgcaaugcggcugugcaccgaggaauguagagugcuugggcacuccgaucaaugcuggaugccucccuugccaucaccuaguagcgacuacagguccaacauguuuauccccggagaggaauuuccaacgcagccgcagcagcaacauccucaccagucucuggaggaugacgcccagcccgcugauucgggugagaaaaagaagucuuuuucaaccuucggcaaagacuccccaaaugaugaagacacaggggauacaaguaccucuagcuuacucuccgagaugucaucuguguuucagcgacugcuucccccuagccuggacacauauagugaaugcuccgaggucgaccgcagcaacucuuuggaacggagaaagggaccacuccccgccaaaacuguuggcuacccucaagguguggcagcuugggccgcgucaacccacuuccagaauccgacgacaaacugugggccaccccugggcacccauuccaguguacagccuagcucgaaguggcuaccagccauggaggagauucccgaaaauuaugaggaagaugacuuugauaacgugcugaaucaccucaacgacggaaaacaugagcugauggaugcuucugaacuugucgcagagaucaauaaguugcugcaggacgugaggcaauccuga

SEQ ID NO: 60411 - RNA, 3306 nt, Artificial Sequence
  derived and/or modified sequence opt3 from PCDH19__Homo_sapiens__NP_001098713
auggagagccugcuccuucccgugcuguuguuacuggccauccuauggacccaggcugcagcccucauuaaccugaaguacuccgucgaagaggaacaaagagcgggcacaguuauagcuaauguggccaaagacgcaagggaggccggguucgcucuugauccucggcaggcaucugccuuucgcguagugucaaacagugcuccacaccuggucgacaucaauccgagcuccggauugcucgugacuaagcagaaaauugaucgagaccugcugugccgucagucucccaaguguaucauuucgcucgaaguuaugucaagcaguauggagaucugcgugauaaaagucgagaucaaggauuuaaacgacaaugccccuuccuucccagcggcacaaauugaacuggagaucucugaagccgcuagccccgguacgcggauuccucuugauuccgccuaugacccagauucaggcaguuuuggggugcagaccuacgaguugacacccaacgagcuguucggacuagaaaucaagacuaggggcgacgguagccgguuugcagagcucguaguugaaaaaucucuggaucgcgagacccagucccauuauucauucagaauaacagcucuugacgggggagauccuccaaggcugggcaccgugggcuugagcauuaaggucacugacaguaaugacaacaauccgguguuuucugaauccacauacgccgugagcguccccgagaacucgccuccaaauacccccguuauccggcucaacgcgucugauccugacgaggggacgaauggacaggugguauauuccuucuacgguuaugugaacgaucgcacucgagaacuguuucaaauugacccacacucaggcuuagucaccgugacaggggcccuggauuacgaggaaggacauguuuacgagcucgacgugcaggcaaaagaucuuggccccaauaguaucccggcucacuguaaggucacugugagcguacuggacaccaacgauaacccucccguuaucaauuugcuauccgugaacucugaacuggucgaggugagcgagucagccccaccugguuaugucauugcucucgugagaguuagugacagggauuccgggcugaauggacgggugcagugccgucuucugggcaacguacccuuccgcuugcaggaauacgagagcuuuucuacaauacucgucgacggcagacuggacagggaacaacaugaucaguauaauuuaaccauccaggcccgggacgggggagugccaaugcugcaaucagcaaaaaguuucacgguucuaauuacugaugagaacgacaaucacccccacuuuagcaagccuuacuaucaggugaucguccaggaaaacaauacaccaggugccuaccuccuguccgugucugcucgagauccggaccuuggcuugaacgggucgguaagcuaucagauagugcccucccaaguucgcgauaugccugucuucaccuacgugucaauuaauccaaacaguggagacaucuacgcgcugagaucuuucaaucaugagcagacuaaggcauuugaguucaaagugcucgccaaggauggcggucugcccagccuucaguccaacgcuacagucaggguuaucauucuggacgugaaugauaacaccccugugaucacggccccacccuugauuaacgggaccgcagaaguauauauaccgagaaauucaggcaucggauaccucgucacagugguuaaagccgaggacuaugaugaaggcgagaacgggcgcgugacuuacgacaugaccgagggagacagaggguuuuucgaaauugaucaggucaauggcgaggugaggacaacucguaccuuuggggaaagcucuaaguccaguuaugagcugaucguuguggcucacgaccauggaaaaacaucauuaucugccuccgcacugguacuaaucuaccucagcccugcgcuggaugcucaagaaaguaugggcagcgucaaccuuucguugauuuucauaaucgcccuggguuccauugcagggauccucuuugugaccaugauuuucguggccaucaaguguaaacgggacaauaaggagauacgaacuuauaacugcagaaucgcugaguacucuuacggccaccagaagaaaagcucaaagaaaaagaaaauuaguaagaaugauaucaggcuggucccacgcgacguugaagagacggauaagaugaacgugguauccuguucuagcuuaacauccucacugaauuauuuugacuaccaccagcagacccuucccuugggaugccggagaagcgaaaguacuuuccucaacguggagaaucaaaacaccaggaauacaucugccaaccauauuuaucaccauuccuuuaauagccagggcccucagcagcccgaucugaucauaaacggggucccacuaccugaaaccgagaacuacucguucgacucaaauuaugugaacucucgcgcacaccugauuaaaaguuccagcacuuuuaaggaucucgagggaaauucucugaaagacagcggucaugaagaguccgaucaaacagacucagaacacgacguucagcgaagucuuuacugugauacggcugugaacgacgucuugaauaccagcgugacuucuaugggcucccagaugcccgaucacgaccaaaacgagggguuccauugccgggaagagugucguauccugggacacucagauagaugcuggaugccaaggaauccgaugccuauucgcaguaagagccccgagcauguucggaacaucauagccuuauccaucgaagcgacagccgcugacguggaggcauaugaugacugcggcccaaccaaaagaacauucgccacuuuugguaaggaugucucugaccaccccgcugaagagaggccuacccucaaggggaaacgaacgguagaugugaccauuuguucgccaaagguuaauagcgugauccgcgaggccggcaacggaugcgaagcaauuucacccgucacauccccucugcaccuuaaaaguucucugccgacuaagccaagcguguccuacaccaucgcguuggcucccccugcccgggaccucgagcaguacguaaauaacgugaauaacggcccaacaagacccucagaagccgagccuaggggugcagacucugaaaaagucaugcaugagguuagcccgauacugaaggagggacguaauaaggaaagucccggcgugaaacgccuaaaggauauugugcuguga

SEQ ID NO: 60412 - RNA, 3231 nt, Artificial Sequence
  derived and/or modified sequence opt3 from PCDH1__Homo_sapiens__NP_001265542
augagauucagggaccugagcuuuuggaaccggggcuccgugcucgggcuuaccgcccuggucgagaaucgcguuucugugggagaggcuuuguuaauccugggucccccucgaauggagcaccuacgucauucaccaggccccgggggacagagacuccugcuuccgaguaugcuguuggcacuccugcugcucuuagccccuagcccaggccacgcgacaaggguaguguacaagguccccgaagaacaaccuccaaacacucugauugguucccuugcugccgauuauggguuccccgacgugggacauuuguacaaacuggaaguuggcgcaccuuaucuacggguggauggcaagacgggggacauauuuaccacagagacuucuaucgaucgcgagggacucagagaaugccagaaucagcugccaggugacccguguauucuugaguucgaagucucgaucaccgaucuggugcagaacggcucacccagguugcucgaggggcaaauugagguacaggacaucaaugauaacacaccuaauuuugccagcccaguuauaacccuggcuauccccgaaaacacuaauauuggaaguuuauucccuaucccacuggcauccgaccgggaugccggccccaacgguguggcuucuuacgagcuccaggccgggccggaagcgcaggagcuuuuuggacugcaagucgcagaagaccaggaggagaaacagccucaguugauugugaugggcaaucuagaucgcgaacgaugggacagcuaugaccugacaaucaaggugcaagauggcgggucacccccaagagccucaagugcucuccugagggucaccguucuugacacgaacgauaaugccccuaaauucgagcggcccagcuacgaagcagagcugucugaaaacuccccaauaggacacucagugauucagguaaaggcuaaugacagcgaucagggugccaacgcggagaucgaguauacuuuucaucaagcccccgaagugguccgucgcuugcucagacuggacaggaacaccggcuuaauuacagugcaggggccuguugaucgggaggaccugaguacucuacgauucucugugcucgcaaaggaucgcggaaccaauccaaaauccgcuagagcccaggucgugguaacaguuaaggacaugaacgauaaugcuccgaccaucgaaaucaggggcauuggucuggugacgcaccaggacgggauggccaacauaagcgaggacgucgcagaagagacugccguggcucuuguccaagugucggaucgggacgagggcgaaaaugcggcaguuacaugcgugguagccggagauguccccuuucaguugcgccaggcuucugagaccggcuccgacuccaaaaagaaauacuuccugcagacuacaaccccucucgauuacgaaaaggugaaggacuauacgaucgagauuguugccguggauagugggaacccaccccugagcuccaccaauucucuuaaaguccaagugguagacgugaacgauaaugcaccuguuuuuacacagagcgucacugagguggccuucccagaaaacaauaagcccggagaggugaucgcugaaauaaccgccucagacgcagauagugguuccaacgcggagcuggucuacagcuuggaaccggagccugcugccaaaggccucuucacaauuucuccagagacuggggaaauccagguuaagaccucacuggacagagagcagagggaaaguuaugaguuaaaagugguggcagccgaucguggaagccccucccugcaaggcacagcuaccguacuggucaaugugcucgacuguaacgacaaugauccuaaguuuaugcugucugguuacaacuucucgguuauggaaaacaugcccgcccuuagcccaguggggauggucacugugaucgacggcgauaaaggagagaaugcacagguucaguuguccguggagcaggacaacggcgauuuuguaauucaaaaugggacgggaacaauccugucaagucucucuuucgaccgggaacagcagagcaccuauacuuuucaacugaaggcugucgaugguggcgugccuccccgauccgccuacgugggggucaccauuaacguuuuagacgagaaugauaacgcgccauauauaacagccccgucaaauaccagccacaagcugcuuacuccucagacaagauugggagaaacggugucucagguagcugcagaggacuucgauuccggcgugaacgccgaacucaucuacaguauugcuggugggaaucccuacggccuguuucagaucggaagccauucuggcgccaucacccuagagaaagagauugaaaggcgccaccaugggcugcaccggcucgucgugaagguuuccgacagaggaaaaccacccagguauggcacugcacuggugcaccuuuacgucaacgagacauuggcgaaucgcacccuguuagaaacacuccugggucauucacuugauacuccucuggacauagacaucgccggggauccagaguaugagcgaaguaagcaacggggaaacauuuuguucggcgugguugcugguguggucgccguagcacuccugaucgcucuagccgugcugguucguuacugcagacagagggaagcaaaaagcggcuaucaggccgggaagaaggagaccaaagaccucuacgcucccaagccuucgggaaaagcguccaagggcaauaaaucuaaggggaagaaaagcaagucaccgaaaccagugaagcccgucgaagaugaggacgaagccggacugcagaaaagucuuaaguuuaacuugauguccgaugcaccuggcgacucuccacgcauucaccuacccuuaaauuauccuccggguagccccgaucucgggcggcauuacagauccaacucaccacugccuagcauccaacuucagccccagaguccaucugcuuccaagaaacaccaggugguacaagaccugccucccgccaacacguucgugggaaccggcgauacaacuagcaccgguucggagcaguacucagacuauucuuacaggacaaauccaccgaaguauccuaguaaacaggucggccaacccuuucagcuauccacuccacagccccucccucauccauaccacggggccauauggaccgagguuugggaauga

SEQ ID NO: 60413 - RNA, 2856 nt, Artificial Sequence
  derived and/or modified sequence opt3 from PCDH20__Homo_sapiens__NP_073754
augagaggcagggggaacgcccggagcucccaggcucugggagugucuuggugccccgcaaccuggcacccucgccucgacaugggucgacuucaucguccaagaucaaguacaagcuacaggaaucugccgcacuuguucuuauuuuuccuguuugucggccccuucuccugucuagggucuuauucgcgggccacugagcuccuguacucacuuaacgaaggacugccugcgggcguuuugaucgguagccucgcugaggaucugcgccugcucccaagaagugccgggaggcccgacccucaaucccaguuaccagaacggacgggagcagaguggaaucccccucugucuuuuagccuugccucccgcggcuugucaggccaguaugugacccuggauaaccgaaguggggaacuacauacaagcgcucaggagauugacagagaggcacucugcguagaaggagguggcgggacugccuggucuggauccgugucaauaagcaguucuccauccgauagcugucugcuucuguuggacguccucgugcugccgcaagaguacuucagguuuguuaaggugaaaaucgcuauucgggauaucaaugacaacgcgccccaguucccugucucgcagauuucuguguggguaccagaaaaugcccccguuaacacccguuuagcaaucgagcacccugccguggauccagacgucggcauaaauggugugcagacauaucgccugcucgauuaccaugggauguuuacccuugacguggaggaaaacgagaauggagaaagaacucccuaucugaucgucaugggcgcuuuggauagggagacacaagaccaguacguuuccauuaucauugccgaagacggcgggucaccgccucuacugggaagugcaacccucacgaucgguauaagcgauauuaacgacaauugcccccuguucacugauucccagaucaacgugaccguauacggcaaugcuacaguggggacuccaauugccgcgguccaggccguggacaaggaucuuggaaccaacgcacaaaucacauauucuuacagccagaaaguuccucaggcuucaaaggaccuguuucacuuggaugagaacaccggcgugaucaaacucuucaguaagauugguggguccguccuggagagccacaaguuaacgauacuggccaauggccccggauguaucccagcugugauuacugcccuaguaucuaucauaaaaguuauuuuucggcccccugaaaucgugccacgauauaucgcaaacgagauugacggcgucguguaccucaaggaacuggagccggucaauacacccaucgccuucuucaccauucgcgauccugaagggaaauauaaggugaacugcuaccuugacggagaggguccauuuagauugucacccuauaaaccuuacaauaacgaguaccugcucgaaacuacaaagccaauggauuaugagcugcaacaguucuacgaaguugcugugguagcguggaauagugagggcuuucaugucaagagggugauaaaaguucagcuucuggacgacaacgauaaugcacccaucuucuugcagccgcucauugaacugaccaucgaggagaacaauagcccuaacgccuuuuuaacgaagcuguaugcuaccgacgccgauuccgaggaacgggggcaagugucuuacuuccuaggaccagacgcacccucguauuuuagccucgauuccgucacaggcauccugacugugucaacccagcuugaccgcgaagagaaagagaaguacagauauacaguaagggccguggauugugguaaaccuccccgugaaaguguugcuacugucgccuugaccgugcuggacaagaaugauaacucuccacgguucauuaauaaagacuuuagcuucuuugugccugagaacuuccccggguacggcgaaauaggagucaucuccguuacagaugcagacgcgggccgaaacggguggguggcucucucagugguaaaucagagcgauauuuuugucaucgacaccggaaaggguaugcugagagccaaggugucuuuagacagggagcagcaauccaguuacacucuguggguugaagcaguggauggcggggagccagcccuuagcucuacggcuaaaauuacaaucuugcuccuggacauaaacgauaauccgccucuaguccuguucccccaguccaacaugucauaucuccuggugcuuccaaguaccuugcccggaagcccuguuacugagguguacgccguagacaaggauaccggcaugaaugcagucaucgcuuauucgauuaucggucgccgggggccaagacccgaauccuucaggauugacccuaaaacaggcaacaucacccuggaggaagccuuacuccagacugauuacggacugcaccgccuucuggugaaggugucugaccauggcuauccggagccauugcacagcacagucaugguuaaucucuuugugaacgauacgguaucaaaugaaaguuacauagagucccugcuacgaaaagagcccgaaauuaacaucgaggaaaaggagccucagauuucuaucgaaccaacccaccggaagguggagagcgucuccugcaugcccacucugguggcgcucucaguuauaagccuggggaguaucacacuugugaccggaaugggcauuuauaucuguuugcguaaaggugagaagcauccuagagaagacgagaaucuggaaguccaaauuccguuaaaagggaagaucgaucuccacaugagggagcgcaaacccauggacauaucuaacauuuga

SEQ ID NO: 60414 - RNA, 3768 nt, Artificial Sequence
  derived and/or modified sequence opt3 from PCDH7__Homo_sapiens__NP_001166994
augcugagaaugaggaccgccggcugggcucggggguggugccucggauguugccuucuguugcccuuaagccugucccuagcagccgcgaagcagcuccugcgcuaccgacuugcugaggaagguccugccgacgugcguaucggcaacgucgcaucugaucuggggauuguuacaggaucaggcgaggugacuuucaguuuggaaagcgguuccgaguaucucaaaauagacaaucugacgggggaacugucuaccucggagagaaggaucgaucgggagaagcucccacaaugucagaugauuuuugacgaaaacgagugcuucuuagauuuugaaguaucagugaucggaccgagccagaguugggucgaccuguucgagggccaggugauuguucuugauaucaaugacaacacacccacuuuuccuuccccaguguugacccugacagucgaggaaaaucgccccgugggcacccuauaccuccugccuacugccacagauagagacuucgggaggaacggaauagagcgguaugaacuucugcaagagccagguggcgggggaucuggcggugaaagccgccgagcuggggcagccgauuccgcucccuacccuggaggcggcgggaauggagccucagguggcgggaguggaggcagcaaaagaagguuggacgcgucugagggugggggcggaaccaacccaggcgggcgguccucaguauuugagcuccagguugcagauacgccggacggagaaaagcagccccagcugaucgugaaaggugccuuagaccgugagcaacgcgauagcuaugaacugacucucagagucagggacggcggggauccuccacggaguucucaggcuauucuucgagugcugaucaccgacgugaaugauaacucgccccgcuucgaaaagagcgucuacgaagccgacuuggcagaaaauucggcuccuggaacaccaauucuacagcugagagccgcggaucucgacguuggcgugaacggucagaucgaguauguauuuggggccgcaacugagucugugaggcggcugcuucgccuggaugagaccuccggcugguugucaguccuccacagaauagacagggaagaggugaaucaacugcguuucacaguuauggcucgggaucgaggacagcccccgaagaccgacaaagccacgguggucuuaaacauuaaggacgaaaaugauaacgugccuaguaucgagauuagaaaaaucggcaggaucccccugaaggacgggguagcuaacguugccgaggaugugcuagucgacacuccaauugcacucgugcaggucagcgaucgcgaccaaggagaaaauggugugguuacauguaccgugguaggcgaugucccuuuucagcugaaacccgccuccgacacugagggggaucagaacaagaagaaauacuuccuucauacaucuaccccauuggacuacgaagcuacgcgggaguuuaaugugguuauaguggcggucgauagcggaucacccagucuguccagcaacaauucucucaucgugaagguaggcgacaccaacgauaauccuccaauguucggucagucagugguugaggucuauuucccggaaaacaauauucccggggagagaguggcaacagugcuggccacugacgcugacaguggcaaaaacgccgaaaucgcauacagccuugauuccucugucaugggaauauuugccauugacccugauucgggcgacauccugguuaauaccguguuggauagggagcaaacagaccgcuaugaguucaaggugaacgcuaaagauaaggggaucccaguacuccagggaagcacuaccgucauugugcagguugccgacaaaaaugauaacgaccccaaguuuaugcaggauguguucacauuuuacgucaaggagaaucugcaaccuaacuccccagugggcaugguuaccgugauggacgcagauaaaggucgaaacgcggagaugucauuauauaucgaagagaauaacaauauuuucaguauagaaaacgacacugggacgaucuacucuacaaugagcuuugaccgggagcaccagaccacuuauaccuuccguguaaaggcugucgauggaggcgacccaccgagauccgccacagcaaccgugucacuguuugugauggaugaaaaugacaacgccccuacugucacacuacccaaaaauauuagcuacacgcuccugcccccuucuuccaacguuaggaccgugguagcuacugugcuugccacagauagugacgaugguaucaaugcagacuugaacuacagcaucgucggcgggaaucccuucaagcuguuugagauugauccaaccucuggagugguuucccucgugggcaaacugacacagaagcauuauggguuacaccgccuggucgugcagguuaacgacucaggacaaccuagucagagcacuaccacgcuugugcaugucuucguaaaugagucgguguccaacgcuaccgccauagauucucagaucgcgcggagcuugcacauuccccucacacaggacaucgccggcgacccaucauacgaaauuaguaagcaaagacuguccaucguuauagguguggucgcugggaucaugacugugauucuaaucauucugaucguagugauggcaagguauugccgaucuaaaaauaagaacggauacgaggccggcaaaaaggaucacgaagacuuuuucaccccgcagcagcaugauaaaagcaagaagccuaaaaaggacaaaaagaacaaaaaguccaagcaaccccucuauucaagcauagucacaguugaggcuaguaaaccaaauggucagcgcuacgauucugugaacgaaaagcuguccgacagccccucgaugggccgguauagaucagugaaugggggaccuggcucuccagaucuugccaggcacuacaaaaguuccagccccuugccuacuguccagcugcauccgcagucuccaaccgcagggaagaaacaccaagcggugcaggacuuacccccugccaacacguucguuggagcuggcgauaauauuagcaucgguuccgaccacuguucagaguacaguugccagacaaacaauaaguauagcaaacagccauuucgucgcguaaccuucucuguggucucccaaccccaggauccucaucaggggucacuccagaguuguuacgacagcggacuggaggaauccgagacuccgucuuccaagagcucauccggcccccggcuuggugcccugccauugccugaagauaacuaugagagaacaacccccgacggcagugugggggaggcagaacacauggagaaugacucuaggccacucccugauguugcucugacuggaaagugcacccgagaaugugacgaguacggccauagcgauuccugcuggaugcccgugcggacaucaccagaacgcaaaaagucucaaccgaaacuaagcacguuuaugccugucgacgagagagggagucaggagaagcuggccaacggagaagcagccauuaugggcgauaggaaucggaaccuccugaauaaaaaguugaccuccagcuaugagacuuucucugcugcgucauuuuccaagaacgaagaggccaaucccgaagacaucccacuuacaaaaaccggugaguacaagcccaguccugugaacacacugacucgaagagagguauauuuauga

SEQ ID NO: 60415 - RNA, 3213 nt, Artificial Sequence
  derived and/or modified sequence opt3 from PCDH8__Homo_sapiens__NP_002581
augagccccgugagaagguggggcuccccuugccuguucccacuccagcuguuuucucuuuguugggucuugucaguugcccaaaguaagaccgugcgguacagcacauucgaggaagacgcuccggggacuguaaucggaacguuagcagaggaucugcacaugaaaguguccggugacaccucuuuucgccuaaugaagcaguucaacucgucacuccugcgaguccgugaaggcgaugggcagcuuacagugggagacgccggccuggauagagagagguugugcggucaggcgccccaauguguucucgcuuuugacguggucagcuucagucaggaacaguuucggcuggugcauguagagguugaggugcgcgaugucaaugaccacgccccuagauucccaagggcacagauucccguggaaguguccgagggggccgcugucggaacucggauaccucuggaaguuccaguggaugaggacguaggcgcaaacggccuccaaaccgugcgcuuagccgagccccauucuccuuuucgagucgaacugcagacaagagcugauggggcccagugcgcggaccuuguguugcugcaggagcuagauagggaaagccaagcagccuauucccucgagcugguugcucaggacggaggucggccaccgcguucagccaccgcagcucuuagugugcgcguccuggacgccaaugaucacagccccgcguucccucagggcgccguggcagaaguagaguuggcugaggacgccccaguugggucucuccuguuagaucuggacgcugccgaucccgacgaaggaccuaacggcgauguggucuuugcauucggugccagaacuccacccgaggcuaggcggcucuuucgacuugacccgcgcuccgggagacugacauuggcgggaccuguggauuacgaaaggcaagacaccuaugagcuagauguccgggcacaggaccgcggccccggcccaagagccgcuacguguaaagugaucguuaggauucgugacgugaaugauaacgccccugacaucgcaauuacuccccuggccgcuccaggggcccccgcaaccucaccuuucgcggcugccgcagccgcugccgcacucggaggugcugaugccagcaguccagcgggcgccgggacaccggaagcuggagcaacuucucugguacccgagggcgccgcucgggagucccuugucgcccuggugagcaccucggaccgagauucuggugcaaaugggcagguuagaugcgcguuguacggccaugaacacuucaggcuccagccugccuaugcuggauccuaccugguggucacagccgcaucauuagaccgcgagcggaucgcugaauauaaccugacccuaguggccgaggauagaggcgcaccaccccucaggacgguacgcccuuacacugugcgaguuggggacgaaaaugauaacgccccacuguuuacacggcccgucuacgaggugagugugcgugagaauaacccgccuggagcuuaucuugcgaccgucgccgcaagagacagggauuugggucgcaauggccaaguuacuuaccggcugcucgaagcugagguggggagagccggaggcgccgugagcacauauguauccgucgacccagcuaccggugcaauauacgcccugaggucuuucgauuaugaaacgcuucgacagcuggacgugcgcauccaggcgagcgacgggggcucaccccaguugaguuccagcgcucucguucaagugcggguccuggaucagaacgaccacgccccuguguuaguucaucccgcaccagccaauggaucucuggagguggcuguaccuggcagaaccgcaaaggauacagucguggccagggugcaggcgcgugacgcugaugagggggccaacggagaacuagcauuugagcuccagcaacaggaaccccgcgaggccuucgcuauuggucggagaacuggcgaaauccugcuuaccggggacuugucacaggagccaccgggaagggucuuucgagcccugcucguuauuagugauggcggucggccuccccugacaacuaccgcaacagugagcuucguagugaccgcugggggcggacgcggcccagccgcgcccgccuccgcagggucuccugagagaucgaggccacccggaagccgguuaggcgucuccgguucagugcugcagugggacacuccucuuaucguuauaauuguguuggcugggaguuguacgcuccugcuagccgcuaucauugcaaucgccacaaccugcaaccgacggaaaaaggaaguccgcaagggaggcgcccugagggaggaacguccgggugcugcgggcgggggagcaucugccccaggcagccccgaggaagcugccagaggggcaggaccuagaccaaauauguuugaugugcucacuuuccccggcaccgguaaagccccuuuuggguccccggcugcggacgccccacccccugcaguugcugccgcagaggugcccggaucagagggcgguagcgccacaggcgaaucugcuugucacuucgaggggcaacagaggcugcgcggagcccaugcggaaccauacggcgcauccccuggguuuggaaaggagcccgccccaccggucgcuguauggaaaggccacaguuucaacaccaucagcggucgagaagccgagaaguuuucugggaaagauuccggaaagggcgacucagauuucaaugacagugacagcgauauuucgggugacgcucuuaagaaagauuugauaaaccacaugcaguccggccugugggcaugcacugccgaguguaagaucuuagggcauucugacagaugcuggagcccuucaugcaguggacccaaugcucacccaucuccccauccuccagcccaaauguccacauucuguaaaagcacgucccucccccgggauccucugaggcgcgacaacuauuaccaggcacagcuuccgaagaccgugggccugcagucaguuuacgaaaaaguguugcaccgugauuaugacagaacugucacacuccugagcccaccccggccugggaggcuacccgaucugcaagagauuggagugccacucuaccagaguccucccggccgcuaucugucuccaaagaaaggugcgaaugaaaacguauga

SEQ ID NO: 60416 - RNA, 3612 nt, Artificial Sequence
  derived and/or modified sequence opt3 from PCDH9__Homo_sapiens__NP_065136
auggaccugagagauuucuaccuccuugccgcucugaucgcaugcuugagguuagacagcgccauugcgcaggagcugauauauaccauccgggaagaacuacccgaaaacgugccuauuggcaauaucccaaaggaucucaacauuucccacaucaaugcugccacagggacuucugcaucacuggucuaccgccuuguuaguaaagccggagacgcuccgcuggugaagguaagcuccucuacgggugagauauuuaccacaucgaaccgaaucgaucgugaaaaauugugugcaggcgccucauaugcugaggagaaugaaugcuucuuugagcucgaaguggucauucugcccaacgacuucuuuagacugaucaagauuaaaaucauagugaaggauacuaaugacaacgccccuauguucccaagccccguuauuaauaucaguauuccugagaacacccucaucaauuccagguuuccaauccccucugcgacagauccugacaccggguucaacggagugcaacauuacgaguuacugaauggccagagcgucuuuggucuugauauuguggaaacuccagagggggaaaaguggccgcaguugauaguacagcaaaaccuggaccgggagcagaaagauacauauguuaugaagaucaaaguggaagacggaggcacgccccagaaguccucaaccgcaauucuacaggucacugugagugacgugaaugauaaccgcccugucuucaaagagggccaaguugaggugcacaucccagaaaacgcccccguagggaccagcgugauacagcuccaugcuacagacgccgauauuggaucuaaugcagagaucagauacaucuuuggugcucaggucgccccugcgacuaagaggcuguucgcccuuaacaauaccacaggccugauuaccgugcagcgguccuuggaccgcgaagagacggcaauccacaagguuacugugcucgcuucagaugggagcaguacaccagcccgagcuaccgucacuauuaacgugacagacguaaaugauaaucccccgaacauagaccugagauauaucauuucuccuaucaacggaaccguuuacuuauccgaaaaagaucccgugaauacgaagaucgcccugauuaccgucagcgacaaagauacagacgugaacggcaaggucauauguuuuaucgagagggaggugccauuccaucucaaagcaguuuacgacaaucaauaucuucuggaaacuucgucuuugcuagauuacgaggguaccaaggaguucuccuuuaaaauuguggccucagacagugggaagccuagccugaaccagacagcucucguacgggucaagcuggaggaugaaaaugacaaucccccaaucuucaaccagcccgugauugagcuuuccguuucugagaacaaccgucgcggacuguauuugacuaccaucagcgcgacagaugaagacucaggcaaaaaugcagauauaguguaccaacucggcccuaacgccagcuuuuucgaccuggauagaaagaccggggucuuaacugcuuccaggguguuugaccgggaggaacaggagcgauucaucuuuacgguaacagcccgcgauaauggaaccccaccgcugcagagccaggcagccgugauuguuacuguccuagacgagaacgauaauucucccaaauucacccacaaccacuuucaauucuuugugucagaaaaucucccuaaguauaguacagugggugucaucaccguuacugacgcugacgccggcgagaacaaagcagugacacugagcauucuuaaugauaacgacaauuucguguuggauccauacuccgggguaaucaagucuaacgucucguuugacagagaacagcagagcuccuauacguucgaugugaaggcgaccgacggaggccagcccccuaggucaaguacugcuaaaguuacaauaaaugugauggaugucaacgacaauucuccagugguuauuagucccccguccaacaccucauucaagcuggugccucucagcgccaucccagguucuguagucgcagagguguuugccguggaugucgacacagggaugaacgcugaacugaaauacacuauuguuuccggcaauaacaagggacuuuuccggaucgaucccgugaccggcaauauaacgcuggaggagaaaccugcccccaccgacguaggguugcaucgccucguggucaacaucagugaucugggauacccaaagagcuuacacacacuggugcuaguuuuucucuaugugaaugacacugcagguaacgcuucuuacauuuaugaccugaucagaaggaccauggaaacaccucuugaucguaauauuggcgacuccucacaacccuaccagaacgaggauuauuugacuaucaugauagccauuaucgcgggggccauggucgugaucguugugauuuucgucaccguacuggugcggugccgacaugcuaguagauuuaaggcagcccagaggagcaaacagggagcugaauggaugucgccaaaucaagagaacaagcagaauaaaaagaaaaagcgcaagaaacggaaguccccgaaaucuagccuccugaacuucguuacgaucgaagagucaaagccugacgaugccgugcacgagcccauuaauggcacaauaaguuuaccagcagaacuggaggaacaguccaucgguagauuugacugggggcccgcgccuccaaccacuuucaaacccaacucuccugaucuugccaagcacuacaaaagcgcuuccccgcagccagccuuucauuugaagcccgacacaccugucucagugaagaaacaccauguaauucaagagcucccacuggauaauaccuucgugggcggaugugacacucuaagcaagaggaguucuaccuccagcgaucacuuuucggcaucagaaugcucuagucagggcggguucaaaacaaagggaccccugcauacgcgccagucccaacgacgggucaccuuucaccucccugacgguagccaggagucuuguagcgacuccggccugggggaucacgagccgguuggaucaggcacucuuaucagucaucccuugccacuggugcagccucaggacgaguucuaugaucaagcuagccccgacaaacguacagaagccgaugguaacucugacccaaacuccgaugggccuuuaggccccagaggacucgcagaagccaccgagaugugcacacaggagugucuggugcuuggccacucagacaauugcuggaugccaccggggcugggaccuuaccagcaucccaagaguccauugagcacuuucgcuccccagaaggaaugggucaaaaaggauaaacucgugaacggccacacccugacgagggcguggaaggaggacuccaaucgcaaccaauuuaaugaucggaaacaguacgguucuaacgaagggcacuucaauaacggaucgcauaugacagacauuccucuagccaaucucaagagcuauaagcaggcaggcggugcuaccgagucaccaaaagaacaccagcuguga

SEQ ID NO: 60417 - RNA, 2853 nt, Artificial Sequence
  derived and/or modified sequence opt3 from PCDHA1__Homo_sapiens__NP_061723
augguguucagcagaaggggcgggcugggagcccgggaccuccuucugugguuguuacugcuagcugcaugggaggucgguuccggccagcuccacuacucuauccccgaagaggccaagcaugggaccuuuguuggacgcguggcgcaagaucugggccuugaacuggcugaguugguaccucgacucuuccguguggccucaaaaacacacagagaccugcuggaagucaaccuccagaaugguauuuuauuugugaacaguaggauagaucgggaggagcugugccaguggagcgcagaauguuccauccaucuugaguugauugccgaccgcccacugcagguuuuccacguggaagucaaggugaaagauaucaaugacaacccgcccguauuuagagggagggagcaaauuaucuucauaccugagucucggcuacucaauucgcgcuuuccaaucgaaggagcugcagaugccgacauuggcgcuaacgcccugcuuacuuauacgcugucacccagcgauuacuucaguuuggacguugaggcguccgaugaacucucuaagagccugugguuagagcugcgaaaauaucucgacagagaagagaccccugagcuucaucuguugcuaacagcaacugauggcgggaagccagaacugcagggaaccguggagcuccugaucacaguccuugacgugaaugacaacgcuccccuguuugaucaggccguguacaggguccacuugcucgaaaccacugccaaugguacacugguuaccacguuaaacgcauccgacgcugaugagggcgugaauggggaaguaguguucucauuugacaguggaauuagccgggauauccaggagaaguucaaagucgacucuuccucaggcgagauacgucugauugauaagcuagacuaugaagagacuaaaagcuacgaaauccaagugaaggccguugauaaagguaguccuccaaugucuaaccacugcaaggugcucgucaaggugcuggacguaaaugauaacgcgccggagcuugccguuaccuccuuguaucugcccauucgcgaagacgcaccucucagcacagugaucgcucugaucacugucucggacagagauucuggggccaauggacaggugaccuguucccuuaugccacauguccccuuuaaacuggugucaacauucaagaacuacuacaguuugguucucgacagcgcucuggauagggaguccuuaucuguguaugagcugguagucaccgcccgggacggcggcagcccuucacuaugggcaacggcccgagugaguguugaaguggcugaugucaacgacaaugcgccagcauucgcccagcccgaguacacuguguuuguaaaagaaaacaauccgccugggugccacauuuucacaguguccgcucgcgaugccgacgcacaggagaacgcccucguuagcuauucucuggucgagagaagggugggagaacgggcucuuucaaauuacgugaguguccaugccgagagcgguaagguuuaugcauugcaaccccuggaucacgaggaacucgaacuguuacaguuucagguguccgcgcgcgacgcuggcgugccaccucuggggucuaacguaacccuucaagucuucguguuggaugagaaugacaacgcccccgcacuccuggccccaagaguuggaggcacuauaggugcugugucggagcuaguccccaggcuggugggggccggccacguuguggcaaaaguacgugcugucgaugccgacagcggauacaaugcguggcucuccuaugaacugcagccugccgcuggcggggcacggaucccauuucgagugggacuuuacacaggugagauuucaaccacgagaguguuggacgaagccgaucugaguagguaccgcuuacucguccugguuaaggaccauggcgagccggcucuuaccgccacagcaacugugcugguaucuuugguggaaagcgggcaggcgcccaaagccuccucacgggcuagcgucggaguggccggcccugaggcagcucucguugaugugaacgucuaucugaucauagccauuugugcagugucuucccuacugguucucacccugcuuuuguacacagcccugagaugcagugugccacccacugagggugcuuaugucccugggaagccaaccuuaguauguagcucugcgcucggcuccuggucaaauagucagcaaaggcgccagcgagugugcagcucggaaggacccccgaagacagaccugauggccuucuccccuggccuuucuccaagccugaacaccucagagcggaaugaacagcccgaggcaaaccuagaucucagugggaauccucgucagcccaacccagacuggagauacuccgcuucucugagggccggaaugcacagcuccguucauuuggaagaggccgguauccugcgcgcuggcccugggggacccgaucaacaguggccaacugugucaagcgcaacgccggagccugaagccggcgaggucagucccccagugggugcggggguaaacucuaauuccuggacauuuaaauauggccccggaaacccuaagcagagcggcccaggggaauuacccgacaaauucaucauuccuggaucgccggcuaucauuucaauacggcaggagccaaccaauucucaaaucgauaagagugacuuuauuacuuucggcaaaaaggaggaaaccaagaaaaagaaaaagaaaaagaaggguaacaaaacacaggagaagaaagaaaaggggaacuccaccacugauaauagcgaccaguga

SEQ ID NO: 60418 - RNA, 2844 nt, Artificial Sequence
  derived and/or modified sequence opt3 from PCDHA4__Homo_sapiens__NP_061730
auggaguucagcuggggcuccgggcaggaaucuagaaggcugcuccuucuguuguuacugcuagccgcuugggaggcaggaaacggucaacuccacuacucagugagugaagaggccaagcauggcaccuuugucgggcggaucgcgcaggaccugggacuugaacuggcugaguugguuccccgccucuuccgaguggccagcaaaggccguggugggcugcuggagguaaaucuccagaacggaauuuuauuugucaauuccagaauagauagggaggaacugugccggcgcucugcagaauguucgauccaccuugaggugauuguggacagaccuuugcagguuuuccauguggaugucgaggugagggacaucaacgauaauccaccgguauuucccgccacacaaaagaaccugucaauugcugaaagccggccucuagacagucgcuucccacucgagggcgcauccgaugccgacaucggcgaaaaugcucugcuuacuuaucgacugucucccaacgaguacuuuagcuuggaaaaaccuccagaugacgagcucguuaaggggcugggauuaauacugagaaaaucccucgauagggaggaagcccccgagaucuuccuugugcugacggcgaccgacgguggcaagccugaauugacagggacuguccagcuacugauuaccgugcucgaugcaaaugacaacgccccagcuuuugaccggacaaucuauaaggugcgucugcuugagaaugucccgaacggaacccugguuauuaaauugaaugccucagaucucgacgaaggccugaacggugauaucguguacaguuucagcaaugacauaucucccaacguaaaguccaaauuucacauugauccuaucacugggcagauuaucgugaagggauauaucgacuucgaggagucaaaaagcuacgaaauuauagucgagggcaucgauaagggccaguuaccacugagugggcauugccgcgugauuguugaaguggaggacaacaaugauaacguccccgaccuagaauuuaagucucucucccugccuaucagagaggaugcaccacuuggaacagugauagcuuugauuagcguaucggacaaagacauggguguuaauggccuggugaccuguucucucacgucccacguccccuucaagcuggugucaacuuucaaaaacuauuacagucuuguccuggauagcgccuuggacagggaguccgugucugcguacgaacucguugugaccgcccgggaugggggaagcccgucacugugggcaacagcuaguguauccgucgagguggccgacguuaaugauaacgcuccugccuuugcacaacccgaauauacuguguucgucaaggagaauaacccaccuggcugccacaucuuuaccgugagcgccugggacgcugaugcgcaggagaaugcauuaguaucuuacucacugguggaacgacgcguuggugagagagcccuaaguagcuaugucuccgugcaugcugaaucugggaaaguguacgcccuccagccccuggaccacgaggaacuugaguugcugcaguuccaagucacagcaagggaugccggcguuccaccccucggaucgaacgugaccuuacagguguuuguacuggacgagaaugauaacgcuccugcccugcuugcaccacgggcgggcgggacgggaggugcugucagcgaauuggugccgugguccguuggcguggggcaugucguggccaagguucgcgcaguggacgccgauucaggauauaaugcuuggcucaguuacgagcugcagcccggcacugguggggccagaaucccuuucaggguaggccuauauacaggagaaauuucuaccacucgugcacuggacgagacagacgcuccacggcaccgacuccugguccuugugaaagaucacggcgaacccgccuugaccgcgacggccaccgugcuggucagcuuaguugaguccgggcaagcuccuaaggcaucaagcagagcccucgugggagcuguagguccagacgccgcacugguggaugucaacguguaccuuaucauugcgauaugugccguuucuucccuguuggugcucacacugcuacuguacacugcucucaggugcagugcccugcccaccgagggcgcaugugcuccggggaagccuacacuugucugcagcucugccgugggauccuggucauauagucagcagcgccggccaagaguuuguagcggcgaaggucccccuaaaacugacuugauggcauuuucgcccucccugccagauucuagggaccgcgaggaucaguuacaaaccacagaagagagcuucgccaagccucgacagcccaauccagacuggcgguacucagcuagucuccgugcggggaugcauuccucugugcaccuggaagaggccggcauccuuagagcaggaccgggcgggccugaucagcaguggcccaccgucagcuccgcuacuccagagcccgaagccggagagguaucaccuccagugggcgccgguguuaacagcaacaguuggacguuuaaauaugggcccggaaauccuaagcaaucuggcccgggugaacugccagacaaauucauuauccccggcuccccugcuaucauuagcauaaggcaggagccaacaaacucgcagaucgauaagucagacuuuauuaccuucgggaagaaagaggaaacuaagaaaaagaaaaagaagaaaaagggaaauaaaacccaggagaagaaagaaaagggcaacucuacaaccgauaauagugaccaauga

SEQ ID NO: 60419 - RNA, 2853 nt, Artificial Sequence
  derived and/or modified sequence opt3 from PCDHA6__Homo_sapiens__NP_061732
augguguucacccccgaggacagacugggcaagcagugccuccuucugccuuuguuacugcuagccgcuuggaaagucgggagcggacaacuccacuacuccguuccagaagaggcaaagcaugguacauuugugggcaggaucgcccaggaucuggggcuugaacuggcggaguugguaccgcggcuguuccgcauggcuucuaaagaccgagaagaucugcuggaggugaaccuccagaauggaauuuuauuugucaacucacguauagacagagaggaacuguguggcaggagugccgagugcagcauccaccuugaagugauuguugaucggccccuccagguguuccaugucgacguggagguacgcgauaucaaugacaacccuccacuguuucccguugaggaacaaagagugcuaauuuaugaguccaggcucccugauucugucuucccacuggaaggugcaucggacgccgauguggggucaaauagcauccuuacuuacaagcugaguuccucugaguauuuuggauuggacgugaaaauaaacagcgaugacaauaagcagaucggccuccuguuaaagaaaucccuggaccgggaagaggcucccgcacacaaccucuuccuuacggccaccgauggcgggaagccugagcugacaggaacuguccaguugcuaguuaccgugcuggacguaaaugauaacgcuccaacauuugaacagucagaguacgaagugcgcauuuucgagaaugccgacaacgguaccacugucauccgacucaaugcgagugauagagacgaaggcgcaaacggggccauuagcuauucuuuuaauucccugguggcugccaugguuaucgaucauuucucaauagacaggaacacaggagagauugugauccggggcaaccuugauuuugagcaagaaaaucuguacaaaauuuugaucgacgcaaccgauaagggucacccgcccauggcugggcacuguacgguccucgugcguauccuggacaaaaacgacaauguaccugagauugccuuaacuagccugagucuaccaguucgcgaagaugcgcaguucggaaccgugauagcccucaucucugucaacgaccuggauuccggcgcaaauggccaggugaacugcagccuuacaccccaugucccuuucaaguuggugucgacuuuuaagaauuauuacucucugguucucgacuccgcucuggauagagagucagugagugccuacgaacuuguagucaccgcuagggacgggggaagcccaucccugugggccacagcaucuuugagcguggagguugccgauaugaacgacaaugcucccgcguucgcacagccggaguauaccguguuugucaaagaaaacaauccucccgguugucacauuuucacggugucagcccgggaugcugacgcccaagagaacgcacucguaaguuacucccugguggaacgacgcguuggcgagagagccuuaagcucuuauaucucaguccaugcugagagugggaagguguacgcccugcagccacuagaucacgaagaguuggaacugcuucaguuucaagugagcgcaagggacgcgggagucccucccuugggcuccaauguuacucuccagguguucgugcucgaugagaacgacaaugcuccagcccuguuagcaccccggguaggugggacaggcggagccgucucugaacuggugccucgcucgcuuggcgcugggcagguuguggccaaagucagagcaguggacgcugauagcggauauaacgccugguuguccuacgagcuccagccaccggcgucaagugccagguuucccuuccguguuggucuguauaccggcgagauaucuacuacacgggugcuagacgaagcugauagcccucgacacagacugcucguacuggucaaggaccauggggagccagcacuuaccgccacggcuaccguguuggugucccuggucgaaucaggacaagcccccaaagcaagcucuagggcguccguuggcgccgcugguccugaggccgcauuaguggauguaaacguguaccucauuaucgcuaucugcgccgucaguagccugcuugugcugacauugcuccuguacacugcacuacgcuguucugccccacccaccgaaggggcuugcacagcggacaagccgacucugguuuguuccucagccgugggcaguuggagcuauucgcagcagcggagacagagggucugcuccggagagggcccuccaaaaauggaucucauggcauuuucucccagccugucaccuugucccauuaugauggggaaggcugagaaucaagaccuuaacgaagaucacgacgccaagccacgccagccuaaucccgauuggcgauacagugccuccuugcgggcuggaaugcauucuagcgugcaccuggaggaagcagguaucuuacgugccggcccagggggaccggaccagcaguggccuaccguuuccucagcgacacccgagccagaagcuggcgaggugagucccccugucggugccgggguaaacagcaauucuuggaccuucaaauauggcccaggaaaccccaagcaauccggcccuggggagcucccggauaaauuuauuauaccaggaagccccgcaaucauuucgaucagacaggaaccuacuaauucacagaucgacaagucugacuucauuacguuuggcaaaaaggaggaaacaaagaaaaagaaaaagaaaaagaaggguaacaaaacccaggagaagaaagagaaggggaauaguacuaccgauaacuccgaccaauga

SEQ ID NO: 60420 - RNA, 2457 nt, Artificial Sequence
  derived and/or modified sequence opt3 from PCDHB1__Homo_sapiens__NP_037472
auggccggcaccagaaggaagucacugcagaaccggcaaguggggucccuccuuaucuuccugugcauuucugucggagacgcuacaacuauacgcuacucaguugcagaggaaauggagagugguagcuuuguggccaauguagcgaaagauuugggcuuagaaguggggaagcuggcugcccgaggagcacgucuagucuccgagggcaacaaaaugcacuucagacuccauaggaagacgggugaccuguuugugaaagaaaaacuugaucgggagucucugugugggaaggccgaccccugcguuuugcacuucgaggugguccucguggaaccucugcagucguuucgcgcugagguaagaguuuucgauaucaaugacaacgcaccaguguuucugaauaaagaaccgcucuuaaagauucccgagucaaccccucugggaagcagguucccacuucagagugcccaggauuuggacgucggccugaacggccuacaaaauuauacacucuccgcuaacggguacuuucaucugcacacucgguucuguucucauggacccaaauaugccgagcuugugcugaauaagccuuuggaucgcgaggaacagccagaagugaaccucaccaucacagcggucgacgguggcucacccccuaaauccgggaccgcacacauucacguugugguacuggaugugaaugaccaugucccacaguuuucacgauuaguguacagagcccagguuagugagaacagcccgaauggaucucugguggcuacugucacagccguggaucucgacgaaggcaccaacaaggcaaucacguauucccuugcucaaaaucccgaggccauacugaagacuuuccagaucgacccucagaacggugagguaagguugcgggggccacuagauuuugaagcgauugagaccuacgacaucgauauucaggccacagacggaggcggccugucagcacacagcaaaguucucguggaagucguggaugucaacgacaaucccccugaggugaugguuaguucuguguccagcccacugcccgaagauucgccgccucaaacuguagucgcucuuuucaccauccgugaccgcgauauaagagugggaggaaagguuacaugcuuccugagggaggacuugcccuuugugauuaaaccaaccuucgguaacucuuauucccucgucacggaucggucacuggaccgagaggaagugaguggcuacaauaucacuauuguagccauggacacagggccucccagcuuauccgcugagaccaugaucgaagugcugaucucugauguuaacgacaauccacccauuuuucgcgaggauagcuacauacuaacugucagagaaaacaauagcccugccguguucaucggaaaggugcaugcagaggaccucgaucugggcgagaacgcccagauuacauauagucuuuugccaccgaaaaauggugaccuguccgucuuugcuuacaucagcauaaacucugggaauggcaagcucuaugcgcugaggaccauggauuacgaagcaauucaggacuuccaauuuguugugaaagccacggauggaggcuuccuuucacugaguagccaggugaccguacgggucgugguuuuggacgauaacgacaaucgccccaugauccucuauccucugcagaacgggacauuaccauguaaugaucuggugcccagauccgcugaggccggauaccuagucacuaaggugguugcaguggacggugacucuggccagaacucguggcucagcuaucaucugcuuaaggccaccgauuuggggcuguuuuccguacaaaggcagaacggagaaauccacacacuccgucagauuucagagcgggacccuaugaugcagaaacugaucauuuuaguccaagaucacggccagccagcucugaguacuaccgugucucuuaauauauugcucguggacgguuucagcgagcccuaccugcaguuucaggauccgacaaagcacucccgaaaagucaacccuucaaccaaguaccuaguuaucagccuggugauucucucuuuccuguuucuuuuguccguaaucgugaucuucauuauacaugucuaucaaaagaucaaguacagagaaaaguucacuauucaggagcacuuuuaugacgauugcaauuucaguaacaaucuggugcaggggcagggcaacgggagcuuaucuaggccaugucccuacgaaaugugcuccgccacgggcacagggaauagcgaguuucgcuuccucaaacgguuuaugccuaacuuccccuuuccacaugcaaccggagaaaucaagauggaggcggguaguagccugccucccaauucggacagaaacaaaucccaaaggcuugagggccacgaucagguuucugacgauuauauguga

SEQ ID NO: 60421 - RNA, 2397 nt, Artificial Sequence
  derived and/or modified sequence opt3 from PCDHB2__Homo_sapiens__NP_061759
auggaagccggcgaagggaaggagagagugcccaaacagaggcaaguccugaucuucuuuguucuccuuggaauugcucaggcaagcugccagccucggcacuacuccguggccgaagagaccgaaucugguucauucguagcgaaccuguugaaggacuuaggccuggagauaggggagcuagcugugcgcggagcccgagucgugaguaaaggcaagaaaaugcaucuccaguuugaucgucaaacaggugaccugcuucugaaugaaaaguuggauagagaggaacucugugggccaacugagccgugcguucugcccuuccaggugcugcucgagaacccuuuacaguuuuuccaggcagaacugaggauccgggacgucaaugaucacagcccaguguuucuugacaaggagauuuugcugaaaauccccgaauccauuacgccuggaaccacauuccuaaucgagcgcgcccaagaucucgacguaggcacuaacucucugcagaauuauaccauaucgccaaacuuucauuuccaccuuaaucugcaggauucauuggacggcaucauucucccccagcugguuuuaaacagagcucuggauagggaagaacaaccugagauccggcucacacuuaccgcacuggacgggggaagcccaccgcgcagugguacugccuuggugcgaauugaagucguggauaucaaugacaacgugcccgaguuugcuaagcuacuguacgaaguccagauaccugaggacuccccaguuggcucucagguggccauuguaagcgcgagagaucucgacaucgggacaaauggagaaauuuccuaugcauucucacaagccagugaggauaucaggaaaaccuuucggcugagcgcuaagucuggcgagcuucuguugcgucagaaacucgacuucgaauccauccagacguacacugugaacauucaggccaccgauggugggggacugucaggcacaugugucguguucguucaagugauggacuuaaaugauaaucccccugagcugacuaugagcacccuaauaaaccagaucccagaaaaccuccaggacacacugauugcagucuuuagugugucugaucccgacuccggcgauaacgggcgcaugguaugcagcauccaggacgaccuuccguucuuuuugaagccuucgguugagaauuucuauacccuggugauaucuacggcucucgauagagaaacuagguccgaguacaacauuacaaucaccgucacugacuuuggaacaccccggcugaagaccgagcauaauaucacggugcuugucucagaugugaacgacaaugccccagcguucacccaaacaaguuauacucuguuuguucgagaaaacaauagcccugccuugcacauugguuccgugucugcaaccgaucgcgacagcggcacaaacgcucagguaacuuacucacuccugcccccacaggauccccacuuaccucuggccagucuagucuccaucaaugcugacaacgggcaucucuucgcccugcagagccuugauuacgaggcauugcaagccuuugaguucagagugggagcugcggacaggggcucuccagcacugucaagugaggcccucguucgggugcuggucuuagaugcuaaugacaacagcccguuugugcuguauccccuucagaaugguuccgccccuuguaccgaguugguaccacgcgcagccgaacccggguaccucgugacaaaaguugucgcuguggauggcgacucuggacagaacgccuggcugucguaucagcuacugaaggcaaccgagccuggccucuucggggugugggcgcacaauggagaagucagaacugcuaggcugcuucgugagcgggacgccgcaaaacaacgauugguugugcuggugaaggauaacggugaaccacccagaagcgccacggcuacauuacauguacuccuggucgacggcuuuucccagccguaccuucuguugccugaggccgcaccagcucaggcccaagcggaucuccugaccguguaucuaguuguggcccuggcuucagucaguucucucuuccuguucagcgugcuuuuguuuguugcagugaggcugugccgccgguccagagccgcuucaguagggagguguagcguccccgagggaccuuuccccggccagaugguggacgugucugguacugggaccuuaucccagaguuaccaguaugaagucugccucacaggcggaagcggcaccaacgaguuuaaauuccugaagccaauuauaccuaauuuuguugcccaaggggcagaacgcgugucugaggcgaaccccuccuuccgaaaaucauuugaguucacuuga

SEQ ID NO: 60422 - RNA, 2391 nt, Artificial Sequence
  derived and/or modified sequence opt3 from PCDHB3__Homo_sapiens__NP_061760
auggaggccggcggggaaagguuccugaggcagcggcaagugcuccuucuguuugucuucuugggagguagcuuagcuggcuccgagucucgccgauacucaguugcagaagagaaggaaaaaggguuucugaucgccaaccuagcgaaggaccucggacugcguguggaggagcuugcugccagaggcgcacagguagugaguaaagguaauaagcagcacuuccagcugagccaucaaaccggggauuugcuccugaacgaaaaacuggacagggaggaacucugcggacccacagagccuuguauuuuacacuuucagauacugcuucagaauccauugcaguucgucacuaacgagcugcggaucauugaugugaaugaccauuccccgguuuucuucgaaaacgagaugcaccuaaagauccucgaaucuacgcugcccggcaccgugauuccucuuggcaaugccgaggaucuggacgucgggcgcaacucguugcaaaauuauacaaucacuccaaacucacauuuucacgugcucaccagaagcaggcgggauggacgcaaguaccccgaacugguauuagacaaagcucuggaucgagaggagcagccugaacucagucuuacacugaccgcauuggacgguggcuccccacccagaucugggacugcccagauaaauauccagguucuagauauuaacgacaaugcuccugaguucgcccaaccacuguaugaaguggcgguccucgagaacacaccggugaauagcgugaucgucaccguuuccgcaucagaucuggacacgggaaguuuuggcacuauuagcuacgccuucuuucacgcuucugaagagaucaggaagaccuuccagcuuaaccccauaacaggugacaugcagcuggugaaauauuugaacuucgaggccauuaauuccuacgaaguagauaucgaggcaaaggacgggggaggccucucaggcaaaagcacugugauuguccaagugguugaugugaacgacaauccuccagaacugaccuuaaguucugucaacucccccaucccugagaauagcggggaaacagugcuggcuguauuuucgguuucugaucuagacuccggagauaacggucgggugaugugcucaaucgagaauaaccucccauucuuucugaagcccagugucgagaauuucuauacccuugugagcgaaggcgccuuggaccgugagacgcgcuccgaauacaacauuacuauaacaaucaccgaucuggggacuccgagacucaagacaaaauacaauauuaccguccuggugucugacguuaacgauaaugcgccugccuuuacgcagaucagcuauacccuuuucgugagggagaacaauucacccgcacugcauauaggaaguguauccgcuacagaccgggacagcggcacuaacgcccaggucaccuacucuuugcucccaccucaggauccccaucugccauuaucaagucuggugagcauuaacgcugacaauggucaccuauuugcccuccgaucccuggauuaugaggcacuucaagccuucgaauuucgcguuggggcuacagacagaggcucucccgcguugucgagcgaggcacuggugaggguccucgugcuggaugccaacgacaauuccccuuucguauuauacccacugcagaacggaucagcuccguguacugaacuugugccccgggccgcagagccuggcuauuugguuaccaaggucguggccguggauggggacaguggacagaaugcuuggcucucuuaccagcugcuaaaagccacagaaccaggucuguuuggcgucugggcacacaacggggagguucgcaccgcgagacuccugagcgagagggaugcugccaagcaccgucuugugguguugguaaaagacaauggagaacccccucgguccgcaacugccacgcugcaugucuuacucguggauggcuucucacaaccauaucugccccuuccggaggcugccccugcacaggcucaggccgaccuguugacaguuuaccucguggucgcgcuggccagcgugucuucccuauuucuguucaguguucuccuguucguggcuguacgacuuugcagaaggagccgcgcagccucugucggucgguguuccgugccagaagggcccuuuccuggccagaugguggaugucucaggaaccggcacuuugagucaaagcuaccaguaugagguuugccugaccgggggaucggguacaaacgaauuuaaguuuuuaaaacccaucaucccaaauuucguggcucagggcgccgagagaguauccgaggcaaacccuucuuuuagaaagagcuucgaauuuucauga

SEQ ID NO: 60423 - RNA, 2406 nt, Artificial Sequence
  derived and/or modified sequence opt3 from PCDHB8__Homo_sapiens__NP_061993
auggaggccagcggcaagcugaucugcagacagaggcaagugcuguucuccuuucuucuguugggguuaucucuggcuggagcagccgaaccccggucauacagugucguugaggaaaccgaggguagcuccuucgugacaaaccuagcgaaagaccucggccuggaacagcgcgaguuuucucgacgugggguaagaguggucucgaggggaaauaagcuccaucugcaguugaaccaggagacugcugaucuccugcugaaugaaaaacucgaccgggaggauuuauguggccacacggaaccuugcgugcugcgcuuccaaguucuuuuggagucaccauuugaguucuuucaggccgaacuccaggugauugacauaaacgaucacagcccggucuuccuagacaagcagaugcucgugaaaguaagugaguccucucccccugguaccgcauuuccacugaagaaugccgaagaucuugacaucgggcaaaacaauauugagaacuauaucauuagccccaauuccuacuucagaguucugacaaggaagcggucagauggacgcaaauauccugaauuggugcucgacaaggcucuggaucgagaggaggaagcagaguuaagacugacucucaccgcccuugacggcggcaguccacccaggagcgggacagcucaggucuacaucgaagugguggaugucaacgacaaugccccugaguuugaacagccauucuaucggguucagauaucugaggacuccccgaucucauuucuggugguaaaagugagcgcgaccgaugucgacacuggagugaacggugagauuaguuacucuuuguuccaagcauccgaugaaaucagcaagacauucaaaguugacuuucuaaccggcgagauucgucugaagaagcagcucgauuucgaaaaauuucagucguaugaggugaauaucgaagcccgcgacgcugggggauucucuggcaaguguacgguccugauacaagugauugauguaaacgaccaugcccccgagguuacuauguccgcauuuaccucaccuaucccagagaaugcucccgaaacaguggucgcccuuuucagugugagcgaucuggacuccggugagaacgggaaaauuucuugcagcauccaggaagauuugccuuuucuccugaagucaagugucggaaacuucuacacuuuacugaccgagacaccacuagacagagaguccagggcggaauacaaugugaccaucacgguuacugaccucggcacaccccggcugaccacucaccuuaacaugacaguguugguaagcgaugucaaugacaacgccccggcauuuacccagacgucuuauacccuguucgugcgagagaauaacaguccugcucuccauauuggcucaguuagcgccacagaucgcgacuccgggacuaaugcucaggugaccuacucucugcuucccccacaagauccucaucugcccuuggccucgcucgucagcauaaacacagacaauggacaccuguuugcauuaagaucccuggauuaugaagcccuacaggcuuucgaguuuagggugggugcgucagaccggggcaguccagcacucucuagcgaagcccugguacgcgugcuuguuuuggaugcuaacgacaauucccccuucguccuguacccucuccagaacgggucagccccauguacugagcuggugccgagagcagccgagcccggauauuuagugaccaaagucguugcuguggauggcgacagcggucagaaugccuggcugucuuaccaacuuuugaaggcaacagaaccugggcuuuucggcgugugggcgcacaacggagagguaaggaccgcucgucugcuauccgaacgggaugccgcaaaacagcgacuggucgugcucguuaaggacaauggcgagccacccugcagugccacugcuacgcugcacgugcuuuuggucgacggguuuagccagccuuaucugccauuacccgaagccgcaccggcucagggacaagccgauucucucacaguguaccugguuguggcgcuugccuccguaucaagucuguucuuguuuagcguccuccuguucguggcugugcuacuguguagaaggucgcgcgcagccuccgucggucggugcucuguuccugagggcccauuucccgggcaucucguggacguaagaggaaccggcagccugucacagaacuaccaguaugaggugugucuugcuggugggaguggcacuaacgaguuccaguugcugaagccugucuuacccaauauccaaggacacuccuuuggcccagaaauggaacagaacucuaauuucaggaacggguuuggauucagccuccagcugaaauga

SEQ ID NO: 60424 - RNA, 2808 nt, Artificial Sequence
  derived and/or modified sequence opt3 from PCDHGA11__Homo_sapiens__NP_061737
auggccaacagacugcagaggggcgaccggagccgccuccuucuguuguuaugcaucuuccuggggacccuacgaggauuucgugcuagacaaauuagguacuccgugcccgaggaaacagagaaggguucuuucgucggcaauauaucaaaagaucucgggcuggaaccucgggagcuugcaaagcgcggaguuagaaucgugaguaggggcaaaacucagcuguuugccguaaacccacggagcgguuccuugauuacggcggggcgcaucgaccgagaagaguugugugagaccgugucuucgugcuuccugaauauggaacugcucgucgaggauacauuaaagauuuauggaguggaaguugagaucauagacaucaacgauaaugcuccgucauuucaggaggacgaaguggagauuaaagucagcgaacacgccauccccggcgcaagauucgcccugccuaacgcuagggauccagacgugggcguaaauagucuucaguccuaccaauugucucccaacaauuauuuuagccugcagcuacgggggcguacugauggagcaaagaacccugagcucguucuggaagguucccuugaccgcgagaaggaggccgcucaucuguugcuccugaccgccuuagauggcggggacccaauuagaaaaggagcggugcccaucagggucguggugcuggaugucaaugaccacauaccuauguucacacagucaguuuaccgggugaguguaccagaaaacauuagcucuggcacccgagugcucauggucaaugcaacugacccggaugaggguaucaacggggaagugauguauuccuuucgcaauauggagucaaaggccagcgaaauuuuccagcuugacagucaaacaggagagguucaggugagaggcucucuggauuuugagaaauacagguucuaugaaauggagauccagggccaggacgggggagguuuguuuaccacgacuaccaugcuaaucacagucguggauguaaacgacaacgcucccgaaauuacuauaaccuccagcaucaauucgauucuggagaacucuccuccaggcacaguuaucgcccuccugaaugugcaagaucaggacuccggggaaaacggacaggucucauguuucauacccaaucaucuuccuuucaagcuggagaaaaccuacggcaacuacuauaaguugauuacgagucgggugcucgaucgcgagcugguccaaagcuacaauaucacuuuaacagcaaccgaccaggguuccccaccccugucugcugaaacucacguguggcuaaacguugccgaugacaaugacaacccgccuguguuuccccauagcucauauagugcguacaucccagagaauaacccuagaggggccuccauuuucagcguaacagcacucgaucccgacucuaagcagaaugcucuggucaccuauucacuuacggaugacaccgugcagggcguuccauugaguagcuacguguccaucaacucuaauacaggaguccuguaugcccuccaaucguuugauuacgaacaguucagggaccuggagcuucgugugauugcucgggauagcggcgaucccccucuguccucaaacguaaguuugucucucuuugugcuggaccagaacgacaaugccccagagauauuauacccggcacugcccacugaugggagcaccggaguugaacuagccccucgauccgcugagccagguuaucucgucacaaaagugguggcggucgacaaggauucaggccagaacgcauggcugagcuacagacuuuugaaagccucugaacccgggcuguucgcuguuggagagcacacuggcgaagugaggaccgcccgcgcacuccuggaccgggacgccuuaaagcaaucccuggugguagcuguccaggaucacggucagccuccacuuagugccacagugaccuugacuguugcaguggcggacagcauccccgagguccucgcugaucuggggucucuagagucccuggccaauucagaaacgagugaccucagccuguaucuugugguugcaguggccgcuguaucgugcauuuuucucgucuucgugaucgugcuguuagcccucagacuguggagguggcauaaaucccgccuucugcaggcaucugagggcggauuggcuggcaugccgacaagccacuuugucgggguugauggagugcaagccuuccuccagaccuacucacaugaaguaagucugaucgcggacucccagaagucucaccuaauuuuuccucagccaaacuauggugauacucugauaagccaagaguccugugaaaaaucagagccccuccugaucgccgaggacagcgcuauuauccuuggcaagugcgauccuaccaguaaucagcaggcacccccaaacacagacuggcgauucucucaagcccagcggccugggaccuccggaagccagaauggcgaugacacugguacauggcccaacaaucaguuugauacggaaauguugcaagcuaugauucuggccucggcaucagaggcggccgacgggucuaguaccuuaggcggaggcgcugggacuaugggacucuccgcccguuacggcccacaguucacacugcagcacgugccggacuauagacagaacgucuacaucccugguagcaaugcaacccuuacaaacgcugccgggaagagggauggaaaagcacccgccggcgguaauggcaacaagaaaaagucugggaaaaaggaaaagaaauga

SEQ ID NO: 60425 - RNA, 2799 nt, Artificial Sequence
  derived and/or modified sequence opt3 from PCDHGA3__Homo_sapiens__NP_061739
augaccaacugccugagcuucagaaauggcagggggcucgcccuucugugugcuuuguuaggaacacugugcgagacugguuccggccagauccgguacucugugucagaagaacuagacaaggggaguuuugucggaaacauugcaaaugaucucggccuggaaccccgcgagcuugccgaacgagguguucguauagugagcagagggaggacgcaacuguucuccuugaacccucagucuggaucgcucguaaccgcggagcggaucgaccgcgaggaacugugugcucagauuccacugugccucgugaaaaucaauauuuuagucgaggauaagcugaaaaucuuugaaguggagauagagaucaaggacauuaacgauaaugccccgaacuuccccacagaggagcuugaaaucaaaauuggcgaguugacuguuccuggcaccagauuuccaaucaagacagcauucgaccccgauguggggauaaauucacugcagaacuauaagcuaagcccuaaugacuacuuuagucucgccgucaacuccgugucugaaggagcuaaauauccagagcugguacuugagagggcacuggaucgggaaaagaaagagauucaccaauugguucucguggccagcgacgguggcgaucccguccauuccgggaaucugcacauccaggugauuguguuagacgcuaacgauaauccuccaauguucacccagccggaauaccgcgucucaguuugggagaacgugcccguaggaacucgacugcucacagugaacgccaccgacccugacgaaggcuuuaaugcgcaggucaguuauauccuugauaagaugccagguaaaaucgcagagauuuuccaucugaacagcgugucuggggagguuuccauauugaagucacuagacuacgaagaugccauguuuuaugagaucaagauugaagcucaagacggacccggccugcucagcagagccaaaauccuggugacgguccuugaugugaaugacaacgcaccugagauaacuauuaccagucugacaucuuccguaccagaagagggcacuguugggagggagaucgcuuugaucgaugugcacgaccgggauagcggacagaauggucaggucgaaguguucguccucggcaaccugcccuuuaaguuagagaaaucgauugaccaguacuaccgucuggugaccgccacaucucuagaucgcgaacaaaucuccgaguauaauauuucacucagagcgagugacgggggaagcccgccucuguccaccgagacgcauauaacucuucacguuaucgacauuaacgauaaucccccaacauucccucacuugucuuacagcgccuauauccccgaaaacaauccaaggggcgcaucaaucuucagugugaccgcucaggaccccgauuccaacaauaacgcccggauuacuuacgcucugacagaggacacccuccagggugccccucugagcucuuuuguaucaauaaauaguaacacggggguccuuuaugcacugcgaucuuucgauuacgaacaauuucgcgacuugaagcuccuggugaccgccuccgauucuggcaacccaccguuaucgagcaauguuucccugaaccuauucgugcucgaccagaaugauaacgcucccgagauccuguauccugcgcuuccaacagacggaucaacuggcgucgaauuggcacccagaagugccgagccuggguaccuggugaccaaaguaguggcuguugauagggacucuggacagaaugccuggcucagcuaccggcuguuaaaggcauccgagccaggucuguuuucagucggccuucauacaggggaagugcgcacugccagagcuuugcucgauagggacgcccugaaacagagccuaguggucgcaguucaagaccacggacagcccccgcugucugcgaccgugacacucaccguggcuguagccgaucguauuccugacauccuggcagaucuuggcuccuuggagccaagugccaagcccaacgacagcgaucugacuuuauaucucgucguggcuguugccgcagugucuugugucuuccuggcuuuugugauuguucuucuggccuugcggcuccgaagauggcauaaguccaggcugcuacaggcgucaggugggggccuggccaguacgccuggaagccacuucgugggcgcugacgggguacgcgcauuucuccagacauacucgcacgaagucucccugaccgccgauucucggaaaagccaucuuaucuucccccaaccaaauuaugcugacacuuugauaucacaggagaguugcgaaaaguccgagccucuguuaaucacccaggaucuccuggagaugaaaggagacucuaaccuucugcagcaagcacccccaaauacagauuggagauuuagccaggcccagaggccggguaccuccggcucacagaacggggacgauacuggaacauggccuaauaaccaauucgacacggaaaugcuacaggcgaugauucucgccagcgcuagugaggccgcagacggcagcuccacccugggugggggcgcuggaacuaugggcuugagcgcccgcuacgggccccaguuuacacugcaacacgugccagauuaucgacagaauguguacauccccggaucgaacgcaaccuuaacaaaugccgcuggcaagcgggacgguaaagcgccugccgggggaaacggcaacaagaagaaaucagguaagaaagaaaagaaauga

SEQ ID NO: 60426 - RNA, 2772 nt, Artificial Sequence
  derived and/or modified sequence opt3 from PCDHGB4__Homo_sapiens__NP_003727
augggcagcggggccggagagcuggguagagcugaaaggcuccccgugcuuuuccuguuuuuguuaucccuguucugcccugcacuaugugagcagauccgguaccgcauuccagaagagaugccgaagggcucugucguugggaaccucgccaccgaccugggauuuucagugcaagaacuucccacacgaaaacugcguguaaguagcgagaagccuuauuucacuguguccgcggagucuggcgaauugcucgucucgucaagacuggauagggaggaaauaugcgguaaaaagccagcuugugcccuggaguuugaggcaguggccgaaaauccccucaacuucuaccacguuaauguggagaucgaagacauuaacgaucauacgccuaaauuuacccagaauagcuucgaguuacagaucagugaauccgcucagccagggacacgguuuauucugggaucugcacacgacgccgauaucggcagcaacacucuucaaaauuaucaguugucccccucagaccauuucagucugauaaacaaggaaaagagcgauggcucuaaauacccugagaugguccuaaagaccccacucgaccgcgaaaaacagaaguccuaucaccugacacuuaccgcucuggauuuuggggccccgcccuugucaagcacugcgcagauccaugugcucguaacagacgcaaaugauaacgccccuguuuucagucaagacguguacagagucucucuguccgagaauguguauccaggaaccacgguguuacaggucacugcuaccgaucaggacgaagguguuaacgccgagauuacauuuagcuucucggaagcaucucagaucacucaauucgaccucaauuccaacaccggcgagauuacagugcugaauacccuugauuuugaggaaguaaaagaguacucaaucgugcuggaagcuagggacgggggaggcaugauagcccagugcacggucgagguggaaguuauugaugagaacgacaacgcgcccgaggugaucuuccagaguuugccuaaucuaauuauggaagaugccgagcuggguacucacaucgcacuccugaagguccgggacaaggauagccgccacaacggggaagugacauguaaacuugagggagacguaccauuuaagauccugaccuccucucgaaauacuuacaaauugguuacagaugcugugcucgacagagagcaaaaccccgaauauaauauuaccgucacggccaccgauaggggcaagccgccucugagcucaaguuccagcauaacauuacauaucggcgacgugaacgacaaugcucccgucuucucucagucaaguuacauugugcacguugccgagaacaauccaccuggggcaagcaucucccaggugcgggccucugaucccgaccugggaccaaacggucagguaucguauugcauaauggcuagcgaucuagaacaacgugagcucuccucauacgucaguauuucugcggaaagcggcgugguuuuugcacagcgcgccuucgaccaugagcagcugagagcuuuugagcuuacuuugcaggccagggaucaagggucccccgcacugucagccaaugugagccuccggguccugguggacgaucgaaacgacaaugcuccucgcguacuuuauccagcccugggaccggauggcucugcauuguucgacauggugccccacgcggcugaaccugguuaccucguuaccaaagucguggccguggaugcagacuccgggcacaacgccuggcugaguuaucaugucuuacaggcuagcgagccaggccuguuuucucuaggacucagaacaggcgaaguuaggacugcccgggcacugggggaucgcgacgcugugagacagaggcuuuugguggccguacgugacggaggucagcccccucuguccgcgaccgccacacuccaccuggucuucgcugauucauuacaagaggugcugccagacaucaccgaucggcccgacccgagugaucuucaggcagaauugcaguuuuaccucguuguggcccuggcucuaaucagcguccuguuccucguggccaugauucuggcaaucgcgcuucgauugagaaggucguccucuccugccagcuggucauguuuucagccaggccugugcguuaagagugaguccgugguacccccuaauuacucugaggggacuuuacccuauagcuacaaccucugugucgcucauacgggaaaaacagaguucaacuuccugaagugcuccgagcaacuuucaagcggccaggacauucuguguggugauaguucuggggccuuguuuccacucugcaauuccagcgaacugaccucgcaccagcaagcaccucccaacacugacuggcgcuucucacaggcucagcggccaggcaccucuggaagucagaauggcgaugacacagggaccuggccgaacaaucaauuugauacugagaugcuacaggccaugauacuggcauccgccagcgaagcugcggacggaucuagcacacucgguggcggggccggaacgaugggccuguccgcaagauaugguccucaguucacccuucagcaugugcccgauuacaggcaaaacguguauaucccagggucaaaugcuacuuugacaaacgccgccggcaagcgcgacggaaaagcucccgcaggcgggaauggaaacaagaaaaagaguggcaaaaaggagaagaaauga

SEQ ID NO: 60427 - RNA, 2793 nt, Artificial Sequence
  derived and/or modified sequence opt3 from PCDHGB6__Homo_sapiens__NP_061749
augggcgggagcugcgcccagagaaggcgggcuggaccccgccaagugcuguucccucuccuucugccauuguuuuacccgaccuuauccgagcccauccgauauucuauuccugaggaacuggcaaaggguucagucguuggcaaccuagccaaagaccucgggcugagugugcuugauguaagcgcgcguaagcugagaguguccgcugaaaaauugcacuucucugucgacgccgagucgggagaucuccuggugaagaauaggauagaccgggaacagaucuguaaagagcgcagaaggugcgagcugcagcucgaagcaguuguggagaacccauuaaauauuuuucaugucaucgugguaauugaagauguuaacgaccacgcuccccaguucgauaagaaggagauccaucuggagauauuugaaucagccagcgcaggcacacggcuuaguuuggacccugccacugauccagacaucaauauuaacuccaucaaagauuacaagauuaauucuaaccccuauuucagccugauggugcgcgucaauuccgacggugggaaauacccugagcuaucacucgaaaagcugcuugaucgagaggaacaaagaagucacagccugaucuugacggcucucgacggaggcgacccaccgaggucugccaccgcgcauauagagauuuccgugaaagauacaaacgacaaucccccuguguuuucacgggaugaguaucguaucagccugagugaaaacuuaccacccggcucuccuguccugcagguuacugcaaccgaccaggaugagggggugaaugccgaaauuaacuacuauuuccgcuccacagcucagagcaccaagcacauguuuucgcucgacgagaagacuggaaugaucaaaaauaaccaaucuuucgauuuugaagacguagagagauacacaauggagguggaagccaaggaugguggcgggcuuuccacccaguguaaagucaucauugagauacuggacgaaaacgauaauucaccagagaucauuaucacgaguuugagcgaccagauacuagaaaacucucccccgggaauggugguugcacuguucaagacuagggaccucgauuuuggcgguaauggggaggugcggugcaacauugagaccgacaucccuuucaaaaucuacuccagcucaaauaacuauuacaagcuggucacagauggagcucuugaccgagaacagacucccgaguauaaugugaccauuguagccacagaucgcggcaaaccaccucugaguuccagcagaucuaucaccuuguacguugcggacauuaacgauaaugcccccguguucgaccaaacgucauaugucgugcacgucgcagaaaacaauccacccggcgcuaguauagcccaggugagcgcuuccgauccugaccucgggcugaacggacauaucucuuacucgauuguugccagcgauuuagagccacuggcaguguccucauauguaagugucucugcccagagcggugugguuuuugcucaaagggcguucgaccacgagcagcuacgggcauuugcccucacucugcaggcucgcgaucauggcuccccgacacuuucagccaaugugagcuugagaguccuggugggggacaggaacgacaaugcaccccguguacucuacccugcccugggaccagauggcucugcuuucuuugacauggugccccgguccgccgaaccugguuaccuuguuaccaaggucguggcaguggaugcggacagugggcacaacgcuuggcugagcuaucacgucuugcaggccucugagccaggccucuucucccugggauuacgaacuggcgaaguuagaacagcaagggcccugggggaucgcgacgcugcccggcaaagacuacucguggcagugagggauggaggucagcccccgcugucagcuaccgccacgcuucauuugguauuugcggacaaccugcaggagauccucccugaucugagugaccgcccagucuuaagcgauccccaggccgaacugcaauucuaccuugugguugcuuuggcacucaucucggugcuguuucuacuggccgucauucucgcuauagcccugcgacuucggcguuccuugucuccugcaaccugggacuguuuccaccccggccugugcguuaagagcgggccaguggugccucccaauuauucagagggaacauuaccauacaguuauaaccucuguaucgcgcauacuggcaccaaagaguuuaauuuccugaagugcuccguaccgcuucacucuaacgaagauauggucuguagcguguccccuggugcccugauucccccacaugggggcgaggacuugacaucacaccccgaaacucucaccagccaggcuccuccaaauacagacuggagauuuagucaggcccagaggcccggaaccucuggcucccaaaacggggaugacacuggaacguggccuaauaaccaguucgauacagagaugcugcaggcaaugauccuagcuagcgccucggaagcagccgacgguucaucuacccugggcgggggagcuggcacuaugggucucagugcgcgcuacgggccgcaguucacccugcaacacgugccagauuaucggcagaaugucuacauucccggcuccaacgccacacuuaccaaugcagcuggaaaaagagacggcaaggccccugccgggggaaacggcaauaaaaagaaaagcgguaagaaggagaaaaaguga

SEQ ID NO: 60428 - RNA, 2805 nt, Artificial Sequence
  derived and/or modified sequence opt3 from PCDHGC3__Homo_sapiens__NP_002579
auggugcccgaggccuggagaagcggccuggucuccaccgggaggguugugggaguacuccuucuguugggugcuuuaaacaaggcaucuacagugauccacuacgaaauuccugaggaacgggagaaaggcuucgccgucgggaaugugguugcgaaccugggacuagaccucggcucacugagugcucgccgauuucguguggucagcggugccuccagaagguucuuugaagugaaucgggagacuggggagauguucguaaacgaucgccuugacagagaggaacugugcggaacguugccaucuuguaccguuacacucgaacugguggucgagaauccgcuggagcucuuuucgguggaaguggucauacaggauaucaacgacaauaaccccgcauucccuacucaagagaugaaguuagaaauuucagaggccguugcuccaggcaccagguuuccccuggaaagcgcacaugauccugacgugggcaguaauucccuucagacauaugaguugucucggaacgaguacuucgcccugcgcguacagacccgagaagauagcacuaaauaugcugagcuagugcucgaaagagcccuggacagggagcgggaaccaucccuucagcuggucuugacagcgcucgaugggggaacccccgcacugucagccaguuuaccuauccacauuaaggugcuggacgcuaaugauaacgccccaguuuuuaaucaaagccucuaccgugcacgcgugcuugaggacgcuccgucugguacgagagucgugcagguacuggccacugauuuggacgagggccccaacggggaaaucauauauuccuucggaucacauaauagggcgggcguucggcagcuauuugcccuggaccucgugaccgguaugcugacaaucaaagggcgacuugauuucgaggacacuaagcugcacgaaauuuacauccaggcaaaggauaaaggagcuaacccugagggcgcccauugcaaggucuugguggaagucguggacguuaacgauaaugcuccagagauuaccgugacaagcguauauagucccgucccugaggacgccccacucggcaccgugaucgcacuguuaucuguuacggaucuggacgccggggaaaacggucuagugacuugugagguucccccgggacucccuuuuucccugacaagcucgcuuaaaaauuacuucaccuugaagacuucugcugaucuggaccgcgaaacagugcccgaguacaaccucuccauaaccgcgagagaugcaggcacgccaucacugagugcccuuaccauuguaagggugcaaguuagcgacaucaaugacaacccuccccaguccucucagagcucauaugaugucuacauugaggaaaauaaccugccaggggcucccaucuugaaucucagugugugggacccugaugccccacagaacgcacggcuguccuucuuuuuacuggagcaaggagccgaaacaggccuagugggucgcuauuucacuaucaauagagacaacgggauugucagcucucucguuccgcuggauuacgaggacaggcgugaauuugagcuuaccgcucacauaucagauggcggaacacccguguuggccacuaauaucagugugaacauuuucguaaccgaccggaaugauaacgcaccucagguccuguauccacgacccggcgggagcuccguggagaugcucccuagaggaacaucugcgggucaccugguuucgaggguggucggcugggacgcugaugccgggcauaacgcaugguuaagcuacucccugcuuggaucaccaaaucagaguuuguuugccaucggccuccacaccggucaaauaucuacugcucgccccgugcaggacacggauagcccgcggcagacacugaccguucuaauuaaagacaacggggaaccuucccugucaacuaccgccacacucaccgugagcguaacugaggacucuccagaagcaagagcugaguuccccuccggcagugccccuagggaacagaagaagaaucugacauuuuaucuuuugcugagcuuaauccucgucucugugggauucguggucacgguuuuuggcgugaucauuuucaaaguauacaaguggaaacaaucccgcgaucuguaccgagcgcccgugucaagucuuuaucggaccccagggccuagccugcaugccgacgcuguccguggagguuugaugucgccccaccucuaccaccagguguaucugacuacagauuccagaaggucugacccacuacugaagaaaccgggcgcagccagcccucucgcuucacgccagaacacccugcggaguugcgaucccgucuuuuacagacaggugcuuggggccgaguccgcaccacccggacaacaggcgccuccaaauacagacuggagguucucucaggcccagcgacccggcacuagcgguucccaaaacggggaugacaccggcacguggccuaauaaccaguuugauaccgagauguugcaggcuaugauccuggccucagcaagcgaagcugccgacggaaguucuacauuaggcgggggagcaggcacuaugggucucuccgcccgcuaugggccgcaguucacccugcaacaugucccagauuaccggcagaauguguauauucccggaagcaacgcuacacuuacuaaugcggccggcaagagagacgguaaagcuccugcaggcgggaacggaaauaagaagaaaucgggcaagaaagagaagaaauga

SEQ ID NO: 60429 - RNA, 1299 nt, Artificial Sequence
  derived and/or modified sequence opt3 from PCED1B__Homo_sapiens__NP_001268358
augauccugcucagagccagcgaggugaggcagcuucugcacaacaaguucgucguuauuuugggcgacuccgugcaucgggcuguauacaaagauuuagugcugcuacuccaaaaggaccgccugcuuacccccgggcagcugcgagcacguggagaauugaauuuugagcaggaugaacucgucgacgguggccagagagggcacaugcauaacggacugaauuauagggaggugcgggaguuccgcucugaucaccaucugguuagauuuuacuuccucacaaggguguauucagacuacuuacaaacuauacugaaagaacuucagaguggcgagcacgccccugauuuggucaucaugaacagcugccugugggacauuucccgguaugguccaaauucuuggcgcucguaccuagaaaaccucgagaaucuguuucagugucuuggacaggugcugccggaaucaugcuugcucguauggaacacggcgaugcccguuggggaggaggugaccggcggcuuccugccuccaaaguuacgaagacaaaaagcuacauuucugaagaaugaagucgugaaggccaacuuccacagcgcaacugaggccaggaaacauaauuuugaugugcucgaccuucacuuccauuuucggcacgcucgugaaaaccugcacugggaugggguccauuggaauggacgcguucacagauguuugagucagcuacugcucgcacauguggccgacgcuugggguguagagcugccccacaggcauccugugggcgaauggaucaagaaaaagaaaccagggccccgggucgagggaccuccacaggccaaccgaaaucacccggcgcuuccccuguccccuccauugcccucuccuaccuaucgcccacuccugggcuucccuccgcagagauuaccucugcuaccccuccugagcccacaaccucccccacccauucuucaccaucaggguaugccuagguuuccacaggggccgcccgaugcaugcuucuccucagaccacacauuccaaagugaccaguuuuacugucauagcgaugugccuucuuccgcccacgcuggauucuuuguugaggacaacuucauggugggcccacaguugcccaugcccuuuuucccaaccccucgguaccagcgcccggccccugucgugcacagaggcuuugggagguaucguccacggggacccuacacuccuuggggucaacgacccagaccaucaaagaggcgcgcacccgcuaaccccgaaccacggccgcaguga

SEQ ID NO: 60430 - RNA, 4668 nt, Artificial Sequence
  derived and/or modified sequence opt3 from PCF11__Homo_sapiens__NP_056969
augagcgagcagacccccgccgaagcuggcgcagccggggcgagagaggacgcuugcagggauuaccaauccucucuggaagaccucacauucaacucaaagccucacaucaauaugcuuacuauucuggccgaggaaaacuugccauuugcaaaagagauagugaguuuaaucgaggcccagacggcuaaggcaccgagcuccgaaaaacugcccgucauguaucuaauggauucuauuguuaagaaugugggacgggaguaccucaccgccuucacaaagaaccugguagcuacuuuuaucuguguguucgaaaaggucgacgagaauacccgcaagucgcuuuuuaaacugcgaucaacaugggaugagauuuucccuuugaagaaacucuaugcccuggacgugcguguuaacagccuggauccagcguggcccaucaagccucucccacccaaugugaacaccaguuccauacaugucaauccuaaauuuuuaaacaagucuccagaagaaccgagcacucccgguacagugguauccucaccuaguaucagcaccccacccauuguuccugacauccagaagaaucugacgcaggaacaacuuauuagacagcaguugcuggcaaaacagaagcaacuacucgagcugcagcagaaaaagcuggaacuugaguuggagcaggccaaagcucaacucgccgugucucuguccguccagcaggaaacuucaaacuuaggcccagggagcgcacccaguaagcugcacgugucucaaaucccgccuauggcugugaaagcuccccaucaggucccaguucaguccgaaaagagcaggccuggacccucgcuccagauacaagaucuuaagggcaccaaucgggacccacgccugaacagaauuucucagcacucccaugguaaagaucagucacacaggaaggaguucuugaugaauacacuaaaccagagugacacuaaaaccagcaagacaauccccuccgagaaacugaacucuagcaagcaagaaaagucaaaaaguggggagaagauuaccaaaaaggagcucgaucagcuggacuccaaaagcaagucuaagucaaaaaguccuagcccacuuaagaauaaacugucccacacgaaggacuugaaaaaccaggaaucugagucgaugcggcucagcgauaugaauaagcgcgacccgcgacugaagaaacauuuacaggauaagacugacggaaaagaugacgaugugaaggagaaaagaaagacagcggagaaaaaggacaaggaugaacacaugaaauccucagagcauaggcuggccggcagucggaacaagaucaucaauggcauuguacaaaaacaggacaccauaacugaggaaucugagaagcaggggacaaaacccggacguagcuccacccgcaagagaucaaggagccggucuccuaagucccgaaguccaaucauucacagccccaaacgcagagauaggcggucuccuaagcgcagacagagguccaugucaccaacgaguacccccaaagcagguaagauccgucaaagcggcgcuaaacagucgcacauggaagaguuuacaccgccuucccgggaggaccgaaacgccaagagaucuacuaagcaggacauaagggauccacgccggaugaaaaagaccgaagaggaaagaccccaagagacaacuaaucagcauagcaccaaaucagggacagaaccuaaggagaacguggagaauuggcagaguuccaaaucugcuaagagguggaaaagcggaugggaagagaacaaaucccuacagcaagucgacgaacacucaaagcccccacaucuccgccaccgagagagcuggaguucuaccaaaggcauucuguccccucgggcccccaagcagcagcagcaucgucuuagcguggaugcaaauuugcaaaucccaaaagaacugacucucgccucgaagagagagcugcuucagaaaacgucagagaggcuggcuucuggugaaaucacacaggacgauuucuugguugugguccaccagauucgccaacucuuucaguaccaggagggggugcgggaggaacaaagaaguccguucaacgacagguuuccucugaagcgaccccgcuaugaagauuccgacaagccauucguagauagccccgcgucucgguucgcaggauuagacaccaaucagagacugacugcccuagcugaggauaggccucucuuugacggcccaagccgucccuccguugcccgcgauggcccuaccaaaaugaucuucgaggggccgaacaagcugucaccacggauugacggacccccuacaccagcaagucuuagauuugacgguagccccggccagaugggagggggcgguccuuugagguucgaagggccgcagggccaacugggaggcgggugcccccuccgauuugagggaccaccuggucccgugggcaccccacugcgguucgaagggccuauaggacaggccggcggugggggcuuucgcuucgagggaucucccggcuuaagauuugagggguccccaggaggucugagguucgaaggccccgggggacagccugucggcggucuucgguuugaggggcaccgaggccagcccgugggaggcuugagauucgaagggccacauggacaacccgucggcggucuccgcuuugauaauccuagggggcagccagugggaggccugcguuucgaggguggccacgggcccucaggagcugccauccgguucgacggcccucaugggcagccgggaggcgguauuagauuugaagggccacuacugcagcaaggaguuggcaugagguucgaggguccccacggccagaguguggcagggcuccgcuuugagggacagcacaaccagcugggcgggaaccuucgauucgaaggaccucauggccaacccgguguagggaucagauuugagggaccauugguccagcagggcgguggcaugcgguucgaagggccuagcgugcccggaggcgggcugaggaucgagggaccauuaggccaaggugggccucgcuuugaaggaugucacgcgcuccguuucgauggccagccgggccagcccucccugcuuccaagauuugacgggcugcauggacagccugguccccgguucgagaggacuccaggccaaccugggccccagcgcuuugauggaccgccaggccagcagguucaaccucgauucgacggugugccccagagauuugaugggccacagcaccagcaagccucucgguucgacauucccuugggacuccagggcacaagguucgauaaucauccuucgcagcgccuggagagcgucucauuuaaccaaacgggcccguacaaugacccgccagggaacgccuucaaugcaccuucccagggacuacaguuucagagacacgaacaaauauucgauaguccccaggguccuaacuuuaauggcccacacgggcccggaaaccagucuuucagcaauccucugaacagggccuccggccauuauuuugacgagaaaaaucuccagucaucucaauucgguaacuuugggaauaucccagcucccaugaccgugggaaacauucaggccagccagcagguacugaguggcguggcacaaccgguugcuuucggccaggggcagcaguuucuuccuguccacccacaaaaucccggauucgugcagaacccuuccggugccuugccaaaggcguaccccgauaaccaucugagccagguggacgucaaugaauuauucucuaaacuccugaagacuggcauccuuaagcugucacaaacagacuccgccaccacacagguuagugaggugacugcucagccgccucccgaagaggaggaagaucagaacgaggaccaagaugugccagaccuaaccaauuuuacgguagaggaacucaaacagcgguacgauagcgucauuaaccgucuguauaccgggauccagugcuacucguguggaaugcgcuucacaacuucucagaccgacguguaugcagaucacuuggacuggcauuaccgacaaaauagaacagagaaggauguuuccaggaaagugacucaccggcgcugguauuacagccugaccgacuggauagaauuugaggaaaucgccgauuuagaggaaagagcuaagucacaguucuuugagaaaguccacgaggaagugguucucaagacgcaggaggccgcaaaggaaaaagaguuccagagugugccugcgggccccgccggugcuguagaaucuugcgagauuugucaagagcaguuugaacaguauugggacgaggaagaggaagaguggcaucugaagaacgccaucagggucgacgggaaaauuuaccacccauccugcuacgaggauuaucaaaauacaagcucauucgacuguacccccaguccuagcaagacuccaguggaaaacccgcuuaauaucaugcugaacauagugaaaaaugaguugcaggaacccugcgauuccccuaaggucaaggaggagcggauugacacaccacccgcauguaccgaagagucuaucgcuacuccuagcgaaauuaaaaccgagaacgauacaguugaauccguguga

SEQ ID NO: 60431 - RNA, 780 nt, Artificial Sequence
  derived and/or modified sequence opt3 from PCGF1__Homo_sapiens__NP_116062
auggccagcccccagggcgggcaaaucgcuauugcaaugagacugaggaaccagcuccaguccguguacaagauggacccucuucggaaugaggaagagguccgcguuaaaauaaaggaucugaacgaacacaucgugugcuguuugugcgccggauauuucguagacgcgaccacaauuacugaguguuuacauacguuuugcaaaucuuguaucgugaaguaccugcagaccucaaaauauugcccaauguguaauauuaagauccacgaaacacaaccgcuacucaaccugaaacuugaucgagucaugcaggacauaguguacaagcugguucccgguuugcaggauagugaggagaagcguaucagagaguucuaucagagcaggggccucgaccgggugacucaaccuaccggggaagaaccagcucuguccaaucugggacuccccuuuucuucguucgaucauucaaaagcccacuacuaucgcuacgacgagcaguuaaaccugugccuugagagauugagcaguggcaaggauaaaaauaaguccguccugcagaacaaguacgugagguguucuguacgggcagaaguucgccaucuacgaagagugcucugccacaggcugaugcuuaauccucagcacguccaacuguuguuugacaacgaggugcucccagaucauaugacaaugaaacagauuuggcugagccggugguucgguaagcccuccccuuuacugcuccaguauucagugaaagaaaagcgucgcuga

SEQ ID NO: 60432 - RNA, 1035 nt, Artificial Sequence
  derived and/or modified sequence opt3 from PCGF2__Homo_sapiens__XP_005257698
augcacagaaccacaaggaucaagauuacugagcugaacccccaucucaugugcgcccuuuguggcggguacuucauagacgcuacgaccaucguggaaugccugcacagcuuuuguaaaacaugcauuguccgguauuuggagacuaauaaguacuguccuaugugcgauguucaggugcauaaaacccgcccauuacuguccauccgaucugacaagacacuacaagauauuguauauaaacucgugccgggacuguucaaggacgaaaugaagcguagaagggauuuuuacgcagccuauccccuuaccgaggucccuaacgguucaaaugaagaccggggcgaggugcuggagcaggaaaaaggggcguugagugaugacgagaucguuagccucuccauagaguucuacgaaggagcucgcgauagagacgagaagaaaggcccacuggaaaacggugauggggacaaggagaaaacuggagugagguuucugcggugucccgccgcaaugacagucaugcaccucgccaaguucuuacgcaauaagauggaugugccuucuaaauauaagguagaaguucuguacgaggacgaaccacuuaaagaguacuauaccuugauggacaucgcuuacauuuaucccuggcgaagaaacggcccucugccacuaaaguacagggugcagccggcaugcaaacggcucacgcuggccacuguccccaccccuucggagggcacaaauacuucaggggcuagcgaaugugagaguguguccgauaaggccccaucucccgcgacccuuccugcaacaagcuccucacugccaagucccgccaccccgagccauggaucuccuuccucacacggucccccagcuacgcacccuacuagccccacaccacccaguaccgccucuggcgcaacuacagcugccaacgggggauccuugaauugccuccagaccccuagcucgacgucucguggccgcaaaaugaccgugaacggugcgccagucccgccccugacauga

SEQ ID NO: 60433 - RNA, 627 nt, Artificial Sequence
  derived and/or modified sequence opt3 from PCGF3__Homo_sapiens__XP_006713915
augaccgugugcagaagcugucuggucaaguaccucgaggaaaacaauacaugccccacuuguaggaucguuauucaccagucccauccucuucaauauauaggccacgaccggacgaugcaggauaucguguacaaacugguaccaggguugcaggaggccgaaaugcgcaagcagcgagaguucuaucauaaauuaggaauggaagugccgggugacauuaagggcgagaccugcucugcuaaacaacaccuggauucacaucguaacggggagacaaaggcagacgauaguagcaauaaggaagccgcggaggaaaaacccgaggaggacaacgauuaccacagauccgacgaacaggucucuaucugucuagagugcaauucgucaaagcucaggggacugaaacggaaguggauucgcuguagcgcucaggccacugugcuucaccugaaaaaguuuaucgcaaagaaauugaaccucaguuccuucaaugaacuggauauacugugcaacgaggaaauccucggcaaggaccauaccuuaaaauuuguuguggucacaagauggagguucaagaaagccccucugcuuuugcacuaucggccaaagauggaucugcuauga

SEQ ID NO: 60434 - RNA, 1053 nt, Artificial Sequence
  derived and/or modified sequence opt3 from PCGF6__Homo_sapiens__NP_001011663
auggagggcguggccgucguuaccgcugggagcgugggagcagccaagacagaaggugcggcugcccugcccccuccaccgcccguauccccuccagcacucacucccgccccugcugcaggcgaggaagggccagcuccccuuucugagacgggagccccuggcugcucagguaguagaccaccggaacuggagcccgagaggagcuuggggcgguuccgcggacgauuugaagacgaggaugaagaguuagaggaagaggaggaacuggaagaggaggaagaggaagaggaagaggacaugucccacuucucucuacgucucgagggcggcagacaggauucggaagacgaggaagagaggcugaucaaccuuucagaacugaccccuuacauuuuguguagcauaugcaaaggguaucucaucgaugccacaacuauuaccgagugucugcauacauuuugcaagaguuguaucgugcggcacuucuacuauuccaaucgcugcccaaaauguaacauugucgugcaucaaacccagccccuguacaauaucagacucgacaggcaguuacaggauauaguuuauaagcuggugaucaaccuugaggaacgggagaaaaagcaaaugcacgacuuuuacaaggaacgcggauuggaggucccuaaaccagcggugccccagccgguaccuucuagcaagggucgauccaaaaagguucuggagucaguguucaggauucccccagaacuagauaugagucuccugcuugaguuuaucggcgcaaaugaagggacuggacauuucaaaccucuggagaagaaguuugucagagugagcggcgaagccacaauuggucacguggagaaauucuugcggcguaagauggggcucgaccccgcuugccaggucgauaucauauguggagaccaccuguuagagcaguaucaaacccugcgcgaaauuagaagggccaucggcgaugcagcuaugcaggacggccuccuuguucugcauuacggguuggugguaucuccacuaaaaauuacguga

SEQ ID NO: 60435 - RNA, 3537 nt, Artificial Sequence
  derived and/or modified sequence opt3 from PC__Homo_sapiens__XP_011543388
augcugaaguucagaaccgugcacggcgggcucaggcuucugggaauccggcgcacaagcacugcccccgcugcauccccuaacguccgacguuuggaguacaaaccaauuaagaaaguuaugguggccaauagaggugaaauagcgaucaggguauuucgggcuugcacggaguuaggcauucgcaccguggccaucuauucugaacaggacacagggcaaaugcauagacagaaggcagaugaggccuaccugauuggaaggggccuagcuccgguccaggcauaucuccacauccccgacauaaucaaaguggccaaggaaaacaauguugaugcugugcauccugguuacggguuccugucagagcgggccgacuuugcgcaggcaugucaagaugccggaguccgcuucauuggcccaagucccgaggugguacgaaagaugggcgacaaaguugaagcuagagccaucgcaauugcugccggggugccugucgugccaggaacugaugcgcccaucaccagccuucacgaggcccaugaauuuuccaacacauaugguuucccuauaauuuuuaaggcagcuuacggcgggggaggcagggguaugcgggugguccacucuuaugaggagcuggaagagaauuacacccgugccuacucggaggcuuuggccgcauucgggaacggagcccucuuuguugagaaauucaucgaaaagccacgccacauugaggugcagauccugggcgaccaguauggcaauauccugcaucucuacgagagagauugcucaauucagaggcggcaccaaaaaguaguggaaauagcuccggcggcacauuuagacccccagcugcgaacucgccuuacaagcgauagugucaaguuggccaaacaggugggguaugagaacgcuggaaccguugaauuucugguggacagacacgguaaacacuacuucaucgaggucaauuccaggcuacagguggaacauacgguaacugaggagauuaccgauguugaccucgugcacgcccaaauccaugucgcagaaggccggucucugccugaccuugggcugcgccaggagaacauaagaauuaauggaugugccauccagugcagggugacaacugaagauccagcucguagcuuucaacccgacaccggccggaucgaggucuuccgauccggugaagggaugggcauuagauuggauaacgccucagcauuccagggagcggugaucaguccucacuaugacagccuccugguuaaggugauugcucauggcaaagaucacccaacagccgcaaccaagaugucuagggccuuagcugaguuucgcguacggggagucaaaacgaauauagccuuccugcagaacgugcucaauaaccagcaauuucuugcagggacuguugacacacaguucaucgaugagaaccccgaacuguuucaguugagaccggcucagaauagggcccaaaagcuacugcacuaccucggucaugugauggucaacggcccuaccacucccauuccagugaaagcguccccuucacccacagacccaguagugcccgccguuccuaucgggccaccgcccgcuggauuccgcgauauccugcuucgagagggcccugaagguuuugcacgggccguccguaaucacccagggcuguugcucauggacaccacguucagagaugcucaucagagccuguuagccaccagggugcgcacacacgaccugaagaagauugcacccuauguggcgcacaacuuuaguaaacuauucucuauggagaauuggggcggagccacuuuugacgucgcuaugcgguuccucuacgaguguccuuggagaaggcugcaggaacuucgagaguugauaccaaacauccccuuucagaugcugcuccgcggcgccaaugcaguuggguacaccaacuauccggauaaugugguguucaaguucugcgaaguagcuaaagagaacggaauggacgucuuucggguguucgauucccugaauuaccuuccuaacaugcuguuggguauggaagccgcaggcagcgccgggggaguuguggaggcugcgauuucguauacaggcgacgucgccgauccaucuagaacuaaguacucccuccaauauuacaugggucuggcagaggaauuagugagggcugggacccauauccuguguauuaaagacauggccggccuacucaagcccacagccugcaccaugcugguuucaagucuucgugaucgcuuuccugacuugccccugcacauccauacucacgauacgagcggagcuggcguggcagccaugcucgcgugugcucaggccggggcagacguagucgauguggccgcugacuccaugucuggaaugacaagccagccaucaaugggcgcacugguggccugcacccgggguacuccuuuagauaccgagguccccauggaaagaguuuucgacuauagugaguacugggaaggggcgaggggacuguacgcugccuuugacuguacagcaaccaugaaguccggcaauagcgauguguaugagaacgagauaccagguggccaguacacuaaucuucauuuccaagcccacucuaugggguugggaucaaaauuuaaggaaguaaagaaggcuuauguggaggccaaccagaugcucggcgaccugaucaaagucacaccgaguagcaagauugugggggaucuagcacaguucaugguucaaaacggacugucccgagcugaagccgaggcgcaggccgaagaacucucuuuuccucggucgguggucgaguuccugcagggcuacaucggugugccccacgggggauuuccagaacccuuccgcagcaagguucuuaaagacuugccuagaguggagggcaggccaggugcaucccugcccccuuuagaucuccaggcucuggaaaaggagcuugucgaccggcauggcgaggaaguaacgccggaggaugugcugucagccgcuauguauccagacguuuuugcacacuucaaagauuucaccgccacuuuugggcccuuggacagucucaauacacgacuguuccuacaaggaccuaagauugccgaagaguuugaaguggagcuggagagaggcaaaacccuccauaucaaggcucuggcggucucugaucuuaaccgcgcagggcagcgucagguguucuuugaauugaauggacagcugaggagcauauuaguaaaggacacacaagccaugaaagagaugcacuuccauccaaaggcucucaaagaugugaagggccagauuggugcccccaugccugggaaagucaucgacauuaagguuguggcaggagccaaaguggcuaagggccagccgcugugcguccuuuccgcgaugaagauggaaacugugguuaccucacccauggaggguacgguacggaaagugcacgucaccaaggacaugacacuggaaggcgaugaccuaauccucgagauagaguga

SEQ ID NO: 60436 - RNA, 1200 nt, Artificial Sequence
  derived and/or modified sequence opt3 from PCID2__Homo_sapiens__NP_001120675
auggcccacaucaccauuaaccaguaccugcaacagguguaugaggcuauagacagcagagauggcgcauccugcgccgaacucgucucuuucaagcauccccacguugcgaauccuaggcuucagauggcuucaccagaggaaaaaugucagcaagugcuggagccgcccuacgacgaaauguuugccgcacauuugcggugcacauaugccguagggaaccacgauuucaucgaggcuuacaagugucagacugugauuguccagaguuucuuacgcgcauuccaggcccauaaagaggaaaauugggcucugccugugauguaugccguugcgcuagaccuccgaguguuugcaaacaaugccgaucaacagcuggucaagaaaggaaagagcaaggugggugacaugcuugagaaagcugccgaacuguugauguccugcuuccguguaugugcaucugauacgagagcuggcaucgaggacucgaagaaaugggggaugcucuuucugguuaaccagcuguucaagauuuacuuuaaaaucaauaagcuccacuuaugcaagccacugauaagggccaucgauucaagcaaccuuaaagacgauuauaguaccgcgcagcgggugacauacaaguacuaugucggacgcaaagccauguucgacuccgauuuuaagcaagcagaggaauacuugucuuucgcuuuugagcacugucauagaagcucccagaaaaauaagaggaugauucugaucuaucuacuccccgugaaaaugcugcuuggccacaugccuacuguggaacuguugaagaaguaccaucucaugcaguucgccgaggucacccgggcuguuucagaagguaaccuguuacugcuccacgaggcccuugcaaaacacgaggccuucuuuauucgcugcgggaucuuccugauauuggaaaagcuaaaaauuaucacauaucgaaaucuguuuaagaaaguguaccuccugcuuaagacccaucaacugaguuuggacgcuuuccucguagcgcugaaguuuaugcaaguggaggacgucgauauugacgaagugcaguguaucuuagcaaaccugaucuauaugggacacguuaaaggcuacauuagccaucagcaccagaagcuaguggucucuaaacagaauccauuucccccucucuccacugugugcuga

SEQ ID NO: 60437 - RNA, 1869 nt, Artificial Sequence
  derived and/or modified sequence opt3 from PCK1__Homo_sapiens__NP_002582
augcccccucagcugcaaaacggccucaaucuuagcgccaaggugguccaggggucccuggacucuuugccacaggcuguuagagaguucuuagaaaacaaugcagagcugugccagccggaucacauccauauuugugacggaucagaagaggaaaacgguaggcuacucggccaaauggaggaggaagggauacugcggcgccuuaaaaaguacgauaauugcuggcuggccuugaccgacccccgagauguggcgcguaucgagaguaaaacaguaauugugacucaggaacagagagacacggucccuaucccaaagaccggacucagccagcuggguagguggauguccgaggaggauuuugaaaaggcuuucaacgcccgguuucccggcuguaugaaagggcgcacaauguaugugauuccuuucucuaugggaccacugggcucgccccucucaaagaucggcauagaguuaacugacagcccuuacguuguggcaaguaugagaaucaugaccaggauggggacaccaguccuggaagccgugggagauggugaguuuguaaaaugccuucacuccguuggcuguccguugccccugcaaaagccucuagugaauaacuggccaugcaaucccgaacucacccugauugcucaucuuccugaccggcgcgagaucauuucuuucgggagcggauauggcgguaacucccuguuggggaaaaaguguuuugcacuccgaauggccucaagacuggcuaaagaggaaggaugguuagccgagcacaugcugauccucggcauaacuaauccagaaggcgagaagaaguaccuugcggcagccuuccccagugcuugcgggaaaacaaaccuggccaugaugaauccgagcuugccuggauggaaggucgaaugugugggugaugacauugcauggaugaaauuugaugcucagggccaucuaagggccaucaaccccgagaauggguucuuuggaguggcgccaggcaccucugucaagacgaacccuaacgccauuaaaacuauccagaagaauaccaucuucacaaacguugcagagacuuccgacggugggguguauugggaaggcauugacgagccccuggcuucaggaguaaccauaacaagcuggaaaaauaaggaauggaguucugaggauggcgaaccaugcgcccaccccaacucccgguuuuguaccccugcuagccagugcccaaucauugacgccgcaugggagucgccggagggggugcccaucgaaggaauaauuuucgguggccgucgcccugccggggucccacucguguacgaggcucugucuuggcaacacggaguuuucgugggcgcggcaaugagauccgaagccacggcugccgcagagcauaaggguaaaaucaucaugcacgaucccuuugccaugaggccuuucuuuggguauaauuucggcaaguaccuugcucauuggcugucaauggcccagcacccagcagcgaaauugcccaagauuuuucacgucaacugguuccggaaagacaaggagggaaaguuucucuggccgggcuucggggaaaauagucgagugcuggaguggauguuuaaccgcaucgauggaaaagcuagcacuaaguuaacaccuauugguuacauaccaaaagaagacgcccugaaucuaaagggccucgggcauaucaacaugauggagcuguucuccauuucuaaagaauuuugggagaaggagguagaagauaucgagaaguaucuugaagaccagguuaaugcagauuugcccugcgagaucgaaagagagauucuggcccucaaacaaaggauaagccagauguga

SEQ ID NO: 60438 - RNA, 1326 nt, Artificial Sequence
  derived and/or modified sequence opt3 from PCK2__Homo_sapiens__NP_001018083
auggccgcucuguacagacccggccucaggcuuaacuggcacgggcugagcccuuugggauggccauccugccggucuauccagaccuuacgcgugcugucaggugaccuaggccaacucccgacagggauucgagauuucgucgagcauagugcacgucugugucagcccgaaggaauacacaucugcgacggcacugaggccgaaaauacggcgacccuuacacuguuggagcagcagggucucauuagaaagcugccuaaauauaacaauuguuggcuggcuaggacugauccaaaggacguugcccggguggaaagcaaaaccguaaucgugacacccucccaacgcgauaccgucccucucccacccgggggagcaagaggccaguuaggcaacuggaugucuccugccgacuuucagagggcuguggaugagcgguucccagggugcaugcagggacgcacuauguacguucugccguuuucgaugggucccgugggcucaccucuuagccgaauugggguccaauugacagacagugcauaugugguagccuccaugagaaucaugaccaggcugggaacgccaguucuacaggcucucggcgauggugacuucgugaagugucugcauucugucgggcagccccuuacuggacagggcgagccugugagccaauggccaugcaaucccgagaaaacccugauaggccacgugccggaucagcgggaaaucauuuccuuugggucaggauacgguggcaacaguuugcucgggaagaaguguuucgcccugcguaucgcgagccgcuuagcaagagacgaaggauggcuggccgagcauaugcucauucuuggcaucacaucuccugcugguaaaaagagguaugucgccgcagcuuuucccuccgccugcgggaaaacuaaucuggcgaugaugcggccagccuugccuggcuggaagguugagugugugggagaugacauagcauggaugcgauucgacucagaaggccgccuaagagcuauuaaccccgagaauggguuuuucggaguagccccagguaccagcgcuacaaccaaccccaaugccauggcaacgauccagaguaacacuauuuuuacaaauguggccgaaaccucugauggcggggucuacugggagggaaucgaccaaccucugccaccgggcgugacuguuacauccuggcucgguaaacccuggaagccugggaugugcggcggagaaggcguggcucagccacccgggcugagcacccuuauggucgagaagcugucgccucagccacccacgaucuucuga

SEQ ID NO: 60439 - RNA, 14808 nt, Artificial Sequence
  derived and/or modified sequence opt3 from PCLO__Homo_sapiens__NP_055325
augggcaacgaggccagccuggaaggggagggacuccccgaaggucuugcugcagccgcggcugccggcgggggagcauccggcgccgguucuccuucacacaccgcuaucccagcagggauggaggccgaccugagucaguugagcgaagaggagcggaggcaaauugcugccgugaugucccgggcgcagggauuaccgaagggcucugucccacccgcagccgcugaaucgccaucaaugcaucgcaaacaggagcuggauagcagucacccaccuaagcaguccggccgaccacccgacccugggcguccagcccaaccgggacuaucuaaaagccggacuacugauacguucagguccgaacagaagcuccccggucggucaccuaguaccaucagccugaaagagucuaagucccgcacugaccuuaaggaggaacauaaaucaagcaugaugccaggcuuucugagugagguuaaugcauugucugcuguguccagcguagugaacaaguucaaucccuuugaucucaucucggacucugaagccucccaggaggaaacuaccaaaaagcagaaagucgugcaaaaggagcaggggaagccugagggaauuaucaaaccaccccugcagcagcaaccgccuaagcccauuccaaaacagcagggcccugguagagauccccugcaacaggacgggacuccaaagucaaucaguagccagcagcccgagaagaucaagucccaaccuccaggaaccggcaaaccgauccagggccccacucagacaccucagaccgaucacgcgaagcucccauuacaaagggacgccucucggccccagacgaagcaggcagauauuguucgcggggagagcgugaaaccuucacugccaagucccuccaagccgccuauccagcaaccaacucccggaaaaccucccgcucagcagccaggucaugaaaagagccagccuggccccgccaaaccaccggcucaaccuucugggcuuaccaagcccuuggcccagcagccaggaaccgucaagcccccugugcaaccacccggcacuaccaaaccuccggcacagccacugggucccgccaagccuccagcucagcagacagggucagagaaacccaguagcgaacaaccuggcccgaaggcgcuagcacagcccccaggaguaggcaaaaccccugcccagcagcccgggccagcuaagccucccacgcaacagguuggaacuccaaagccgcucgcccagcagccuggucugcaaucccccgcaaaagccccaggccccacaaagaccccugugcagcagccagggcccggaaaaauuccugcucaacaggccggcccggguaagacuucugcacagcagacagggccaaccaaacccccuucgcaacuucccggcccagcgaagccucccccacagcagccuggaccggcuaagcccccaccucagcaacccggcagcgccaaaccaccuucccagcagcccgggucaacgaagccgccaccucagcaacccggaccagcaaaacccaguccucagcagccggguucuaccaagcccccaagccagcaaccuggcuccgccaaacccucagcucagcagccuagcccagccaagcccucugcacaacaguccacaaaaccugucagucagacugggagcggaaagccacugcagcccccgaccgugucuccuuccgcuaagcaaccacccucacagggcuugccuaaaacaaucugcccacucuguaacacuaccgagcuguuacugcacgugcccgagaaggccaauuucaacacaugcaccgaaugucagacuacggucugcagucucugugguuuuaauccgaacccucaccuuacagagguuaaagaauggcugugcuugaauugucagaugaagcgagcgcuagggggcgaccuggcccccgugccaagcucgccucaacccaaacucaagaccgcuccaguaacuaccacauccgcagugucuaagagcucaccccagccucagcagaccagucccaagaaagaugccgcuccgaaacaagaccuguccaaggcccccgagccuaaaaagccacccccucuugucaagcagccaacucugcauggaucucccagcgcaaaagcgaagcagccuccggaagccgacuccuugucaaaaccagcucccccuaaggagcccagcgugccaagugagcaagauaaagccccuguugcagacgauaagcccaagcagccaaaaauggugaagccgacaacggaccucgucucuuccagcucggcuaccacuaaaccugauauacccucaucuaaggugcagagucaggccgaagagaaaacaaccccaccccugaagacagacuccgcaaaaccuagccaaucuuucccacccacuggcgaaaagguaagcccuuuugauuccaaggccauuccgagaccagcuucagacaguaaaaucauuagccaccccgggccuucuuccgagucaaagggacagaaacagguugauccagugcagaagaaagaggaacccaagaaggcgcaaaccaaaaugaguccuaagcccgacgccaaaccaaugccgaagggcagcccuacgcccccagguccuaggcccaccgcagggcagacagucccaacuccucagcagucccccaaaccgcaagagcagucucggcguuucucguuaaaccugggaagcaucaccgaugcuccaaagucacagccuacaacuccccaggaaaccgugacgggcaagcuauuugguuucggcgccuccaucuuuagucaagccucuaaucucauuagcacagcugggcagccaggaccccauucccagucaggcccuggggcaccgaugaaacaagccccagcgcccucucagccucccaccagccagggaccaccuaagaguacuggccaggcucccccagccccugcaaaauccauaccggucaagaaagagacaaaggcccccgcugcagaaaagcuggagccaaaagccgagcaagcgccuaccgugaagcgcacugaaaccgagaaaaagcccccaccuaucaaagacagcaagucucuuacagcugaaccccagaaggccguuuugccgacgaaacuggagaagucaccaaaaccugaaaguaccugcccccucuguaagacugagcugaacauugguagcaaagacccacccaauuucaacacaugcaccgaguguaagaaucaggugugcaaccuuugcggguuuaacccuacaccccaccugacugaaauccaggagugguugugucucaauugccaaacccagagagcaauaagcggacagcugggcgauauuaggaaaaugcccccugcaccgucgggucccaaggcuucuccaaugccuguacccacggaauccagcucacagaagacagccgucccaccucaagugaaauuaguuaagaaacaggagcaggaagugaagaccgaggcagagaaagucauccuggaaaaggugaaggagacucuaaguauggagaaaauaccaccgaugguaaccacagaccaaaagcaggaggagucuaaacucgaaaaggauaaggcuuccgcccugcaggagaagaagccucuuccagaagagaaaaaguugauucccgaagaggagaaaauccggagcgaagagaagaaaccucugcucgaagagaagaagccaacucccgaagacaaaaagcuguuaccugaggcgaaaaccucagccccagaggaacagaagcacgaucugcuuaaaagucaagugcagauugcagaggaaaaguuggagggccgaguugcucccaaaacaguccaggaagggaagcagccgcaaacgaagauggagggacucccuagcggcaccccucaaucccugccaaaagaggacgauaagacuacaaaaaccauaaaggaacagccccagccuccauguacugccaaacccgaccaaguggagccugggaaggaaaagacagagaaagaggaugacaagucugauaccagcuccucacagcagccaaaaucuccgcaaggacuaagugacacgggcuacucgagcgaugguaucuccucuucacugggggaaauucccagccucaucccuacugacgagaaggacauccugaaaggacuuaagaaggauuccuucagucaggaaucuagcccaucaucccccagugacuuggcuaaacuggagagcaccguguuaucuauucucgaagcacaggccuccacacuggccgaugagaagucagagaaaaagacccagccucaugaagucagcccagagcaacccaaagaccaggaaaagacucagucgcuuucugagacacuggaaauaaccaucagugaggaggaaauuaaggagucccaggaagaacgcaaagauacauucaagaaagacagccaacaggauaucccgucauccaaggaccacaaagaaaagucugaguuuguugaugacauuacuaccagaagggagccuuaugauagcguggaagagaguuccgaaagcgagaacucuccagugccccagcggaaacgcagaacgucaguaggcaguuccagcucugacgaguacaagcaggaagauucgcaagguucaggcgaggaagaggacuucaucaggaagcagauaaucgaaaugagcgcugacgaggaugcguccgggagugaggacgaugaauuuauucguaaucaguugaaagagaucucuagcuccacagaaucacagaagaaagaggaaaccaagggaaaaggcaagauuacugcagggaagcaucggcgacucaccagaaaaaguucuacaagcaucgacgaggaugccggaaggcgccacuccuggcaugacgaggaugacgaggcuuucgaugagucaccugaacugaaguaucgggagacuaaaagccaagaaucugaggagcuagucgugaccggcggugggggacugagaagguuuaagacgauagaacucaacuccacaauugccgacaaauacagugcagagagcucgcagaagaagaccucccuguauuucgaugaagaacccgagcuugaaauggagucuuugacugacucaccagaagaccgcagccgaggcgagggcaguuccucucugcacgccagcucauuuacaccggggaccuccccuacaagcguuagcucuuuagaugaagacucagauuccagccccucucacaaaaagggagagaguaaacagcaacggaaggcucgucauagaccacacgguccccuccugccuacaaucgaggacucguccgaagaggaagaacuuagggaagaggaggaacugcuaaaagagcaggaaaagcagcgcgagauugaacagcaacagagaaaguccucaucuaaaaagagcaaaaaggauaaagacgagcucagagcgcagaggcgacgcgagcggccaaagacacccccuuccaaucugaguccaaucgaagaugccucaccgacggaggaauugagacaggcagcugagauggaggaacugcauaggucuagcugcuccgaguacagucccagcauagaauccgacccugagggcuucgaaaucucuccagagaagauuaucgaggugcaaaaagucuauaaguuacccacugccgugucacucuacagcccuaccgaugaacagucgauuaugcagaaagaggggucccagaaggcacugaaaagugccgaagagauguacgaagagaugaugcacaagacacacaaauauaaggcuuuuccagccgcgaacgagcgugacgaaguuuucgagaaggaaccccuuuacggaggcaugcugaucgaggauuauauauacgaaucuuugguggaggacaccuauaaugguagcguagaugggucacuccugacacgccaagaggaagagaacggauuuaugcagcagaaaggccgggaacaaaagauuagacuauccgagcagaucuacgaggacccuaugcagaaaaucacugaccugcagaaggaguucuaugagcuugaaucucuccauagugucgugccgcaagaggauauugugagcuccucauuuaucauucccgaaagccacgagauagucgaccugggcaccaugguuacgucuacagaggaagagaggaaauugcuggaugcagacgccgcuuacgaagaguuaaugaagcgacagcagaugcagcucacuccagggaguuccccuacccaagcccccaucggagaagauaugacagagagcaccauggacuucgaucggaugccagacgcuucacugacuucuuccgugcuuucgggugcaagccugaccgauaguacaucuuccgccacguugagcauuccugacguaaagaucacucagcauuucucaaccgaggaaauugaggaugaauacgugacagacuauacccgcgagauccaggaaauaaucgcucacgagagucucauucugacuuacuccgagcccagcgaaucugccacaucagucccaccgagcgauaccccuucccuaacgucuagugugucgagcguuuguacuacagacuccucaucucccaucaccacccuggacagcauuacuacaguguauaccgagccagucgauaugaucacaaaauuugaagacagugaggagauauccucaucuacuuacuuccccggcagcauuaucgauuauccugaagagaucuccgugagucuugacagaacggcaccacccgaugggagggcgagcgccgaccauauuguuauaucucucucagauauggcuuccagcaucauugaaaguguggucccuaagccggagggacccguagccgacaccgugucuacagaucuguugaucuccgaaaaagacccaguuaagaaagcaaagaaggagacuggcaaugguauuaucuuagaggugcuggaggcuuaccgggauaaaaaggagcucgaagccgagcgaaccaaaucgagccugucagaaacagucuuugaccacccucccuccucugugauagcacuuccaaugaaggagcagcugaguaccacuuauuucacgagcggggagaccuuuggacaagaaaaaccugccucacaguugcccuccggcagcccaucuguaaguucccuaccggcuaagccuagacccuucuuucgcagcucaucucuggacaucucggcgcagccaccucccccaccucccccgccacccccuccacccccuccgcccccaccucccccaccucccccacucccucccccgacaagcccuaagccaacuauucugcccaaaaagaaacuuaccguggccuccccugucacaaccgcaacuccauuauucgaugcuguuacaacgcuggagaccacugccgugcucaggaguaacggcuugcccgugacacguaucugcaccaccgccccgccucccgucccacccaagccuucuucaauuccaagcgggcugguguuuacacaccggcccgaaccuuccaaaccaccgaucgcacccaagccuguuauaccacagcuccccacuacgacccaaaaaccuacagacauucauccaaagcccacuggacugagucuuaccucuagcaugacacugaauuugguaaccuccgcugauuacaagcuaccgucaccuacuagcccacugucuccccacuccaacaaaaguucaccuagauucagcaagucgcucacggagacauacguggucaucaccuuacccuccgaaccagguacuccuaccgacucuagugccagccaggcgaucacaucauggccccugggcuccccaucuaaagaucuugugagcguugagccgguguuuagugucgugcccccuguaacugcugucgagauuccaaucuccagcgaacagaccuucuauauaucuggggcccugcaaacauuuucagcaacgcccgugaccgccccuuccagcuuccaggcugcaccaacaaguguuacacaguuccucaccacugaggugucuaagacagaagucucagccaccagguccacggcgcccagcgugggauugucgucuauuaguaucaccauuccuccggagccacuggcucucgacaauauccaucuggagaaaccccaguacaaggaagauggcaaacuucagcuaguuggugacgugauagaucugcgcacagucccuaaaguggagguaaagacuaccgacaaauguauugauuuguccgccagcacaauggacgugaagcgacagaucacugcaaacgaaguuuaugggaaacagaucucagccguccagccaucuauuaucaauuuaagcgugaccuccaguauugugacacccgucucacuggcuaccgagacuguaacguuugugacaugcaccgccagcgcauccuacacuaccggaacagaaucucucguuggcgcugagcacgccaugacgaccccucugcaacuuacuacaaguaagcaugcggagcccccauauagaauaccgagcgaucagguguucccuaucgcccgggaagaggcacccauuaaccugucccucggcaccccagcucacgccgucacuuuggcaaucacaaagccugugaccguucccccagugggggucacaaacggauggacugacucaaccgugucucaggguaucacggacggcgaaguaguggaucugucgaccacaaaaagccacaggacuguugucaccauggacgaguccacaaguucugugaugacuaagauuauagaagaugagaaaccgguggaccuaaccgcugggcgccgugccgucuguugcgauguuguguacaagcugccuuuuggaagaagcuguacggcccagcaacccgcgacaacccucccagaggaccgguucggcuauagggaugaccauuaccaguacgaucgcucaggucccuauggguaccgaggaaucggcggcaugaaaccuuccaugagcgacacuaaucuugcugaagcagggcacuuuuucuauaagucuaagaacgccuuugauuacagugagggaacagacaccgcuguagaccugacuuccgguagagugaccacaggcgaagucauggauuauucaagcaaaacgaccgggccauaccccgagacuagacaggugauuucuggagccggcaucucgacaccucaauauuccaccgcaaggaugacuccgccacccgguccucaguacugcguugggaguguguuacgcagcucaaauggcgucguauacucuuccguggccacacccaccccaagcacguucgcuauuacaacccagccuggaaguaucuuuucaacuaccguuagagacuuguccggcauacauacagcggaugccgugacuagccugcccgcaaugcaccacucucagccaaugccuaggaguuauuucaucaccacaggggcuagcgaaacggacauugccgucacuggaaucgauauuuccgcaucucuccaaaccaucacaauggagucacugaccgccgagacuauagacagcgugccgacacuuaccacggcuuccgaagucuuucccgaggugguuggugaugaaucggcccugcucauugugccagaggaggacaagcagcagcagcaauuggaucuggaacgggaguuacuagaacuggagaaaaucaagcagcagcguuucgcggaagaacucgagugggaacgccaggagauucaacgauucagagaacaggagaaaaucaugguacagaagaaacuugaagaacugcaaucuaugaagcagcauuugcuguuucagcaggaggaagagaggcaagcacaguucaugaugcggcaggaaacucucgcccagcaacagcugcagcuugagcagauacaacagcuccagcagcaacugcaccagcaguuggaggaacagaagauccgccagauuuaccaguauaacuacgacccuaguggcaccgcuagcccccagacaaccacugagcaagccauccuggaagggcaguaugcagcuuuagagggaucacaguuuugggccacagaagaugcuaccacaacugccuccgcaguggucgcgauugagaucccacagucucaaggcugguacaccguucagagcgacggugugacgcaguauauagccccucccgggauucuauccacagucagugagaucccgcugaccgaugugguagugaaagaagagaagcagcccaaaaagagaucaagcggcgcuaaaguuaggggacaauacgacgacaugggcgaaaauaugacugaugacccccggucuuucaagaagaucguggauuccgggguccagaccgacgaugaggacgccacagaucgaaguuacgugagcagacgcaggcggacuaaaaagucagucgacacgucugugcagaccgaugacgaagaucaagacgagugggauaugccuacacguuccagaaggaaagcacgcguuggaaaguauggugacucgaugaccgaggcugacaaaacuaagccacucagcaagguaaguuccauugccgugcagacagucgcagaaaucucugugcagaccgagcccguuggcacuauacggacaccuucaauucgagccagaguggaugcgaaagucgaaaucauuaagcauaucagcgcucccgagaaaaccuacaagggagggucccuuggcugccagacggaagccgacucugauacucaaagcccacaguaucugagugcaaccucaccuccgaaagacaagaagaggcccacaccauuggagauagguuacuccagccaucugcgcgccgauucuaccgugcagcucgcuccuagucccccaaaauccccuaagguacuguauagccccaucucaccgcuuucgccagggaaagccuuagagucugcauuugugccuuacgaaaagccccugccagacgauauuagcccucagaaaguucuccaccccgacauggcuaaggucccgccugccucccccaagacugcgaaaaugaugcaacggaguaugucagauccaaagcccuugucuccuacagcugacgagagcuccagagccccauuccaguauaccgaaggcuacacgacaaaaggaagucagacuaugaccagcucuggcgcacagaagaaagugaagcguacacugcccaacccuccacccgaggaaaucuccaccgggacucaaucaacguuuagcaccaugggaacagugucgaggcggcgcauuugucgaacuaauaccauggccagagcuaaaauccuacaggauauugacagggagcuggaccucgucgagcgggaauccgcaaaacuucgcaagaaacaggccgagcuggaugaagaggagaaggaaaucgacgcgaaauugagauaccuggagaugggcauaaacaggcgaaaggaagcccuccugaaagagcgggaaaagcgugagagagcuuauuuacaggguguugcagaggaucgcgacuacaugucugauagugaagugucaagcacaaggccgacccggauugagucccaacacgggaucgaaagaccucgcacugccccacagacagaguucucucaguuuauacccccucaaacccagacggaaagccagcuuguaccacccacaaguccuuauacacaguaccaauauucauccccagcucugcccacccaggccccgacuagcuacacccagcagucucacuucgagcaacagacacucuaucaucaacagguguccccuuaccaaacccagccaacguuucaggcagucgcuacaaugaguuucacuccccaagugcagccuacccccacaccacagccgagcuaccagcuacccucacaaaugaugguuauucagcagaagccuaggcagacuacccuguauuuggagccaaaaauaacaucuaauuacgaagugauccgaaaccaaccccugaugauugccccugucuccaccgacaauacuuuugcggugagccaccucggaucgaaguauaacagucuugaucugcggaucggcuuggaggaaagaucuucaauggccuccagcccaauuucuagcaucuccgcagacaguuucuacgcugauauagaccaucacacgcccaggaauuauguacugaucgaugacauuggugagaucaccaaaggcacagccgcacucucaacugccuucagcuuacacgaaaaggaucuguccaaaaccgaccgccuucugcguacaaccgagacucggagaucucaggagguuacagacuuucuagcuccucuccagaguucaagcaggcugcauuccuacgugaaggccgaagaggauccaauggaagacccguaugaguugaagcugcucaaacaccagauuaagcaagaguuccgccgagggacggaaucucuugaucaucuggcgggauuaucgcacuacuaccaugcugacaccagcuaucggcacuuucccaaauccgagaaguacaguaucucaagacugacuuuggaaaaacaggcagccaagcagcucccugcugccauacuguaucagaagcaaucuaaacacaagaaaagccuaauugauccaaagauguccaaauucagucccauccaggagucuagggaccuugaaccugauuacagcucauauaugacauccagcaccucuucaaucggcgggauuaguucccgcgcaagacugcuccaggacgauauaaccuuuggacugcggaagaacaucacugaccaacagaaauucaugggcagcucguuggguacagggcugggaacgcucggcaauaccauuaggucugcccuucaggaugaggcugacaagccauacuccagcgguucacguagucgacccucuucccgcccgagcucagucuauggccuggauuuaaguaucaagagagacuccaguucuucgagccugcgguugaaagcgcaggaggccgaagcacucgacguguccuuuucacaugccucuaguagcgcuaggacaaagccuacuucccugcccauuucucaaucacgcgggagaaucccaauaguggcacagaacagcgaggaagagaguccucuaucccccgucggacagccaaugggcauggcccgggcugccgcggggccucuucccccgaucucugcagauaccagggaccaguucggaagcucccacucacugccagaaguucaacagcauaugcgagaggagagucguacaagaggcuacgaucgcgacauugccuuuaucauggaugacuuccagcacgcuaugagcgauucugaagccuaccaccuccggagggaggaaacugacugguuugauaaacccagagagucccgccuggaaaacggucauggguuggaccggaaguuaccugagaggcuggugcacucgcgaccacucagccagcaucaagagcagauuauccagaugaauggaaaaaccaugcacuauauuuucccccaugcaagaauaaagaucacgcgggauucaaaggaccacacaguaaguggcaacggccuugggauuaggaucgugggagguaaagaaaucccuggccacuccggggagauuggagcuuacauagccaagauccugccaggcgguucugcggaacaaaccgggaaacuaauggagggaaugcagguccuggaguggaauggcauuccccucacuagcaagaccuaugaagaggugcagucaaucauuucccagcaaucuggcgaagccgagaucugcguucgcuuggaccugaacaugcuuagcgauagugaaaauucccagcaucuggagcuccacgagccuccgaaagcuguggacaaggcaaagagccccggggucgauccaaaacaguuagccgcugaacugcagaaggugucuuugcaacagucaccucugguacucaguuccguuguggagaaaggaagccauguccacucuggucccacaucggcaggcucaagcuccgugccaaguccugggcagcccggaucuccgagcguuuccaagaaaaagcauggcucaaguaagccaacugacgguaccaaaguggucagccacccuauaacaggggaaauccagcuucaaauuaacuacgaucugggaaaucuaaucauucacauccugcaggcccguaaccucgugcccagagacaauaacggcuauucugauccauuuguaaagguguacuugcugccuggccgagggcaggucaugguugugcaaaaugcuuccgccgaguauaaaaggcggacgaagcauguccagaaaagccuuaaccccgaauggaaucagaccgugauauacaagucaauuucuauggagcagcugaaaaagaagacuuuagagguaacagugugggacuacgaucgcuucuccaguaacgacuuccucggagaaguucugaucgauuugagcucgaccucccaccuggacaauacuccaagaugguauccgcucaaagagcaaacagaaucuauugaucaugguaagucacacagcagucaguccucucagcagagccccaaaccuucagugaucaagaguaggucccacggcauauuuccagaccccagcaaagacaugcaagucccuaccaucgagaagucucauuccucacccgggagcaguaagucuucguccgaaggacaccuucggagccauggcccaucacgcucucagaguaaaacgagcgugacccagacacaccuggaggaugccggugccgcgauugcugccgcagaggccgcuguucagcaacuaagaauccagccuuccaagcgaaggaaauga

SEQ ID NO: 60440 - RNA, 6075 nt, Artificial Sequence
  derived and/or modified sequence opt3 from PCM1__Homo_sapiens__NP_006188
auggccaccggcgggggacccuucgaggacgguaugaacgaucaggaccugccuaauuggagcaacgaaaauguggaugacagacucaacaauauggauuggggcgcucaacagaagaaagcaaacagguccucugagaaaaauaaaaagaaauuuggggucgaaucagacaagcggguuacuaacgauaucaguccagagagcuccccgggagugggccgccgacguacuaagacgccccacaccuucccucauucuagauacaugucgcagaugucagugccagaacaggccgagcuugagaaacugaagcaaaggauuaauuuuagcgacuuggaucagcggaguauagguuccgacucucaggggcgcgcgacagcugccaacaauaaaagacaguuaagcgaaaacaggaagcccuucaauuuucugccuaugcaaaucaacacuaauaaauccaaggaugcaucaaccaguccacccaaccgggagacaauuggaagcgcccagugcaaggaacuauucgcuucugcacucuccaacgaccugcuucagaauugucaggugucagaggaggauggccgcggcgaaccugccauggagagcagucaaaucgucucucgacuggugcagauuagagacuauaucaccaaggcuuccagcaugagggaagacuugguugagaagaacgaacggucggccaauguggagcgucucacucaccugauagaucaucugaaagagcaggaaaagucuuacaugaaauuucucaagaaaaucuuagcgcgcgacccacaacaggagccgauggaagagauugaaaaccugaagaagcagcacgaucuuuugaaaagaaugcugcagcaacaggagcagcuaagggcacuccaggggcggcaagccgcucugcuugcccugcagcauaaggcagagcaggcuaucgccgucauggacgauuccgugguagcggaaacagccggaucauugagugguguuagcauuaccuccgagcucaaugaagaacugaacgacuuaauccagcgauuccacaaucaacugcgcgauucucagcccccugcagugccagacaacagaaggcaggcugaaagccucucacuuacgcgggaggucagucagucccgcaaacccagcgccucugagagacugccugaugaaaagguggaguuguuuucaaaaaugagggugcuacaagaaaagaagcagaaaauggacaagcugcucggcgagcugcacacucuucgugaucagcaucugaauaacaguagcuccucuccacaacggucggucgaccagcgaagcaccuccgcucccucagccaguguuggguuggcaccggugguaaauggagagucuaacagccucacauccucagugccuuaucccacugccagccuggucucucagaaugaauccgagaacgaaggccacuuaaauccaagugagaaacugcagaagcuaaacgaagugagaaaaaggcucaacgagcugcgcgagcuuguucauuacuaugaacaaaccagcgacaugaugacagaugcugugaaugagaaccggaaggacgaagagaccgaagagucugaguacgauuccgaacacgaaaauucagaaccugucacgaacauaagaaauccccagguggcgaguacuuggaacgagguaaauagccacucgaacgcacagugcguuuccaauaacagggacggucgcacaguaaauucuaacugugaaauuaauaaccgaagcgccgcuaauauccgggccuugaacaugccacccucacuggauugccguuauaacagagagggggagcaggaaauucaugucgcacaaggagaggacgaugaagaggaggaagaggaagccgaggaagagggcgugaguggcgcuucccucucuagccacagguccucacuggucgacgagcauccugaagaugccgaguucgaacagaagaucaaucgccuuauggcagcgaaacagaagcugcggcaguugcaagaccucguggcuaugguucaggaugacgaugccgcacagggggugaucagcgccagugcuucuaaccuggacgacuuuuacccagccgaggaagauaccaaacaaaauuccaacaauacuagaggaaacgcaaauaagacacagaaagacaccgguguaaacgagaaggcuagggagaaguucuacgaagccaaauuacagcagcaacagcgagagcugaagcagcuacaggaggaacgcaaaaagcucauugauauacaagagaaaauccaggcgcugcagacggccuguccggaccuucaguugagcgcugcaucggucggcaauugccccaccaagaaauauaugccugccgugacaucaacuccaaccguuaaccaacacgagacaucuacaaguaaguccguguuugagcccgaagauagcucuauugucgacaaugagcuguggagcgaaaugcggagacaugagaugcucagggaggaacugcgucagcgccggaagcaguuagaggcucugauggccgaacaccagagaaggcaagggcuugcagagaccgcguccccuguggccguaucauugcgaagugauggaagcgaaaaccucuguacaccacagcagucucggaccgagaaaacuauggcuacguggggcgguuccacacaaugcgcccuggacgaggaaggggaugaggacggcuaccuaucagaaggaaucgugcgcaccgaugaggaagaggaggaggaacaggacgcaaguagcaaugauaacuucuccguuugucccucuaauucggucaaccacaacagcuauaauggcaaggaaacuaaaaacagauggaagaauaacugcccguucucagcugacgagaauuacaggccucuggccaaaacccggcagcagaacauauccaugcaacgacaggaaaaucucagaugggugagugagcugucuuauguggaggaaaaggagcaguggcaggaacaaauuaaccagcuuaagaaacaguuggacuuuagcgucuccaucugucagacacugaugcaagaucagcagaccuuaucaugccuccugcaaacucuucugacagggccauacucuguuaugcccagcaauguggcaaguccucaggugcauuucaucaugcaccaguugaaccagugcuauacgcaacucaccuggcagcagaauaacguacagcgccugaagcaaaugcuaaaugagcugaugaggcagcagaaccagcaucccgagaaaccaggagguaaggaacguggcuccagcgccucucacccucccucaccaucccucuuuuguccguucaguuuuccuacucaacccgucaaucuguucaacauuccaggguuuacaaauuucagcucguuugcucccggaaugaacuucucuccucuuuuuccauccaacuucggcgacuuuagccagaauaucucaacccccagugagcagcagcaaccuuuggcgcagaacucuuccgguaaaacagaauacauggccuucccgaagccauucgagagcucaaguagcauuggggcagaaaagccccggaauaaaaagcugccugaggaggaaguggaguccucuagaacuccaugguuauacgaacaggagggcgaaguugagaaacccuuuauaaagaccggauucagcguguccgucgagaaaucaacgucuaguaacaggaagaaucaacucgauaccaacggccgccgaagacaguuugacgaagagucgcuggagagcuucuccucuaugccugauccgguggaccccacaacuguuaccaagacauuuaaaacucggaaggcuucagcccaggccagccuugcuuccaaagauaagaccccaaaaaguaagucuaaaaagaggaauagcacgcagcugaagucacgcgugaaaaacauccguuaugaguccgcaaguaugagcucuacaugcgaaccuuguaaguccagaaaucggcacucagcccaaaccgaggagcccguacaggcgaaagucuucagcaggaagaaccaugaacagcuagagaaaauuaucaagugcaaucgcucgacugaaaucucuagugagacaggguccgacuuuagcauguucgaggcucuccgagauaccauuuacucagaaguggccacucugauaucccagaacgagucuagaccacacuuuuugaucgaacuguuccaugaguuacaacuccugaauaccgacuaucuucggcagagggcacuguacgccuugcaggauauugugagccgccacaucagugaaucccaugagaagggagagaacgucaaaagcguuaauucugguacauggauugcuucaaacagugaacucacgccuuccgagagccuggcaaccacugacgacgaaacauuugagaagaacuucgaaagagagacccacaaaaucucugagcagaaugaugccgacaacgcgucggugcuaucaguaagcuccaauuuugaacccuucgcuacagaugaccugggcaacacugugauacaccuugaucaagcccucgcaaggaugcgggaguaugaacguaugaagaccgaggccgaaaguaauucuaacaugcgcuguacgugccgaaucauugaggacggggauggagcuggcgccgguacaaccgucaauaaccuggaggaaacuccagugaucgagaauagaagcucccagcagccgguuucagaagugaguaccauuccuugucccaggaucgacacacaacaguuggaucggcagauaaaagcaauuaugaaggaggucaucccauuccugaaggagcauauggacgaagugugcucuagccaguuacucacuuccguucgcagaauggugcugacccuuacacaacagaacgaugagucaaaagaauuugucaaguucuuucacaaacagcuggggagcauuuugcaggacucucucgcuaaguucgccggcaggaaacugaaggauuguggagaggaccuacugguagaaaucuccgaggugcuuuuuaaugagcucgcguucuuuaagcugaugcaagacuuggauaacaauaguauaacgguuaaacagcggugcaagcgaaaaaucgaagccaccggcgugauucagagcugugcaaaggaggcuaaaagaaucuuagaagaccaugggucgcccgccggagagauugaugacgaagauaaggacaaggaugagacugagacagucaaacagacccaaacuuccgaaguguacgacggcccuaagaacguacgcucugauaucucagaccaggaggaagaugaggaaagcgaggguugcccagugaguauaaaucuguccaaagcugagacacaggcacucaccaacuaugggucuggagaagacgagaacgaagaugaggagauggaagaguucgaagagggccccgucgacguucaaacgagccugcaggccaauacugaagccaccgaggagaacgaacacgacgaacaggugcuucagagggauuuuaagaaaacagcugaaucaaagaaugugccucuggagcgggaagcgaccuccaaaaacgaccaaaauaacugcccggucaagccauguuacuugaauauucuagaggaugagcagccccugaacagugcagcccauaaggaaagcccucccacuguggacucuacacagcagccaaauccucucccccugcgucuuccagagauggaaccuuuaguuccgagaguaaaagaggugaagucagcucaagaaacccccgaguccagccuggccgguucuccagauacagagaguccuguccucgugaacgacuacgaagcagagucgggcaauaucucccagaaaagcgaugaagaggacuucguuaagguggaggauuugccccugaaacucacuaucuauucagaagccgaccugaggaagaagauggucgaggaggagcagaaaaaccaccuuucuggggaaauuugcgagaugcagaccgaggaacuggcuggaaauagcgagacguugaaggaaccagagacagugggcgcgcaauccaucuga

SEQ ID NO: 60441 - RNA, 861 nt, Artificial Sequence
  derived and/or modified sequence opt3 from PCMT1__Homo_sapiens__NP_001238978
augcccggcgccagaagcgggggauccgguggcgacgggucuaacucaggaaguuacagcggcgaugcuuccggugcagugaccgucugggagguugugucucugcucgggaaacuucugggaacaguaguggccuugaaggucguguuauaucugcuaaggguuugccucgcgauggcuuggaagucgggcggcgccucacacagcgaacugauccauaaucuucggaaaaacgggauuauaaagacugacaaaguguucgaggucaugcuggcaacggaucgcagucacuacgccaaguguaauccuuauauggacuccccacagucuaucggauuucaagcuaccauuagcgcaccgcauaugcacgccuacgcuuuggaacuccuguucgaucagcugcaugagggugccaaggcgcucgacgugggcuccgggucaggaaucuuaacagcaugcuuugcccgaaugguaggcuguacugguaaaguuauugggaucgaucacauaaaggaacugguggacgauagugucaacaaugugcguaaagacgaucccacccuuuugagcucuggaagagugcagcuggucguuggcgacggcaggaugggguaugcugaggaggccccuuacgaugcaauccacgugggagcugccgcgccaguagugccccaggcccuaauugaccaacucaagccugguggccggcugauccuuccagucgggcccgcaggaggcaaccagaugcuggaacaguaugacaaauugcaggaugguuccauuaagaugaagccucucaugggggugaucuacguuccacugacagacaaagagaagcaauggucacgcgaugaauuauga

SEQ ID NO: 60442 - RNA, 846 nt, Artificial Sequence
  derived and/or modified sequence opt3 from PCMTD1__Homo_sapiens__NP_001273711
augcccggcccuagaaggcugcggagcccagggggauccgguuguucuucacgcggcagugggccgcgacucagcacccguagauggaggcccugcugcuacuguggaggcuccgguguguggcuucugcggacaccuccaucucccucggccuggccugcucgcagaugcccaaggcaccgguucgaguuuugugaacccgcauucgucguugggaacugcuugcagaucgccucagacagccaucaauaugaucgcauuuacuguggagcgggcgugcagaaggaccacgagaauuauaugaaaauauuacugaagguaggcgggauccuagugaugccuauugaagaucagcucacucagaucaugcgaacgggacaaaacaccugggagaguaaaaauauucuggcugucuccuuugccccacuugugcagccgucuaagaacgacaaugguaaacccgauagcguuggccugccuccaugcgcagugagaaacuugcaggaccucgccaggaucuacauacggcguacacugcgcaauuucaucaacgaugaaaugcaggcuaaggggauuccccaaagagcaccuccaaagaggaaacggaagcgagucaaacagcgcaucaauacuuauguguuuguaggaaaccagcugauuccccagccgcucgacuccgaggaggaugaaaagauggaggaagacaauaaagaggaggaagagaaggaucauaacgaagccaugaagccugaggaacccccacaaaauuuacugagagagaaaaucaugaaacuuccuuugcccgagucacugaaggcuuaccuaaccuauuucagggacaaguga

SEQ ID NO: 60443 - RNA, 786 nt, Artificial Sequence
  derived and/or modified sequence opt3 from PCNA__Homo_sapiens__NP_872590
auguucgaggccagacuggugcagggcagcauccucaagaaaguccuugaagcucugaaggacuugauuaacgaggcaugcugggauauauccucuucagggguuaauuuacaaaguauggacagcucccacgugucucugguacagcuaacccucaggucggaaggauuugauacauaccggugugaccgcaaccuggccaugggugugaaucuuacuucaaugagcaaaauccugaagugcgcgggcaacgaggauauuaucacguugcgagcugaagacaaugccgauacccucgcacuggucuucgaggcccccaaccaggagaaagugagugacuaugaaaugaagcugauggaucucgacguugagcaguuagggauuccugaacaagaguacuccuguguggucaagaugccaucuggagaguuugcucguaucugcagagaucugagccauauaggcgacgcagugguaaucuccugugccaaagaugguguuaaguucucagcuaguggggaacuuggaaauggcaacauuaaauugagccagacaucuaauguggacaaggaggaagaggccgucacuaucgaaaugaacgagccggugcagcugaccuuugcgcuaagguaucucaauuucuuuacaaaagcaacuccccuguccucaaccgugacacuuagcaugagugccgacgucccucugguuguggaguacaagauugcugauaugggccacuugaaguauuaccucgccccaaaaaucgaagacgaggaagggucuuga

SEQ ID NO: 60444 - RNA, 10011 nt, Artificial Sequence
  derived and/or modified sequence opt3 from PCNT__Homo_sapiens__NP_006022
auggagguggaacaggagcaaagaaggcggaaggucgaagccggccgcacaaaacuggcucacuuccgacagcguaagacaaaaggggacagcucccacucugagaagaaaacugccaagagaaagggaucagccguugaugcgagugugcaggaagagagccccguaacgaaagaggacuccgcucucugcgguggcggggauaucuguaagucuaccucgugcgacgauacaccugacggagccggcggugcguuugccgcucagccagaagauugugacggggagaaaagggaagaucuugagcaacugcagcagaagcaagugaacgaccacccgcccgagcaaugcggaauguucacugucucagaucauccuccagaacagcacggcauguuuaccgugggcgaccaucccccugagcagcgggggauguucacaguuagcgaucacccacccgaacagcacggaauguuuaccgugagugaccauccuccagagcaacgcgguauguucacuauuuccgaccaccagccggaacagagaggcauguuuacagucucugaucauacccccgagcaaagggggauauucacgaucagcgaccacccugcagagcagcggggaauguuuacuaaagaaugugagcaggaaugcgaguuggccauuaccgauuuagaauccggccgcgaggacgaggcuggucugcaccagucacaagccgugcaugggcuagaacucgaggcgcugcgacuuagucugagcaauaugcacacagcacaguuggaacucacucaggccaaccugcagaaggagaaggaaaccgcucugacagagcucagagagauguuaaauucuaggcgggcccaagaacuggcacuuuugcagucccgucagcagcaugagcuggaacuacuccgcgagcaacacgcuagagagaaagaagagguaguucugagguguggacaggaagccgcggagcuuaaggaaaaacugcagucagagauggagaagaacgcccagaucgugaaaaccuugaaggaagauugggagagcgaaaaagaccucugccuggagaauuuacggaaggaacugagugcaaagcaucaaucugagauggaggaucuccagaaccaguuccaaaaagaacuugcugagcagcgagccgaacuggagaagauuuuucaggacaaaaaucaggcugaacgcgccuugagaaaccuagagucccaccaccaagcagccaucgagaagcugagggaagaucuccagagcgagcauggccggugucuggaagaccuugaguucaaauuuaaggagucggaaaaggagaaacagcuggaauuggagaaucuccaggcuucuuacgaagaucugaaggcgcaaucccaggaggagauacgcagauuauggucacagcuggacagugcaaggacgagccgucaggaacuauccgagcuccacgaacaacugcuugcccggacuucucgagucgaggacuuggaacagcugaaacagagagagaagacacaacaugagagcgaacucgagcagcugaggaucuauuucgagaagaaacuucgcgaugcugagaagaccuaccaggaagaccugacuuugcuccagcaacggcugcagggcgccagagaggaugcauuacuggacucaguggagguggggcuaaguugcgucggacucgaagagaaaccagaaaaggguaggaaagaucacguugacgagcuggagcccgaacgccacaaggagucccuuccucgauuccaggccgaauuggaggaaagccaucggcaccagcuggaggcucucgagucuccacuguguauucaacaugaaggccacgugucagaucguugcugcguagagacaagugccuuagggcaugaauggagacuggagcccagcgaaggacacucccaggagcuuccgugggugcacuugcagggcguccaggacggugaucucgaggcagacaccgaaagggcggcucgcgugcuggggcuagagacggaacauaaaguucaacugucucuccugcagaccgagcuuaaggaagagaucgaguugcugaagauugaaaaccggaauuuauauggcaaacuccagcacgagacaagacugaaggaugaccuugaaaaagugaagcauaaccugaucgaggaucaccagaaagaguugaauaacgccaagcagaagacugaacucaugaagcaggaguuucagaggaaggaaaccgacuggaaagucaugaaggaggaacugcaacgagaggcagaggaaaaacuaacacugaugcuccuggagcuucgcgaaaaggccgagucggaaaaacagacuauaauuaauaaguucgaguugcgggaggcugaaaugagacagcugcaggaccaacaggccgcacagaucuuagaucucgagaggagccugaccgaacagcaaggacgucuucagcagcuggagcaggaccuaacauccgaugacgcucuccauuguucacaaugcggccgcgaaccucccaccgcccaggauggggagcuggcggccuugcacgugaaggaggacugugcucugcaguuaaugcucgcacggaguagauuucuggaagagaggaaagaaauuacugagaaguucucugccgagcaagaugcuuuucuucaggaagcccaggagcagcacgcacgagaacugcaauugcuccaggagcggcaucagcagcaacugcuaagcguaacggcggaacuggaggcccgccaccaggcugcccuuggagagcucacagcaucccuggaaucaaaacagggugcuuugcuggccgcaagaguugccgaguuacagaccaagcaugcugcggaccucggcgcccuggaaacuaggcaccuuagcucucuggauuccuuggagaguugcuaccucagcgaguuccaaaccauccgggaggagcaccgacaggcacuggaacuacugagagcugacuuugaggaacagcuuuggaaaaaggauucucuccaucagacaauccugacccaagaguuggaaaaguuaaaacgcaagcacgagggggagcugcaguccgugagggaccaucuccguacugaagucucaacagagcuggccggaacgguggcccacgaacuucagggcguccaucaaggugaguucgggagugagaaaaagaccgcucugcacgaaaaagaggaaacuuugcggcuacagagcgcacaggcccagccauuucaccaagaggaaaaggagucgcugucccuccagcugcagaagaaaaaccaucaggugcaacagcuuaaggaucagguuuuaucucugagccacgagauugaagaguguagaucagaacucgagguguugcagcaaaggcgcgaacgagagaacagagagggcgcgaaucugcucaguaugcugaaagcugacguaaaccuuucccauucugaacggggagcccugcaggacgcauugaggcgccuacugggccucuucggggagacauuacgugccgcugucacccugagaagccggauaggagaaagggugggucuuugccuggaugacgcaggcgccgggcucgcguuguccacagcuccugcccuggaggaaacuuggucagauguugcacuccccgagcuggaccgcacccuuagcgagugugccgaaaugaguucuguggcugagaucuccagccacaugcgagaaucguuucuaaugucaccagagucugucagagagugcgaacagcccauucggaggguguuccaaagucuguccuuggccguagauggauuaauggagauggcacuggacagcucucgccagcucgaagaggcuagacagauccacagcagguuugaaaaggaguucuccuucaaaaaugaggaaacggcccaggugguucggaagcaucaagagcugcuugaaugucugaaagaggaaucagcggccaaggcagagcucgcuuuggagcugcacaagacccagggcacacuagaagguuuuaaagucgagacugccgaucugaaggaagugcucgcugggaaagaggacagugaacaucgucuugugcuggaguuagagagcuugcgccgacagcugcagcaagcagcccaggaacaggccgcucucagagaggaaugcaccaggcuguggucucggggcgaggcgacagcaacugaugccgaggcucgcgaagccgcacuuagaaaggaggucgaagaccugaccaaagagcaguccgaaacgaggaagcaagccgagaaggaucggucagcucucuugagucagaugaaaauacuggagagcgaauuagaggaacagcuaucccaacaccgaggaugugcgaagcaggccgaggcaguuacagcucuggaacagcaaguggccucucucgacaaacaucuuagaaaccaacgccaguucauggacgagcaggcagccgagagggaacacgagcgggaagaguuucagcaagaaauucagcgucuggagggccaguugagacaggcugccaagccucaaccaugggggccgagggauucgcagcaggcgccccuggacggagagguggaacuccugcagcaaaaacuucgcgagaagcucgaugaguucaaugagcuggcaauccagaaggagagcgccgaccggcagguauugaugcaagaagaggaaaucaaacgacuggaggaaaugaacauuaauaucagaaagaaagucgcucaguuacaggaggagguggaaaagcagaaaaacauuguuaagggccuagagcaagauaaggaagugcugaaaaagcagcagaugucaucccuccuucuggccaguaccuugcagucuacucuggacgcugguaggugcccugagccacccagcggguccccuccagaaggacccgagauacaacucgaggucacacagcgcgcacugcuucggagagaaucagagguguuagaucugaaagaacagcucgagaagaugaaaggcgacuuggaaucuaagaaugaggagauccugcaccuaaaccugaagcucgauaugcagaauagccaaaccgccguuagucuucgugaacuggaggaagagaacacuuccuugaaagugauuuauaccaggagcucugagaucgaagaacugaaggcuacaaucgaaaaucuccaggagaaccagaaacggcugcaaaaggaaaaagccgaggagauugaacaguuacaugagguaauagaaaaacuucagcacgagcugucacucauggguccggucgugcaugaaguguccgacagucaggcaggcagccuacaaucggagcuguugugcucucaggcagggggaccucgcggccaggcccugcagggggagcucgaagcugcccuugaggcaaaagaagcucugucccgauugcuggccgaucaagagagaaggcacagccaggcacucgaagccuuacagcagcggcugcaaggagcugaggaggcggccgaacuucagcuggcagagcuagaacgcaaugucgcucucagagaggccgagguugaagacauggccucaaggauccaggaguuugaagcagcucugaaggccaaggaggcgacgauugcugaacgaaacuuggagaucgaugcccugaaccagcggaaagcagcccacagugcugagcucgaagcagugcuucuggccuuagcgcguauuagacgcgcucuggagcaacagccauuggccgcaggcgccgcucccccugaacuccaguggcugagggcccaaugugcacggcuaucuagacagcuucagguacugcaucagcgcuuccucaggugccaaguggagcuggaccgacggcaggcuagaagggccaccgcgcacacucgcguccccggugcccauccacagccucguauggacgggggagcaaaggcucaggugacaggcgauguugaagccucccacgacgcagcuuuggagcccguggucccagauccgcaaggugaccugcagccugugcucguuacccuuaaagaugcaccacuguguaagcaggagggcgugaugagcgucuuaacaguaugccagcggcaacugcagucagaauugcuccuggugaaaaaugagaugagacuaagucuugaagacgggggaaagggcaaggagaaaguucuggaagauugucagcucccaaagguggaccuggucgcccaagugaaacaguugcaggagaaguuaaacaggcugcucuacagcaugacuuuucagaauguagaugcggcugacaccaaaucccuuuggcccauggcaucugcccaucugcuagagagcuccuggucagaugacucuugcgauggggaagaaccugacaucaguccacacauagacacgugugaugcuaacacagccaccggaggcgugacugacgucaucaagaaucaagcaauugaugccugcgacgcuaacaccacacccggugggguuacugaugugaucaagaauugggacucgcugauuccugaugaaaugccggacagcccaauccaggagaaauccgagugucaggauaugucucucucaagccccaccuccguguugggaggcagucgccaccagucucauacagcggaagccgguccucgaaagagcccagucggcaugcuggaccuuucauccuggaguagccccgaggugcugcggaaagauuggacgcucgaaccuuggccgucuuuacccguuaccccacacuccggggcacugucauugugcagcgcugacacuucgcugggagacagagccgauacaucucucccucaaacccagggccccgggcuucuguguaguccaggaguauccgcagccgcucuagcccugcagugggcggagagcccucccgcagacgaucaucacgugcagaggacugccgucgaaaaggacguggaggauuucauaacaaccucauuugacucccaagagacgcucucuagcccaccgccuggcuuggaagguaaagcugaucgcagugagaaguccgacgggagcggauucggcgccagacugucucccggcucagggggaccagaagcacagacugcuggucccguuaccccugccaguauuuccggccgguuucagccacuucccgaggcuaugaaggaaaaagaggugaggccuaagcaugucaaagcccuguuacaaauggugcgugaugagagccaccagauccucgcacugucugaaggguuggcgccgccaucgggagagccccacccuccccgaaaggaagacgagauucaggauaucucacugcauggcgguaaaacacaggaaguaccaaccgccugcccugacuggcgcggggaucuccuucaagucgugcaggaggcuuucgagaaggaacaggagaugcagggaguugaacugcaacccagacuaagcggcuccgaccugggcgggcacaguucucucuuggagcggcuggagaaaauaaucagggaacagggagacuuacaggaaaagagccuugaacaucugcgccucccagauagauccucacuguugagugagauucaggcccugcgggcacaacucaggaugacucaccuucagaaccaggaaaagcugcagcaccuacgaacagcucugaccucugccgaggcacgugguagccaacaggagcaucaguuaagacgccaaguggaacuccuggccuauaaagucgagcaggaaaagugcaucgcgggcgacuugcagaaaacacuuuccgaggaacaggagaaggcuaauucagugcaaaaacugcucgccgcagagcagacuguugugcgggaucugaaguccgacuugugugaaucuaggcagaaguccgagcagcugaguagaagccuaugcgaaguccaacaggaggugcuccagcuucgcucgaugcuguccucuaaagaaaacgaguuaaaggccgcucugcaggagcucgaaucagagcaagggaaaggacgggcccugcagagccaguuggaagaggagcaacuuaggcaucugcagcgagaaagucaguccgcaaaggcucucgaggaacugagagccucucuagagacccagcgggcgcaaagcucaagguuguguguagcucugaaacaugaacagacggccaaggauaaucuccagaaggagcuucgcauugagcacucccguugcgaagcacuguuagcccaggagagaagucaacugagcgaacuccagaaagaccuggcugcagagaagucucgaacauuggaacuuucagaggcccugaggcaugagcggcuccugaccgaacagcuaucccagcgcacucaagaggcgugugugcaccaggauacccaggcccaccaugcuuuacugcagaaauugaaggaagagaaaagcagaguugucgaccuccaagcaaugcuggaaaaggugcagcagcaagcccuucacucucagcagcagcuggaggcugaggcccaaaagcauugcgaagcacucaggcgggagaaagaagugagugcuacacugaagucgacugucgaggccuugcacacccagaaacgcgagcuuagauguucccuggaacgagagagggaaaagccugcguggcuacaggccgagcucgaacagagccacccgcggcugaaagagcaagagggccguaaggcagcucgcagaucagccgaagcaaggcagucucccgccgcugccgagcaguggcggaaauggcagagagauaaggaaaaguuacgcgagcuggaauugcaacgacagagggaccuccauaaaaucaagcagcugcaacagacgguacgggaucuugagagcaaagacgaggugccagguuccagacugcaccucgggagugcgcgucgcgcugcaggaucagacgccgaucauuugagggaacagcagcgggagcuggaagcuaugagacaacgacuucugucugccgcaagguuacuaaccagcuuuaccucccaggccguugaccgcacugugaacgauuggacaaguagcaaugagaaggcugucaugucccuccugcacacccuggaagaguugaaaucugaccucucacggccuacuagcucgcagaagaagauggcggccgagcugcaguuccaauucguggauguucuucugaaagacaacguguccuuaacaaaggcacucaguaccgucacgcaggaaaaacuggaguugucuagagccgugagcaaacuugaaaaacugcuaaagcaucaccuccagaagggcugcucacccuccaggucugagcgcagugcuuggaaaccagaugagacugcaccucagagcucccugcgucggcccgacccgggcagacugcccccugccgcuucagaagaggcccacaccagcaauguaaagauggaaaaauuguaccuccauuaccugcgagcggagucuuuuaggaaggcacuuauauaucagaagaaguaccuguuacuccugauugggggauuccaggauagugaacaggagacacuauccaugaucgcccacuuggguguguuucccagcaaggcugagcgcaaaaucaccucacggccauucacaagauuuaggacugccguucgcgucgugauugcaauccugagacuucgguuccucgugaagaaauggcaggaagucgaccgaaagggcgcucuggcccaagggaaagcgcccaggccuggaccgcgugccagacagccccagucuccaccucggacccgcgagucgcccccuacgagggauguuccaagcggccauacacgagaccccgcuagaggucggcgccuggcagccgcugcaagcccucacagugggggaagggccacuccaucucccaacuccagauuggaacggagccuuaccgcuucacaagauccggagcauagucucacagaauauauucaccaccuggaggugauacagcagcguuuaggcggcguacugccugacuccaccagcaagaagucuugucauccaaugaucaaacaguga

SEQ ID NO: 60445 - RNA, 6414 nt, Artificial Sequence
  derived and/or modified sequence opt3 from PCNXL2__Homo_sapiens__NP_055616
auggugagccagguccugcaacuccuuagacagggcguuugggcagcucugaccgggggaugguaccacgaccccgaacaguccaaguucacuaacucuugccauuuguauuuauggcuguuuuuacuccugcuuccucuggcauugcaccucgccuucccaccgaaugcgaucauuguguuuuucuacuguucagcuguaacuauauuuuucacgaucauuaaacuggugaguuauaggcugcaucucauguuugauaagggugaagucauccagcaaaaacccagccggaaggaagaaaaaccuaacaaggacaaggaagccaaaggcgaacacauuaccaaucaucgcaacccauccaauaaccgacagauccacaaugggaagaaagaggaggcaucucguaacuuaucgacacccccucugagaugcucaagcaggggacagaguauaacuucccaccauucuagcggcccacuugaauuguccgcccaggagaccguggaagaucugaaggguguuauccugcucgaggaccaccccauugcuccugugucaaguacaagcccagggaucaaagucgagucucugccggcaucccaagcccauaugcuugaaaccacuacaaagucagugauucccguuaagccuguugcuaccgagacgcugaucaauggaaaaggcaaggaacggggcgggaaaggacagccacccuugcgccacagaagcgaggguggccucguggauaaggggccucugaaaaaguuaccacaccugagucucucucaguacgaccuucuggaaacugaugucuccuuccagcccuggggaagcgagaacucgguguugauaccggagccugugucuugucccaggggcuccauucgggaacgcguccaaucaaaaaguccacaggacagccucuccucuagcugcccucagugugauaccaucguugccaagcccguggaggaaccagcggacacaucaugccaaguagauacaaguugucagggugaccugccccuccaucaggagguggauuccagcgacucugaagucgcagugacccugauugacacaucacagccuggggauccacuuagucugcacgagccgaucaagaucguuauuaccaugagcuccacgcccaauucuaugacugacuuggagucgagccuccaucugcgaguggucggaacagagaagaccuccgugaagucagaugccgagccuacuaacccaggcgcugccggcagucccaaugcagaacaaauaucuaucccuguaauuacauuagaccugccagaagggggagguggcgggguucccugcccggaaggaaacggcagcgagagaaccccugagaggcucaaaacgcggguguccaccaaucaguguucagguuaugggagcggcgaaggaggcaacgcuaucaaggaucacucuuccaguagccgugagccaugggaaucugucucccgccucacacccgacacugggucagagaguaaagugggaaaggagggucagaccaaccuggauccuagcucgugcaaguccucucaugagaagagacacgccaggguccuuagcguggacucaggcacagauguauuuuugaguaaguccucugcggagauagugaaugacacugagaaaaccaugcccacaagcaaguccgaucuggaggccaaagaagggcagaugccaaacgagucaaauuuccucgaguuuguaagccugcuugaaaguauuaacaccucuaagaugacugcauccagccaacugaauggaucggcugagcagaacgaagagucaggcuugcuccgggacaauuguucucaggaaaagaaagaggagauccuggaaaacgagaagccuaguggucacuccagcaaacaggggaagcccgacuuacaaucucaggaucauacgagcacaggcccagccugcacccagccggcuaaaacuaccgccuucuuucagggaaaucgacaacgccagaucauuuacagagucacaucccagcaagacucaagugugcugcagguuaucagcggcccugaaaccucugugcaggaggaaauuuccgucgaugcaaugcacguguucauagacgagcauggggagaucaggucaugcuaucuaaagaguggaaaccagaaggaagguccccuccaaccacugcccagcaauaacgauugucuuucccaggcccgggagaugcagguaucuucgagcucaacuacaacguccgaaagucaggacccuucuagcggcgauccagcuguguccgcguugcaacagcagcugcuccugaugguugcacgcagaacccagucagagacucccaggcacgucucucaagacuuagaggccagcaguugcuccagcacacaggggaaauucaaucgugaacaguuuuacaaguucauuaucuuuccuggaaaauggaucaaggugugguacgaucggcugacccuuuuggcucuccuggaccgaacagaggauauuaaagaaaacgugcuagccauacugcucaucguccugguuucucuuuugggcuuccugacuuuaucacaagguuuuuguaaggacaugugggugcuccuguucugccuugugauggcauccugucaguauagucuguugaaaagcguacagccggauccagccucgcccauucacgggcauaaucagaucauuaccuacucuagaccuaucuauuuuugcguccucuguggccugauacuacugcucgacacgggagcuaaggccaggcacccacccuccuacgugguuuauggccugaaacuuuucagcccuguguuuuugcaaucagcacgcgacuaccugaucgucuucuuauauugcuuuccggcgauuagucuccuggggcuuuucccccagaucaacaccuuuuguacauaccugcuagagcagauugauaugcuauucuucggaggcucugcuguguccgguaucacuagcgccguuuacucaguggcacggaguguacuggccgcugccuugcugcaugcagucugcuuuagcgcugugaaagaaccaugguccaugcagcacauaccugccuuauucucugcguuuugugggcuccugguggcccuuagcuaucaucuguccagacaaucaucugaccccagugucuugaugucguucauucagugcaggcucuuuccaaaguuccugcaccagaaccuagcugagagcgcagccgauccucugcccaaaaagaugaaagacuccguuaccgaugugcuuaagugggaccucaucguaugcgcuguggucgccgugcugucuuuugcaguuucagcgagcacaguguucuugucccugcgcccauuuuuaaguauuguccucuucgcccuggcuggagccgugggcuuuguuacucacuacgugcuuccgcagcugcgaaagcaucacccuuggauguggaucucucaucccauauugaaaaauaaggaguaucaccaacgggaaguccgugauguagcacaucucaugugguucgagagacuguacguguggcuacaguguuuugaaaaauauauccuguacccagcucuuauucucaacgcccugaccaucgacgcauucuugauuagcaaucacaggcgcuuagguacgcacugggauaucuuccugaugauaauugccggcaugaagcuccugcggacaucauuuugcaaccccguuuaucaguucaucaaucuuuccuuuaccgugaucuucuuucauuucgacuacaaagauauuagugagagcuuucuguuggacuucuuuauggucucuauccuauucuccaagcugggggaucuccugcacaaacuucaguuuguguuaacuuacguagcuccuuggcaaauggcguggggaagcucauuccauguguucgcccagcuguuugcaauuccacacucggcuaugcuauucuuucagacaauagccaccucuaucuucaguacucccuuguccccuuuucugggcagcgucauuuucaucaccucauauguuagaccggugaaauuuugggaaaagaacuacaauacaaggcgaguggacaacuccaauacgcgccucgccguccaaauugagcgggacccagggaacgaugacaauaaccuaaauucuaucuucuaugagcaccuuaccagaacucugcaggagagcuuguguggagaucuagugcugggcagaugggguaacuacaguuccggggacugcuuuauacucgcuagcgaugacuuaaaugcauucguucaucugaucgagauuggaaacggccuuguaacauuucagcugcguggucucgaguuccgcggcaccuauugucagcaacgggagguggaagccaucauggagggggaugaggaagacagaggaugcuguugcuguaaacccggccacuugccucaucugcucucuugcaacgcggcuuuucaccugagguggcuuacaugggagauuacucagacccaguacauccuagaaggguauucaauacuggauaauaacgccgcaacgauguugcaggucuucgacuuacgacggauucugauccgcuacuacaucaagaguauuauauauuacauggugacaucccccaaacuccugagcuggaucaagaaugagucucuucugaagucgcuccaaccauucgccaaauggcauuauauugagagagauuuggcuauguuuaacaucaauauugacgacgauuacguuccuugucugcagggaaucaccagggcaucauucugcaacguguaucuagaauggauacagcacugcgcccggaagcgacaggagcccagcacuacccuggacuccgaugaagacaguccacucgucacacuuucuuuugcgcuguguacuuuaggcagacgcgcuuuggguaccgccgcacacaauauggccaucagccuggauuccuuccucuacgggcugcaugugcuuuuuaaaggagacuucaggauuacagcucgugaugaguggguauuugccgacauggaucugcuccacaaggucguggccccugcuauccggaugucauugaaacugcaucaagaccaguucacgugcccggaugaauaugaggaccccgccguuuuauacgaggcgauucagaguuuugaaaagaaaguggucaucugucacgagggcgauccagccuggagaggugcagugcuaucuaacaaggaagaacugcucacccuuaggcacguuguggacgaaggcgcugacgaguacaaggucauaaugcugcaucgcagcuucuuguccuuuaaagugauuaagguaaauaaagagugcgugcgagggcugugggccggacaacagcaggaacucaucuuccugagaaaccggaauccugagaggggcucaauccagaacaauaagcaaguucuucgcaaccucauuaauagcucuugugaucagccccugggguauccaauguacgucuccccuuugacuacaaguuaucugggaacccaccgucagcugaaaaacaucuggggcggucccauaacucuagacaggauucggacaugguuuuggaccaagugggugaggaugcgcaaggauugcaacgcucgacagcauagcgggggaaauaucgaagacguggauggcggcggggcaccgacgacuggagguaacaaugccccaucgggcgggucccaagagucuucagccgaacagccuagaaaaggaggcgcucagcacggugucagcaguugugaggggacccagcggacaggaaggcgcaagggcagaucccaaucuguacaggcgcauagcgcacuaucacagaggcccccaaugcucuccaguagcggccccauucuugagucucggcagaccuuccugcaaacuucaacauccgugcacgaauuggcccagcgucugagcgggucucgccucagucugcacgcuucggccaccucccuucauagccagccuccgcccguuacaacuaccggacacuuaucagugcgagagagagcagaagcccugaucaggucuagccucgguuccaguacgucaucuacauugagcuuccuguuuggcaaacgguccuucaguagcgcucuagucauauccgggcugucugcggccgagggaggcaacaccucagacacucaaagcucguccagugugaauauuguuauggguccaucugcacgcgcugccagccaggcaaccagacaucucucagagccuugcgaacccccugaugccacagagcaggggcagcuucacgacaggugucuggcugaagccguggcggauacuuugggagucgugugccggcgagcaucccaagaggacaugggccuggaugacaccgccucucagcagaguguaagcgaugaacaguga

SEQ ID NO: 60446 - RNA, 2817 nt, Artificial Sequence
  derived and/or modified sequence opt3 from PCNXL4__Homo_sapiens__NP_071940
augcccgcccuggagcacaugaaccagauccuccauauucuuuucguguuucugccuuucuugugggcuuuaggcacccugccaccgcccgacgcacuacuccugugggccauggaacaaguccuugaguuugggcugggagguagcuccaugucuacacacuugagacuccugguuauguucauaaugucagcgggcacugcuaucgccaguuacuuuauuccuagcacgguggggguagugcuguucaugaccggauuuggcuuccucuuaucccugaaucuuucugauaugggucauaagaucgggacaaaaucgaaggacuugccaucaggacccgaaaaacacuuuagcuggaaggagugccuguucuauauuaucauccuaguccucgcacugcuugaaaccagucuguugcaucacuuugccggcuucucccagauaucuaaaagcaacucccaggcuauugugggcuacgggcucaugauccuguuaauuauccuguggauacucagggagauucagucaguuuauaucauuggaaucuuucggaauccuuucuacccaaaggaugugcaaacugucacaguguucuuugagaagcagacccgccuuaugaaaaucgguauuguacgacguauacuguugacucuaguuagucccuucgcaaugaucgccuuucugagccucgacucuucccugcagggccuucacucagugagcgucuguauuggguucacaagagcuuuuaggaugguguggcagaacaccgaaaaugcccuguuggagacggugaucgucaguacuguucaucucauaucuuccaccgauauuugguggaaccggagccuggacacaggauuacgccugcuacucgugggcaucaucagagauaggcugauucaauucaucucgaaacuucaguuugcgguaacuguguugcugaccucuuggacagaaaagaagcagcggcgcaaaaccacggcaacucucugcauucugaauauagucuucuccccuuuugugcuuguuaucauuguguucucaacacuguugaguagcccacuccugccguuauuuacccugcccgucuuccuaguggguuuuccucgaccaauccaguccuggcccggggccgcuggaacuacagccuguguaugcgcagacaccguuuauuacuaucaaauggugccuagacucacggcuguccugcagaccgccauggcggccggcucucuuggcuugcugcucccagggagccacuaccugggaagguuccaggaucgguuaauguggaucaugauucuggagugugguuacacauauugcucaauaaacaucaagggccuugaguugcaagaaaccaguugucauacugcagaggcucgucgcguggacgaagucuucgaggaugccuuugaacaggaguacacaagagugugcucccucaaugagcacuucgggaacguucugacucccuguaccgugcuaccgguaaagcuguauagcgacgcuaggaauguccucucuggaauuaucgauucacacgaaaaccugaaagaguuuaagggcgaccuuauuaaaguguugguuuggauccuggugcaguacugcaguaagcggccugguaugaaagaaaauguccauaacacagagaauaaggggaaagcccccuuaaugcucccagcacugaacacccuuccucccccaaagagccccgaagacauagauucccugaacucugagacuuucaaugacuggucggaugacaacaucuuugaugacgagccuacgauuaagaaagugaucgaagagaagcaccaguugaaagaucucccaggcacaaaucuguucauuccgggaagcguagaaucccaacgagugggcgaccauucaaccgggacuguucccgagaacgaucuauauaaggccguccugcucggauacccugcuguggacaaagguaagcaggaagauaugccauauaucccccugauggaguuuaguuguucucacagccaucuugugugcuugccugcggaguggcgcaccuccugcaugccaucaagcaagaugaaagaaaugucuucccuguuccccgaggacugguaccaguuugucuuaagacagcucgaauguuaccacagugaggagaaggcaagcaauguucuggaagagauagccaaagacaaggugcuuaaagauuucuaugugcacacaguaaugaccugcuacuuuucucuguucggcauugacaacauggcuccguccccugggcauauccuaagggucuauggaggcgugcucccauggucaguugcccuggauugguugacugaaaagcccgagcuguuucaauuagcacucaaggccuuccgguacacacugaaacuuaugauugacaaggcuagucuggguccuaucgaagauuuccgcgaguugauaaaauaucucgaggaauacgagagagacugguauaucgggcuggugagcgaugaaaaguggaaagaggccauucuacaggaaaagcccuaccuguuuucgcuuggcuacgacuccaauaugggaaucuauacgggcaggguccucucucugcaggaguugcugauucagguggggaaguuaaacccagaggcaguucguggacaaugggcgaaucucagcugggaacugcuuuacgcuaccaacgaugacgaggaacgguauucaauccaggcccacccucuguugcuccgaaaucugacugugcaggcagccgagcccccacuagguuacccgauauauaguuccaaaccucugcauauucaccuuuacuga

SEQ ID NO: 60447 - RNA, 1248 nt, Artificial Sequence
  derived and/or modified sequence opt3 from PCOLCE2__Homo_sapiens__NP_037495
augagaggcgccaacgcuugggcaccccugugccuccuucuggccgcggcuacccaguugagcaggcaacaguccccugagcggccaguguucacaugugggggaaucuuaacuggugaaucuggcuuuauugggucagagggauucccgggcgucuaucccccuaauaguaagugcacguggaaaauaaccguuccagaagguaaggugguagugcugaacuuucgcuucaucgaccuagagagcgauaaucucugucgauacgacuuugucgauguguacaacgggcacgccaauggacagcguauuggcagauucugcggcacauuuaggcccggggcacugguuuccucuggaaacaaaaugauggugcagaugaucucggacgccaauacugcugguaacggcuucauggcaauguuuucagccgcugaaccuaaugagcgcggggaucaauauuguggaggccuucuggaccggccaagcgguaguuucaagacccccaacuggccugauagagacuacccagccggggucacaugcguguggcauauuguagcgccgaaaaaucaguugaucgagcucaaguuugaaaaguucgauguugagagggacaacuauugucgguacgauuauguggcagucuuuaauggaggcgaagugaacgacgcccgccgaauaggcaaauacugcggggauucucccccugcuccaaucguguccgagagaaaugagcugcugauucaguuccucagcgacuuaucccugaccgccgacggauucaucggucacuacauuuuuaggcccaagaaacuuccuacuacaaccgaacagccagucacgacuaccuuccccguuacaacuggcuugaagccgaccguggcacugugucaacagaaaugccggcguacagggacccuagagggaaacuauuguucaagugauuuuguacucgcuggcacggugaucacuacaauaacccgcgacgguagccugcaugccacugucucuauuaucaacauuuacaaggaagggaaucuugcgauccagcaggccggcaagaacauguccgcaagacugacagugguuugcaaacaaugcccuuugcucaggcggggacugaauuauaucauuaugggccaggugggggaggauggacgagguaagauaaugcccaacucauucaucaugauguuuaaaaccaagaaucagaaauuacuggacgcucucaagaacaaacaauguuga

SEQ ID NO: 60448 - RNA, 1350 nt, Artificial Sequence
  derived and/or modified sequence opt3 from PCOLCE__Homo_sapiens__NP_002584
augcugcccgccgcuaccgcaagccuccuuggcccucuguugacagccugcgcguuacugccauucgcucaggggcaaacuccgaacuacacgagacccguguuucuauguggaggugacgucaagggcgaguccggguauguugccucugaaggauucccuaaucucuacccacccaacaaagagugcaucuggaccauuacagugccugaaggccagacuguaucacugaguuuuaggguguucgaucuugagcugcacccagcaugucgguaugacgccuuggaagucuuugcugguagcgggaccuccggacagcgccucggccgauucugcggcacauuucgucccgcaccucugguggccccagggaaucagguuacccugagaaugacuacagaugagggaaccgguggcaggggguuccucuuaugguacucuggacgggcuacgucgggcacugagcaucaauuuuguggugggcgccuggaaaaggcccagggaacccuuacaacuccgaacuggcccgagucagacuauccuccaggcauaagcugcaguuggcacaucauugcgcccccugaucaggugaucgcauugaccuucgaaaaauuugaccuggagccagauacauacuguagauaugacuccgucucuguguucaauggcgccguaagcgaugacuccaggcggcuagggaaguuuugcggagaugcuguucccgguucaauuaguagcgagggcaacgaacuccuggugcaguucgucucugaccuuuccgugaccgccgauggguucucagcaagcuacaaaacgcugccgcgcggaacugcuaaggagggccaagguccugggcccaagcgaggcacagaaccaaaagugaaguugccucccaaaagucagccacccgagaagaccgaagagucuccuuccgccccagacgcgccgacuugucccaaacagugcagaaggacaggaacccuccagagcaauuuuugugccucgucucuggucguuacggcaaccgugaaguccaugguacgggagccuggcgaaggguuagcugugacagucucacugaucggagccuacaagacugguggccucgaccuuccaagucccccuaccggggcuagccugaaauucuaugugccaugcaagcaaugucccccgaugaaaaagggaguuuccuacuugcuaaugggccagguggaggaaaaccgugguccuguccugccacccgagucuuuugugguacuccaucgcccuaaucaggaucaaauacugacaaaccuuagcaaaagaaagugccccucacagccaguuagggccgcagccagucaggacuga

SEQ ID NO: 60449 - RNA, 411 nt, Artificial Sequence
  derived and/or modified sequence opt3 from PCP2__Homo_sapiens__NP_777555
augauggaccaggaggaaaagaccgaggaaggcagcgggcccugcgccgaggcuggauccccugaucaagaagguuucuuuaaccugcucucucacgugcagggcgacaggauggaggggcagagguguucacuucaggcaggaccaggccaaacaacuaaaagucagagcgauccgacgcccgagauggacucccugauggauauguuggccucuacccagggucggcgcauggacgaucagcgagucacaguuucgucauuaccuggguuccaaccagugggaagcaaggacggcgcgcagaaacgugcuggcacucugaguccccagccucuacucaccccacaggaucccacagcccugggguuuagaagaaauuccucuccucaaccaccgacccaggcacccuga

SEQ ID NO: 60450 - RNA, 189 nt, Artificial Sequence
  derived and/or modified sequence opt3 from PCP4__Homo_sapiens__NP_006189
augagcgagagacagggcgccggggcuaccaacggaaaggacaaaacauccggugaaaaugauggccaaaagaaagugcaggaggaguucgacaucgauauggacgcacccgaaacugaaagggccgcggucgcuauucagucucaguuucggaaguuccagaaaaagaaggccgggucacaaaguuga

SEQ ID NO: 60451 - RNA, 2262 nt, Artificial Sequence
  derived and/or modified sequence opt3 from PCSK1__Homo_sapiens__NP_000430
auggagagaagggccuggagccugcagugcaccgcuuucgugcucuuuugugcauggugcgcccuuaacuccgcgaaggcuaaacggcaauucgucaaugaaugggccgcagagauccccggcgggccugaagccgcuucugcaauugccgaggaacugggauacgacuuguuaggucagauaggcucacuggagaaccacuaucuauuuaagcauaaaaaucacccacgccgaagucguagaagcgcuuuccauaucacaaagaggcucuccgaugacgaucggguuauuugggccgagcagcaguacgaaaaagagcgcucuaagagaucggcgcugagggacucagcacuuaaccuguuuaaugauccgauguggaaccaacagugguauuugcaggacacucggaugacggccgcucuccccaagcuggaucugcacgugaucccuguauggcagaaagggauuaccggaaagggcguggucaucacagugcucgacgaugguuuagaauggaaucauacugacauauacgccaacuaugauccagaggcaagcuacgacuucaaugauaacgaccacgaccccuuuccucgcuaugauccaaccaaugagaacaaacacgggacacgaugugcuggagaaaucgccaugcaagcgaauaaccauaagugcggcguuggcguggccuacaauaguaaagucgggggaauuagaaugcuggacgguaucgugaccgaugcaauugaggcuuccucuaucggcuucaaccccgggcacguagacauauacagcgccuccuggggaccuaacgaugacggcaagacuguugaagguccagggaggcuugcucagaaggccuuugaguauggagugaaacagggccggcagggcaaggggucaauuuucgucugggcaaguggaaaugguggccgucaaggggauaacugugacugcgauggauacacagacagcaucuauaccauuucuaucuccucagccagccagcagggcuugaguccgugguacgcugaaaaauguucuuccacgcuggcgacuagcuauucgucuggugauuacaccgaccaacgcaucacauccgcagaccuacauaaugauugcacugagacccacacagggaccucagccagugcuccccucgccgcaggcauuuuugcccuggcucuugaggccaacccuaaucugacguggagagacaugcagcacuuggugguguggacuagcgaauaugauccacucgcaaacaaucccggauggaagaaaaacggcgcggggcugauggucaauuccagguucggauuugguuuacugaacgcuaaggcccucguugaccuugcagauccucggacauggcgaucugugccagagaaaaaggaauguguagugaaggacaaugauuucgagccccgcgcccugaaagcuaacggcgaagucauaaucgagauuccgaccagagccugcgaggggcaggaaaaugcaaucaagagcuuggagcaugugcaguucgaagcuacuauagaguacucaaggcggggagaccuacacguuacacugaccagugccgcgggcacguccaccgugcuccuggccgaacgcgagagagauacaagcccuaacgguuuuaaaaauugggacuucaugucuguccauacuuggggcgagaaccccauugggaccuggacacuuaggaucacugauaugucaggacguauccaaaacgaaggccggauugugaauuggaagcugaucuugcacgggaccaguagccagccagagcauaugaaacagccucgaguauacacauccuauaacaccguucagaaugacagaaggggaguggaaaagauggucgaucccggugaggagcaaccaacucaggaaaaccccaaggagaauacgcucgugucuaaaucgccuagcuccucaagugucggcgggcgccgggacgaacuggaggaaggagcuccaucucaggcaauguuaagacugcuacagagcgccuuuuccaagaacucaccgcccaaacaaagcccuaagaaaucuccauccgcuaagcucaauauucccuacgagaacuucuaugaggcccuggaaaaacuuaauaagccuagucaguugaaggacagcgaggauucucuguacaacgacuauguggauguguuuuacaauacaaaaccauauaagcacagggacgaucgccuccugcaggcacuuguugacauacugaacgaagagaauuga

SEQ ID NO: 60452 - RNA, 783 nt, Artificial Sequence
  derived and/or modified sequence opt3 from PCSK1N__Homo_sapiens__NP_037403
auggccggcagcccccugcucugggggccuagagcuggaggugugggccuucuggucuuguuacugcuagggcuguucaggccaccgcccgcacugugcgcccggccuguuaaggagccacgcggacuuuccgcggcuucucccccucuggccgaaaccggcgcaccacgacguuuuagaaggucagugccccggggugaggccgcuggggcaguacaggaauuggcccgcgcucucgcccaccuccuggaggcggaaagacaagagagggcacgggccgaggcucaggaagccgaggaccagcaggcacgcgugcucgcucaauuacugcgagucuggggagccccuagaaacagugauccagcgcuuggcuuggacgaugacccggaugcccccgcagcucagcuggccagggcucuacuccgggcccgucuggacccugcagcccuugcugcgcagcuggugccagcacccguuccugccgcugccuugcgcccaagacccccgguguacgaugacggcccugcagggcccgaugccgaagaggcuggagacgagacaccagaugucgacccugaacuccugagguauuuacugggucggauccucgccggcagcgcagauuccgaggggguggcggcuccccgacgccuuagaagggccgcagaccaugacguaggaucugaacugccacccgagggcguuuugggugcccuacugcgggugaaacgccucgaaacuccugcuccacaggucccggccagaaggcugcuucccccuuga

SEQ ID NO: 60453 - RNA, 1860 nt, Artificial Sequence
  derived and/or modified sequence opt3 from PCSK2__Homo_sapiens__NP_001188457
augguguucgccagcgcugagagacccgucuuuaccaaccacuuccugguugaacuccauaagggcggggaggacaaagcaaggcaaguggccgcggaacacggauuugguguacggaaacuuccuuucgcugagggccuguaccauuuuuaucacaauggguuggccaaggcaaagcgccgacguuccuuacaucacaaacagcagcuggaaagagauccaagggugaagauggcccuacagcaggagggauucgaccggaagaaacgcggcuacagagauaucaacgagauugacauaaauaugaacgauccgcucuuuacaaagcaaugguaucugaucaauacuggucaggcugacgggacgcccggacuugaucugaacgucgcagaagccugggaguugggcuacaccggcaaaggggugacaauuggaaucauggacgaugguauugacuaucuccacccugaucuggcuucuaauuacaacgccgaagcgucauaugacuucaguagcaaugauccauaccccuacccuagguauacugacgacugguuuaacucccauggcacccggugcgcaggggagguuucugccgcugccaauaacaauaucuguggagugggcgucgcauacaacucgaagguggcugguauacgcaugcuggaucagccauucaugacagacaucauugaggccucaagcaucagucacaugccccagcucauugauaucuauuccgcgucuugggggccuaccgacaauggaaaaacuguagauggcccacgagaauuaacacugcaagccauggcagacggcguuaacaaggggagaggagguaagggcagcauauacgugugggcuuccggggauggaggcucauaugacgauugcaacugugacgguuacgccaguagcauguggaccauuucuaucaauuccgcuauuaacgaugggaggacggcccuuuaugacgagucaugcagcaguacuuuggcaucuaccuuuuccaauggccggaaacguaacccggaagccggagucgcuacaacugaccuguacggcaauuguacccuacgccauagcgggacaucggcggcagcccccgaggcugccggaguguucgcacucgcccuggaagcuaaccuuggucugaccuggagagauaugcagcacuugacggugcucacuucuaagaggaaucagcugcacgacgagguccaucaguggcggcgaaacggcguuggguuagaguuuaaucaccuguucggauacggcgugcucgaugccggugcaaugguaaaaauggcgaaggacuggaaaacagugccugaacgcuuccauugcgucgggggcuccgugcaagauccagagaagauccccucaaccggaaaacuuguucugacuuugacaaccgacgcuugugaaggcaaggagaacuuugugagauaucuagaacacguccaggccgugaucacgguaaaugcaaccaggcgcggggaucugaacauuaauaugacaaguccuaugggaacuaagagcauacuccugucccggagaccaagggacgaugacucuaaaguugguuucgauaaguggcccuuuaugaccacacauacuuggggcgaggacgcccgugggaccuggacacuugagcugggauucgugggcagcgcuccgcagaaaggugucuugaaggaauggacccucaugcugcacgggacucaaucagccccuuacaucgaucaggugguccgggacuaucagaguaaauuagcaauguccaagaaggaggaacuggaggaggaacuagacgaggcuguggaacgaagccucaaaucuauucugaacaagaauuga

SEQ ID NO: 60454 - RNA, 2268 nt, Artificial Sequence
  derived and/or modified sequence opt3 from PCSK4__Homo_sapiens__NP_060043
augagacccgccccuaucgcucuguggcucaggcuugugcuggcauuggccuuaguccggccacgcgcgguuggcugggcuccggugcgagcccccauuuacguaagcuccugggcagugcaggucucucaagggaaccgugagguggaaagacuggccaggaaguucggauuuguuaaucuagguccuauauucccagacggccaguauuuucaccuccggcaucgcggggugguccagcagucacugacaccccacuggggacauagacuucaccugaaaaagaacccuaaagugcaaugguuccagcagcagaccuugcaaaggcggguaaagcgcaguguuguggucccaacugaucccugguuuagcaaacagugguacaugaacuccgaggcucagccugaccucucuauccugcaggcauggucgcaaggccugucaggucaggggauuguggugagcguccucgaugacggaaucgaaaaggaucauccagacuuaugggccaauuaugauccgcuggcuaguuacgacuucaaugauuaugaccccgauccucagccacgauacacgcccuccaaggagaacagacacggcaccaggugcgccggcgaaguugcggcaauggccaauaacggguuuuguggaguggguguagcuuucaaugcccggauuggcggggugcguaugcuugacggaacaaucacugaugucauagaggcacaaucuuugagccugcagccucagcacauccauauuuauuccgcuucauggggcccagaggacgacggucgcaccguggaugggcccggaauccuaacaagagaagccuuuaggcggggcguuaccaaaggccgagggggacucgguacucuguucauuugggcgaguggcaacgggggacuucacuacgacaauugcaacugugauggcuacacaaauagcauccauacccugucuguggguuccacgacucagcaagggcgcgucccgugguauucagaggccugcgcaagcaccuugacaacuaccuacaguucuggcguggcuacagacccucagauaguaaccacggaucuccaccacggauguacugaccagcauacaggcaccuccgccagcgcuccccuggccgcagggaugauugccuuagcucuggaagcgaacccauuucucacuuggagagauaugcagcaccuuguugugagggcaucgaagccugcccaucugcaagcugaggacuggcggacaaauggagucggucgccaggugucucaccauuauggcuacggguugcuagaugccggacugcucgucgacaccgcaagaacguggcugcccacccagccacagaggaaaugcgccgugcguguucaaucccggcccacaccuauccuuccacugauuuauauccgagagaacgugucagcuugugccggcuugcacaacaguaucagaagccucgaacacguacaggcacagcugacuuuauccuacucuaggcgcggugaucuggagauuagccuaaccucaccgauggggacacggaguacucucgucgcgauaagaccccuggacguguccaccgaaggcuauaauaacuggguuuucaugagcacacauuuuugggacgagaauccucagggaguguggacccuuggcuuggaaaacaagggguacuacuucaauacuggaacgcuguauagguacacacuccugcuuuaugguaccgcugaggauaugacugcccgcccaaccggcccccaagucacaucuucagcaugcgugcagcgagacaccgaggggcugugucaggccugcgauggaccugcuuacaucuugggccaacucugucuggccuauugcccaccccgguucuuuaaccacacucguuuaguaacagcagguccggggcauacggcugccccugcgcugagagugugcaguagcugucacgccuccugcuacaccuguaggggcggaucuccacgcgacugcacuucgugucccccuagcuccacacuagaucagcagcagggcucaugcauggggcccaccacaccagacagucggccuagacucagggcugcagccuguccccaccaucgaugcccagcuucugccaugguucugagccuuuuggcagucacucugggaggcccggugcucugugguauguccauggaucugccuuuauaugcguggcugucacgcgcccgggcuacccccacgaaaccacaaguguggcuucccgccgggaccuga

SEQ ID NO: 60455 - RNA, 5583 nt, Artificial Sequence
  derived and/or modified sequence opt3 from PCSK5__Homo_sapiens__NP_001177411
augggcugggggagcagaugcuguugccccggcaggcuggaccuccuuugugugcuggccuuguuagguggcugccugcuaccugucugucggacccgcguuuacacaaaccacugggcugugaagaucgcagggggauucccagaagccaaucgaauugcguccaaguauggcuuuauaaacaucggucaaauuggggcucucaaggauuacuaucacuucuaccacucucguacuaucaaaagaucaguaauuaguagcaggggaacgcauuccuuuaucucuauggaaccgaagguggaguggauacaacagcaggucgugaaaaagcggaccaagcgcgacuaugauuucucgagagcccagucaacauacuuuaaugaccccaaauggccuagcaugugguauaugcacugcagugauaacacucauccaugucaauccgacaugaauaucgaaggcgcauggaagaggggcuacaccgggaaaaacauuguugugacaauccuggaugacggaauugagcggacccaccccgaucuuaugcagaauuacgacgcccuggcuucuugcgaugucaacgguaaugacuuggauccuaugccacgcuaugacgcaagcaacgaaaauaagcacggcacucgaugugccggggagguggcugccgcggcaaacaauucccauugcacaguaggaaucgccuucaacgcuaaaauaggcgguguuagaaugcucgacggggaugugaccgacauggucgaggccaagucagugaguuuuaauccccagcacgugcauauuuacagcgcaucuuggggaccugaugacgauggcaagacggucgacggcccagcuccgcugacuaggcaggccuucgaaaacgggguucggaugggacgucgcggucugggcuccguguuuguaugggcgucagggaacggaggcagaagcaaagaucacuguaguugcgacgguuauaccaauucuaucuacacaauuuccaucagcucgacugccgagucugggaagaaacccugguaucucgaagagugcuccucaaccuuagcaacaaccuacaguagcggcgaguccuaugauaagaaaaucauuacgacugaccugaggcaacgguguacagauaaccacaccggaacuucugcuagcgccccuauggcugccggcauaaucgcacuugccuuggaagcuaauccauuccugacauggcgagacgugcagcaugucauugugcgcaccucaagagcggggcaccuaaacgcaaaugacuggaagacgaacgccgcuggauuuaaaguuagucaucucuacgguuucggccugauggaugccgaggcaauggugauggaagccgagaaguggaccacaguccccaggcagcacgugugcguagaauccacugaccggcagaucaagaccauacgcccuaauagcgcuguuagaucuauuuacaaagccucaggguguagugauaacccaaauaggcaugugaacuaucuugagcacgucgugguccguaucacaaucacucacccccggcgaggagaccuggcaauuuacuugaccagcccguccggcacaagaucucaacuccuggcgaauagguuauuugaucauucgauggaggguuucaagaacugggaguucaugaccauccacugcuggggagaacgcgcugccggcgacugggugcuggaaguuuaugauacuccuagccagcuccggaauuuuaaaacgcccggaaaacuuaaagaguggucccugguguuguacggcacaucaguacagccauauaguccuaccaacgaguuccccaaggucgagagauuuagguacucucgcguggaggacccaacugaugacuaugggaccgaagauuacgcaggacccugugacccugagugcagcgaaguugguugugauggcccagggccggaccauugcaaugacugucuacacuacuauuacaagcugaaaaacaacacacgaauuugcguguccucaugucccccuggacacuaucaugccgauaagaaacggugccguaagugcgcuccaaauugugagagcugcuucggcucucacggugaccaauguauguccugcaaauacggguauuuucucaacgaagagaccaauaguugugucacucauugccccgauggcagcuaccaggacacaaagaagaaccuguguagaaaaugcucugagaauuguaagacgugcaccgaguuccacaacuguacugagugcagggauggacuuucccugcagggcucacgcugcagugugagcugugaagacgggcgguauuuuaauggacaggauugccaaccuugucauagauucugcgccacaugugcaggcgcuggugccgacgggugcauaaacuguaccgagggauacuuuauggaggauggaaggugcguacagucguguuccaucucuuacuauuucgaccacagcucagaaaaugguuacaaaaguugcaagaaaugugauauuuccugcuugacaugcaacggcccaggguuuaagaauuguacuucuugccccagcggauaucuccuggacuuaggcaugugucagaugggggcgaucugcaaggauggagaguacguggacgaacacggccauugucagaccugcgaggccuccugugcuaaaugccaagguccgacgcaggaagacuguaccacaugcccuaugacucgaaucuucgaugacgggcgcuguguuucaaacugcccaagcuggaaguuugaguucgagaaucagugccaccccugucaucauaccugccagcggugucaaggaaguggcccuacacauugcacuucuuguggugcagauaacuauggcagagaacacuuccuguaccagggggagugcggagacuccugucccgaaggccacuaugccaccgaggggaauacgugccuaccauguccugauaacugcgaacucugucauagcguccacgugugcacaaggugcaugaaaggauacuuuauugcucccaccaaccauacuugucagaagcuggagugcggccagggugaggugcaagacccagauuacgaagagugugucccgugcgaagaggggugucuuggaugcucguuggacgauccuggcacauguaccucaugcgccauggguuauuaccguuucgaccaccacuguuauaaaacuugccccgaaaagaccuacucugaggagguugaauguaaagcaugcgauaguaauuguggcuccugcgaccagaacgggugcuauuggugugaggaaggauuuuuccugcucggcgggagcugcgugcgcaaguguggaccaggcuuuuacggugaccaggagaugggggagugcgaaucuugucaucgggcgugcgagacauguacgggacccggccacgaugaaugcagcuccugucaagagggccugcagcuucugagagggaugugcgugcaugccaccaagacucaggaagagggaaaauucuggaaugacauauugaggaagcuccagccuugucacucaaguugcaaaacaugcaacgguagcgcuacccuguguacaucuugcccaaagggcgccuauuuacuggcacaggcuuguguauccucaugcccccaggggacuuggccuaguguccgaagcggauccugugagaauugcaccgaagccugugcaaucugcucuggcgccgaucuauguaaaaagugccagaugcagccgggucauccacucuuucugcacgaggggcgguguuacucgaagugccccgaaggaagcuacgcugaggacggcauuugcgaacgcuguucauccccuugcagaacgugugagggcaacgcgacaaauugccacaguugugaaggugggcaugugcuucaccaugggguuugccaagaaaacuguccagagaggcacguggccgucaaaggcgugugcaagcacugucccgaaaugugccaggauuguauccaugagaaaaccugcaaggaaugcacuccugaguucuuuuugcacgacgauaugugucaucagucuugcccgcggggguucuaugcagacagccgacacuguguucccugccauaaagauugucuggagugcuccggaccaaaggcugacgauugugaacucugccuggagucaucuuggguguuauacgacggccugugucuugaagagugcccugccgguaccuauuacgagaaggaaacaaaagaguguagagauugccacaagagcugcuugacuuguaguuccagcgggaccugcacaacgugucagaaaggacucauuaugaauccccgcggcucuugcauggccaacgaaaaguguucaccauccgaguauugggacgaagacgcuccuggcugcaaacccugucacguaaagugcuuucauuguauggggccagcagaggaucaaugccagaccuguccgaugaauagucugcuacugaacacuacaugcgucaaggacugcccugagggauacuaugccgaugaagacagcaauaggugugcgcacugccauucgucuugucguaccugcgagggucggcacuccagacagugucacagcugcaggcccggcugguuccaacucgggaaagaaugucugcuucagugccgcgagggauacuacgcugauaacucaacuggccgaugugaaagaugcaaucggaguuguaaggguugccaggggccaaggcccacagacugcuugucuugugaucgcuuuuucuuccuguuacguuccaaaggagagugccauagaagcuguccugaccacuauuacguggagcagucaacccaaacgugcgaacggugucauccaacuugcgaucaguguaagggcaaaggcgcccucaacugccugaguuguguguggagcuaucaccuuaugggagggaucugcaccuccgacugucuggucggugaguacaggguuggcgaaggggagaaguuuaacugcgaaaaaugccaugagucuuguauggagugcaagggacccggcgcaaagaauuguacauugugcccugccaaccucgugcugcacauggaugacagccacugucuacauugcuguaauaccuccgauccgccaucagcucaggaaugcugugacugccaggacacuacagaugaguguauacugcgcaccucuaaaguacgacccgcaacagaacacuucaagacugcccucuuuaucaccaguucgaugaugcuggugcuuuugcugggugcggcugucgugguuuggaaaaagagcagagggcgggugcaaccugccgcaaaagccggauaugagaaguuagcugaccccaacaaguccuacucuucauauaaaagcuccuacagggagaguacgucuuucgaagaggaucaggucauugaauaccgcgacagagauuaugacgaggaugacgaugacgauaucguguacaugggccaggacggcacaguuuauaggaaguuuaaauacgggcuccuggacgaugacgauauugacgaacuugaguaugaugacgagagcuacucauauuaccaguga

SEQ ID NO: 60456 - RNA, 2910 nt, Artificial Sequence
  derived and/or modified sequence opt3 from PCSK6__Homo_sapiens__NP_002561
augcccccuagagccccaccggcucccggcccuaggccacccccucgggcagccgcggcuaccgacacagccgcaggggccggaggugcuggcggggcaggaggcgccggugggccaggauuccgcccccuggcuccucgaccauggcguuggcuccuucuguuggccuuaccggcggcaugcagcgcucccccuccaagacccguguacacuaaccacugggccguccagguucugggcggcccugccgaggcagauaggguggcugccgcgcauggguaucuaaaucucggacaaaucgguaaccuggaagacuacuaucacuuuuaccauuccaagacguucaagcggucuacccuuucaagucgcggcccacacacauuucugagaauggauccccagguaaagugguugcagcagcaagaggugaaaaggcgggucaagcgccaggugcgaagcgacccgcaggcccucuauuucaaugauccuauuugguccaacaugugguaccugcauuguggggacaaaaauucuagaugcaggucggaaaugaacguucaggcagcuuggaagcggggauauacuggcaagaauguggucgugaccauacuggaugacgguaucgagcguaaccaccccgaucucgccccaaauuacgacucauacgcuagcuaugauguaaacgggaaugacuacgauccuaguccccgcuaugacgccuccaacgaaaauaaacacggaacaagaugugcaggcgagguugccgcuucugcgaacaauagcuacugcauugugggcaucgcauauaacgccaagauugggggaaucaggauguuagacggugaugucaccgacgugguggaggcuaaaucccugggcauacggccaaacuacaucgauauuuauucagccaguugggggcccgacgaugacggaaagacugucgauggcccuggucgacuugcaaaacaagccuuugaauacgggaucaagaagggccgccagggauugggcagcauuuucguuugggcuucugggaauggagguagagagggcgacuacuguuccugcgauggguauacaaacucaaucuacaccauaagcgugaguucugccacggaaaauggauauaaaccaugguaccuggaggagugugcauccacucuagcgaccacauauagcucgggcgcuuuuuacgaaaggaagauuguaacuaccgaccuccggcagcgcugcacagauggucauaccgggacgucuguguccgccccgauggucgcaggcaucauugcccuggcucuugaggccaacucacagcugacuuggagagacgugcaacacuugcucguuaaaacaaguaggcccgcacaucugaaggcuagcgacuggaaagugaauggagccggccacaaggucucccacuucuauggguuuggauuaguggaugcggaagcccugguaguugaggcuaaaaaguggaccgcagugccuucucagcauaugugugucgccgcuagcgacaagcguccacggucaaucccccucgugcagguccuucgaacuacagcccugaccagugcaugcgcggaacacuccgaucaaagagugguuuacuuggagcaugugguagucaggacgagcaucucucacccucgccggggugaccuacagauuuaccuggugucaccaaguggcaccaaaagccagcuccuggccaagagacuucuggauuuguccaacgagggguucacaaauugggaauuuaugacuguucauuguuggggagagaaagcugaaggccaguggacccucgagauacaagaccugcccucucaggugaggaacccggaaaagcaggguaaauuaaaggaguggucgcugauccuauaugggacagccgagcacccuuaccacacuuucagcgcacaucagucccgcucacgaaugcucgaacugagugcuccagagcuugaacccccuaaggccgcauugucucccagccaagucgaggugccagaagaugaggaggacuauaccgcccaguccacaccuggcucagcuaauauucugcagaccagcguaugccaccccgaaugcggagauaaaggcugugacgggccaaacgcggaucagugccucaauugugugcauuuuucucugggauccguuaagacgagucggaaaugcgucagcguguguccgcuuggcuacuucggugacacugccgcacguagaugcaggcgcugucacaaggggugcgagacauguucuucccgggcugccacccaaugccugucauguagaaggggauucuaucaccaucaggaaaugaacacuugcgugaccuugugcccugccggcuuuuacgcugaugagagucagaaaaauugucucaagugccaccccagcuguaagaaaugcgucgacgagccagaaaaguguacaguuugcaaagaggguuucucgcuggcacgaggcuccuguauccccgacugcgaaccugggaccuauuuugauucugaguuaauacgcuguggagaaugccaucacacuuguggcacaugcguggggccaggacgggaggagugcauucauugugccaagaacuuccacuuucacgacuggaaaugcgugcccgcguguggcgaagguuucuacccugaggaaaugccggggcugccacauaagguaugcagaaggugugaugagaauugccuaagcugugcuggaucaagucguaacugcucccgcuguaagacgggcuuuacccagcucgguacuucuugcaucacaaaccacaccuguagcaaugccgacgaaacauucugcgagauggucaaauccaaccggcugugcgagagaaaacuuuuuauccaauucuguugcaggacuuguuugcuggcaggcuga

SEQ ID NO: 60457 - RNA, 2358 nt, Artificial Sequence
  derived and/or modified sequence opt3 from PCSK7__Homo_sapiens__NP_004707
augcccaagggcagacagaaagugccucaccuggacgccccacucgggcuuccgaccugccugugguuggaguuagcuggacuguuccuacucguccccuggguuaugggucuggcaggcacagggggaccugauggccaagguacugggggaccaagcugggccgugcaucuugaaucccuggagggcgacggcgaagaggaaacguuggagcagcaggcggaugcucucgcccaggcagccgggcugguaaacgcuggaaggaucggugagcugcaaggccacuaccucuuugugcagcccgcagggcaucggccugccuuagaagucgaggcuauucgccaacagguggaagccguucuggcgggacacgaggcagugcgauggcauucugagcagcgucuuuugagaagggccaagcggucaguccacuucaaugacccaaaauauccccagcaguggcaccugaacaaucgcagaaguccuggcagggauauaaacgugaccgguguaugggaacggaauguuacagggcgcggagugacugucgugguggucgacgauggcguugagcauaccauccaggacauugcuccaaacuacagcccggaaggcuccuaugaucuaaauucuaacgaccccgauccuaugccacaccccgacguggagaaugggaaccaucacggaacacgaugugccggugaaaucgcagcuguaccuaauaacucguuuugcgccgugggcgucgcguacgggucaagaauugccggaaucagggugcucgauggcccacugaccgacagcauggaggcaguugcuuucaauaagcacuaucaaauaaacgacaucuacaguuguuccuggggucccgaugacgaugggaaaacuguggacggcccgcaucagcuuggaaaggccgcucugcagcacggcgucauugccgggcggcaaggauuugguucuaucuucgugguagcaagcggcaaugggggacagcauaacgauaacugcaauuaugacggcuacgccaacuccauuuacacaguuaccaucggugcuguggaugaggaagggcguaugccuuuuuaugcggaggaaugugcaucaauguuggccgucacguucaguggcggagacaagaugcuccgcagcauagugacuaccgauugggaccugcagaaaggcacagggugcacugagggacacaccgguacaucugcugccgcacccuuagccgcuggcaugauugcccugaugcuccaggucagaccaugucuuaccuggagggaugugcaacauaucauuguuuuuacggcaacucgguacgaagaccgacgcgcggagugggugacaaaugaggcuggguucucccacucacaccagcauggauuuggccuguugaacgccuggagacuuguaaaugcagccaagaucuggaccagcgucccuuaucuggcuaguuacgugucucccguucucaaagaaaacaaggccaucccacagucccccaggagccuggaggugcuuuggaaugucucgcggauggaccuggaaaugucugguuugaaaacucucgagcacguggcaguaacaguguccauuacccauccucgcagagggucacuggaauuaaagcuguucugcccaaguggcaugaugagccuaauaggagcuccgagguccauggauucugaccccaacggcuuuaaugauuggacguucagcaccguucguuguuggggcgagcgggcccgaggaacauauagacucgucaucagggacgugggcgaugagucauuccagguggguauucugcgccaauggcagcuuacuuuguacgggagugucugguccgcgguugacauccgggauagacagaggcugcucgaaagcgccaugucuggaaaguaucugcacgacgauuuugcucuaccuugcccacccggccugaaaauaccugaggaagacgguuacaccauuacaccaaacacuuugaagacccucgugcuggugggcuguuucacaguauuuuggaccgucuacuauauguuagagguguaccugucacagcgcaauguugcaaguaaccaagugugccgaagcgggcccugccacuggccgcaucggucccguaaagccaaggaggaaggaacugagcuagaaucugucccucucuguucgagcaaagauccagacgagguggaaacggaguccagagggcccccuacaaccucagaucugcuugcucccgacuugcuggagcagggggacuggagucucucucagaauaagagcgcccuggauugcccacaccagcauuuagacguuccucacggaaaagaggaacaaaucuguuga

SEQ ID NO: 60458 - RNA, 429 nt, Artificial Sequence
  derived and/or modified sequence opt3 from PCTP__Homo_sapiens__NP_001095872
auggacagcgauuacagaaagcagugggaccaauaugugaaagagcuguacgaacaggagugcaacggcgaaaccgucguuuauugggaggugaaguaccccuucccuauguccaauagggauuauguauaccuccggcagcgccgagaccuugauauggaagggcguaaaauccacgugauucuggccagaucuacaucaaugccacaguugggagagaggaguggugucauacgggugaagcaauauaaacagagcuuagcuaucgaguccgacggcaagaaggggucuaaaguuuuuauguacuacuucgauaacccgggaggccagauucccucguggcugaucaauugggcagccaagaacggugugccuaauuuucuaaaagacauggcgcgcgcuugucagaacuaucucaagaaaacuuga

SEQ ID NO: 60459 - RNA, 1104 nt, Artificial Sequence
  derived and/or modified sequence opt3 from PCYT1A__Homo_sapiens__NP_005008
auggacgcccagugcagcgcuaaggugaacgcaagaaaaaggcggaaggaggcccccggcccuaauggggcgaccgaagaggauggagucccauccaaaguucaacgcugugcugugggucugcgacagccggcccccuucucugacgaaaucgagguagauuuuucaaagccuuacgugcgugucacaauggaagaggcaaguagaggcacuccaugcgagaggcccgugcggguuuaugccgacgggauuuucgaucucuuucacagcggacaugcucgcgcacuuaugcaggccaaaaaccuguucccuaauacguacuugauagugggcgucuguuccgacgaauuaacccacaacuuuaaggguuucacagugaugaaugagaacgaaagauaugaugcuguacagcauugcagguacguugacgaggugguccggaaugccccauggacucugacccccgaguuucuagcggaacaccgcaucgauuucguggcacaugacgauauuccuuauucuucggccgggucagacgauguguacaagcacaucaaagaggcuggaauguuugccccaacacaacgaaccgaaggcauuagcacaagugacaucauaacuagaaucgucagggacuaugauguuuacgcacggcguaaccuccagcgcggcuacaccgcuaaggagcugaauguguccuucauuaacgagaaaaaguaucaccuucaggagagaguagacaaagugaagaagaaagucaaggauguggaggaaaaaucuaaggaguuuguucagaaaguggaagaaaagagcaucgaccugauucaaaaaugggaagagaaguccagggaguucaucgggucauuuuuggaaauguucggaccggagggugcccucaagcauaugcugaaagaaggcaaggggcggaugcugcaggcgauaagucccaaacagagcccuucuuccucaccaacgcgagagcgcagccccaguccuucuuucagauggccauuuuccggaaagacuucgcccccguguagcccugccaaucucucuaggcacaaagcagcugccuacgauauuuccgaagacgaggaggauuga

SEQ ID NO: 60460 - RNA, 1056 nt, Artificial Sequence
  derived and/or modified sequence opt3 from PCYT1B__Homo_sapiens__NP_001156736
auggugggccaccaggagugcaucauggaagaggacaacagagcuccccaacuguggaggaagacccucacagccccugcaccauucgccgaugaaacuaauugucagugccaggcgccgcaugagaaacuuacgauugcucaggcccggcuggggacccccgcagaccgcccuguccgaguuuacgccgauggaauauuugacuuguuccacagcggucaugcucgugcauuaaugcaagccaagacacuguuuccaaacuccuaucuacucgugggcguauguucugaugaccugacucacaaauucaagggguuuaccgugaugaaugaagcugagagauacgaggcccuuaggcauugccgguaugucgaugaagugauccgcgacgcgcccuggacacugaccccugaguucuuggaaaaacacaagauugauuuuguugcacacgacgauaucccauacucaagugccggaagcgacgauguguauaagcauauuaaagaggcuggcauguucguccccacucagagaacagaggguaucuccaccucugacauaaucacgaggauugugcgggacuacgauguauaugcccgccgaaaccuccagagaggguacacugcaaaggaacugaauguuucguuuaucaacgagaaaagguaccgguuccagaaucaaguggacaagaugaaagaaaaggucaagaacguggaggaacguucaaaagaguuugugaaucgcgucgaggaaaagagccacgaucugauucagaaaugggaggaaaagaguagagaguucaucggaaacuuucucgaauuauucggcccugacggcgcuuggaaacagauguuccaggagagguccucucggaugcugcaagcccuuagcccaaagcaguccccgguuucaagucccacccgaagccgcucuccuuccagaucaccaagccccacauuuaguugguugccucugaaaacuucuccacccuccagcccgaaggcggccucggcaucuauauccucaaugagugagggggaugaagacgagaaguga

SEQ ID NO: 60461 - RNA, 546 nt, Artificial Sequence
  derived and/or modified sequence opt3 from PDAP1__Homo_sapiens__NP_055706
augcccaagggcgggagaaaaggaggucacaagggcagggcccggcaguacaccagcccugaggaaaucgacgcucaacugcaggcagagaaacagaaggcccgcgaagaggaggagcagaaagaagggggagauggcgcggcuggugacccaaagaaggagaaaaagucccucgauucugacgaaucagaagaugaggaggacgauuaucaacagaaacgaaaggggguggaaggacuuauugacauagagaacccgaaucgugucgcccagacaacuaaaaagguuacgcagcuggauuuggacggccccaaggaauuaaguagaagggagcgggaagagaucgagaaacaaaaggcaaaagaacgcuacaugaagaugcaucuggccggcaaaaccgagcaggcuaaggcagaucuagccagacucgcuauuaucaggaaacagcgggaagaggccgcgcgcaagaaggaagaggagcgaaaagcaaaggacgaugccacacugagcgggaaaagaaugcagucccuuucucugaacaaguga

SEQ ID NO: 60462 - RNA, 639 nt, Artificial Sequence
  derived and/or modified sequence opt3 from PDCD10__Homo_sapiens__NP_665859
augagaaugaccauggaagaaaugaagaacgaggccgaaacaacuagcaugguguccaugccccuguacgcugucauguauccuguuuucaaugagcucgaaagggugaaccuuucugcagcccagacgcugcgggcggcuuuuaucaaagccgagaaggagaauccaggcuugacccaagacauuauaaugaaaaucuuagaaaagaaaucaguagaggugaacuucacagaaagucugcuacgcauggcagccgaugacgucgaggaguacaugauugaacgaccggagcccgaauuucaggaucucaaugagaaggcucgugcacugaagcagauccuuagcaaaauuccugacgaaaucaacgauagagugagguuccugcagacuauaaaggacaucgccuccgcuauuaaagaguugcucgauaccguuaauaacguguuuaagaaauaucaauaccagaaucggcgcgcccuggagcaccagaagaaggaguucgucaaauauucuaagucguuuucagacacacugaaaaccuacuucaaggaugggaaagcgaucaacguguuuguaagcgcaaauagacucauucaucagacuaacuuaauccugcaaacauucaagaccguugccuga

SEQ ID NO: 60463 - RNA, 867 nt, Artificial Sequence
  derived and/or modified sequence opt3 from PDCD1__Homo_sapiens__NP_005009
augcagaucccccaagccccuuggccaguggucugggcuguucugcagcucggcuggagaccggggugguuccuugacagccccgauaggccuuggaacccacccaccuuuuccccugcacuguuggugguaacagagggagacaaugccacuuucacgugcucuuuuucaaacaccagugagagcuucguguuaaauugguaccggauguccccaucuaaccagacagauaagcuggcggcuuuucccgaagaccgcucgcagccuggucaagauugucgauuccgugucacucagcuaccaaauggcagagacuuucacaugucagugguuagggcccggcgcaacgauagcgggaccuaucucugcggagcaauuagucuggccccgaaagcucagauaaaggaaucccuuagagcagagcugagggugacagaacggcgcgccgagguccccaccgcucauccuucuccaagcccccgaccugccggccaguuccaaacuuuggugguagguguugucgggggacuccugggcucccuggugcucuuagugugggugcuggcggucaucuguucaagagcagccaggggcacaauuggggcucggcguaccggacagccacuuaaagaggaccccagugccguuccgguguuuagcguagauuacggugaauuggacuuccaguggcgcgagaagacgccugaacccccagugccuugcguccccgagcagacugaguaugcaaccaucguguuuccaucuggcauggggacauccucacccgcuagaaggggaagcgccgauggcccucggagugcgcaaccacugcgaccggaagacggucacuguucuuggccccuauga

SEQ ID NO: 60464 - RNA, 822 nt, Artificial Sequence
  derived and/or modified sequence opt3 from PDCD1LG2__Homo_sapiens__NP_079515
augaucuuccugcuccuuaugcugagcuuggaguuacagcugcaccaaauugccgcucuauuuaccgugacaguccccaaggaacucuacauaaucgagcauggcuccaacguuacucuggaaugcaauuucgacacggggucucacgugaaccuuggagcaauuaccgccucacugcagaaaguagagaaugauacaaguccucauagagaaagggcgacuuugcucgaggagcagcugccacuggguaaggcuagcuuucacaucccccaggugcaaguccgggacgaaggccaguaucaguguauuaucauauacgggguggccugggauuauaaauaccucaccuuaaagguuaaagcauccuaucgcaagaucaacacacauauucugaaggugccggagaccgacgaagucgagcuuacuugccaggccacaggauacccuuuggcugaggugucuuggccaaauguaucgguucccgcaaacaccucacacagccgaacgccugaaggccuguaucaagugaccaguguccuacgucucaaaccacccccugguagaaauuucuccuguguguuuuggaacacucacgugagggagcugacacuugccucuaucgaucugcagagccagauggaaccacggacucauccgaccugguugcuccacauuuucauccccuuuugcauaauugcuuucaucuuuauugccacagucaucgcgcugcgcaagcaguuaugucaaaaacuguacuccucaaaggacaccacgaaaagaccuguuacuacaaccaagagggaggugaauagugcaaucuga

SEQ ID NO: 60465 - RNA, 936 nt, Artificial Sequence
  derived and/or modified sequence opt3 from PDCD2__Homo_sapiens__NP_001186391
auggccgcugcaggcgccagacccguggagcugggguucgcggaaagcgcuccugccuggaggcuccgguccgagcaguuuccaucuaaggucuacgcaccgcuucccggacgcccugacgccuuccaccgaugcaucuuucuguucuguugccgugaacaaccauguugcgcugguuugagaguuuuuaggaaccaguuaccccggaaaaaugauuucuauucauacgagccuccaagugaaaaucccccuccagagaccggcgagagcgugugucugcagcuaaaguccggggcacaucucugccgcguauguggaugccugggcccgaaaacauguucuagaugccacaaggccuauuacuguucgaaagaacaucagacucuugacuggaggcugggucacaagcaggcuugcgcccaacccgaucauuuggaccacauuauaccugaucacaacuuucucuucccagaguuugaaaucgugauugagacggaggacgaaaucaugcccgaggucguggaaaaggaggauuauucagaaauuaucgggagcaugggagaggcgcuggaggaagaacuggacaguauggcaaaacaugaaucccgggaggauaagauauuccagaaauuuaagacccagaucgcccucgaaccugagcaaauuuuacgcuacggccgaggcaucgcuccaauuuggaucucuggggagaacauaccccaggaaaaagacauuccggauugcccuuguggagccaagagaauccuggaguuccagguuaugccccagcuuuugaauuaucugaaggcagacaggcuagguaaaagcauugauuggggcauccucgcuguguuuacaugcgccgaauccuguucacuggggacuggauacaccgaggaguucgucuggaagcaagacgugacagacaccccauga

SEQ ID NO: 60466 - RNA, 1368 nt, Artificial Sequence
  derived and/or modified sequence opt3 from PDCD4__Homo_sapiens__NP_001186421
auggacguggagaacgaacagauccugaaugucaaccccgccgagaaugcuggcaccgaagagauuaagaacgaaauaaaugggaacuggaucagcgcauccucuauuaaugaggccagaaucaacgcgaaagcuaagaggcggcuccgcaaaaauucaagucgagauagcggacguggugacuccguuucugauucgggcucagacgcccuuagaagcgggcugacagugccuacuagcccaaagggaagguuguuagaucggcgcuccagaucuggcaaagguagggggcugccgaagaagggaggcgcaggcgggaaaggaguaugggguacgcccggccaaguguacgacgucgaggaaguggauguuaaggacccuaacuaugaugacgaucaggagaauugcguguacgaaaccgucgugcuaccacucgacgagcgggccuucgagaaaacacugacucccauuauccaggaauauuuugagcacggggauaccaacgaaguagcugagaugcuucgcgaccugaauuugggagaaaugaagaguggcguuccugugcucgcagucucccuggcccuggaggguaaggcuucacaucgagagaugacaaguaagcucuuaagcgaccugugugggaccgugaugucuacuacagauguggaaaaguccuucgacaaacuuuugaaggaucugccagagcuagcccucgacacccccagagcgccucagcuggucggacaauuuauagcaagggccguuggcgauggcauccuuugcaacacguacauugacucauauaaagggacuguggauuguguacaggcucgggccgcacuggacaaggcuaccguguugcucagcaugaguaaaggagguaagcguaaagauucugucuggggcuccgggggaggccagcagagcgugaaucaccugguuaaggaaaucgacauguuacugaaggaguaccuccuuucgggugauauuucugaagccgagcauugccugaaagaguuggaagugccacacuuccaucacgagcuagucuaugaagcgaucauaauggugcuggaguccacaggggaaucaacuuuuaagaugauucucgaccugcuuaaaagucuguggaaaagcuccaccaucacaguagaccaaaugaaacgcggcuacgagagaauuuacaacgagaucccggauaucaacuuggacguuccccacucuuauagcgugcucgaaagguucgucgaggaauguuuucaggccggaauuauaucaaagcagcugcgggauuuaugcccuagucgaggccgcaagagauucguguccgagggggacggagguaggcugaaaccagagagcuacuga

SEQ ID NO: 60467 - RNA, 378 nt, Artificial Sequence
  derived and/or modified sequence opt3 from PDCD5__Homo_sapiens__NP_004699
auggccgacgaggaacuggaggcucucagaaggcagcggcuugcagaacugcaagccaagcacggcgaucccggggacgcggcucagcaggaggccaaacaucgcgaagcagagaugcgaaacagcaucuuggcccagguguuagaucaauccgcucgugcaagacugucuaaucuagcccucgucaagccugagaaaaccaaggcuguugaaaacuaccugauucagauggccagguauggacagcuuucagagaaagugagugaacagggucugauagagaucuugaagaagguaagccaacagacagagaaaacuacgaccgugaaguucaaucggcgcaaagucauggacuccgaugaagacgaugacuacuga

SEQ ID NO: 60468 - RNA, 570 nt, Artificial Sequence
  derived and/or modified sequence opt3 from PDCD6__Homo_sapiens__NP_001254485
auggccgcuuacagcuauagacccggcccuggggcaggaccagguccggccgcgggcgcugcccugcccgaccaguccuuccucuggaacguguuucaaagggucgauaaggaccggucugggguuaucucagauaccgagcuucagcaggcacugaguaauggaacauggacuccuuucaacccagugacgguacgcagcauuauauccauguuugaccgagaaaauaaagccggcgugaacuucucugaguuuaccggugucuggaaguacaucacagauuggcagaauguguuccguacuuaugacagagauaacucggggaugauugacaaaaaugaauugaagcaggcuuuaucaggauacaggcugagcgaucaauuucacgacauccuaauucggaaauucgaucgccagggcagaggccagaucgcauuugacgauuucauacaagggugcaucguucuccagaggcugaccgacauuuuucggcgcuaugacacagaucaggacggauggauccaggugaguuacgagcaauaucuuuccauggucuucucuauuguguga

SEQ ID NO: 60469 - RNA, 2622 nt, Artificial Sequence
  derived and/or modified sequence opt3 from PDCD6IP__Homo_sapiens__NP_001155901
auggccaccuucaucagcgugcagcugaagaaaacauccgaggucgaccucgcuaagccccuuguuaaauuuauucaacagacuuacccuucuggcggggaagaacaggcacaguauugcagagccgcggaggagcugucaaaguugaggcgggcugccgugggacgcccauuagauaaacacgaaggugcacuggagacgcuacuccgauacuaugaccaaauauguaguaucgagccgaaguuccccuuuagcgaaaaccagauuugccugaccuucacauggaaggaugccuuugacaaaggcucccuuuucgggggaucuguaaagcuggcuuuggcaucgcucggcuacgagaaaucaugugugcuguuuaauugcgccgcucuggccagccagaucgcggcagaacagaaccucgauaaugacgaggguuuaaagauugccgcuaaacauuaucaauucgccaguggggcauuucugcacaucaaggagacuguccuuuccgcuuugucucgugaaccuaccguggauauaagcccagacacaguuggaacccugucccuaaucaugcucgcccaggcgcaggagguguucuuucugaaggccacuagagauaaaaugaaggacgcaauuaucgcuaaacuugccaaccaggcugccgauuacuucggcgacgcauuuaagcaaugucaguauaaagauacacugcccaaguacuucuacuuccaggaagucuuuccuguguuggccgcuaaacauugcauuaugcaagcgaaugcagaguaucaccagucaauccucgccaagcagcagaagaaauucggcgaagagauagcuaggcugcaacaugccgcagaguuaauuaagaccguagccagucgguacgacgaauauguuaacgugaaagacuuuagcgauaagaucaaucgcgcucuggccgcagcgaaaaaggacaacgauuucauuuaccacgacagagucccagaucucaaggaccuugaucccaucgggaaagcuacgcuggugaagucuacuccugugaaugucccaaucucccagaaauuuaccgacuuguucgagaagaugguuccggugucaguacagcagagccuagccgcauauaaccaaaggaaagccgaucuggugaaucggaguauugcucagaugcgcgaagccacaacucucgcaaacggaguccuggcuucucuuaaucugcccgccgcgauagaggacguguccggugauaccguuccucagagcaucuugacaaagucgcgaucugugauugaacagggcgggauccaaaccgucgaccagcucauaaaggagcugccagaguuacugcagagaaacagggaaauucuagacgagucccuccggcugcuugaugaagaggaagccacggacaaugauuugcgugcuaaauuuaaggagcgcuggcagagaacucccucaaacgagcuguacaaaccucucagggcagaaggaacaaacuuccggaccgugcuggacaaggccguacaagcugauggccagguuaaagaguguuaucagagucaccgagacacuaucgugcuucugugcaagccagaacccgaguugaaugccgcaaucccgagcgcgaacccugccaagacaaugcaagguuccgaggucgugaauguccucaaaucucuguuaagcaaccuggaugaagugaagaaagagcgcgaagggcuagagaaugaccucaagucaguuaacuuugauaugaccaguaaauuccugacggcucuugcccaggacggagugauuaaugaagaggcauuguccguaaccgagcuggauagagucuacggcggccucacaacuaaggugcaggaaagccugaaaaagcaggagggguuacugaagaacauccaaguuucucaucaggaauuuucaaaaaugaagcagaguaauaacgaggcuaaucuuagggaagagguguugaaaaaccucgccaccgcauacgacaauuucgucgagcugguggccaaccuaaaggaaggaacaaaauuuuauaaugagcugacugaaauucucguacgguuccagaacaaguguagcgauauaguguucgcucgcaagaccgagagagacgaacugcuuaaagacuugcaacaguccaucgcgagggagcccucugccccaucgauuccuacacccgcauaccagagcuccccagcugguggccacgcccccaccccuccaacuccggcuccccguacgaugccuccaacaaagccccagccuccagcccggcccccgccuccaguucugcccgcaaaccgagccccuucagcgaccgcucccaguccagucggggccggaacugcagccccugcucccucucaaaccccaggcagcgcaccgccuccccaggcccaggguccacccuauccuacauacccaggguaucccggcuacugccaaaugccuaugccgaugggauauaauccauacgcguacggccaguauaacaugcccuacccuccaguguaucaucagucccccgggcaggcuccuuacccgggaccccaacagccaucauauccuuuuccccagccaccucagcaaagcuacuauccccagcaguga

SEQ ID NO: 60470 - RNA, 1458 nt, Artificial Sequence
  derived and/or modified sequence opt3 from PDCD7__Homo_sapiens__NP_005698
auggcccugcccccuuucuuuggccaggggagaccaggaccgcccccuccacaacccccuccacccgcuccuuucgguugcccaccgcccccucucccaagccccgcauuuccuccaccccuuccgcagaggccuggccccuucccaggggccuccgcgccuuuucugcagcccccauuggcuuuacagccccgggccucugcagaggccucacgcggaggcgguggggcuggagcauucuacccugugccaccgcccccucugccacccccuccaccccaaugucgaccguuuccuggcaccgacgccggcgaacguccaagacccccucccccagggccuggacccccauggaguccgagguggccugaggcucccccacccccugccgauguccuaggugacgcggcacuccagcggcugcgcgauagacaguggcuugaagccguuuucggcacaccaaggcgggcugggugccccgugccucagcgcacucacgccggaccgagccugggcgagguacgagcaagauugcucagggcucugcggcuggugcgucgccucagagguuuaucccaagcccugagggaagcggaggccgacggggcagcuuggguccuuuuguauucucagacggccccacugcgggcugagcuagccgaacgacuccagccccugacccaggcagccuacgugggagaggcucgcagaaggcuugaacggguucgcagaaggcgucugcgguugcgagagagagcgagggagcgcgaagcagagcgggaagccgaggcugccagagcaguggaaagggagcaagagaucgaucgcuggcgagucaagugugugcaggaaguagaggagaaaaagcgggagcaggaacucaaagccgcugccgacggcguucugucggaggugcguaagaaacaagcagauacaaagagaauggucgacauuuuaagggcgcuggagaagcuccgcaaacuucggaaggaagcugccgcaagaaaaggcgugugcccuccagccucagcugaugagacuuuuacccaucaucugcagagguugcgaaagcuaaucaaaaagcgcagcgaacuguaugaggccgaagaacgggcacucagagugaugcuggagggggaacaggaggaagagaggaagcgugagcuugagaaaaagcagcgcaaagaaaaggagaaaauacuguugcaaaagcgggaaauugaaaguaaacucuucggagaccccgaugaguuuccucuggcucacuuacuggagccguucagacaguacuaucuacaggccgaacacucccuccccgcgcugauccagauuaggcaugacugggaucaauaccuugucccaucugaccacccuaaggguaacuuuguuccccagggcuggguguugccaccucugcccagcaaugacaucugggccacagcuguaaagcuccacuga

SEQ ID NO: 60471 - RNA, 585 nt, Artificial Sequence
  derived and/or modified sequence opt3 from PDC__Homo_sapiens__NP_072098
augagcucuccccaguccagaaacggcaaggacucaaaagagagggugagucggaagaugagcauccaagaauacgagcugauucacaaagaaaaggaggaugaaaauugccuccgcaaauaucgacgucaguguaugcaggacaugcaucagaaacuuuccuucgggccuagauacggauuugucuaugagcuggagaccgguaagcaauucuuggaaacaauagagaaggaauuaaagaucacuacgauuguugugcacaucuacgaggauggcauuaaagggugcgacgcccugaacucuucgcuaaccugucucgcugcagaguauccaaucguaaaguuuugcaaaauaaaggccucaaauacaggagcgggcgauagguucagccuggacgugcuuccgacucuguugaucuacaaggguggggaacucauuaguaacuuuaucuccgucgcugagcaguucgccgaagaguuuuucgcaggagauguggaaucuuuucugaaugaguauggccugcuccccgagcgggaaguucauguguuagagcacaccaaaauugaagaggaagacgucgaguga

SEQ ID NO: 60472 - RNA, 726 nt, Artificial Sequence
  derived and/or modified sequence opt3 from PDCL2__Homo_sapiens__NP_689614
augcaggaccccaacgaggauaccgaauggaaugacauccugagagauuucggcauucucccuccaaaggaggaaagcaaagacgagauagaagagauggugcuuaggcugcaaaaggaggccauggucaaaccguuugaaaagaugacauuggcucaguuaaaagaggcagaagaugaguucgacgaggaagauaugcaggccguugagacuuaccggaagaagcgccugcaggaauggaaagcgcuaaagaaaaagcaaaaauuuggggagcuccgagaaaucuccggaaaccaguaugugaaugagguaacgaacgcugaggaagacgugugggucauuauccaccuguaccguucuucaauucccaugugccuucuggugaaucagcauuugagucuccuggccagaaaguucccugagaccaaguuuguuaaagcaaucgugaacagcuguauacagcacuaucaugauaauugccugccaacaaucuucgucuacaagaacggucaaauugaagccaaauuuaucggcauuaucgagugugggggaauaaaucucaaguuagaggaacuggaguggaaacuugcugaagugggcgcaauucagacugacuuggaggaaaaccccaggaaggauaugguagacaugaugguuuccucuauccggaauaccucgauucacgaugacucagacagcaguaacuccgauaaugacacaaaauga

SEQ ID NO: 60473 - RNA, 720 nt, Artificial Sequence
  derived and/or modified sequence opt3 from PDCL3__Homo_sapiens__NP_076970
augcaggaccccaacgccgauaccgaguggaaugacauccugagaaagaaaggcauucucccuccaaaggaaagccuuaaagagcuggaagaggaagcugaggaggaacaaaggauauugcagcaguccguggucaagacauacgaggauaugacuuuagaggaacuggaggaccacgaagaugaguucaacgaagaggacgaacgggcaaucgagauguaucgccgacguagacuagccgaguggaaagcgacgaagcucaagaauaaauuuggggaaguucuggagauuucuggaaaggauuacgugcaggaaguaaccaaagcuggugagggccuuugggugauccugcauuuguauaagcaagggauuccgcucugcgcccugaucaaccagcaccugucaggacucgcaaggaaauuccccgacgucaaguuuauaaaggccaucaguacaacuuguauuccuaauuacccagaucggaacuuacccaccaucuucguguaucuggaaggcgacauuaaagcucaguuuaucgguccucuuguuuucgggggaaugaauuugacacgcgaugagcuggaguggaagcuaagcgaauccggcgcaauaaugaccgaccucgaggaaaaccccaaaaagccaauugaggaugugcugcuuucuucggucagaaggucagugcugaugaaacgggacagcgacagugaaggcgauuga

SEQ ID NO: 60474 - RNA, 2370 nt, Artificial Sequence
  derived and/or modified sequence opt3 from PDE10A__Homo_sapiens__NP_001124162
auggaggacggccccagcaacaaugccuccugcuucaggaggcugaccgaauguuuucucucuccuucacuuacagaugagaaggugaaggcuuaccugaguuugcacccacaggucuuagacgaguucguuagcgaguccgugucugcagaaacuguagagaaguggcugaaacggaagaacaauaaaucggaggaugaaucagccccgaaggaggugagccgcuaucaagacacgaacaugcagggggucguguacgaacuaaauaguuauaucgagcagcgacucgauaccggaggugacaaccagcugcuucuguacgaguuguccucuauuauaaagaucgcgacaaaagcugauggcuuugcccucuauuuccugggggaaugcaauaacagccuguguauuuuuacucccccuggaaucaaggagggcaaaccacgucucauucccgcagguccuaucacccaagggacaaccguuuccgccuacguggcuaagucaagaaaaacuuuacuggucgaagacauacuuggagaugagagguucccacggggcacaggcuuggaaagugggacccgcauccagagcgugcugugccuacccauuguaacggcaaucggagaccucauugguauccuggagcuuuauagacauuggggcaaggaggccuuuugucugucucaccaggaaguugcuacugccaauuuggcgugggcauccguggccauacaucagguccaagugugcagggggcucgcuaagcagaccgagcugaacgauuucuuacuggacgugucaaaaacauacuuugauaauauugucgccaucgacagccuccuugaacacauuaugaucuacgcaaagaaccugguuaaugcugaccggugugccuuguuccagguggaucauaaaaacaaggagcuauauagugaccuguuugauaucggagaagagaaagagggcaagccuguauucaaaaagacuaaggaaauucgcuuuucuauagagaaagguaucgcggggcagguugcccgaaccggagaaguccucaauauuccagacgcauacgcugauccgagauucaacagggagguggaccuguauacaggcuacaccacgcggaacauccuuugcaugcccauaguuucccguggcagcgugauuggggucgugcaaaugguaaauaagaucucgggaucugccuucuccaaaacugaugaaaacaauuuuaagauguucgcuguguuuugugcccuggcauugcacugcgccaacauguaucaccgcaucagacauucagaguguauuuacagggugacaauggagaaacucaguuaucacagcaucugcaccuccgaagaguggcagggucugaugcaguucacuuuaccuguccggcugugcaaggaaauugagcuauuucauuucgacauaggcccauuugagaauauguggcccgggaucuucguguacaugguccaccgaucuuguggaacaagcugcuuugaacucgagaagcugugucgcuucauuaugucagugaaaaagaacuacagaaggguuccuuaucacaauuggaaacaugcugugaccguagcgcacugcauguacgcaauccuucaaaacaaucauacguuguuuaccgaucuggaacggaagggccuccugaucgccugucuuugccacgaccuggaucaucgcgguuucaguaacuccuauuugcagaaauuugaccacccacucgcugcccuguacagcacaucuacuauggagcagcaccauuucucacagaccgucaguauuuuacaacuggaagggcacaauauauucagcacacuauccucuucggaguaugaacaggugcucgaaaucauuagaaaggcaaucauugccacugaccuggcucuuuacuuuggcaacaggaagcaguuggaggaaauguaucagaccggaagccugaaucucaacaaucaaucccaucgugaucggguuaucggccugaugaugacagccugugacuuaugcucagugaccaaacuguggcccgucacuaaacuuacggcaaacgauauauacgcggaguucugggcugaaggggacgagaugaaaaaguugggaauccagccgauuccuaugauggaucgagacaaaaaggaugaggugccccagggucagcucggcuuuuacaacgccguagcaaucccauguuauacaacccugacucaaauucuaccucccaccgaaccacugcucaaggccugcagagacaaucugagucagugggagaaagugaucagaggggaagagacagcuaccuggauaucuagccccuccguugcccagaaggcagcugccucagaagauuga

SEQ ID NO: 60475 - RNA, 1470 nt, Artificial Sequence
  derived and/or modified sequence opt3 from PDE11A__Homo_sapiens__NP_001070664
augagccccaagugcuccgccgacgcugagaacucuuucaaagaaucaauggagaagaguagcuacuccgauuggcugaucaauaacucuauugcagaacucguggccucgaccggccuuccugucaauauaucagacgcguaucaggauccaagauuugacgcugaggccgaucaaaucagcggguuccacauuaggaguguucugugugugccgaucuggaacuccaaucaucagauuaucggaguagcacagguguugaaccgguuagacgguaaacccuuugaugacgccgaucagcgccuguucgaggcuuuugucauauucugcggccuagggaucaauaacacaauuauguacgaccaagugaagaaaucuugggcaaagcagagcguugcccucgaugugcuguccuaucacgcuacuuguucaaaggccgaggucgacaaauuuaaggcggcaaauaucccucuugugagugagcuggccauugaugacauccauuucgacgauuuuagcuuggacguagaugcuaugauaacggccgcacuccgaauguucauggaacugggaaugguucagaaauuuaagauugacuacgagacccugugccguuggcucuuaacagugaggaaaaacuauagaaugguccuguaccacaauuggcggcaugcuuucaacgugugucagcuuauguuugccauguugacuaccgcgggcuuccaagauauccugacagaaguggagauucuagccgucaucguugguugccucugucacgaccuggaucaccgcgggaccaauaacgcauuccaggcuaagucuggauccgcccuugcucagcuguauggcacuucagccacauuggagcaucaccauuuuaaucacgcagugaugauccuccagagcgaaggccacaacauuuucgccaaccugaguucuaaggaguacuccgacuuaaugcaacugcucaaacagagcauacuugcuaccgaucugacguuguacuuugaaagaaggacugaguucuuugagcuaguaucgaagggggaauaugacuggaauaucaaaaaccaucgggauauuuuccgcucuaugcugaugaccgcgugcgaccucggagcagugacaaagccaugggagaucucccgacaggucgccgaacuggugacuucagaguuuuucgaacaaggugacagagagaggcuugaacugaaauugacccccagugcuauauuugaucggaaucguaaggacgagcucccucgccugcaguuagaguggauugauagcaucuguaugccacuguaccaggcccuaguuaaagugaacgucaagcucaagcccaugcuggacuccguggcaacaaauagaucuaaaugggaagaacuucaccagaagagguugcuggccagcaccgcuucaaguuccccugccagcguaaugguugcaaaagaagaucggaacuga

SEQ ID NO: 60476 - RNA, 1830 nt, Artificial Sequence
  derived and/or modified sequence opt3 from PDE12__Homo_sapiens__NP_808881
auguggagacugcccggcgccagggcugcacuccgggugauccgcaccgccgucgagaaacuuagccgagcggaagcugggucccagacagccgcaggagccauggagcgugcuguugugagaugcguaccuucugaaccaaagcugucauugaguuucgcauuagccgacgguagccacaagaacaugcaaagggaucaguccgagccgcugggccgggugcuaucucgcauugcuacuaaugcccucaaagggcaugcgaaggcagccgcugccaaaaagucgagaaagucaaggcccaacgcaagcggaggcgcugccuguagugguccugggccagaacccgcggucuuuugcgagccugugguuaaacuguacuaucgggaggaagccguggcagaggacguccuuaauguggaugcuuggcaggacggagccguacugcagauaggcgauguuaaguacaaaguggaacgcaacccacccgcuuucacggaguugcaacucccucgauauaucauggccggcuuuccagucuguccgaagcugucccuggaguucggggaccccgcaucuagccucuuuagaugguacaaagaagccaagccuggagcugcggagccagaagugggugugcccuccucauuaaguccuagcucuccauccucaagcuggaccgagacagaugucgaagagaggguuuauacucccaguaaugcagacauuggccugcggcuuaaguugcacugcaccccgggggauggacagcguuucggccauucucgcgagcuggaauccguguguguaguggaggccgguccugggacaugcaccuuugaccacagacaucuauacacuaaaaaggucacagaagaugcucucaucaggaccgugagcuauaacauucuggccgacacguacgcacagacugaguucucgcggaccguucuuuaccccuauugugccccauacgcucuggaauuggauuaucgacagaaucucauccaaaaagagcugacaggauacaacgccgacgugauaugcuuacaggaggucgaccgcgcaguguuuucugauucccugguaccugcgcucgaggcuuucggccuugaaggcguuuuuagaaucaagcagcacgaagggcuggccacuuucuauaggaaaucaaaguuuaguuugcuaagccagcacgacauuuccuucuacgaggcacuggaaucugauccccuccauaaagagcugcuugagaagcugguguuguauccaagcgcccaagaaaagguccuccagcggucaagugugcugcaggucuccguguuacaaagcaccaaagacucuucaaagcgcaucuguguugcuaauacacaccuguacuggcaucccaaaggagguuacauuagacuaauccagauggccguggcacucgcucacauaaggcacguaaguugcgaucuguauccuggcauuccagucaucuucuguggggacuuuaacagcaccccguccacgggaauguaccauuucgugauuaauggcucuauccccgaggaucacgaagacugggccucgaacggugaggaggaacguugcaauaugagccuuacucacuuuuucaaguugaaauccgcgugcggggagccugccuauacaaacuacguuggcggauuucauggcugucuggauuauaucuucauugaccucaaugcucuggaaguggagcaggucauaccacuucccucacaugaagaggugaccacucaccaggcacugccuaguguaucucacccaagcgaucauaucgccuuggugugcgaccucaaguggaaguga

SEQ ID NO: 60477 - RNA, 1608 nt, Artificial Sequence
  derived and/or modified sequence opt3 from PDE1A__Homo_sapiens__NP_001003683
augggcagcuccgccaccgagaucgaagaacuggaaaacacaacuuucaaguaccucacgggggagcagaccgagaaaauguggcaaagacuuaaggguauucugaggugcuuggugaaacaguuagagcggggagacgucaauguuguggaucugaagaaaaacauagaguaugcugcaucuguacuagaagccguguacaucgacgagacacgccgacuccuggauacugaagacgagcuuucagauauucagaccgacaguguccccagcgaggugcgugauuggcuggcguccacauuuaccagaaagaugggcaugacuaagaaaaagccugaagagaaaccaaaguucaggucuaucguucacgcugugcaggccgggauuuuugucgaacggauguaucgcaaaacauaccauauggugggauuggcauauccggccgcuguaaucguuacccucaaggacguggauaaguggucguucgacgucuuugcacugaaugaggccucaggcgaacacagccugaaauucaugauauacgagcucuuuacgagauaugauuuaaucaacagguucaagauucccgugaguugucugaucacuuuugcugaggcccuugaaguggguuacuccaaauacaagaauccuuaucauaacuugauucacgcggcagacgucacccaaacaguucauuacaucaugcugcacacugggauaaugcacuggcuaaccgagcucgaaauucuggccaugguguucgcugccgcaauccaugauuaugagcacacaggaaccacgaauaacuuucauauucagacucggucugacguagcuauccuuuacaaugaccgcagcgugcuggaaaaccaccacgucuccgccgcguaucgauugaugcaggaggaggaaaugaauauccucauuaaccugucaaaagaugacuggagagauuuaaggaaucuggugauagagaugguucucaguacagacaugagcggccauuuccagcaaaucaagaacauucguaauucucuucagcagccagaaggcaucgaucgggccaaaaccaugucccugauauugcacgcagcugacauuucacaucccgccaagagcuggaagcuacacuaccgcuggacuauggcucugauggaggaauuuuuccuccagggggauaaagaggccgagcugggacuuccuuucaguccacugugcgacagaaagucuacaaugguggcacaaucccagaucgguuuuaucgauuucauugucgaacccaccuuuagcuugcucacggacucgaccgagaaaaucgugauuccucugauagaagaggccucuaaggcugagacauccucauauguagcgaguagcuccacuaccaucguuggcuuacauauugcagaugcccugaggcggucuaacacaaaagggagcaugucagacggaaguuacuccccagacuacagccuagcugccguggaucucaagucuuucaagaacaaucuggucgacaucauccagcaaaacaaagaacgauggaaggagcuugcagcccaggaagcucgcacuucaagucagaaaugugaguuuauucaccaguga

SEQ ID NO: 60478 - RNA, 1611 nt, Artificial Sequence
  derived and/or modified sequence opt3 from PDE1B__Homo_sapiens__NP_000915
auggagcugagccccagauccccuccagaaaugcucgaggaaucugacugcccgucaccccuugagcugaagagugccccuagcaaaaagauguggaucaaauugagguccuuacugcgguacauggugaagcagcuagaaaacggcgagauuaauauagaggaacucaaaaagaaccuggaguauaccgcuucucuucuggaagcagucuacaucgaugagacacgccaaauuuuggacacugaggaugaacuccaggagcugcgaucggacgccguuccaucagaagugcgugauuggcuggcgagcacguucacccagcaggcuagagccaaggggaggcgggcagaggaaaaacccaaguuucgcaguaucguacacgccgugcaagcuggaauuuucgucgagagaauguuuaggcggacauauacuuccguggguccuaccuacucuacagcaguucucaauugucugaaaaacuuagaccuuuggugcuucgauguguuuagcuugaaucaggccgcugacgaucaugcccugcgcaccaucgucuucgagcuacucacucgacacaaccugauauccagauuuaagaucccaacaguguuccuuaugucauuucuggacgcguuggaaaccggcuaugggaaauacaagaaucccuaucauaaccagauucacgcagccgauguaacgcagacuguucauuguuuccuccugaggaccggaauggugcacugcuuaagugagaucgaacugcucgcuauuaucuuugccgcagcuauacacgacuacgagcauacaggcacuaccaauagcuuccacauucaaacaaagucugaaugugccaucgucuacaacgaucgguccgugcuugagaaucaucacauuucaagcguguuucgucugaugcaggacgacgagaugaacaucuucaucaauuugaccaaagaugaguucgucgaacuacgcgcgcugguuauugaaauggugcucgccacggacaugaguugccacuuucagcagguaaagacuaugaaaacagcacugcaacagcuugagagaauagauaagccuaaagcucugucuuugcuccugcaugccgcugacaucucccacccaaccaagcagugguuagugcauucgagguggacuaaagcccugauggaagaguucuuucggcaaggugauaaggaggcagaacuagggcucccguucagcccccugugugaccgaacaucuacccuugucgcccagucccagauuggauuuaucgauuucauaguggagccuacguuuucaguuuugaccgacguggcugaaaagaguguccagccacuggcggaugaggacagcaaauccaagaaccaacccucuuuccaguggcgccagccuagccucgauguggagguaggcgacccaaaucccgacguugugucauuuagaaguacaugggucaaaaggauucaggaaaacaagcaaaaauggaaggagcgggcagccuccggcaucacuaaccagaugagcaucgaugaacugucuccgugcgaggaagaggcuccucccucaccagccgaggacgaacacaaucagaacgggaaucuugauuga

SEQ ID NO: 60479 - RNA, 2130 nt, Artificial Sequence
  derived and/or modified sequence opt3 from PDE1C__Homo_sapiens__NP_001177986
auggagagccccaccaaggaaaucgaggaguucgaauccaacucucugaaauaccuccagccugaacaaauugagaagauauggcuuagacugaggggcuugcggaaauauaagaaaacaucacagcgcuuacgaagucuggugaagcagcuagagcguggggaagccagcgucguugaccucaagaaaaaucuggaguacgcugcaacugugcuugaauccguauauaucgaugagacgagaaggcuguuggacaccgaggaugaacucucugacauucagucggaugccgugccaucagagguccgggacuggcuggcgagcacauuuacucgccaaaugggaaugaugcugagaaggagugaugaaaagccgcgguucaaauccaucgugcacgcuguucaggccgguauuuuuguggagcgcauguaccgaagaaccucuaacauggucggccucagcuaucccccugcagugaucgaagccuuaaaggacguagauaaaugguccuucgacguuuuuagccugaaugaggcuaguggggaucaugcacuuaaguucauauuuuacgaguugcugacaagguaugaccuaaucagccgguucaagauuccaaucucugcccucguguccuuugucgaagcucuggaggugggauacucaaaacacaagaaccccuaccauaaucuuaugcacgccgcggaugugacccagacuguccauuaucuguuguacaaaacaggcguugcaaacuggcucaccgaacuggagauuuucgccaucauauuuagcgcugccauucacgacuaugaacacacggguacuaccaauaacuuccauauccagacacguagugacccugcaauuuuauacaaugaucgcucugugcuggagaaccaccaucucuccgcugccuauagacuucugcaagacgaugaggaaaugaauaucuugaucaaccuaagcaaggacgauuggagggaguuucggacucugguaauugaaauggugauggcgaccgacaugucgugccacuuccagcagauaaaagccaugaagacagcacuccagcaaccagaggcuaucgaaaaacccaaggcccugucucuuaugcugcacaccgcugauauuucccauccugccaaggcaugggacuugcaccaucgauggacgaugucacuccuggaggaguucuuucgccagggggauagagaagccgaguuaggacugccauucaguccgcuaugugacaggaaaagcacuauggucgcucagucccaagugggcuuuaucgauuucauaguugaacccacauuuaccgugcucacugacaugacagagaagauugucucuccucugaucgacgagaccagccagacgggcgggaccggacagcggcgcucaagucuuaauuccaucucaucuucagaugcgaaaagaaguggugugaagacaagcggcuccgaagggucugcaccaauuaacaauucgguaaucagcguugacuacaaauccuucaaggccacuuggaccgaggugguccacauuaacagggaacguuggcgggcuaaggugcccaaagaggaaaaggccaaaaaggaggcagaggaaaaagcccgauuggcugccgaggaacagcaaaaggagauggaagcaaagucacaggcggaggagggagcuaguggcaaagccgaaaagaaaacaucuggugagacuaagaaccaggucaaugggaccagagcaaacaaaagcgauaauccuaggggaaagaacuccaaggccgaaaaaucaagcggcgagcagcaacagaauggcgacuuuaaggaugggaaaaacaagacagacaaaaaggaucauucuaauauaggaaacgacuccaaaaagaccgaugguacuaagcagcgcagucacggcagcccagcucccucuacguccucaacaugccggcugacccucccggugaucaaaccuccccugagacacuucaagaggccagccuaugcaaguagcucguacgcuccuuccguuucuaaaaagacugacgaacaucccgcccgcuacaaaaugcuugaucagcgaauuaagaugaagaaaauccaaaauaucagccacaacuggaaucggaaguga

SEQ ID NO: 60480 - RNA, 2805 nt, Artificial Sequence
  derived and/or modified sequence opt3 from PDE2A__Homo_sapiens__NP_001137311
auggugcugguccuccaccauauccuuauugccguugugcaguuccugagaaggggccaacagguauuuuugaagcccgacgagccuccaccgcccccucagccaugcgcugauagcuuacaggacgcacugcuaucccucgggucugugauagauaucucaggacugcaacgggccgucaaagaagcgcuuagugcugugcugccccgcguugagaccguguacacauauuugcucgacggugaaagccagcuggucugugaggauccuccacacgaacugccccaggagggcaaggugcgagaggccauuaucucccagaaacgucucgggugcaacggauuaggcuucucugaccugccugguaagccacuugcaagauugguagccccgcuggcucccgauacucaaguucuagugaugccucucgcagacaaagaagccggggcugucgccgcggugauucuggugcauuguggacagcuuucggauaaugaggaauggucacugcaggcagucgagaagcacacguugguugcccucaggcgggugcagguacugcaacagcgcggcccaagagaggcucccagggccgugcagaacccuccagaaggcaccgcagaggaccaaaaagggggagcugccuacacagaucgggaccgcaaaaucuuacagcugugcggugaacucuaugaucuugacgcgagcagucugcaguugaagguccuacaguaccugcaacaggagacucgagccuccagauguugccuccugcuugugucugaagacaaucugcaguugagcuguaaaguuauaggcgauaaggugcucggggaggaggucuccuuuccccugaccggaugcuuaggccaggugguagaagacaaaaagucaauccaacugaaggaucuaacaagugaggacguucagcagcuccagagcaugcuggguugugaacuucaagcaauguugugcgugccggucauuucuagggcuaccgaucagguggucgcccuggcuugugccuucaacaaacucgagggggaccuguuuacugaugaagacgagcaugugauccagcacugcuuccacuauacauccaccguucuuacgucaacucuggcauuucagaaggagcaaaaauugaagugcgaaugucaggcccucuuacagguggcuaaaaaucuguucacccaucuggaugacguaagcguccuacuccaagagauuaucacagaagcgcggaaccugaguaaugcagagauaugcucuguguuucuuuuggaucagaacgaacugguugccaagguguucgacggaggcgucguggacgaugaguccuacgagauucguaucccugcugaccagggcauugccgggcacguagcaacuaccggacagauccucaauauccccgaugccuaugcucauccacuguuuuaccgcgguguggacgauagcacaggcuucagaaccaggaacauuuuauguuuuccuauaaagaaugaaaaccaagagguuaucggggucgccgaacuggugaauaagauuaacggacccugguucucgaaguucgacgaggaucuugcaacggcguuuucuaucuacugcggcauauccauugcucacucauugcucuauaaaaaggugaaugaggcccaguaccggagucaccuggcaaacgaaaugaugauguaucauaugaaagucagcgacgaugaguacacuaagcuacugcacgacgguauccagccaguugccgcuaucgauuccaacuucgccucuuuuacauauacuccccgaagccucccugaagacgauaccucaauggcaauucugaguaugcuucaggacaugaauuucaucaacaauuacaaaauugacuguccaacauuggcucgcuuuugccugauggugaagaagggguauagagauccgcccuaccauaacuggaugcacgccuucuccgugagccauuuuuguuacuuacucuauaaaaaucuggagcuuaccaacuaccuggaagacauagagaucuucgcguuguuuauuucuugcaugugucacgaucucgaccacaggggcacgaauaacucauuccaaguagccaguaagagcguccuggcugcacuauauuccucugagggaucggugauggaacggcaucacuuugcccaggcuaucgccauccugaauacccauggcugcaacauuuucgaucacuuuagccgcaaagacuaccagagaaugcucgaucugaugagggacauaauccuugcaacagauuuggcgcaccaucugcguauuuucaaggacuuacagaaaauggccgagguuggguaugaucggaauaacaagcaacaccaucgacuccugcuuugucugcuaaugacuuccugcgaccucucagaucagaccaagggauggaaaacaacuagaaagaucgcugaacugauuuacaaagaguucuuuagucagggugacuuggaaaaggccaugggcaauaggccuauggagaugauggaccgcgagaaagcauauaucccagaacugcaaauaucuuucauggagcacaucgcuaugcccauuuacaaguuacuccaggaucuguuuccuaaggccgcagaacuuuacgagcggguggccagcaacagagaacauuggaccaaagucucccacaaguucacaaucagggggcugccaucaaauaacagcuuggacuuucucgaugaggaguaugaagugcccgaccuggauggaacccgcgcuccgauuaacggcugcuguucucuagacgcggaguga

SEQ ID NO: 60481 - RNA, 3426 nt, Artificial Sequence
  derived and/or modified sequence opt3 from PDE3A__Homo_sapiens__NP_000912
auggccgugcccggcgacgcugcaagggucagggauaagccuguucacagcggggugucccaggccccaaccgcgggacgggacugccaucaccgcgcugauccggccucuccccgagacucagguugucguggcugcuggggagaucugguacuccaaccucuuagaaguagcaggaaacuguccucugcauugugugccgggucguuaucauuccugcuagcucuccuggugcggcuuguccgcggcgagguggguugcgaccuggaacaguguaaggaggcagccgcugccgaagaggaagaggcggcaccaggggccgagggaggcguuuuucccggcccuagagggggagcuccagguggcggggccagguugagccccuggcuccagccuagugcacugcuguucucccucuuaugcgcuuucuucuggaugggacuguaccuuuugcgggccggcgugcgccugccacuagcggucgcccuccuggcagcuuguugcgguggggaagcccuugugcagaucggacugggcguaggcgaggaucauuugcucucucugccggcugccgggguuguguuaagcugucuggcagccgcuacauggcucguccuucgacugagauugggagugcuaaugauugcgcugacuuccgcagugaggacggucucacucauaagucuggaacgguuuaaaguugccuggcgucccuaucuugcuuaccuggccgguguguugggcauccuccuggcacgcuauguagagcaaauuuuaccucagagcgccgaggcugccccaagagaacaccuggggucucagcuaaucgcaggaaccaaggaggacauucccguguucaaaaggcggcgacgcuccucaagcgucgugagugcggaaaugucuggcugcuccagcaagucgcauagaaggacaucucucccuuguaucccacgggagcagcugaugggucacuccgaaugggaucacaagcgcgggcccagaggcucacaaaguagcggaacuuccauaaccguugacaucgcugugaugggcgaggcccaugggcuuauuacagauuugcuggcagacccgucucucccucccaacgucugcaccagccugagggccgugucaaaucuucugaguacucaguugacauuucaggcuauccacaaaccacguguaaacccuguuaccucccucagcgagaauuacacgugcucugauucagaagagaguagcgaaaaggacaaacuggccauucccaagcgguuacgaagaucccugccacccggacuacucaggcgcgugucuucgacuuggaccacaacuaccagcgcaacaggucugccuacccuugagccagcuccgguccggagagacagguccacgucaaucaaauugcaggaagcccccaguucuagcccugauuccuggaacaauccagugaugaugacucugacaaagucacgcagcuucaccucuuccuaugcgauaagugccgcuaaccaugucaaggcuaaaaagcaaagccgacccggcgcccucgcuaaaauuucuccucuguccucaccauguaguagccccuuacaggggacuccggccucgucccuggugucuaagaucagcgcaguucaguuuccugagucagcggacacaaccgccaaacaaagucuuggaucccaccgggcuuugacguacacccagucugccccagaucucagcccccagauucugacaccucccgugaucugcuccucauguggccguccauauagccaggguaauccugcagacgagccccuagaaagaagugggguagcuacuaggaccccaucucgcacagaugacacugcccaagucaccuccgauuacgagacaaacaauaacagcgacucgucagauaucgugcagaaugaagacgagaccgaaugccugcgggagccgcucagaaaggcaucugccuguaguacuuacgcuccugagacgaugauguuccuggauaaacccauucuugcgccagaacccuugguuauggacaaccuggacuccauaauggagcaguuaaauacauggaacuuuccuaucuucgaucucguggaaaauauuggcaggaagugcggacgaauccugagccaggucucuuaucgccuuuuugaggacaugggccuguucgaggccuucaagauaccaauucgggaauuuaugaacuacuuccacgcauuggagaucggguauagagauauccccuaccauaacaggauucacgcuaccgacgugcuccaugccguaugguaucugacuacccaaccuaucccgggacuaagcacagugauuaaugaucacgguuccaccucagacagugauagcgacucuggcuuuacucaugggcacaugggauacguuuucuccaaaacauauaacgucacggaugacaaguacggcugucugucagguaauauaccagcccucgaacugauggcucuuuacguggcagccgcgaugcacgauuaugaccaucccgggcguaccaacgcauuuuugguggccacaagugcaccucaggccguccuguacaaugaucgcagcguuuuagagaaccaccaugcugcagccgcguggaaucucuucaugucccggccagaauauaacuuucugaucaaucuugaccacguggaguucaaacacuuuagauuccuggugauugaggcuauccuagccacugaccucaagaaacauuuugauuucguagcaaaguuuaacggcaaggucaaugacgaugugggaaucgacuggaccaacgaaaaugauaggcuguugguuugccagauguguauuaaacuggccgacauaaacggccccgcuaagugcaaagaguuacaccuccaguggacagaugggaucgugaaugaauuuuacgagcaaggagacgaagaggccucucugggccuuccuauuucgccguucauggaucgaagcgcaccccagcuggcuaacuugcaggagucauuuaucucccauauugucgguccacucuguaacaguuaugacucugccgggcugaugccuggaaaguggguggaagauagcgacgaguccggcgauacugacgaccccgaagaggaagaggaggaagcgccagccccuaaugaggaagagaccugcgagaacaaugaaucacccaaaaagaagacguucaaacggcgcaagaucuacugccagauaacccaacaccuacugcagaaccauaaaauguggaagaaaguuaucgaggaggaacagagacuugcagguauugaaaaucaaucucucgaucagacaccacagagccacaguuccgagcagauccaagcuauuaaggaggaagaggaagagaagggcaaaccgagaggggaagagaucccuacucagaagcccgaccaguga

SEQ ID NO: 60482 - RNA, 3339 nt, Artificial Sequence
  derived and/or modified sequence opt3 from PDE3B__Homo_sapiens__NP_000913
augagaagggacgagcgggaugccaaggcuaugcgcagccugcagcccccugacggcgcaggguccccaccggaaucucuccgaaacggauacgugaaaucaugcgucaguccccuucgucaagauccuccaagagguuucuuuuuccaccuguguagguuuugcaauguugaguugcggcccccuccagccagcccccagcagccucgcagauguuccccauucugcagggcgcgguuaucucugggcgcucuagccgcauuugugcucgcccugcuucugggggcugaaccggagucgugggcagccggagcugccugguugcgcacccuccugucaguauguagccauagucugagcccccucuucucuaucgcgugcgcauuuuucuuuuuaacauguuuccugacucgaacgaagagaggcccugguccagggaggagcugcggauccugguggcuuuuggcccugcccgcuuguugcuaucuaggcgacuuucucguguggcagugguggucauggccuuggggcgauggggacgccggaagugcagcuccacacacacccccggaagccgcggccggucggcugcuucuggucuugagcugugugggccuccuguuaacccuggcacauccucuccgucuucgccacugcguucugguguugcuacuggcuucuuucgucugguggguguccuuuacuucacucgggagccugcccagugcccuuagaccacuguugucuggacucguaggcggugcugggugccuguuagcccugggacuagaucauuucuuccaaauuagggaggcaccucuccacccccggcuguccagcgccgcugaggaaaaaguuccagugauacgaccccgcagaaggucgucuugugucucccuuggcgagaccgcggcaucauacuauggcaguugcaagaucuuucggcgcccuagcuugccauguauuuccagagaacagaugauccugugggacugggaucucaaacagugguacaagccgcacuaucagaacucugggggagguaauggcguggaccugagcgugcuuaacgaggccaggaauauggucucagaucuguugacagaccccagucucccuccacaaguuauuuccagccugcguucuaucucaaguuuaaugggggcuuucagcggauccugccggcccaagauaaacccucugaccccauuucccggcuucuacccguguucugagaucgaagauccugccgagaaaggugaccgaaagcuaaauaaagggcucaacagaaauucgcugccaacuccccagcuuaggcgcagcuccggcacaucaggauugcugccuguggaacagaguucucggugggacagaaacaauggcaagaggccccaucaggaguuugggauuagcucccaaggaugcuaucucaacgguccauucaauucaaaccuguuaaccaucccuaaacagcgcuccucuuccguaagucugacgcaccaugugggccuucgacgggcaggggucuugagcucucucucccccgugaauaguaguaaccacggaccaguuagcacuggcucgcugaccaaccguuccccgauugaauuuccugauacagccgacuuccuaaauaagcccucugugauccugcagagaagccucgguaacgcuccaaauacucccgauuuuuaccaacagcugaggaacucagacaguaaucuuuguaacuccugcgggcaccagauguugaaguacgucucuaccagcgaguccgauggcacagacuguugcucaggaaaaagcggcgaggaagagaauauauucaguaaggaaucuuuuaaacugauggagacccagcaagaagaggagacggaaaagaaagauucccgcaaguuauuccaggagggggacaaauggcucacugaagaggcccagagcgaacagcaaacaaacauugagcaggaggugucgcuggaucuuauccugguagaagaguaugacucauugauugaaaagaugucuaauuggaacuuuccuaucuucgagcucguugagaagaugggagaaaaaucaggucggauccugucccaggugauguacacccuauuccaggauacuggccugcucgagauuuuuaagauaccaacacaacaguucaugaauuauuuuagagcacuggaaaacggguacagggacauccccuaucauaaucgcauucacgcgaccgacguccuucaugcugugugguacuugacgacccgaccugucccgggacugcagcagauccacaacggcugugguacagggaaugagacugauagcgacggccggauaaaccauggaagaauugccuauaucucuagcaaauccugcucaaacccagaugaaaguuacggcugcuuaagcucuaauauccccgcacucgagcugauggcccuuuacguggcugccgcaaugcacgacuaugaucacccugggaggaccaacgcuuuccugguugccacaaaugcgccacaagccgugcuauacaacgaccguuccguacucgagaaucaucacgcugcaucagccuggaaccuguauuugagucgccccgaauacaauuuucuguuacaucucgaucacgucgaguucaagcgguuuagauuccuggugauugaagcuauccuugccacugaccugaaaaagcacuuugauuucuuggcagaguuuaacgcgaaggccaaugacguuaacagcaauggaauugaaugguccaacgagaaugauaggcuccuggugugucaggucugcauaaaacuagcugacaucaacggcccugccaaggugcgagaucugcaucuuaaauggaccgaggguauuguaaaugaguucuaugaacagggggacgaagaggcaaaccucggacugccgaucucucccuuuauggaccggucgagcccacaauuggcuaagcugcaggaaucauucaucacacacauugugggcccuuuauguaacuccuacgaugccgcaggucuccugcccggccaguggcuugaggccgaggaagacaaugauaccgagaguggggacgaugaagacggagaggagcuggauacugaagacgaggaaauggagaacaauuugaacccaaaaccuccccgcagaaagucuaggcggcgaauauucugccagcucaugcaucaccugacggaaaaucauaagaucuggaaagagauuguugaggaagaggaaaaguguaaagcugauggcaacaagcuacaagucgagaauagcucccugccacaggcggacgaaauccaggugauugaggaggccgaugaagaggaauga

SEQ ID NO: 60483 - RNA, 2661 nt, Artificial Sequence
  derived and/or modified sequence opt3 from PDE4A__Homo_sapiens__NP_001104777
auggagcccccuaccgugccaagcgaaagaucccugucucucucacuuccgggccccagggaggggcaggccacacugaagccuccaccccaacacuuguggcggcagccucgcacuccaauccguauucagcagcgaggauacagugacagcgcugaaagagcagagagggaacggcaaccccaucgcccuauagagagagccgaugcgauggacacguccgauaggccagguuuacggaccacacgcaugucuuggccgucgucauuccacggcacugggaccggaagcggcggugcugggggaggcaguucccgaagauuugaggccgaaaacggccccacaccuucuccagggaggagcccccuggacucccaggcaucaccuggacugguccuccaugccggugcugcaaccagucagcggcgugagagcuuccuguaucgcucugauuccgacuacgauaugucaccaaaaacuaugagcagaaauaguucuguuacauccgaagcccacgcugaggaccuuaucgugacccccuuugcccagguacuggcgagcuugaggucggugcggucuaacuucucccuccugacgaaugucccggugccuucaaacaagcgaaguccccugggcgggccaacuccuguuugcaaagcaacccucagcgaggaaacaugucaacaguuagcccgcgagacucuggaagaacuugauuggugcuuggaacagcuggagaccaugcagacauauagauccgugucugagauggcuagccauaaguuuaaaaggaugcuaaaucgggaacucacccaccugucagagaugagucgcuccggaaaccaagucagcgaauacauuucuacgacuuuccuugacaagcagaaugagguggaaauccccucaccaacaaugaaggagagagagaaacagcaagcccccaggccucguccaagucagccgcccccuccacccguaccucaccuacagccaaugagccagauuaccggcuugaagaaacucaugcauuccaacucucugaauaacucgaauaucccccgguuugguguuaagacugaucaagaagaguuacuggcacaggaacucgagaaccuuaauaaaugggggcugaacauauucugugugagcgacuaugcuggaggccgauccuugacaugcaucauguacaugauuuuucaggaaagagaucuacugaagaaguucaggaucccggucgacaccauggugacguauaugcucacccuggaggaccacuaccaugccgauguggcguaccacaauucacuucacgccgcagacguccugcagaguacacauguuuugcucgcuacuccugcccuggaugcuguguuuaccgacuuagagauucuggccgcacuauucgccgcugcgauccacgauguagaccauccaggcgugucuaaccaauuucucauaaacacaaauagcgaacuggcacuuauguauaacgaugaguccgucuuggaaaaucaccaucuggccgugggguucaaacuccugcaggaggacaacugugauauuuuccagaaucuuucaaagcgccagcggcaaagccugagaaaaaugguuaucgacaugguguuggcuacugauaugucuaagcacaugacccuccuggccgacuuaaaaacaauggucgagaccaagaaagugacuuccaguggaguacugcuacucgacaacuacagcgauaggauucagguucugcgcaauauggugcacugcgcagaccuuucuaaccccacgaagccuuuggaacuguaucgacaguggacagaucggaucauggccgaguuuuuccagcaaggugaccgugaaagagagaggggcauggaaaucucccccaugugugauaagcauaccgcuucagucgagaaaagucaggugggguuuauugacuacauaguccacccacucugggagacuugggccgaucuggugcauccugacgcacaggaaaucuuagauacccuggaggacaaucgcgauugguauuacagcgcgauucggcaaucgcccuccccaccgccugaagaggaaucuagaggacccggccacccaccccuuccugacaaguuccaguuugaguugacacucgaggaagaggaagaggaagagaucagcauggcucagauaccaugcaccgcccaggaggcacugacugcccaaggucuaucagggguugaagaggcucuggaugccacaauugcaugggaagcuagucccgcccaggagucccucgaggugauggcgcaggaagccucucuggaggcugaacuugaggcaguauauuugacgcagcaagcccagagcaccggcuccgcuccugucgccccggacgaguucucaagcagggaggaguuugugguugcagugagucacucuuccccaagcgcgcuggccuuacagucgccccuccugccugcuuggcgaacucuuucagucucugaacaugccccaggacugcccggcuugccuaguacagcagcugagguggaagcccagcgcgagcaccaagcagccaaacgggcuuguuccgcgugcgccgggaccuucggagaagacacaagcgcacucccggcucccgguggcgggggaucuggcggugauccaacuuga

SEQ ID NO: 60484 - RNA, 2430 nt, Artificial Sequence
  derived and/or modified sequence opt3 from PDE4D__Homo_sapiens__NP_001098101
auggaggccgaaggcagcuccgcucccgcaagagccgggucuggagaggguucagacagugcgggcggggcuacccugaaggccccuaaacaccucuggaggcaugaacagcaccaucaauacccacuucggcagccgcaguuccgccuguugcacccccaucaccacuuaccuccacccccuccacccagcccucagccacaaccgcagugcccccugcagccuccacccccuccaccccuaccgccucccccaccucccccaggagcagcccgaggccguuaugcuuccucuggugcaacagggagagugaggcaucggggauacucggauacugagcgcuaucucuacuguagagccauggacaggacgucauaugcugucgaaaccggccaccggcccggccugaagaaaagccgcaugaguuggccuuccucuuuucaggggcuucgaagauucgauguugacaacggaacaagcgccgguagguccccacuggauccgaugacuucacccggcaguggguugauccuccaagcgaauuuugugcauagccagcggcgugagucuuuccuguaccgcuccgacucagauuaugaccugagcccuaagaguaugucuagaaacuccagcauugcaucggauauacacggagacgaucucaucguaaccccauuugcccagguguuagcuucucugaggacaguccggaauaacuucgccgcacuuaccaauuugcaggaccgagcucccuccaaacgcucaccuaugugcaaccaaccaaguauuaauaaggccacuaucacagaggaagcguaccagaagcuggccagcgagacccuagaagaacucgauuggugucuggaccagcuugagacgcugcaaacuagacacuccgugucugaaauggcaagcaacaaauuuaagaggauguugaaucgggagcucacccaucugucagaaaugagucgcuccggcaaccagguuagcgaguucauuucuaauacauuuuuagacaaacagcacgaaguggagauccccucaccgacucagaaggagaaagaaaagaagaaaagaccuaugagucaaauaagcggugucaagaaacugaugcauuccucuucgcucaccaacagcuccaucccaagguucggggugaagacagagcaggaagauguacuugcuaaagagcuggaagacguuaauaaguggggauugcacguguuucguauugccgagcuaucaggcaaccggccccugaccgucaucaugcauacgauuuuccaggagcgagaucuccugaaaacuuuuaagaucccuguggacacacuuauaaccuaccugaugacuuuggaagaucacuaucacgcugacguggccuaccauaauaacauucacgcagccgaugucguucagaguacacaugugcuccugucuacccccgcuuuagaggcgguauucacggaccuggaaauccuagcagccauuuucgcuagcgccauccacgauguggaccacccaggcgucuccaaccaauuucucaucaauaccaacucagagcuggcacuuauguauaaugauagcucuguguuggaaaaccaucaccuggccguuggguucaagcuccugcaggaggagaauugcgacauuuuucagaaccuuacuaaaaagcagagacaaucccugaggaaaauggugauagacaucgucuuggcuacagauaugaguaagcauaugaaucuccuggccgacuuaaaaaccaugguggaaacaaagaagguaacuagcucuggaguucugcuacucgauaacuacuccgaccgcauucaggugcugcagaauaugguccacugugcagaucuuucaaacccuaccaaacccuugcagcuguaucggcaauggacagacagaaucauggaggaguucuuuaggcagggugaucgcgagcgagagcggggcauggaaauaaguccaaugugcgacaagcauaaugcgagcguggagaaaucgcaggucggguucauugauuacaucgugcacccgcucugggaaaccugggcugaccugguucacccugaugcccaagacaucuuagauacucuggaggacaaccgugaaugguaucaguccacgauuccccagucuccaagccccgcaccugacgauccagaggagggaagacagggccaaacagaaaaguuucaguucgagcuuaccuuggaagaggacggugaaucagauacugagaaagacagugggucccagguggaggaagauaccucuuguagcgacuccaagacacucugcacccaggauucagagagcacugaaaucccccuggacgagcaaguagaagaggaggccgucggcgaagaggaagagagucagccugaggcuugugugauugaugacaggucuccggauacauga

SEQ ID NO: 60485 - RNA, 2628 nt, Artificial Sequence
  derived and/or modified sequence opt3 from PDE5A__Homo_sapiens__NP_001074
auggagagagccggccccagcuucgggcagcaaaggcagcagcagcaaccucagcagcagaagcaacagcagcgggaccaggauuccguggaggcuuggcuggacgaucacugggacuuuaccuucucuuacuuuguccgcaaagcaacacgagaaaugguuaacgccugguucgcggaacgugugcauacuaucccaguaugcaaggagggaauuagaggucacacggaaucauguaguugcccgcuccaacagagccccagggcugauaauuccgccccuggcaccccaacacggaaaauaucugcaucggaguuugaccgcccccuuagaccuaucguggucaaggauucagaggggacugugagcuuccugagugacuccgagaaaaaggaacagaugccauugacacccccuagguuugaucaugacgaaggagaucaauguucucgguuacuggagcuaguuaaggacauuagcucccaccucgaugugaccgcccugugccauaaaaucuuccuucacauucacggccugaucucagcugaccgcuauaguuuguuucucgucugugaggacagcucuaacgauaaguuccugauaucccgacuguuugacguggcagaagguucaacccucgaggaaguaagcaauaacugcaucagauuagaguggaauaaagggauuguuggacauguggccgcucugggcgaaccacuuaacaucaaggaugccuacgaggacccgagguucaaugcggaggucgaucagauuacuggcuauaaaacacagaguaucuuguguaugcccauaaagaaccaccgggaagagguggugggggucgcacaggccauuaauaagaaaucuggaaacgguggcaccuuuacggaaaaggacgagaaagauuucgcugccuaccuggcauucugcgggaucguucuacauaaugcucaacucuaugaaacuucccugcuugagaacaagcguaaucaggugcuguuggaccucgccagccugauuuuugaggaacagcagucguuagagguaauccugaaaaagaucgcggccaccauuauaucuuucaugcaagugcagaaauguacaaucuuuauugucgaugaagacugcuccgauucauucaguagcguguuucacauggagugugaggaacucgagaaguccucugacacucuuacccgcgaacacgacgcaaacaagaucaauuacauguaugcucaguacguuaaaaacacaauggagccucugaacauaccagaugugagcaaggacaaaagauuccccuggaccacggaaaauacuggaaacgucaaucagcaaugcauuaggucauugcuaugcacaccuaucaagaacggcaaaaagaauaaggugaucgguguaugucagcugguuaacaaaauggaggagaauaccgggaaggugaaaccauuuaaccggaaugaugaacaguuccucgaggccuuugucauuuucugcggacugggcauccagaacacucaaauguacgaagcuguggagcgagccauggcaaagcagauggucacacuugaagugcugaguuaucaugccuccgcugcggaggaggaaacccgcgaguugcagagccucgcagccgcuguugugcccucugcccaaacgcugaaaauuaccgacuuuucauucagugauuuugaauuaagcgaccuggagacagcacuauguacuauaagaauguucaccgaucucaaucugguacagaacuuccagaugaagcacgaaguccuuuguagguggaucuuguccgugaagaaaaauuaccggaagaacguugccuaucauaauuggcgccacgcuuuuaacacagcccagugcauguucgcagcgcugaaagcuggcaagauucaaaacaaacucacugaccuggagauccuugcccuguugaucgcagcccucucucaugaucuggaccacagaggggugaauaacucguacauucagaggagcgagcacccguuagcucagcuguauugccauuccauaauggaacaccaucacuuugaucagugucuaaugauccucaauucaccuggaaaccaaauucugaguggucuuucuaucgaggaauacaagaccacauugaagauuaucaaacaggccauacuggcaaccgaccucgcucuguauaucaagcgucggggcgaguucuuugaauuaauucgaaagaaucaguucaaccuggaggauccccaccagaaagagcuauuuuuggccaugcucaugacugcgugcgaccugagcgccaucacgaaaccauggccuauucaacagagaaucgcugaacuugucgcaacagaguucuuugaccagggggauagggaacgcaaggagcugaauauagagcccaccgaccucaugaaccgggaaaagaaaaauaagauuccauccaugcaagugggauucaucgaugccauuugucugcagcuuuacgaggcuuugacucauguaucagaagacugcuuuccccuguuagauggcuguaggaaaaacagacagaaguggcaggcccucgcagagcaacaggagaaaaugcugaucaauggugaaagcgggcaggcgaagcgcaacuga

SEQ ID NO: 60486 - RNA, 2583 nt, Artificial Sequence
  derived and/or modified sequence opt3 from PDE6A__Homo_sapiens__NP_000431
augggcgaggugaccgccgaagaggucgaaaaguuccuggacagcaacaucggguuugcuaaacaguacuauaaucuccacuacagagcaaaacuuauuuccgaucuguugggagccaaggaggcggcuguugacuucucuaacuaucauucacccaguagcauggaagaguccgagauaaucuuugauuuacugagggacuuccaagaaaaucuacagacagagaagugcauuuuuaacgugaugaaaaagcucuguuuccugcuucaggccgaucggaugucucuguuuauguaccgcacucgaaaugguaucgcagaauuggccacgcgucucuucaacguacacaaggacgcugugcuggaggauugccuggucaugccugaccaggagauuguguuuccacucgauaugggcaucguugggcauguggcacacucgaaaaagauagccaaugucccgaacaccgaagaggacgaacauuucugugauuuuguggacaucuuaacagaguauaaaacuaagaauauucuggcuucacccaucaugaacggaaaagauguaguugccauuaucauggcggugaauaaggucgacggcagccacuucaccaagagagacgaagagauacuuuugaaauaccugaacuuugcaaaucuaauuaugaagguguaucaccucaguuaccugcauaacugcgagacaaggcggggucaaauccuucugugguccgggucuaaaguguucgaagaguugaccgauauugaacgccaguuccacaaggcccucuacacugucagagcuuuucugaauugugacagguauagcguuggauuacuggauaugacaaaacagaaggaguucuuugacguguggccuguacucaugggcgaagugccacccuacuccggcccucggaccccagaugggcgcgagaucaacuucuauaaagucaucgacuacauucuucauggaaaggaggauauaaaggugauccccaacccuccaccggaccacugggcccugguuucagguuugcccgcauauguggcucagaauggccuaauuugcaacaucaugaaugccccugcggaagacuuuuucgccuuucaaaaagagccacuggaugaaaguggguggaugauaaagaacguccucagcaugcccauugugaauaaaaaggaggaaaucguaggaguugcaacguucuacaaccgaaaagauggcaagccuuuugacgagauggacgagacucugauggaaucucuuacccaguuccuggguugguccguguugaauccagauacauaugagucaaugaacaagcucgaaaauagaaaagacaucuuucaggauauugucaaguaccacgugaaaugugacaacgaggagauccagaagauucugaaaacuagggaagucuacgggaaggagcccugggaaugcgaggaagaggaguuagcugaaauacugcaagccgagcuaccggaugcugacaaguaugaaaucaauaaauuccauuuuagcgaucucccucugaccgagcuugaauuggugaaguguggcauucagauguacuaugagcugaaaguuguggacaaguuccacaucccccaggaggcccucguacgguucauguacagucugucuaaaggauaucguaagaucacauaccauaacuggcgccacggcuuuaaugucgggcaaaccauguucucccuucuggugacgggaaaguugaaaagauauuuuacugaucucgaagcacuggccaugguuacagcugcguucugccaugacauugaucacagggguaccaacaauuuauaccagaugaaaagccagaacccacuggcaaagcuacacggcucgucuauacucgagcggcaucaccuggaauuugggaagacucuuuugcgagacgagucccugaacaucuuccagaaucucaaccgcagacaacaugaacacgccauucacaugauggauaucgcuauuaucgccacagaccuggcauuauacuuuaaaaagaggaccauguuccagaaaauaguggaccagucaaagacguaugagagugagcaggaauggacccaauacaugaugcuggagcagacacggaaggaaaucgucauggccaugaugaugacugcuugugaucuuagcgccauuaccaaaccuugggaggugcagucccagguagcauugcucguggcggcugaguuuugggaacaaggagaccuggagcgcacaguucuacagcagaaucccaucccaaugauggauagaaacaaggccgacgaacugcccaaacuccaggucggcuucauugauuuugugugcacuuucguguauaaggaguuuucuagguuccaugaagagaucaccccuaugcuggacgguauaacaaauaaccguaaagaguggaaggcacuugccgaugaauacgacgcuaagaugaaaguccaagaggaaaagaaacagaagcagcaaagcgccaaaucagcagcugccgggaaucagccaggcggaaacccgagucccggcggggcgaccacuuccaagagcugcuguauucaguga

SEQ ID NO: 60487 - RNA, 2565 nt, Artificial Sequence
  derived and/or modified sequence opt3 from PDE6B__Homo_sapiens__NP_000274
augagccuguccgaggaacaggccagaucuuuccucgaccaaaaccccgauuuugcuaggcaguacuucggcaagaaacuuucaccugagaauguggcagccgcgugcgaagacggguguccaccggauugcgacagucugcgggauuugugucaggucgaggaaagcaccgcuuuacuggagcuaguucaggacaugcaagaguccaucaacauggaacgcgugguauuuaaggugcuccgacgucugugcacacuucugcaggccgauagauguucuuuguucauguauaggcagcggaauggagucgcagagcucgccacucgccuguuuucggugcagcccgacucaguucuggaagauugccucgugccuccagacagcgagauugucuuccccuuagauauaggugugguaggccacguugcucaaacgaaaaagauggugaacgucgaggacguggcagaauguccucauuuuaguuccuucgccgaugagcugaccgacuacaaaacaaagaauaugcuugcuacuccaaucaugaacgggaaggacguggucgccguuauuauggcggugaauaaauugaacggacccuuuuucaccucugaagaugaggacguauuucugaaguaucuaaauuucgcaacacucuaccugaaaaucuaucaccuuagcuaccugcauaacugcgaaaccagaaggggccagguguugcucugguccgccaauaaggucuuugaggagcugacugauauugaacggcaguuccacaaggcuuucuauacagugcgcgccuacuuaaacugugagcgauacucaguuggucugcucgacaugaccaaggaaaaggaguuuuucgauguguggaguguccuuaugggggaaagccagccuuauucuggaccaagaacgccggacggcagggagaucguguuuuacaaaguaauagauuauauccugcauggcaaggaggaaauuaaaguuauccccacuccuuccgcagaccacugggcuuuggccucagggcuaccaagcuacguggcggagaguggauucauuugcaauaucaugaacgccucugcagaugaaauguuuaaguuccaagagggugcucuggacgauuccggcuggcucauaaagaauguccugagcaugcccauugugaacaagaaagaagagaucgucgggguggccaccuuuuauaaccggaaggacggaaagccuuucgacgagcaggaugaaguucuuauggagucgcugacacaguuuuugggcuggucugugaugaauacugacaccuacgauaaaaugaacaagcucgaaaaucguaaagacauugcucaagauaugguacuguaucacgucaagugugaccgcgaugagauccaguuaauccugccaacaagagccaggcuagguaaagagcccgcagacugcgaugaagacgagcucggggaaauucugaaggaggaacuuccgggaccuaccacguucgauauauacgaguuucauuucuccgacuuggagugcacugaacuggaucucgugaaguguggcauccagauguacuaugagcugggcguugugcggaaauuucagauuccccaagaaguccuugugcgauuccuguucucaaucaguaagggguaccgcagaauaacauaucacaacuggaggcauggauuuaauguagcccagaccauguucacuuugcucaugacagguaaacugaaaagcuacuauaccgacuuagaggcuuuugcgauggugacggcaggccugugccacgacauugaucaccgggggaccaacaaucuauaccagaugaaaucccagaacccacucgccaagcugcauggaucuagcauccuugaacgccaccauuuggaguucggcaaguuucugcucucagaggaaacacugaauaucuaucaaaacuuaaauagaaggcagcacgagcauguuauucaccugauggacaucgcuauuauagccacugaucuugcauuguacuucaaaaagcgugccauguuucagaaaaucgucgacgaaaguaagaacuaccaggauaaaaaguccuggguggaguaucucagccuggaaaccacacggaaggagauugugauggcuaugaugaugacugccugugaccuaucugcaaucaccaaaccuugggagguccaaucaaagguugcgcugcucguggcugccgaguucugggaacagggugaucuggaacgaacagugcuugaccagcagcccaucccaaugauggauagaaauaaagcagccgaguugcccaagcugcaaguaggguuuauugacuucgucugcaccuuuguguacaaagaguucaguagguuucacgaagagauauuaccuauguucgaucgccuccagaacaaucggaaggaauggaaagcucuggccgacgaguaugaagcaaagguuaaggcucuugaggagaaagaagaggaagagagaguggccgcgaagaaagucggcacugaaaucuguaacggaggcccagccccgaaaagcuccacgugcuguauucuguga

SEQ ID NO: 60488 - RNA, 2577 nt, Artificial Sequence
  derived and/or modified sequence opt3 from PDE6C__Homo_sapiens__NP_006195
augggcgagaucaaccagguggccgucgaaaaguaccuggaggaaaauccccaauucgcuaaagaguauuuugacagaaagcucaggguugaagugcuuggggagauuuucaaaaacagccagguaccugugcaguccucuaugucauuuagugagcugacccaggucgaagagagcgcauugugcuuagaacugcuauggacagugcaagaggagggagguacuccagaacagggcguucaccgggcccuccagcgccuggcgcaucuucugcaggcugaucgauguuccauguucuugugccguucuagaaaugggauaccggagguggccucgaggcuccuggacgucacgcccaccucaaaguuugaagauaaccuggugggaccugacaaagagguaguuuucccacucgauaucggcauuguggguugggcagcccacacaaagaagacucauaauguccccgacgugaaaaagaacagccacuuuagugauuucauggacaaacaaaccggguacgugacaaagaauuuacuggcuaccccuaucgucguuggaaaagaagugcuugcaguaauuauggccgugaacaaggucaaugcuuccgaguuuucuaagcaggaugaggaaguguucagcaaauauuugaacuuuguuuccaucauacugcggcuacaucacacuucauacauguauaauaucgagagucgcagaagccagauucucauguggucugccaacaagguguucgaagaacugacagacgucgaaaggcaguuucacaaagcgcuuuacaccgugcgguccuaucugaauugugagcgcuacucaaucggcuugcucgauaugacgaaggagaaagaguucuacgacgaguggccaauuaagcugggcgaaguagagcccuauaaagggccuaagacuccagauggacgagaaguuaacuucuacaagaucauagacuauauuuuacaugguaaagaggagaucaaggugauuccgacacccccugcagaccacuggacacugaucagcggccucccaacuuacgucgccgaaaauggguuuaucugcaacaugaugaacgcucccgccgaugaguauuucaccuuucaaaaaggaccuguggacgaaacaggcugggucauuaagaaugugcuuagucugccaauaguuaacaaaaaggaggauaucguggguguagcaaccuucuacaauagaaaggacgggaaacccuuugaugagcaugacgaauauauuacggagacuuugacacaguuccuaggauggucucugcucaacaccgauacuuacgacaagaugaauaaacuggaaaacaggaaggauaucgcucaggagaugcuuaugaaucaaacaaaagccaccccggaagagauaaaguccauucugaaguuucaggagaaauugaacgucgacgugaucgaugacugugaagagaagcagcucguugcgauccugaaagaagacuuaccugauccccggagcgccgagcuguacgaguuccguuuuucggacuucccacuaacggaacacggccucauuaagugcggcauccgccuguuuuucgagauuaauguggucgaaaaauuuaaggugccuguagaggugcuuaccagauggauguauacaguuaggaagggguaccgggcagucacuuaucacaacuggcgacauggauucaaugugggucagaccauguucacauugcugaugacuggccgccucaaaaaguacuauaccgaucuggaggcuuuugccaugcuugcugccgcauucugucacgacauagaucauagagggacaaacaaucuguaccaaaugaaaucuaccucccccuuggccaggcuccacggaucaaguauccuggaacggcaucacuuagaauauagcaagacucugcuacaggacgagucccucaacauuuuucagaaucugaacaaacgccaguucgagacggugauccaccuuuuugaagucgcuaucauugcgacagauuuggcacuguacuucaagaaaagaaccauguuucaaaagauaguugacgccugcgagcagaugcagacugaagaggaggcuaucaaguacgugaccguggauccaaccaaaaaggaaauuaucauggccaugaugaugaccgcaugugaccucucugccauuacuaaacccugggagguacagagccaagucgcucugaugguggccaacgaguucugggaacagggcgauuuagaaaggacaguucugcagcagcaaccuaucccaaugauggaccguaauaagcgggaugagcuuccgaaacuccagguggguuuuauagacuucgucugcacguuuguguauaaggaguucucacgauuucauaaggaaaucacccccauguugagugggcugcagaacaauagaguugaguggaaaucccuagcagacgaauacgaugcgaagaugaaagugauugaggaagaggcuaagaaacaagagggcggagccgaaaaggcagccgaggacagcggcgggggagaugacaagaaaucuaagacuugucugaugcucuga

SEQ ID NO: 60489 - RNA, 453 nt, Artificial Sequence
  derived and/or modified sequence opt3 from PDE6D__Homo_sapiens__NP_002592
augagcgccaaggacgagcgggcuagggaaauccugcggggcuucaaacucaacuggaugaaucuucgcgaugcagagaccgggaagauucuguggcagggaacagaagacuuguccgugcccggugucgagcacgaagcccgaguuccuaaaaagauauuaaaaugcaaggcggugucucgugagcugaacuuuucaaguacugagcaaauggaaaaguucagacuagagcagaaaguauacuuuaagggccagugucucgaagagugguucuuugaguucggguuugugaucccaaauagcacgaacaccuggcagucccugauugaagcugccccggagucucaaaugaugcccgcaucgguccuuacaggaaaugugaucauugaaacuaaauucuuugaugacgaucuguugguuucaaccagcagggugagacucuucuaugucuga

SEQ ID NO: 60490 - RNA, 264 nt, Artificial Sequence
  derived and/or modified sequence opt3 from PDE6G__Homo_sapiens__NP_002593
augaaccuggagcccccuaaggccgaguucagaagcgcuaccaggguggcaggcgggccagucacaccgcggaaaggacccccuaaguuuaaacagcgccaaacucgacaguucaaguccaaaccacccaagaaggguguucagggcuuuggggacgauaucccuggaauggaaggccucgguacggacauuaccgugauaugcccaugggaagccuucaaucaccuugagcugcaugaauuggcgcaguacgggaucauuuga

SEQ ID NO: 60491 - RNA, 252 nt, Artificial Sequence
  derived and/or modified sequence opt3 from PDE6H__Homo_sapiens__NP_006196
augagcgacaacaccacacugcccgccccugcuuccaaucagggcccaacuacgccgagaaaggggcccccuaaauucaagcaaaggcagacccggcaguuuaaaucuaagccacccaaaaagggagugaaggguuucggcgaugacaucccugggauggagggacucggcacagauauuacugucauaugcccaugggaagcauuuucacaccuugagcugcaugaauuggcccaguucgguaucauuuga

SEQ ID NO: 60492 - RNA, 1449 nt, Artificial Sequence
  derived and/or modified sequence opt3 from PDE7A__Homo_sapiens__NP_001229247
auggaggugugcuaccagcugcccguccucccucuugacagaccaguuccgcaacacgugcugagcaggcggggcgccaucuccuucucuucaaguagcgcuuuguuugggugucccaacccucgccaguuaucccagcgacguggagcaauuucuuaugauucgucagaccagaccgcccuguacauaagaaugcuaggugauguaagggugcggagccgcgcgggcuucgaaagugagagaagggggucccauccauauaucgacuuucggauuuuccacucucaaagcgaaaucgaggucuccgugucagcucgcaauauucgaagacuccugaguuuucagagguaccuucggagcucucguuucuuucgcggaacagccguuuccaacucacugaauaucuuggaugacgauuauaacggccaggcaaagugcaugcucgaaaaaguggguaauuggaacuucgacauauuucuguucgauagacugacuaaugggaacagccucgucaguuuaacguuucaucuguucucucuucacggauugaucgaguacuuucaucuggacaugaugaagcuaaggcgguuccucgugaugauucaggaggauuaucacucccaaaaucccuaccacaacgccguacaugcugcagacguuacccaggccaugcacuguuaccugaaagaaccuaaacuugcuaauagcgugacaccaugggauauccuguugucgcucauugccgcggcaacucaugaccuggaccaccccggcgucaaccagccuuucuuaaucaagaccaaucacuaucuggccacacucuacaagaacaccucugugcuugagaaucaucacuggcgauccgcugugggccuguugcgcgaaucagggcuauuuagucaucugccacucgagagcagacagcaaauggagacucagauaggagcccugauucuugcaacagauaucuccaggcagaacgaauaucugucuuuguuccggagccaccucgaccgcggugaucugugcuuagaggacaccagacauaggcaccugguccuacaaauggcucucaagugugccgauauuugcaacccgugucguacgugggaacugucaaaacaguggagugagaagguuacugaagaguuuuuccaccagggcgacaucgagaaaaaguaccaucuuggggugucccccuugugcgaucggcacaccgaaagcaucgcgaauauucagauaggauuuaugacauaucugguagagccucucuucacugaaugggcccgauuuucuaacaccagacugucacaaacaaugcuuggccaugugggucugaauaaagcaaguuggaagggguugcagagggagcagagcuccucugaagacaccgaugcugccuucgagcucaacucgcagcuguuaccacaagagaaucgccugagcuga

SEQ ID NO: 60493 - RNA, 1353 nt, Artificial Sequence
  derived and/or modified sequence opt3 from PDE7B__Homo_sapiens__NP_061818
augagcugccugaugguggagagauguggcgaaauccucuucgagaaccccgaccagaaugccaagugcgucuguaugcuuggggauauuaggcugcggggacaaaccgguguucgcgcugaacgacguggcuccuacccuuuuauagacuucagauuguuaaacucuacaacuuauucaggggagaucggaacgaaaaagaaagugaagaggcugcuaaguuuucagcgguacuuccacgcaagccgccuccugagaggcauuaucccacaggccccgcuucaucuguuggaugaagacuaucucggucaggcgaggcacaugcuguccaaaguagggaugugggauuuugacauuuuccuguuugaucggcucaccaauggaaacucuuuagugacacugcuuugccauuuguucaauacucacggccugauccaucacuuuaagcuagacauggucacccuccaccgcuuccuggugaugguucaagaggauuaccauucgcagaaccccuaucacaaugcugugcaugccgcagacgucacacaggccaugcacuguuaccuuaaggagccuaaacuggcuucauuuuugaccccacucgauauaaugcugggcuuacuggcagccgcugcccacgacguggaucaucccgggguaaaccagccuuuccucaucaagacuaaucaccaucuugcgaaccuguaucaaaauaugagcguuuuggaaaaccaccauuggcgaaguacaauuggaaugcuaagagaguccaggcugcucgcacaucugccaaaagaaaugacccaggacaucgagcagcagcuugguucucugauuuuggccacggacaucaaucggcaaaacgaguuucucacucgucugaaggcucacuuacacaauaaagaucugcgccuagaagacgcccaggauagacacuucaugcuccagauagcacugaagugcgcugacauuuguaaccccugcaggaucugggagaugagcaagcaaugguccgaacgggugugugaggaguucuaccgacagggcgaacuugagcagaaauuugaauuggagauuucaccucugugcaaccagcaaaaggauaguaucccaagcauccagauuggguucaugucuuacauagucgaaccgcucuuucgcgagugggcccauuucaccggaaauuccacacugucagaaaacaugcuuggccaccuggcgcacaauaaagcccaguggaagaguuugcuccccagacagcauaggagccgggguucuuccgggagcggaccugaccacgaucaugcaggccaaggcacugagucggaggaacaggagggggacucuccauga

SEQ ID NO: 60494 - RNA, 2490 nt, Artificial Sequence
  derived and/or modified sequence opt3 from PDE8A__Homo_sapiens__NP_002596
augggcugcgcccccagcauccacauuuccgagagacugguggcugaagacgcaccuucuccagccgcgccgccccucucaagugggggaccuaggcuuccacagggucaaaagaccgcugcccugccccggacacgcggcgcaggguuguuagagagcgaacugcgagauggauccggcaaaaaggucgccguugcugacgugcaguucgguccuaugcguuuucaucaggaucagcuacaaguacuccugguguucacuaaagaggacaaccaguguaauggguuuugcagagcaugugaaaaggccggauucaaaugcacggucaccaaggaggcucaggccgugcuugcguguuuucuggauaagcaccaugacauaaucauuaucgaucacaggaacccacggcaguuggacgcagaggcccucugccgcucuauuagaucgucaaaacugagcgaaaauacaguuaucgugggcgucgugaggcggguagaucgcgaggaacugaguguuaugcccuucauauccgcuggcuuuacucgaagauacguggagaacccuaauaucauggccuguuauaacgagcucuuacaacuggaguucggggaagucaggucucagcuuaaguugcgggcaugcaauagcguguuuaccgcucuggaaaacuccgaggacgccauugaaaucacaucagaggaucguuucauucaguacgcgaauccagccuuugagaccacuaugggauaucagaguggugaacuaaucggcaaagagcucggggaagugccgauaaacgagaagaaagcagaccugcuugauacaauuaauagcuguauccgcauuggaaaggaauggcaaggcaucuacuaugcuaagaaaaagaacggugacaauauccagcagaacgucaaaauuauacccguuaucgggcaaggaggcaagauuagacauuacgugucuaucauaaggguaugcaauggcaacaacaaagccgagaagauuuccgagugugugcagucagacacccacacggauaaucagacugggaaacacaaggaccggcgaaagggaagccuggaugucaaagcuguggccagucgcgcaaccgaaguuucuucccagagaaggcauagcucgauggcccggauccacucuaugacaaucgaggcuccuauuacuaaggugaucaacauuauaaaugcggcacaagaauccucaccaaugcccgucaccgaggccuuggaccgcgugcucgaaauccugagaacaaccgaguuauauaguccucaguucggugcuaaagaugacgauccacaugccaacgaccugguaggcgggcucaugagcgauggacuuaggcgucuguccggcaaugaguacguuuugucuacgaagaacacucagauggugagcucaaauauuaucacacccaucagucuagacgaugucccgccucggauugcacgagccauggaaaacgaggaauacugggacuuugacauauucgagcuggaggcugccacccacaauagaccccucaucuaucugggucuuaaaauguucgcaagguuugggauuugcgaguuccugcacugcuccgaaagcacuuugcgcucuuggcuccagaucauugaagcgaacuaccauucaaguaauccauaucacaacagcacacauuccgcugaugugcugcacgccaccgcauacuuuuuaucuaaggagcggaucaaggaaacgcuggacccuauagaugaggucgccgcucuaaucgccgcaaccauucaugacguggaucaccccggcagaacaaauucguuccucuguaacgcuggaagcgagcuggccauccuuuauaaugacacugcgguuuuggaaucccaccaugccgcucuggcauuucaacucaccacaggcgaugacaaaugcaacauuuucaagaacauggagaggaaugauuaccgcacucugcgacaggggaucauagacauggugcuugccaccgaaaugacaaaacacuuugagcauguaaacaaguucgucaauucaauuaacaaaccacuggcuaccuuggaagagaauggagagacugauaagaaccaggaagugaucaauacgaugcuccggacacccgagaaccguacccugauuaagagaauguuaaucaaaugugccgacguuaguaauccuugcaggccacugcaguauuguauagaaugggcagcgcgcaucucugaggaauacuuuagccaaacugaugaggagaagcagcagggucuaccgguggucaugcccguguucgaccggaauaccugcuccauuccuaaaucacagaucagcuuuauugacuacuucaucacagauauguuugacgccugggaugcuuucguagaccucccagaucugaugcaacaccuugacaacaacuucaaguauuggaaaggcuuggaugaaaugaagcugagaaaucucaggcccccuccagaguga

SEQ ID NO: 60495 - RNA, 2367 nt, Artificial Sequence
  derived and/or modified sequence opt3 from PDE8B__Homo_sapiens__NP_001025022
augggcugcgcccccagcauccacgugucccagucuggggucauuuacuguagagacucagaugagaguagcuccccuaggcaaaccacaucuguuucgcagggaccagcugcaccgcugcccggucucuucgugcagacugacgccgcggaugcuauaccuccaucacgggccagcgggcccccuaguguagcacgcgugcgacgugccagaacggaacuuggcuccggaucuagcgcuggcuccgcagccccagcugccaccacaucaaggggucggcgcagacauugcuguaguagcgcggaggcagaaacucagaccugcuauacaucugucaagcaaguguccucagccgagguuaggaucgggcccaugcggcugacccaggacccuauucagguguuguuaaucuuugcuaaagaagauagccagagugacggauucuggugggccugugaucgcgcaggcuaccgaugcaacauugcuagaacuccagagucugcccuggaguguuuucuagacaagcaccaugaaaucauagucaucgaucacaggcaaacacagaauuucgacgcggaggccgugugccgguccauucgugcaaccaacccgagcgaacauacgguaauccucgcuguugugucgcgcgucucugaugaccacgaggaggccuccgugcugccccuucugcacgcuggcuuuaauagaagguucauggaaaacucaaguauuaucgccuguuauaaugaguugauacagauugaacauggggaggugcggagccaguuuaaacuccgagcaugcaacuccgucuucacugcccuggaucacugucaugaagcuaucgagauuaccucugacgaccacguuauccaaauccacaagauucaucgcgauagcggagacaauucacagacagagccucacaguuuuagauacaaaaacaggcggaaggaauccauagauguuaagagcaucucuucacgcgguagugacgcgccaagccugcagaauagaagguaucccuccauggcacguauucauucuaugacuaucgaggccccuauaaccaaaguaauuaacaucaucaaugcugcccaagaaaacucgccagugacagucgcagaggcccucgaucggguguuagaaauucugcgaaccacggagcuuuacagcccccaguugggcacuaaggacgaggauccgcacacauccgaccugguugggggacuaaugaccgauggccucagaaggcugucagguaaugaauauguguucacuaaaaacguccaucagagucacucucaccuugcuaugccuaucacaauuaaugacgugcccccaugcauaagccagcuguuggauaacgaggaauccugggacuuuaacaucuucgagcucgaagccauuacccauaagcgcccucugguauacuuagggcugaaaguguuuucacgguucggagugugcgaguuccucaauuguagcgagacgacccuuagagcaugguuucaagucaucgaagcgaacuaccacucuuccaaugcuuaucauaacaguacacacgccgcagacgugcugcacgccacugcuuucuuuuugggcaaggagagggucaagggcagccuagaucagcuggacgaaguggccgcacucaucgcugccaccguucaugauguggaccaccccgggcgcacaaauucuuuccugugcaacgcgggauccgagcuugccguacuguacaaugauacugcugucuuggagucacaucacaccgcacucgccuuucagcugacagugaaagacaccaaguguaacauuuucaaaaauauagaucgaaaccauuaucggacuuuacgucaggcuaucauugacaugguucuggccacggaaaugacaaagcacuuugagcacgugaauaaauucgucaacaguaucaauaagccaauggcagcggaaauugaggguagcgauugcgaauguaaccccgccggcaaaaauuuuccugagaaccaaauccuaauaaagagaaugaugaucaagugcgcugacguggccaacccauguaggccgcucgaucugugcauugagugggcagggcgcaucucggaagaguacuucgcucagaccgacgaagagaaacggcagggacuucccguagugaugccuguuuuugauagaaauacuuguuccauuccaaagucucagaucagcuucauagacuauuuuauuaccgacauguucgaugccugggacgcauucgcccauuugcccgcucugaugcaacaccucgcggauaacuacaaacauuggaagacacuggacgaucuuaaaugcaagucacugagguugccuagugacuccuga

SEQ ID NO: 60496 - RNA, 1602 nt, Artificial Sequence
  derived and/or modified sequence opt3 from PDE9A__Homo_sapiens__NP_001001567
augggcagcggguccucuucauacagacccaaggccaucuaucuggacauugauggaaggauacagaaagugaucuucaguaaguacugcaacagcuccgacauuauggaucucuuuuguaucgcuaccggucuuccucggaauacaacuauuucucuguugacgaccgacgaugcaauggucucgaucgacccaacaaugccggccaacucagagcgcacucccuauaaaguucgaccuguggcgauaaagcaauuaagcgaacgugaggaacugauccagaguguacuagcucagguggccgagcaguucuccagagcauuuaaaauuaaugaacucaaggccgaggucgcuaaccaccuggcagugcuugagaagaggguugaacuggagggcuugaaaguggucgaaaucgagaagugcaaaucugauauuaagaaaaugcgggaggaacucgccgcucgcagcuccagaaccaauuguccaugcaaguacucauuccuggacaaccauaagaaacugacacccaggcgggaugugccuaccuauccaaaguaccucuuaagucccgagacuaucgaagcccugcgcaaaccuacauuugacguauggcuuugggagccaaaugaaauguugagcugucuggagcacauguaucaugaucuagggcucguucgagacuucucuauaaacccggugacccugagaagguggcuguuuugcguccacgauaauuaccggaacaaucccuuccauaacuuucgucacuguuucugcguggcgcaaaugauguacuccaugguguggcuuuguucauugcaggagaaguuuagccagacggacauucucauccugaugacugcagccauuugccacgacuuagaucauccuggauauaauaacaccuaccagaucaaugcucgcacagaacuggccgucagauauaacgacaucaguccacucgagaaccaccauugugcaguugcuuuccaaauucuugccgaacccgagugcaauauauuuucuaacaucccuccagauggcuucaaacagauuaggcaggguaugaucacucugauauuggcgaccgacauggcccggcacgcagaaauuauggauuccuucaaggagaaaauggagaauuuugacuacagcaacgaggaacacaugacacuacugaagaugauccucaucaagugcugugauauuucgaaugaagugcgacccauggagguagcugaaccguggguggacugccugcuugaggaguauuucaugcagucugaucgcgaaaaauccgaggggcugccugucgcccccuuuauggacagagauaaggugaccaaagcuacggcccaaaucggauucauuaaguuuguuuugauaccaauguucgaaacugugacaaaacucuuuccuauggucgaggagaucaugcugcagcccuuaugggaaucaagggaccgguacgaggaacugaagcgcauugacgaugcaaugaaggagcuacagaaaaagaccgacagucucacuagcggcgccacagaaaaauccagagagaggucucgugaugugaagaacagcgagggcgacugugcuuga

SEQ ID NO: 60497 - RNA, 732 nt, Artificial Sequence
  derived and/or modified sequence opt3 from PDF__Homo_sapiens__NP_071736
auggccagacuguggggcgcucucagccuuuggccccugugggcagccgugccuuggggaggggcggcugccgucgguguuagggcaugcuccucuaccgccgcuccagacggcguggaggggccggcauugcggcgcucauacuggcgacacuuacguagacugguacuaggacccccugaaccacccuucagucaugugugucaggucggcgauccugugcucagggguguugccgcuccaguggagcgggcccaacuugggggacccgaacuucagcgccugacacagagauugguccaggugaugaggcggcgccgaugcguaggccucagcgcgccucaacugggcguuccaagacaggugcuggcacucgaguuaccggaagcccuguguagggagugucccccucggcagcgugcucugcgccagauggagccauuucccuugagagucuucgugaacccuucccugagggugcuagacucucggcucgucacuuuuccagaagggugcgagucgguugccggauuccuggcaugcgugccccgauuucaagcuguacagaucucaggucuugauccgaauggcgaacagguggucuggcaggccagcgggugggcggcccgcauuauacaacacgagauggaccaucugcagggauguuuguucaucgauaagauggacaguagaacguuuaccaacguguauuggaugaaaguuaaugauuga

SEQ ID NO: 60498 - RNA, 636 nt, Artificial Sequence
  derived and/or modified sequence opt3 from PDGFA__Homo_sapiens__NP_002598
augagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacauga

SEQ ID NO: 60499 - RNA, 726 nt, Artificial Sequence
  derived and/or modified sequence opt3 from PDGFB__Homo_sapiens__NP_002599
augaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcauga

SEQ ID NO: 60500 - RNA, 1038 nt, Artificial Sequence
  derived and/or modified sequence opt3 from PDGFC__Homo_sapiens__NP_057289
augagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggauga

SEQ ID NO: 60501 - RNA, 1113 nt, Artificial Sequence
  derived and/or modified sequence opt3 from PDGFD__Homo_sapiens__NP_079484
augcacagacugaucuucguguacacccucauuugcgccaacuuuuguagcugcagggacacauccgcuacuccccagucugcaucaauaaaggcccuucggaaugcgaaccugcgccgagaugagaguaaucauuugacggacuuauaucguagagaugaaaccauccaagucaaaggaaacggguacguucagagcccuagguucccaaauuccuauccgcggaaccugcuacucacauggcgccugcacucucaggagaauacuaggauucagcuuguguuugacaaccaauucggacuggaagaggcugaaaaugauaucuguagauacgacuuuguagagguggaggauauuucggaaaccucaacaaucauacggggucgcuggugcggccauaaggaggugcccccucgaaucaaaagcagaaccaaccagauuaagaucacuuucaaaagugacgauuauuuugucgccaagccaggguucaagauuuacuauuccuugcucgaagacuuucagcccgcagccgcuucugagacaaauugggagagcguuaccuccucaaucaguggagugagcuacaacucuccuuccgucacggauccaacucugauagcagacgcccuggauaaaaagauugcugaguucgacaccguggaagaccucuuaaaauacuuuaaucccgaaucauggcaggaggaucuggaaaacauguaucuugacacaccuagguaccggggccguagcuaucacgaucgcaagaguaaaguagacuuggauagacugaaugacgaugccaagagguacucuuguacuccacggaacuauuccguuaacauccgagaggagcuaaagcucgcgaauguggucuucuuuccgcgcugccugcuugugcaaagauguggugggaacugcggauguggcaccgugaauuggaggagcugcacauguaacucgggcaaaaccgucaagaaauaccaugaaguucugcaguucgagcccgggcacauuaagcggcgcggcagagcaaaaacgauggccuugguggacauccagcucgaucaccaugaaaggugcgacugcaucuguucuucccguccuccacgguga

SEQ ID NO: 60502 - RNA, 3345 nt, Artificial Sequence
  derived and/or modified sequence opt3 from PDGFRA__Homo_sapiens__XP_006714102
augcugcccagacucgugcuuaacagcugggcccagaugaucugccugccucaauugccaaaguucccgagggcuaugggcaccucccaccccgcauuuuuaguccuggggugucuacucacaggacugucucuuauucugugccaguugucacucccuaguauacugccaaaugagaacgaaaaaguugugcagcugaauagcuccuucucucuccgguguuuuggugagucggaaguaucauggcaguaccccaugagcgaggaagagaguuccgacguggagauccgcaacgaagagaauaacucuggcuuauucgucacugugcuggaaguuagcuccgccucagcggcucauacggggcuuuauaccugcuacuauaaucacacacaaacugaggagaacgaauuggagggacgacauauuuacaucuaugugccugauccagacgucgccuuugugccccugggcaugaccgauuaccuaguaauuguugaagacgaugacagugcaaucauaccuugucguacaaccgauccagagacuccggugacacuccacaauagcgaaggugucgugcccgccucuuaugacuccagacagggguucaacggaaccuuuacggugggcccuuacaucugcgaggcuacugucaagggcaaaaaguuccagaccauuccauuuaauguuuacgcacugaaagccacaucagagcuugaucuggaaauggaggcuuugaagacuguguauaagagcggggaaaccaucguagugacaugugccgucuucaacaaugaggugguugaccuccaguggaccuaccccggagaagugaaagguaagggcauuacgaugcuggaggagaucaaagucccuaguauaaaguuaguguauacucugacaguaccagaagcgaccguuaaagauucuggggacuacgagugcgcagccaggcaagcuacucgggaagugaaggagaugaagaaagucacaauuuccgugcaugaaaagggauuuaucgagauuaaacccaccuucagccagcucgaggccgucaaccuucacgaagugaagcacuuuguuguggagguacgcgcauauccgccucccagaaucucguggcugaaaaauaacuugacgcuaaucgaaaaccugaccgagauuacaacugaugucgagaagauacaggaaaucagguaccggucuaaacucaagcugauucgcgcuaaggaggaagacuccggccauuauaccaucguggcccagaaugaggacgcgguuaaaucauacacauucgaacuucugacucaagugccaaguagcauauuggaucucgucgacgaucaccaugguuccaccgggggacagacagugcgauguaccgccgagggcacuccucugcccgacauugaguggaugaucugcaaggauaucaaaaaguguaacaaugaaacgucuuggacaauuuuagcaaacaauguaagcaacaucauuaccgagauacacucaagagacaggaguacuguggaaggccggguuaccuucgcuaaagucgaggaaacaaucgccgugcguugccuggcuaagaaucuacucggggccgagaaccgcgagcugaaacuuguggcaccaaccuugagauccgaacugacugucgccgcugcgguucucgugcugcuugugauuguaaucaucagccugauugucuuggugguuauauggaaacagaagcccagguacgagauccgguggcgagugauugaaucuaucucaccugauggacacgaguauauuuacgucgacccaaugcaacucccguaugauagucgcugggaauuucccagagacggucugguguuaggcaggguucuggggagcggagcauucggcaaagugguagaggguacagccuacgggcuaucccggucucagccugucaugaagguggcugugaaaaugcucaagccaacggcccgcucgagcgagaagcaggcacugauguccgaacuuaaaaucaugacccauuugggcccccaccugaauauagucaaccuccugggagccugcacuaagucaggcccuaucuauauuaucacagaguacuguuuuuauggggauuuaguuaauuaccugcauaaaaacagagacaguuuccuuucucaccauccagaaaagcccaaaaaggaguuggacauuuuuggacucaauccggcugaugagagcaccagguccuacgugauccugucauucgaaaacaauggugacuauauggauaugaagcaggccgacacaacucaauacguaccuaugcuagagcguaaagaagugagcaaguauucugauauacagcggucccuguacgaccgaccagcaaguuauaaaaagaaaagcaugcucgauucugaggucaagaaccugcuuuccgacgauaacucagaaggcuugacccuguuagaccuccugaguuuuacguaccagguggcgagagggauggaguuccuugcuagcaaaaauugcguucacagggaucuggccgcacgcaacguguugcucgcccagggaaagauugucaagaucugugacuuuggccuggcucgggauauuaugcacgacucgaauuauguguccaaagguucuaccuuccuacccguuaaguggauggccccugagagcaucuuugacaaccuguacacaacucucucagauguguggaguuacgggauacugcuuugggaaaucuucuccuugggcggaacccccuauccaggcaugauggucgacucuacauuuuacaauaaaauuaagagcggguauagaauggcaaaaccugaucaugcuacuuccgagguauacgaaaucauggugaagugcuggaacucagagcccgaaaagaggccgagcuucuaucaccugagugagauuguugagaauuuacucccaggacaauacaaaaagucuuaugaaaagauccaucuggacuuccuuaaguccgaucacccugccguggcgcgcaugcgagucgacagcgauaacgccuacauaggugugaccuacaaaaaugaggaagacaagcugaaggauugggagggcgggcuagacgaacagcggcucucggcugauucaggauauauuaucccccugccagacaucgaucccguaccugaggaggaagacuugggcaaacguaacagacacucuagucagacguccgaggaaagcgcaauugagacagguucuagcuccucaaccuuuaucaagagggaggacgaaacuauugaggauauagacaugauggaugacaucgggauugauaguagcgaccugguggaagauucuuucuuauga

SEQ ID NO: 60503 - RNA, 3321 nt, Artificial Sequence
  derived and/or modified sequence opt3 from PDGFRB__Homo_sapiens__NP_002600
augagacugcccggcgccaugccugcucucgcacuuaagggggagcuguuguuacugagccuacuccugcuucuggaaccacagaucucccaaggauugguggucaccccgcccgguccugagcucguucugaacgugucuucaacauucguacugacuugcaguggcagcgccccaguggucugggaaaggaugucccaggagcccccucaggaaauggcgaaagcucaggacgggacguuuucuucggugcucaccuuaacaaaucugacuggacuugauaccggcgaguacuucuguacacacaacgacucacgggguuuggagaccgaugaacgcaagcgacuguauauuuuuguuccagaccccacugugggguuccuaccuaaugaugccgaggaacucuuuauauuccugacagagaucaccgagauuacgaucccaugccgugucacugacccgcaacuugugguaacccugcaugaaaagaagggagauguugcauugcccgugccuuacgaccaccagagaggcuuuagcggcauuuucgaggauaggaguuauaucuguaaaacaacuauaggggaccgggaagucgauuccgacgccuacuauguguaccgccuccaggugucuagcaucaacgucuccguuaaugcugugcagaccguagugagacaaggagagaacauuacacugaugugcaucgucauugguaaugaagugguuaacuuugaguggaccuauccaaggaaggagucaggccgguuaguggaacccgucacggauuuccugcucgacaugccuuaccauauccgcaguauacuucacauuccaagcgcagagcuggaagacucugggacuuacacauguaaugugaccgaguccguaaacgaucaucaggacgaaaaggccaucaauauuacuguuguggagucaggauauguccgauugcuaggcgagguggguacacugcaguuugcugaacuccacagaagcaggacccugcaggucguguucgaggccuaucccccgccuacgguucuuugguuuaaagauaaccggacccugggggacaguucugcgggagaaaucgcauuguccacacguaaugugagcgagacucgcuacguaucggaacucacccuggucagagugaagguugccgaggcuggccacuacacaaugagggccuuccaugaggaugcagaagugcaauuaucuuuccagcugcagaucaacguccccgugcggguacuagagcucuccgaaucacacccagacaguggcgagcaaacugugcgaugccgcgggagaggaaugccucagcccaauauuauauggagcgcuuguagggaucugaaacggugcccacgcgagcuucccccuaccuugcuggguaacuccucugaagaggaaagccagcucgagacaaacguuaccuauugggaagaggagcaggaauuugaggucgugucaacucugagacuucaacauguggacaggccacugaguguccguuguacguugcggaaugccguuggccaggauacacaggaagugaucgugguaccgcacucccuccccuucaaggucgugguuauuagcgcgauccuggccuuagugguccugaccauaauuucucuaaucauccucauuaugcuguggcagaaaaagccucgauacgagaucagauggaaggugauugaaucaguuaguagcgacgggcacgaguauauauacguggauccaaugcaacuucccuacgacuccacuugggaguugccuagggaccagcugguacucggacgcacccugggcucuggugcauuugggcaggucguggaagcuacagcccauggcuuaucgcacagccaggcuaccaugaaaguggccgucaagaugcugaaauccacugcacggucaagugagaagcaagcccuuaugucugaauugaaaaucaugagccaucucggaccacaccugaacguugugaaucuacugggcgcuugcacaaaagggggacccauuuauaucaucacggaguacuguagauauggugaucucguagacuaccugcauaggaacaaacacaccuuccuucagcaccauuccgauaagcgccgaccgccuucagcggaauuguauagcaaugcacugccagugggcuuaccccucccuucucacgucucccugacuggggagagugacggaggcuacauggauaugagcaaggacgagucuguggauuauguucccaugcuugacaugaaaggugaugugaaguacgccgacauugaauccucaaacuacauggcuccauaugauaauuacgucccuagugcccccgagcggacaugccgugcaacccugauaaacgaaagcccaguguugucguauauggaccucguuggguuuuccuaccagguggccaauggcauggaguuccuggcuucuaaaaacugcguccauagagaucuagccgcaaggaauguacugaucugugagggaaagcucgugaaaauuugcgacuuuggccuggcgcgcgacaucaugcgggauagcaacuauauuucaaaggggaguacauuccuuccguugaaguggauggcuccugaauccaucuuuaauucucuguacacuaccuuaagcgacguuugguccuucggaauacuccugugggagaucuuuacgcuugguggcacccccuauccagaacugcccaugaacgagcaguucuacaaugccauuaaaagaggguacaggauggcacaaccugcccacgcuucagaugaaaucuaugagauuaugcagaaguguugggaggaaaaauuugagauccgaccacccuucagccagcuagugcuccuguuggaacgccuguuaggagagggcuacaagaaaaaguaucaacaggucgacgaagaguuccuccggagugaucacccugccauacugagaucucaggcaaggcuuccggguuuucaugggcugcguuccccauuggacacaagcucggugcucuacacugcuguacagcccaacgagggcgauaacgacuauauuaucccucugccagaucccaagccugaaguggccgacgagggaccgcuagaaggcucacccucucuggcgaguuccacccuuaaugaggucaacacaagcucuacuauuagcugcgauuccccacucgaaccucaagacgagcccgagccagaaccucagcuggaguugcagguugaacccgagccagagcuggaacaguuaccggauucaggguguccugcuccccgcgccgaggcagaagacaguuuccucuga

SEQ ID NO: 60504 - RNA, 1128 nt, Artificial Sequence
  derived and/or modified sequence opt3 from PDGFRL__Homo_sapiens__XP_011542860
augaagguguggcugcuccuuggccuguuguuaguccacgaagcccuggaagacguuaccgggcagcaucuacccaaaaacaagagaccuaaagagccaggagaaaauaggaucaagccgacaaacaaaaaggugaagcccaaaauuccuaagaugaaagaucgggacagcgcuaauuccgcaccaaagacucaaucuauaaugaugcagguacucgauaaaggucgcuuccagaagcccgccgcgacgcugucacuucuggcuggccagaccguggaguugcgaugcaaggggagucguaucggauggagcuacccugccuaucucgacacauuuaaagauuccagacugucugucaagcaaaacgaaagguacggccagcugacucucguuaauucgaccucagcagacacaggugaguucagcuguugggugcaguuaugcaguggguauauuugucggaaagaugaggccaagaccggauccacuuacaucuuuuucacagaaaaaggcgagcuguuugugccaucucccagcuauuucgacgucguguaccuuaacccugaucgccaggcuguaguuccaugcagagugaccgucuuguccgcaaaggugacgcugcacagggaauuuccggccaaagagauucccgcuaauggcacugacaucguguaugauaugaagcggggguucgucuaccuacaaccucauucagagcaccagggaguuguguacugucgcgccgaagcggguggccgaagucagauaagcguaaaguaucagcuccuguacguggcagucccaucugggcccccuuccaccacaauccuugccucaagcaacaaagugaagaguggagacgauauuucuguucugugcacuguguugggcgagccagacgucgaaguggaguuuaccuggaucuuccccggucaaaaagacgaaagaccgguaacaauucaggauaccuggaggcucauccaucgggggcugggacacacgacucguauaucccagagcguuauuacaguggaggacuuugagaccaucgaugcuggcuauuacauuuguacugcccaaaauuuacagggccagacaaccgucgcaacgaccguggaguucucguga

SEQ ID NO: 60505 - RNA, 1173 nt, Artificial Sequence
  derived and/or modified sequence opt3 from PDHA1__Homo_sapiens__NP_000275
augagaaagaugcuggccgcugugagcaggguccucuccggcgcaucucagaaacccgccucacggguucuuguggcgagucgcaacuucgcuaaugacgccaccuuugagaucaagaaaugcgaucugcaccgauuggaagaggggccuccaguaacaacuguguuaacgcgugaagacggacugaaguacuauagaaugaugcaaaccgucaggcggauggagcuaaaagcagaucagcucuacaagcagaagauuauacgcgguuucugucaucugugcgacggccaggaagccuguugcguggggcuugaggcuggaaucaacccgacagaucaccugauuacugcauauagagcccauggcuuuaccuucacaagggguuugagcguucgggagauccucgcugaacugaccgggcgcaaaggaggcugugccaagggcaaagggggauccaugcacauguacgcgaagaauuuuuaugguggcaacgggauugugggagcacaagucccccugggcgccgguaucgcucucgccugcaaauacaaugggaaggacgagguguguuuaacucuguauggagauggcgcagcuaaccagggccagauauucgaagccuacaauauggcggcccuuuggaaguugccuugcaucuuuauuugugagaacaaucgauacgggaugggaacaucuguagagagagcagcugccucgaccgacuauuacaaaaggggugauuucaucccaggccugcggguugacgggauggauauucuaugcgugcgugaagcuacgcgcuuugccgcagccuauuguagaucaggaaagggccccauccucauggagcugcagacuuacagguaucauggucacagcaugagugacccuggggucuccuaccggacccgagaagagauacaagaagugcgcucuaaaagcgauccaauuaugcuucugaaggacagaauggugaacuccaauuuggcuucagucgaggagcucaaagaaaucgacguugaggugaggaaggaaauugaggaugcggcacaguucgccacagcugaccccgaaccuccacuggaggaguuaggcuaucacaucuacaguagcgauccgcccuuugaaguacggggagccaaccaguggaucaaauucaagucuguguccuga

SEQ ID NO: 60506 - RNA, 1080 nt, Artificial Sequence
  derived and/or modified sequence opt3 from PDHB__Homo_sapiens__NP_000916
auggccgcugugagcggccuggucagaaggccccuccgggagguuuccgggcuucugaagcgccgauuccacuggaccgccccugcagcguuacaggugacaguacgugacgcuaucaaccaaggaauggaugaagaguuggaaagagacgagaaaguguuucugcuaggugaagaggucgcccaguacgauggcgcauauaaggugucuagggggcucuggaaaaaguacggagacaaacggauuauagauacuccaaucucagagaugggcuucgccgguauugcuguuggggcagccauggcuggacugcgcccgaucugcgaauuuaugacguucaauuuuaguaugcaggccauugaccaggugaucaacagcgcggcaaagaccuauuacauguccggcggccuucaacccgucccuauaguguucagagggccaaauggagccucugcugguguagccgcacagcauucgcaguguuuugcugccugguauggccacugccccgggcugaagguugugucaccuuggaacagcgaggaugcgaaaggauugaucaagagugccauuagggacaauaacccagucguggugcucgaaaaugagcugauguacggcguccccuucgaguuuccuccagaagcacaguccaaagauuuccugaucccgauugguaaggcuaaaaucgagcggcaagggacacauauaacuguugugucucacagccgccccguaggacauugucucgaagccgcugccguguuauccaaggagggcgucgaaugcgaggugauuaacaugcgaaccaucagaccuauggacauggagacaauugaagcaucaguuaugaagaccaaucaccuggugacugucgagggcggguggccacaguuuggagugggugccgaaaucugugcuaggaucauggagggccccgcguucaacuuucuugaugccccugcaguacggguuacaggggcugacgugccaaugcccuaugccaaaauuuuggaagauaauaguauaccgcaggucaaggacaucauuuucgcaaucaaaaagacccugaacauauga

SEQ ID NO: 60507 - RNA, 1461 nt, Artificial Sequence
  derived and/or modified sequence opt3 from PDHX__Homo_sapiens__NP_001128496
augcagagcggcggggccgagggaucccccggugcuggcagaaccgggaggggaccuggcucugguaaggcaccaccggccgaaaucucaaguggggcgcccgacuucccuggaggcgauccaauuaaaauacugaugcccagccucuccccuacaauggaggaaggcaacaucgugaaguggcuuaaaaaggagggggaagcugucucugccggagacgcacugugcgagauugagacugauaaagccguugugacguuggacgcuucggaugacgguaucuuagcaaagauuguaguggaagagggcucaaagaauauccggcuggggagccuaauaggacucaucgucgaagagggcgaggauuggaaacacguggaaauuccaaaggacguuggucccccuccaccggugaguaaacccuccgagccucgcccaucucccgaaccucaaaucagcauuccagucaagaaagagcauauccccgggacccugcgauuucgucuuuccccggccgcuagaaacauacuggaaaagcacucauuggaugccagucagggaacagcgacuggcccuaggggcauuuucaccaaggaggacgcacucaaacuggugcagcugaagcagacagggaaaaucaccgagagccggcccacuccagccccuacagcuacccccacggccccaucuccccuccaagcaacugcuggaccuuccuacccacgcccgguaauucccccuguuucaaccccaggucagcccaaugccgugggcacauuuacugaaaucccugcgagcaacaucagaagggucauugccaagcgguuaaccgagaguaaaucuacagugccacaugcauaugcuaccgccgauugugaccugggggcugugcuuaagguccgccaggauuugguuaaagacgacauaaagguguccguaaaugauuucaucauuaaggccgcagccgugacgcugaaacagaugcccgacgucaacgugagcugggauggagaaggcccgaagcaacuaccuuuuaucgacauaucgguugcuguggcgacugauaaaggucuccugacaccaauuaucaaggacgcagccgcuaaagggauccaggagauugccgauucugucaaggcacuuuccaagaaagcccgagacggcaagcuguugcccgaagaguaccagggaggcucauucaguaucagcaaucucgggauguuuggaauugaugaguucaccgcugugauaaacccuccccaggccugcauccuggcaguagguagauuuaggccaguuuuaaaacugacugaagacgaggaaggcaaugcgaagcuccaacagcggcagcuuauuacagugaccauguccucugauagccgugucguggacgacgagcuggcuacgcgcuucuugaaaucauuuaaggccaaccuagaaaauccuaucagacuggcauga

SEQ ID NO: 60508 - RNA, 1578 nt, Artificial Sequence
  derived and/or modified sequence opt3 from PDIA2__Homo_sapiens__NP_006840
augagcagacagcugcuccccgugcuucuguuguuacugcuaagggccuccugcccuuggggccaagagcagggggcucggucuccaucagaggagccgcccgaagaggaaaucccuaaggaggacgggauucucguccugagucgccacacccuuggucuggcauugcgagagcauccagcccuccugguugaguucuacgcgcccugguguggccacugccaggcucuggccccugaauauagcaaagcagccgcugugcucgcagccgaauccaugguagugacauuagcuaaggucgaugggccagcccagcgugagcuggcggaggaauuuggagugacugaguaccccacgcuuaaauucuuuagaaacggcaauaggacccauccugaagaguauacagguccacgggacgcagaagggauagccgagugguugcgcagaaggguuggaccgucugcuaugcggcuggaggaugaagccgcagcucaagcccuaaucggcggccgcgaccucguggucauuggguucuuucaggaucugcaggacgaggauguggcgacuuuccuugcccuggcacaggacgcuuuggauaugaccuuuggacucacagaccgacccagacuguuccaacaguuugguuuaaccaaggauacuguaguucuguucaaaaaguuugacgaaggcagggccgauuucccuguggacgaggaacucgggcuugaccugggagauuugucgcgguuucuagucacacacucaaugcgucuggugaccgaguucaacagccagacgagugcuaagaucuucgccgcacgcauucucaaucaucugcuucuguuugugaaccagacuuuggccgcucacagagagcuccuggcgggcuucggugaagcagccccaagguuucgggggcaagucuuauucguugugguagacguggcugccgauaaugagcacguccugcaguacuuuggacuaaaagcagaagccgcucccacccuccgacuggugaaccuugagacaacuaagaaauaugccccuguugacggcggcccagugaccgcagcguccaucacagcuuucugucaugccgucuugaauggacaggugaagcccuaccugcucucucaagaaauaccgccugauugggaccagcgccccguaaaaacccugguuggaaagaacuuugaacagguggcauucgaugagacgaagaaugucuuugugaaauucuaugccccauggugcacucacuguaaggaaauggcuccugccugggaggcacuugcugaaaaauaccaggaccaugaggauaucauuaucgccgagcuggacgcgacagccaacgaauuggaugcuuuugcaguccacgguuuccccacccucaaguacuuuccagccggccccgggagaaaagugauugaguauaagagcacuagggaccuggaaacauucuccaaauucuuagacaauggaggcguucugccuaccgaggaaccaccggaggagcccgcugccccuuuuccagaacccccugcaaacucaacgauggguaguaaggaggaacuauga

SEQ ID NO: 60509 - RNA, 1518 nt, Artificial Sequence
  derived and/or modified sequence opt3 from PDIA3__Homo_sapiens__NP_005304
augagacugaggcggcucgcccuuuuccccggcguggcucuguuguuagcagccgcgcgccuggcugccgcaagcgacguccuagagcucaccgaugacaacuuugaaucccgaaucucugauacagggucagccggacugaugcuuguugaguucuuugcuccuuggugcggucacuguaagcgucuggcaccagaauacgaggccgcugccacuagauugaaaggcauugugccgcucgcgaagguagacugcacggcaaauaccaacacauguaauaaauauggggugaguggauaccccacucugaagauauucagggauggcgaagaggccggugcuuaugacgggccucggaccgccgauggaaucgucagccaucugaaaaagcaggcaggcccagcuuccgugccccuccgcacagaggaagaguuuaagaaauucauuucugacaaggaugccucgaucguuggcuuuuucgacgauucauuuagcgaagcgcacagugaguucuuaaaagccgcauccaaccugagagacaauuacagguuugcucauaccaacguggagucucuugucaaugaauaugaugacaacggggagggaauuaucuuguuccggccuagccaccugacuaauaaguuugaagacaaaacaguggccuacaccgagcaaaagaugacguccgguaagaucaaaaaguucauacaggaaaacauuuucggcaucugcccacauaugacugaggauaauaaagaccuaauucaggggaaggaucuccugaucgcuuauuacgacguagauuacgagaaaaacgccaagggaucaaauuauuggcgcaaccgaguuaugaugguggccaaaaaguuucuugacgcaggccacaagcugaauuucgcugucgcgaguagaaaaaccuuuagccacgaauugucugauuucggucucgaguccacagcaggggaaauacccgugguggccauuaggacugcuaagggagagaaauuugucaugcaggaagaguucucacgggacggcaaggcccuggagcgcuuuuuacaagauuacuucgacggcaaccugaaacguuaucucaagagcgaaccuaucccagagaguaacgaugggccgguuaaggugguaguggcagaaaauuuugacgagauugucaacaaugaaaacaaagacgugcuuaucgaguucuacgcccccugguguggacauugcaagaaucuggagccuaaauauaaggaauugggugagaaacuaucuaaggauccaaacaucguuauugcuaagauggacgccaccgcaaaugaugugcccuccccuuacgaagucagaggcuuuccaacaauauauuucagccccgcgaacaaaaagcugaauccgaaaaaguacgaagggggaagggagcucucggacuuuaucucuuaccugcagcgggaggcuaccaacccucccgugauucaggaggaaaaaccaaagaagaaaaagaaagcccaggaggaucuuuga

SEQ ID NO: 60510 - RNA, 1938 nt, Artificial Sequence
  derived and/or modified sequence opt3 from PDIA4__Homo_sapiens__NP_004902
augagacccaggaaggccuuccugcuccuucuguuguuaggccuggugcagcuacucgcugucgcaggggccgagggaccugacgaagauagcuccaaccgggagaaugcgaucgaagacgaggaagaggaggaagaggaagaugacgaugaggaggaagacgaucuggagguuaaagaagagaacggugugcuuguacugaaugacgcuaacuuugauaauuucguggccgacaaggauaccgucuugcucgaauuuuacgcaccauggugcggccacuguaaacaauucgccccggaguaugagaagauugcuaacauacugaaagacaaggaucccccuaucccaguggcaaagauugacgccacaucugcuucaguucuggccagucgcuuugacgugagcggguaccccacuaucaaaauucucaagaaaggacaggcggucgauuaugaaggcucccgaacgcaggaggaaaucguggcaaagguacgugagguuucucagccugacuggaccccacccccugaagugacauuaguccugacuaaagagaauuucgaugagguggugaacgacgccgauauaauccuugucgaauuuuacgcuccauggugcggucauuguaagaaguuggccccggaguaugaaaaagcagcuaaggagcugucgaaaagaucacccccuauuccacuagccaagguugacgcgaccgccgaaacagaucucgcaaaaagguucgacgugagcggguaccccacccugaagaucuuucggaaaggacgcccuuaugauuacaauggcccaagagagaaguacggcauuguagacuauaugaucgagcaaagugggcccccguccaaggaaauacuuacucugaaacaggugcaggaguucuugaaggauggagacgacgucauuaucauugguguguuuaaaggcgaaucugauccugcuuaccagcaauaucaggacgccgcuaacaaucucagggaggauuacaaguuccaccauacauuuagcaccgagaucgccaaauuccugaagguuucccaggggcaguuaguggucaugcaacccgaaaaguuccagucaaaauaugagccacggagucacaugauggacgugcagggaagcacgcaagauucugcaaucaaggacuuuguacugaaauacgcccucccucuuguuggccaucgcaagguguccaacgaugcuaaacgauauacuagaaggccccuggucguggucuacuacucaguggacuucagcuuugauuaucgggcggcaacccaguucuggcguaguaagguuuuggaaguggccaaggacuuuccagaguacacauucgcuauugccgaugaagaggacuaugccggugagguaaaagaucuagggcugucugaauccggagaggacgucaaugcagcuauacucgacgaaagcggcaagaaauuugccauggagcccgaagaguucgauucggacacucugcgcgaguuugugaccgcauucaagaaaggcaaacuuaagccuguuaucaagucucagccagugccgaagaacaauaaagggcccgucaaggugguagugggaaaaacauuugauuccauuguuauggacccuaagaaagauguccugaucgaguucuacgcgccauggugcggucacuguaagcaguuggagcccguguauaacucacucgcuaagaaauacaagggccaaaaagggcuggugauagccaagauggacgcaaccgccaacgaugucccuagugacagauauaaaguugaaggauuuccaacgauuuacuucgcucccagcggcgauaagaagaauccggugaaauucgaggguggggacagggauuuagaacaccuguccaaguuuaucgaggagcaugccacuaaacuaucucggacaaaggaagaacucuga

SEQ ID NO: 60511 - RNA, 1560 nt, Artificial Sequence
  derived and/or modified sequence opt3 from PDIA5__Homo_sapiens__NP_006801
auggccagagcuggccccgcauggcugcuccuugccaucugggugguccugccuagcugguuguccucugcgaagguuucaaguuuaauugagaggauaagcgacccaaaagaucugaagaaacuacuccggacccgcaacaaugugcugguacuuuacuccaagucugaaguggcugccgagaaccaucugcgauugcucucgacagucgcacaggccgugaaagggcaaggaacuaucugcuggguugacuguggugaugcugaaucacguaagcugugcaagaaaaugaagguggaccugagcccgaaagauaagaaagucgaacucuuccacuaucaggacggcgcauuucacacggaauacaauagagccgugaccuucaagaguauuguagcuuucuuaaaggaucccaaagggccuccacugugggaggaggaccccggagccaaggauguugugcaucuugacuccgaaaaagauuucaggcgguugcugaagaaagaggaaaagccucuacucaucauguuuuaugcgccaugguguucuaugugcaaacgcaugaugccccacuuccagaaggcagccacacagcugagaggccaugcuguccuugccgguaugaacguguacagcuccgaguuugagaauauuaaggaagaguauucagugaggggguucccuacuaucuguuacuuugaaaaaggacgguuccuguuucaauaugacaacuacggcaguaccgcagaggauauagucgaaugguugaagaauccacagccgccccagccucagguuccagagacacccugggcugacgagggcgggagcguguaccaccucaccgacgaagauuucgaccaauuuguaaaagagcacucuuccgugcuggucauguuccaugccccuuggugcggacacuguaagaaaaugaagccagaauuugagaaggcggccgaagcauuacauggugaggcugauucaagcggcgugcuggccgcuguugacgccacugugaacaaagcacucgccgagcgcuuucacaucagugaguuccccacacuuaaguauuuuaaaaauggggagaaguacgcugucccggugcugcgaaccaaaaagaaguucuuggaauggaugcagaacccugaggcgcccccaccucccgaaccaacgugggaggagcagcagacuucuguacuacaccugguuggagauaauuuuagagaaacccucaaaaagaaaaagcauacacuggugauguucuaugcacccuggugcccucacuguaaaaaggucauuccacauuuuacugccaccgcugacgccuucaaggaugacaggaaaaucgcaugcgccgcuguggauugugucaaggacaaaaaccaagaucuuugccagcaggaggccgugaagggcuacccgacauuucacuauuaccauuaugguaaauucgcagaaaaguacgacuccgaccggaccgagcugggguuuacgaauuacauucgugcguugcgcgagggagaucacgaaagacucggcaaaaagaaggaggaacuguga

SEQ ID NO: 60512 - RNA, 1479 nt, Artificial Sequence
  derived and/or modified sequence opt3 from PDIA6__Homo_sapiens__NP_001269633
augagaagggaccugcgggagaagcucgugugggucugccgcccccuugccccuguugaagugccagcuaacaucagcuccgauuuccagccguguucucccaccaguccugcacacucacugagccgaaaauccccaauuauguaccccucuacaacuauggccaaugcgccuggcuugguaucgugcacguuuuucuuagcugugaacgggcuguauucaagcagugacgaugucauagagcuaaccccauccaauuuuaaccgugaagugauccaaucugacagccucuggcugguugaguucuacgcccccugguguggacauugccagagacuuacaccugaauggaagaaagcagccacugcucugaaggauguggucaaagugggugcaguagacgccgauaagcaccauuccuugggcgggcaguauggaguucagggcuuuccaaccauuaagaucuucgguucaaauaaaaacaggccggaggacuaccaagggggacggacaggcgaggcuauuguggaugccgcgcucagugcacugcgccagcuggucaaggacagacucggcgggaggagcggagguuauucuuccggcaaacaggggcggucagauagcaguucuaagaaagacgugaucgaauuaaccgaugacuccuuugacaagaaugugcuggauagcgaggacgucuggaugguugaguucuacgcccccugguguggacacugcaagaaccuugaaccugagugggcugccgcagcuucggaagugaaagagcagacuaagggcaaaguaaaguuggccgcgguggaugccacagucaaucaagugcuggcaucucgcuaugguauacgaggguuuccaaccaucaaaauuuuccagaagggagaaucccccguugacuacgauggcggcagaacgaggucagacaucgugagucgggcucuagaucucuuuagcgacaacgccccuccacccgagcugcuugaaauuaucaaugaggauauagcuaaacguacuugugaggaacaucagcugugcgucguggccguauugccgcacauucucgacaccggggcagccggacgcaacuccuaccuggagguuuuacugaagcucgcugauaaguauaaaaagaaaaugugggguuggcuuuggacagaagcgggcgcacagucugagcuggaaacugccuuggggaucggaggcuucgguuacccugcuauggccgcaauuaaugccagaaagaugaaauuugcucuacugaaggggagcuucucagagcaaggcaucaacgaguuccucagggaacugaguuuuggacggggcuccaccgcccccgucgggggaggugcauucccaacaaucguggagcgagaaccuugggacggccgcgacggggagcuucccguggaagaugacauugaucugagcgacgucgaguuggaugaccucggaaaggaugagcuguga

SEQ ID NO: 60513 - RNA, 1371 nt, Artificial Sequence
  derived and/or modified sequence opt3 from PDK1__Homo_sapiens__NP_001265478
augagacuggccaggcuccuucggggcgcugcacuggccgggcccggaccugguuugcgcgcggcuggcuucagccgauccuuuucuucagacagugggagcuccccagccucugagcguggagugccgggccaggucgauuucuacgcaagauuuucgcccucaccuuuaagcaugaagcaauuccuggacuuugguaguguuaacgccugcgagaaaaccuccuucauguuucuaaggcaggaacucccagugcggcuggcuaauaucaugaaggaaauuucucuucugcccgauaacuugcuccgcacaccuagcguacagcuggugcaguccugguauauacaaucacugcaggagcucuuagacuucaaagauaagagugcagaagacgccaaagcuaucuacgagagaccaaggcggacuuggcugcaggucagcucucuuuguugcauggccuguaagaugauuuuuacggauaccgugauccgcauucgaaauagacacaacgacguuauccccacaauggcgcagggggugauagaguauaaggaauccuucggagucgauccugugacuucacaaaauguacaguacuuuuuggacagguucuauaugagccggaucaguauucguaugcugcuaaaccagcauucucuccuguuuggcggcaaagggaagggauccccaagccaccgcaaacauaucgguucgauuaauccgaacugcaauguucuugaggugaucaaggauggcuacgaaaacgcaagaaggcugugugacuuguauuacauaaauucucccgagcucgagcuggaagaguuaaacgccaaauccccugggcagccaauucaagucguguacgugcccucacaccuguaucauauggucuucgaacucuucaagaaugcuaugcgggccaccauggagcaccacgcaaaccgaggaguuuacccuccaauccaggugcauguaacacuuggcaaugaagaucugaccgugaagaugagugaccgcggugggggaguccccuugagaaaaauugacaggcuauuuaacuauauguacagcacugcuccgcggccucgcguggagacauccagagccguuccccuggcgggcuucggcuaugggcucccaaucucuaggcuguacgcccaguauuuucaaggagaucuuaagcuguacagcuuggaggguuacggcaccgacgcagugaucuauauuaaagcucucucaacggauaguauagaacgucugccugucuacaacaaggccgcuuggaaacacuauaauacuaaccaugaggccgacgauuggugcgugcccucccgggaaccaaaggacaugaccacauuccgaagcgcauga

SEQ ID NO: 60514 - RNA, 1032 nt, Artificial Sequence
  derived and/or modified sequence opt3 from PDK2__Homo_sapiens__NP_001186828
augaaggagaucaaccugcuccccgacagagugcuuagcaccccuuccguccagcugguucaaucuugguacgugcagucauuguuagauauuauggaauuucuggacaaagauccagaggaccacaggacacuaagucaguuuacugaugcccucguaacgauacggaaucgccauaacgacguggucccgaccauggcucagggcgugcuggaauauaaggauacauacggggacgaucccguuagcaaucaaaacauccaguauuuccuugaccgauuuuaccugucccguauuucuaucagaauguugauuaaucagcacacucucaucuucgauggaucgaccaacccugcacauccaaaacacauagguucaaucgaccccaauugcaacgugagcgaggucgugaaggaugccuaugacauggcgaaacugcugugugacaaguacuauauggcuaguccugaucucgaaauucaggagaucaaugccgcaaacuccaagcaaccaauucauaugguauacguucccucucacuuauaccacaugcuguuugagcuuuucaaaaaugccaugagggcuacaguggaaagccaugaguccucauugauccugccuccaauaaaggucaugguggcacuaggcgaagaggaccucaguauuaaaaugagcgaucgcgggggaggcgugccgcugcggaagaucgagagacuuuucucuuauauguacuccaccgcccccacuccucagccagguacagggggaacgccccuggcuggcuucggcuauggguugccuauuucaaggcucuacgccaaauauuuucagggagaccugcaguuauucagcauggaagguuuuggcaccgaugcggucaucuaccugaaggcacucaguacugacucuguugagcggcuuccaguguauaacaaguccgccuggcgccacuaccaaaccauccaggaagcuggggauuggugcguacccagcacagagccgaaaaauacuucgaccuaccgagugucuuga

SEQ ID NO: 60515 - RNA, 1248 nt, Artificial Sequence
  derived and/or modified sequence opt3 from PDK3__Homo_sapiens__NP_001135858
augagacuguucagguggcuccuuaagcagcccgugccuaaacaaaucgagcgguacagccgcuuuuccccaucuccgcugucaauuaagcaguucuuggacuuuggccgagauaacgccugcgaaaagaccaguuauauguucuuacguaaggagcugcccgucagacuagcuaauacaaugagggaaguuaaccuccugccugacaaucuucugaaccggccaagcgugggguugguacaguccugguacaugcagucuuuucucgagcugcuggaauaugagaauaaaucgcccgaggauccucaagugcucgacaacuucuuacagguccugauaaaggugcgcaauagacacaacgauguugugccaacuauggcacagggagucaucgaauacaaggagaaauuugguuucgaccccuuuauuucaacgaauauccaguauuuccuugauagguuuuacaccaaccggauuagcuuccgcauguugaucaaucaacauacacugcuauuuggcggggacacuaacccugugcacccaaagcauauaggaaguaucgauccgaccuguaauguagccgacguugugaaagaugcguaugaaacagcuaagaugcucugcgagcaguacuaccuggucgcccccgagcuugaaguggaggaguucaacgcaaaagccccugacaagccaauucagguggucuauguucccucccaccuguuccauauguuguuugaacucuucaaaaauucuaugcgagcuaccguggaacuguacgaggauagaaaagagggcuauccugcaguaaagacuuuagugacacuggguaaagaagaccucagcaucaagauuuccgaccuugggggaggcgucccacugaggaaaaucgaucgguuguuuaacuacauguauucaaccgcuccccguccgagucuagagccuacgcgcgccgcgccccuggccggcuucggguacggacucccaauaagcagacuguaugcaagguacuuucagggugaccuuaagcuguacucuauggaaggcguggggacugaugccguuauuuauuugaaagcucucuccucagagagcuucgaacggcugccuguguuuaacaagagugccuggcgacacuacaagaccacacccgaggcagacgauuggucuaauccauccagcgagccccgcgacgcuucgaaauauaaggccaaacaagauaagaucaaaacuaacagaaccuucuga

SEQ ID NO: 60516 - RNA, 1236 nt, Artificial Sequence
  derived and/or modified sequence opt3 from PDK4__Homo_sapiens__NP_002603
augaaggccgcuagauucgugcugaggagcgcaggcucccucaacggggccggacuugucccccgggagguugaacacuuuucucgcuacucaccuaguccacugagcaugaaacaguuguuagacuucgguuccgagaaugcgugcgaacgaaccucuuuugcuuuccugcgucaagagcuaccggugagacucgccaacauccugaaggaaauugauauacuucccacacagcugguaaauacuucgucagugcaguuggucaaaagcugguauauccagagucucauggaccugguggaguuucaugagaaguccccugaugaccaaaaagcacugucugauuucguugacacgcucauuaaggugaggaaccggcaccauaaugucgugccaaccauggcccagggcaucauugaauacaaggaugcuuguacaguagaccccguuacuaaccagaauuuacaguauuuucuggaucgcuucuacaugaacagaaucagcaccaggaugcuuaugaaucaacacauauugaucuuuuccgacucacagacagggaacccuagucauauuggaagcaucgauccaaauugcgacguggucgcaguggugcaggaugccuucgaguguucucggaugcugugcgaccaguauuaccuauccucacccgaacucaaacugacccaagucaacggcaaguuuccugaccagccaauucacaucguuuaugugccgagccaccuucaucacaugcuguucgaguuguuuaaaaaugcuaugcgcgccacuguagagcaucaggaaaaccaacccagucucacaccuauagaggugauugucgugcuggguaaggaagauuuaaccaucaaaauuucugaccgagggggaggcguuccacugagaaucaucgauaggcuuuucuccuacacguacagcacugcgcccaccccugugauggacaauucgcggaacgcaccacucgccggcuucggguauggacugcccauuucucguuuguacgcuaaguauuuucagggugaucuaaaccuguacucccucucaggcuaugggacagacgccauaaucuaccugaaggcacuuaguagcgaguccauugaaaaacugccggucuucaauaagucugcuuuuaaacacuaucagaugagcucagaggccgaugacugguguaucccuagucgcgagcccaagaacuuggcgaaagaaguggccauguga

SEQ ID NO: 60517 - RNA, 990 nt, Artificial Sequence
  derived and/or modified sequence opt3 from PDLIM1__Homo_sapiens__NP_066272
augaccacacagcaaaucgaccugcagggccccgggccuuggggauucagacucguggguggcaaggauuuugagcagccacuugccauuagcagggucacuccgggguccaaagcugcacuggccaacuugugcauaggagacguuaucacggcgauugauggcgaaaauaccucuaacaugacacacuuagaggcucagaaucggaucaaggguuguacugacaaccugacccuaacaguggcccgcucagaacauaaaguauggaguccccucgugaccgaggaagggaagcgacacccuuacaaaaugaaucuggcaagcgagccacaagagguccuucauauuggauccgcccacaaccguucugcuaugcccuucacugcaucgccugccucaagcacaaccgcuagagugaucacgaaucaguauaacaauccagccggccuguacaguuccgaaaacauaucuaauuuuaacaaugcguuggagagcaagacugcagccuccggcguugaagcuaacucaaggccccucgaucaugcccagccuccaaguagccuggugaucgacaaggagucugaggucuauaaaaugcugcaggaaaagcaagagcucaaugaaccgcccaaacaguccaccucauucuuagugcugcaggagauucuugaaagcgaggagaagggggauccuaacaaaccaaguggauuucggucuguaaaggcacccguuacaaagguggcugccuccaucgguaacgcgcagaaauugccuaugugcgacaaguguggcacugggauugucggaguguucgugaaacugcgcgauagacacaggcacccagaaugcuacgucuguaccgacugcggcacaaaucuaaagcaaaaaggucacuuuuucguugaggaucagaucuauugugaaaagcaugcccgggagcgcgugacgcccccggaaggguacgagguagugaccgucuuuccuaaauga

SEQ ID NO: 60518 - RNA, 1809 nt, Artificial Sequence
  derived and/or modified sequence opt3 from PDLIM2__Homo_sapiens__NP_067643
augagaggcgggagggcccggcccgcuugggagagcuucaugggacugccuccacgcuccucugcaaaguggggugccggccagucacucgaccgacuuugcugugcgccggggagucguggacuggcuggcgcccccgguagaaugagggcaccuccagccgggcggagccaacccgcuggaggcccuggcgauuccuugccacaucccccugggggauuagguccaggcgggucugcaugggcccgcagagcugaagccgcggcaucgagggcccggggaggcggucgcgggggaccgggcaucaccugggcugaggccggccccggggcaccuggaggucugucaccagaaagcggccgaagacagagggagcgguggcgucuacccgcuuuuccuccaagucgcgccugggcgcccuccagaacaggggaaaggcagccgggagagcgggcccaccuccgacugucugcacgcccugcccuucccggcgcuggucuguugagcgcuccacucuccgccagaaacccugggcuggugaggggccccgcaccauggucacuggccagugcuggagcgcccccucgggcagcccucagcccagcuggcgccuuacugcuucagccgcccgcacgcagagucuugugcccuaggucugaagggggaucccguacuggucgggccggcccaucagggugggcucccccucgaggagccagaagcgcagagaguacggacaggcugaaaggcauggcgcuaaccguugauguggcugguccagcccccuggggguuccgcauuacaggcggacgggacuuucacacuccgauaaugguaaccaagguggcagagagaggcaaagccaaggaugcugaccucaggccuggggauaucauugucgccaucaauggagaaucugcagaggguaugcugcaugcugaggcccaauccaaaauucgccagagcccaucgccccuucgacugcaguuggaccggucucaggcgacauccccuggccaaaccaacggggauucaagucucgaagugcuggccacucguuuccagggaagcguuagaacauacaccgagucccagucuagcuuaaggucaaguuauuccagccccacgucucugucaccacgcgcuggcaguccuuuuagcccacccccguccucuucgagccucacuggugaagcagccaucucccggucauuccagagucuugcuuguucuccugggcugcccgccgcagacagauugagcuacuccggcaggccaggaucacgacaagcgggccuagggcgcgccggagauagcgcugugcugguccuucccccuucuccaggcccccgguccaguagaccuagcauggacucugagggugggucccugcuucuggaugaagacucagagguguuuaagauguugcaggagaauagggaaggacgugccgcaccgcgccagaguagcucguuccggcuccugcaagaggcuuuagaagccgaggaaagaggcgguaccccagcauuucugcccuccucucuaagcccucagucaagucucccagccuccagggcucuggcgacacccccuaagcuccacacuugcgagaaauguucuaccagcauagccaaccaggcaguacgaauccaggagggccgguaucgccauccggggugcuacacaugugcugacugcggauugaaucugaagaugagaggccacuucuggguuggggaugaacucuauugugagaaacacgccaggcaacgguacuccgcccccgcuacccugucaagccgagcauga

SEQ ID NO: 60519 - RNA, 951 nt, Artificial Sequence
  derived and/or modified sequence opt3 from PDLIM3__Homo_sapiens__NP_001107579
augccccagaccgugauccugccuggcccagccccguggggguucagacucagcggagguauugacuuuaaccaaccccuugucauaacaaggaucacuccuggcuccaaggcugcagccgcgaaucugugcccaggggauguuauuuuggcuaucgacggauucggcacggagucuaugacccacgccgaugcacaggaccggauuaaagccgcugcacaucaguuaugucugaagaucgaucgcggugaaacacaccuauggucaccccaggugagugaggacgggaaagcccauccuuuuaagauaaaccucgaaagcgagccacaagaguucaaacccaucggaacugcucacaaucgacgugcccagccuuuuguagcggcagccaacauugaugacaagagacagguggucuccgcuucuuacaauucgccaaucggccuguauucaaccagcaacauucaggaugcccuucauggccaacugaggggguugaucccgaguucuccccagaaugaaccuacagcauccgugccacccgagagcgacguuuaccggaugcuccacgauaaccgcaaugaaccuacccagccaagacaguccggaucauucagggugcugcaagguauggucgacgauggcagugacgaccggcccgcugggacucgcagcgugcgagccccgguaacaaagguucacggaggcucugguggggcgcagagaaugccucugugcgauaaauguggauccggcauagugggcgccgucgugaaggcaagggacaaauaucggcaucccgagugcuuugugugugcugauugcaaccucaauuuaaagcagaaaggguacuucuuuauugaaggagagcuguauugugagacccacgcccgugcucgcacgaagccaccugaagguuacgacacugucacccuuuaucccaaggccuga

SEQ ID NO: 60520 - RNA, 741 nt, Artificial Sequence
  derived and/or modified sequence opt3 from PDLIM4__Homo_sapiens__NP_001124499
augccccacagcgugacccugagaggcccuuccccauggggguucaggcucgucggaggucgggacuuuucugccccgcuuacaaucucacgcguucaugcuggcaguaaggcagcccuggcggcuuugugccccggggauuuaauucaggccauaaacggagagagcacugaacugaugacgcaccuagaggcacaaaaucgaaucaaaggcugucaugaccaccucacccuguccgugucucguccugaagguagaucguggccaucagcccccgaugacagcaaggcucaggcacauaggauucacaucgauccugagauucaggacgggaguccaacaacuucccggcgccccucuggaaccggcacaggcccugaagaugggagaccaagccuuggauccccguacggucagcccccuagguucccaguaccccacaacggcucaagugaggccacccugccugcucaaaugagcacuuugcaugugucuccacccccguccgccgacccugcgcgggggcucccccgcucacgagauugcagagucgaccugggaagcgagguguauaggaugcugcgggaaccagcagagccuguugccgcugaacccaaacagaguggcucuuuucguuaccuccaggguauguuagaggccggggagggaggcgcaccauccagccgccacggcacaucgucuaccauccccuccgcuucaugugccgugacggcggccuga

SEQ ID NO: 60521 - RNA, 1464 nt, Artificial Sequence
  derived and/or modified sequence opt3 from PDLIM5__Homo_sapiens__NP_001011513
augagcaacuacuccgugucucuggucggccccgccccuuggggguucagacuccagggagguaaggacuuuaauaugccacuuaccaucucaagucugaaagauggcgggaaggcugcacaagccaacguuaggauuggagacgugguauugagcauagauggcaucaaugcgcaggguaugacacacuuagaggcucagaacaaaauuaaggggugcacuggaucccugaauaugacgcuacagcgggccucugcagccccgaaacccgaaccugugccaguccaaaagcccaccgugacaucgguuuguucagagacuagccaggaacucgcugagggccagcgccgaggcagucagggggacuccaagcaacagaacggaccuccacguaaacauaucguggaaagauauaccgaguucuaccacguccccacacauucugaugcaagcaagaaaaggcugauugaggacaccgaagauuggcggccucgcacugguacaacccaguccagaucauuuaggauccuugcccagauaacgggcacugagcaccugaaggaaagugaggcugacaauaccaaaaaggccaacaauagccaagagccaucuccgcaguuggcguccucaguggcaagcacacggaguaugcccgaaucucucgauuccccuacuagcgggcgcccaggaguaaccucgcugacaaccgccgcugccuucaagcccguuggcucuacgggugugaucaaauccccuucauggcagcgaccaaaccaagggguccccaguacuggaagaauuagcaauuccgcaacauauucuggcagcguggcuccggccaacucagcgcugggccagacccagccuagugaccaggauacucucgugcaaagggccgagcauauccccgcagggaagcggacaccaaugugcgcucacuguaaucaggucauucguggacccuuuuuaguugcccuggguaaauccuggcacccugaagaguucaacugcgcucauuguaagaauaccauggccuacaucggcuuuguggaagagaaaggggcacuuuauugcgaguuguguuacgaaaaguucuuugccccagagugcggacgcugucagagaaaaauacugggcgaaguaauuagcgcucuaaagcagacguggcacgugucuugcuucgucuguguggcgugcgguaagcccaucaggaacaacguuuuucaucucgaggacggggaaccuuauugcgagaccgauuacuacgcacuguucggcacaauuugucacggaugcgaguuuccaaucgaagccggcgacauguuccuugaggcucugggguauacuuggcacgacaccuguuucgugugcucagucuguugcgaaaguuuggagggacaaacauuuuucagcaaaaaggauaaaccgcucuguaagaaacaugcccacuccgugaauuuuuga

SEQ ID NO: 60522 - RNA, 1374 nt, Artificial Sequence
  derived and/or modified sequence opt3 from PDLIM7__Homo_sapiens__NP_005442
auggacagcuucaaggugguccuggagggccccgccccuuggggguuuagacuccagggagguaaagauuucaacguuccacuuuccaucucuaggcugaccccgggcgggaaggcugcacaagccggaguggcgguaggcgacuggguguugucaauugauggugaaaaugcugggaguuuaacacacauagaggcccagaacaaaauccgggcaugcggagaacgccugagccuaggccucucccgagcccagcccguccagucuaagccucaaaaggcuucggcaccagccgcugaucccccucguuacacuuuugccccaucagugagccugaauaaaacggcgagacccuucggcgcaccuccaccggccgacagugcuccccagcagaacgggcagccucuuaggccacugguucccgacgccuccaagcaacgguugauggagaauaccgaagauuggcgcccuagaccaggaacaggucagucuaggagcuuucggauucucgcacaucugacuggcaccgaguucaugcaggaccccgaugaggaacaccugaaaaaguccucacaggugccgcgcacagaggcuccugcccccgcgaguagcaccccacaagaaccuuggcccgggccaacugcccccucuccuacaucccgaccaccgugggcagucgaccccgcuuuugccgagagauaugcuccugauaaaaccucaacggugcucacuaggcauagccagccagccacccccacaccuuuacagagucggacuucuaucguacaagcagccgcuggaggcguuccaggugggggauccaacaauggcaagacccccgugugucaccagugccauaaagucauucguggccgcuaccugguggcgcuugggcacgcauaucacccggaggaguucguguguagccagugcggaaaggucuuggaagaagguggcuuuuucgaggaaaagggggccaucuuuuguccuccaugcuacgacguuagauaugcucccucgugugccaaaugcaagaaaaagauaacaggagagaucaugcaugcacugaaaaugaccuggcacgugcauuguuucacgugcgccgcuuguaagacuccuauuaggaaccgggccuuuuacauggaggaaggcguacccuauugcgagcgagauuacgagaaaauguucgguacaaagugccacgggugugacuucaagaucgacgcaggcgaucgcuuucuagaagcgcucggauucucuuggcacgauaccugcuuugugugugcuauuugccagaucaaucuggaaggcaaaacuuucuacuccaagaaagacagaccacuuuguaagucacaugccuuuagucacgucuga

SEQ ID NO: 60523 - RNA, 1689 nt, Artificial Sequence
  derived and/or modified sequence opt3 from PDP1__Homo_sapiens__NP_001155251
augugcgugugucccggcccuagaaggaucgggauuccaguccggagcuccucucugccccucuucucagacgccaugccggcuccuacccagcuuuucuucccacugauacgcaacugcgaguugagucgaaucuacggaacagcauguuauugccaccauaagcacuuauguugcagcuccucuuacauuccccaaucgcgucugagauauacuccucauccagccuacgcgacguuuuguaggcccaaagaaaauugguggcaguauacccagggucggcgcuacgcuucaacaccucagaaguucuaucuaacuccaccgcaaguuaacagcauccucaaagccaaugaguacaguuuuaaggugcccgaauuugauggcaaaaacguauccucuauucugggguuugacagcaaucagcuuccugcaaacgccccaaucgaggauagaagguccgcugcaaccugccugcagacacggggaauguugcucggcguguucgacggucacgccgggugugcuugcucacaggccgucagugaacgccuguuuuacuauauagcggugagccugcucccccaugagaccuuacuggagaucgaaaaugcaguugagucuggacgagcccuuuugccuauucugcaauggcacaagcacccaaacgauuacuucuccaaggaggcuucaaaacuauauuuuaauagccucagaacuuacuggcaggaacugaucgaccuuaacacaggcgagaguaccgauauugacgugaaggaagcccugaucaaugcauucaaaagguuggauaacgacauaucucucgaggcucaggucggcgaucccaauuccuuucugaacuauuuagugcugcggguagccuucagcggggcgacggccuguguugcacauguggacggagucgaucuccacguggcuaauacuggugacucgcgugccaugcuuggcgugcaggaagaggacgggucuugguccgcugucacccugucaaacgaucauaacgcccaaaaugaacgcgaguuggagagacuaaagcuggaacacccgaaaagugaggcaaagagcguugugaagcaggacaggcuccugggacuucugaugccuuuccgggccuuuggcgauguaaaauucaagugguccauugacuugcagaaacgagugaucgaaucuggucccgaucaacucaacgacaaugaguacacaaaguuuauuccaccuaacuaucacacucccccauaccugaccgcugaacccgaggucacauaccaucgcuuaagaccucaggauaaauuccuggugcuagcgaccgacgggcucugggagacgaugcacaggcaggauguugugcggaucgucggagaauaucugacuggcaugcaucaccagcaaccaaucgcagugggcggguacaagguaacacuuggacagaugcaugguuugcugaccgagcgcagaacuaaaaugagcucaguuuuugaagaccagaaugccgcuacacaccucauuaggcacgccgugggcaacaaugaguucgggaccgucgaucaugaacgucugaguaagaugcuuucccugccggaggaguuggcacggauguaucgagacgacauaacgaucauugugguccaguuuaacagccacgugguuggagccuaccaaaaucaggaauga

SEQ ID NO: 60524 - RNA, 1590 nt, Artificial Sequence
  derived and/or modified sequence opt3 from PDP2__Homo_sapiens__NP_065837
augagcuccaccgugucuuacuggauccugaacucaacaagaaauaguauugccacucuccagggcgggaggcggcuuuauagccgcuacgucuccaaccgaaauaagcugaaguggcguuuguucucuagaguucccccuacguuaaacucgucaccaugcggagguuuuacccuguguaaggcuuauaggcacacaagcacugaggaagacgauuuccaucuacaacucaguccggagcagauaaaugaagugcugcgggcaggcgagaccacacacaaaauccuugaccuggaaucccgcguacccaacucuguguugagauuugagagcaaucagcucgccgcgaacuccccugucgaggauaggcggggaguggcuucaugccugcagaccaaugggcugauguucggcauuuuugacggucaugggggacacgccugugcacaagccguuagugaacgccucuucuacuauguggcugucagcuuaaugucucaucagacucuggagcacauggaaggcgcaauggaguccaugaagccacuuuugcccauccugcacuggcuaaaacauccuggcgauucaauuuacaaggacgugacaagcguacaccucgaucaucugcgaguuuauuggcaggagcuucuggacuugcacauggaaauggggcucaguaucgaggaagcccugauguacucuuuucagagauuagauuccgacauaagccuggagauccaagcuccacucgaagaugaggugaccaggaaccuuucgcugcaggucgccuucucuggagcgacggcaugcauggcccacguggacgguauucauuugcacguggcuaaugccggcgauugucgggcaauccuagggguccaggaggacaacggaaugugguccugccugccccucacucgugaccauaaugcuuggaaccaggccgaacugucacgccuuaagagagagcacccugaaagugaggauaggaccauuaucauggaagaccggcuguugggcguucucauaccaugucgagcguuuggugaugugcaacugaaauggagcaaggaguuacagcgcuccauucuggagagaggguucaauacagaagcccuaaacaucuaccaguuuacuccgccccauuauuacaccccuccauaucucacagcagagcccgaaguaaccuaccacaggcugcggccucaagacaaauuccuuguguuggcuucugauggacugugggacaugcucagcaacgaggaugucgugcgccugguugugggccaccuugccgaagcugacuggcauaagacggaucuggcccagagaccagcaaauuugggccucaugcagucacuguuacugcagaggaaagccagugggcuacacgaggcugaccaaaacgcggcaacucgucucauucggcaugccaucggaaauaacgaguauggugaaauggaggcugaacgacuggccgcaaugcuuacauugcccgaggaucuggccagaauguacagggacgacaucaccgucacugugguauauuuuaauuccgagagcauuggcgcuuacuacaaagggggauga

SEQ ID NO: 60525 - RNA, 1365 nt, Artificial Sequence
  derived and/or modified sequence opt3 from PDPK1__Homo_sapiens__NP_001248745
auggccagaaccacaagccagcuguacgacgcugugcccauccaauccucugucguucucugcucauguccuaguccaagcauggugaggacucagacggaguccucuaccccgcccggcauuccugggggaucgcggcaggguccagcaauggauggcacagccgcggaaccccgcccuggggcuggaucacuucagcacgcccaaccacccccucagccacgaaagaaacguccggaggacuucaaguuuggcaaaauacugggugaagggagcuucaguacuguaguguuggcaagagaguuagccaccuccagggaauaugcuaucaagauucuggagaaacggcauaucauuaaggagaacaagguccccuacgugacacgcgaaagagauguuaugucuaggcuagaccacccauuuuucgugaaacucuauuuuaccuuccaggaugacgagaagcuguacuuuggacuuagcuaugccaaaaauggcgaacuguugaaguacauccggaaaauaggcuccuucgaugagacuugcacacgcuuuuauaccgcagagaucgucucagcucucgaauaccugcaugggaagggaauuauccaccgagaccugaagccugagaacauucucuuaaaugaagauaugcauauccagauaacggacuucgguacugccaaagugcugagucccgagagcaagcaagcgagagcaaacucuuuuguaggcaccgcccaguacguuuccccugaacuuuugacagagaaaucagcuuguaagagcagugaucugugggcccuagggugcauuaucuaucagcucguggcaggacugccacccuucagggcuggcaaugaguaccuuauuuuucagaaaaucaucaagcuggaauaugacuucccggagaaauucuuuccuaaggcccgggauuuggucgaaaagcuccugguguuagacgcgacuaaacgucuggguugugaggaaauggagggguacggaccccucaaggcccacccauucuuugagucugugaccugggaaaaccuucaccaacagacaccucccaaacugaccgcauauuugccagcuauguccgaggacgaugaagacugcuacggcaauuaugauaaccuacugagccaguucggcuguaugcaagucucgucuuccucaaguagccauucccucucugccagcgacacggggcugccccagcgcucaggaaguaauauugagcaguacauacacgaucuugacuccaacagcuuugaacuggauuugcaguucucugaggacgagaagagacuccuguuagaaaaacaagcugguggcaauccuugccugacugggaggaucauuuga

SEQ ID NO: 60526 - RNA, 2640 nt, Artificial Sequence
  derived and/or modified sequence opt3 from PDPR__Homo_sapiens__NP_060460
augauguucuacagacugcucagcaucgugggcaggcagcgggccucccccggguggcaaaacuggucuucagcucgcaauaguaccagcgcagccgaggcgcgauccauggcuuuaccuacacaggcccaggucguuauuugcggagguggcauaacugggacgucuguggcauaucaccugucgaagaugggauggaaagacaucguauuguuagaacagggccgucuggccgcugguucaaccagauuuugugcagggauucuaagcacagccaggcaucucacuaucgagcaaaagauggcugauuacaguaacaaacuguauuaccagcuugaacaggagaccggcauucagacaggauauacccggacuggcuccaucuuccuggcccaaacacaggaccgcuugauaucucucaagagaaucaaugcggggcugaacgugauuggaaucccaagcgaaauuaucuccccgaaaaaggucgcagagcugcaccaucucuuaaaugugcacgaucugguuggugccaugcaugugcccgaggacgcugucgugucaagugccgauguagcacuugcuuuggccagcgcggccucucagaacggcguucagauauacgacaggaccuccgugcugcacgucauggugaagaaagggcaagugacgggagucgaaacugauaagggccagauugagugccaguauuuuguuaauugugcaggucaaugggcuuacgaacuagggcucucaaacgaggagccugugagcaucccacugcacgccugcgaacauuucuaccuucugacccggcccuuggagacaccucuccagaguucuacuccaaccauuguagacgcugauggacgcaucuauauccgaaauuggcagggcggcauucuguccgggggauuugagaaaaaccccaagccuauauucacagaagguaaaaaucaguuagaaauccaaaaccugcaggaggacugggaucacuuugagccacuccuuagcucgcuguugagaaggaugccggaacuagagacccuggaaauuaugaagcucgugaauugucccgagacguucacuccugacaugcggugcaucaugggcgaaucuccagccguccagggguacuuugugcuggcaggaaugaacuccgccggccuuucauucggugggggcgcuggaaaguaucuggcggaguggaugguucauggcuaccccagugagaaugugugggaauuggaucucaaacguuuuggggcacugcagagcucccgcacauucuuaagacacagggucauggaggugaugccucugauguaugaccuaaagguaccacggugggacuuucaaaccggacgacagcuccgcacuucuccccuguacgauagacuugacgcccagggugcuagguggauggaaaaacacggcuucgagcggccgaaguauuucguuccucccgauaaagacuugcuggcccucgaacagagcaagacauuuuacaaaccagauugguucgacauaguggagucagaggucaaguguugcaaggaagcagugugugucauugauaugaguuccuuuaccaaauucgagaucacgagcaccggggaccaagcccuggaagugcuucaguaccuguuuucuaacgauuuggacguuccugugggacauaucguacacacaggcaugcucaacgagggugggggcuaugagaaugauugcucaauugcucgccugaacaagagaaguuucuuuaugaucagccccacugaccagcagguccauuguugggccuggcuuaaaaagcacaugccaaaagacuccaaucugcuacucgaagaugugaccuggaaguacacagcacugaaccuuauuggacccagggcgguugacguguugucugagcugucguaugcuccuaugacuccagaucauuucccgagccucuuuugcaaggaaauguccgucggcuacgccaaugggauacgugugaugucaaugacccacacaggagagcccgguuucaugcuguauaucccuauugaauacgcauuacacguauauaacgaggugaugaguguuggccaaaaauacgggauccggaaugccggauacuaugcucugcgaucucuuagaaucgagaaguuuuucgccuuuuggggccaggacauuaacaauuugaccacuccacucgaaugcgguagggagagccgcgucaaacuggaaaaggggauggauuucauaggccgggacgcacuacugcagcaaaaacagaacggaguguacaagagacucacgauguucauccuggaugaccaugauuccgaccuugauuuguggcccugguggggcgagccuauuuauaggaaugggcaguacgugggaaagacaaccucaagcgcuuauucuuacucccuggaacgccacgucuguuuaggcuuuguucauaacuucagugaggacacuggugaggaacagguggugaccgccgauuuuaucaaucgaggggaguaugaaauugacaucgcgggauaccgguuccaagccaaagcuaagcucuacccaguagcaagccuguuuacacagaaacguagaaaggacgauauggagcuuucugaccugcacggcaaauga

SEQ ID NO: 60527 - RNA, 402 nt, Artificial Sequence
  derived and/or modified sequence opt3 from PDRG1__Homo_sapiens__NP_110442
augcugagccccgaggccgaaagggugcucagguaccuugucgagguugaggaacuggcugaagagguguuggcagacaagcggcagaucguagauuuagacaccaaacgcaaccaaaaucgagagggccugcgugcccuacagaaggaucucucccugucugaagacgugauggucugcuucgggaacauguuuauuaaaaugccucacccagagacaaaggaaaugauagagaaagaucaggaccaucuugauaaggagaucgaaaagcugagaaaacaguugaaggugaaaguuaauagacucuucgaggcgcaaggaaagccggaacugaaagguuuuaaccugaauccccucaaccaggacgaguuaaaggcucugaaggugauucuuaaaggcuga

SEQ ID NO: 60528 - RNA, 4014 nt, Artificial Sequence
  derived and/or modified sequence opt3 from PDS5A__Homo_sapiens__NP_001093869
auggacuucaccgcccagcccaagccugcuacagcacugugcggcguggucagcgccgaugggaaaaucgcguacccaccgggaguuaaggagauuacugacaaaauaacgaccgaugaaaugaucaagagacucaaaauggugguaaagacauuuauggacauggaucaagacuccgaggaugaaaagcagcaguaucuuccccuggcuuugcacuuagccucugaguucuuucugaggaacccuaauaaagacgugcggcuacucgucgcauguugccuggccgauauuuuccgcaucuacgcuccagaagcacccuauacuucacaugacaaacuuaaagauauuuuucuguucaucacccgacaguugaagggucucgaggacacaaaaaguccucaauuuaaccguuacuucuaucugcuggagaaucucgccuggguuaagagcuacaacauauguuuugaauuagaggauugcaaugaaaucuucauucagcuguuuagaacccuuuucuccgugaucaacaauucucacaacaagaaagugcagaugcauauguuggaccugaugucgucaauuaucauggagggcgacggggucacucaggagcuacucgauagcauacugauuaaucuuaucccagcucacaagaaccugaauaaacaaaguuuugacuuggccaaggugcuccugaaaaggacaguacagaccauugaagcguguaucgcaaacuucuucaaucagguuuuagugcugggacgguccucugucagcgaucucuccgagcauguguuugaccuuauccaggaacuguucgccauugauccccacuugcuacugucagugaugccucaacucgaguuuaagcugaaaaguaacgacggcgaggaacgccuugcugucguuagacuguuggccaaacucuucgguagcaaggauucugaccuggcaacgcagaauaggccauuauggcagugcuuucuggggcgguucaacgauauacacgugccgguacgccuagaguccgugaaauuugcuucacauugucucaugaaccaccccgaccuggccaaggaucuuacugaauauuugaaaguccgaagccaugacccugaggaagcgaucagacacgacgugauuguuaccaucauaacagccgcaaagagggaucuggcucucgugaaugaccaacugcuuggauucguccgggagcguacucuggauaaacgcuggagagugaggaaggaagccaugaugggcuuggcucagcucuacaagaaauacugccugcacggcgaggccgggaaggaggcagccgaaaaaguaaguuggauuaaggacaaauuacugcauaucuauuaccagaacucuaucgaugacaagcuacucguugagaagauuuuugcucaguaucuggugccacacaaucuugaaaccgaggaacggaugaaauguuuguacuaucuguacgcgucccucgaucccaacgcagucaaggcccugaaugagauguggaaaugccaaaacauguuacgaagccaugugcgcgagcugcuugacuugcacaagcagccuacaucggaagcuaauuguucugccauguucggaaaacucaugaccaucgcaaagaaccugccagaucccgguaaggcccaggacuuugucaaaaaguucaaucaggugcuaggcgaugacgagaaacugagaucccaacucgaacugcuuauuucaccgacgugcaguugcaagcaggcugauauauguguuagggagaucgcccggaaauuggcaaacccuaagcagcccacuaauccauuucuggagauggugaaauucuuacucgaacgcauugcgccuguacauaucgacagcgaggcuaucuccgcccuggucaaacuuaugaacaagucuauugaagggacagcagacgaugaggaagagggagugagccccgacaccgccauaagaucaggccuggaguugcucaagguucugaguuucacucacccaacauccuuucacagcgcugaaaccuaugagucucuacugcagugccucaggauggaagaugacaagguggccgaggcagcuauccaaauuuuccguaauacgggucauaaaaucgaaaccgaucugccccagauucggucaacacuuaucccuauauugcaccagaaggccaaacgagggacuccacaucaggcgaagcaagccguccacuguauccacgcuauuuuuaccaacaaggaggugcagcuggcacagaucuucgagccguuaaguagaagccucaaugccgacguacccgaacaacugauuacaccucuugugucccugggacauaucucuaugcuagcuccagaucaguuugccucgcccaugaaaagcguugucgcaaacuucauagugaaggaccuccugaugaacgauagguccacuggcgagaaaaauggcaaguuguggucaccugacgaagaggugaguccagaaguccuggcgaaaguucaggccauuaaguuacucgugcgcuggcugcuugggaugaagaacaaucagucuaaaagcgcuaacuccacccugcgguugcucucagccaugcuggugagcgagggagaucuaacagagcaaaagagaaucucuaaauccgacaugaguaggcugcgccuugcagcugguagcgccauuaugaagcucgcacaggaacccugcuaccacgagaucauaaccccggaacaguuucagcugugugccuugguaaucaaugaugagugcuaccaaguccgacagauuuucgcucagaaacugcauaaggcguuagugaagcuccugcuuccucuggaguauauggccaucuuugcauugugugcuaaagacccaguuaaggaacggcgugcccacgccagacagugccuccugaaaaacauuucuaucaggcgcgaguacauaaagcaaaaucccauggcuacugaaaaacuacugucccuucucccugaguaugugguccccuacaugauucaucuguuggcacacgacccagauuucacgcggucacaggacguggaucaguuaagagacaucaaggaaugucugugguuuaugcucgagguucugaugacaaagaacgagaauaacagucacgccuucaugaagaagauggcggaaaauaucaaacuuaccagggaugcucaaagcccugacgagucgaagacuaacgaaaaacuguauaccgugugcgauguagccuugugugucauuaauuccaagucugcacuaugcaacgccgacagccccaaagauccagugcugccgaugaaguuuuucacacagccugagaaggacuucugcaaugauaaaucauacaucagugaagagacccgagugcuccugcuuacuggcaagcccaaaccagcuggggucuuaggagcaguuaacaagccccuguccgccacaggccgcaaaccuuaugugcggucuacggguaccgagacugggagcaacauuaauguaaacuccgaacucaauccaucaacaggcaacagaagcagggagcagaguucugaagcggcugagaccggaguguccgaaaaugaggagaaccccguccguauaaucagcgugacaccuguuaagaauauugacccggugaagaacaaagaaaucaauucggaccaggccacucaaggcaacauuucaucugaucgcgggaagaaacggaccgucacggcagccggagcugagaauauccagcagaagaccgacgaaaaaguggaugagagugguccacccgccccuuccaagccaagaaggggccgacggcccaagagcgagucucaggggaacgcaacaaagaaugacgauuugaacaagccuauaaauaaaggacgcaagagagcugccguuggccaagaaagcccgggugggcuggaggcgggcaacgccaaagcacccaagcuccaggaccuggcuaagaaagccgcuccagcagaaaggcagaucgaucuucagcgguga

SEQ ID NO: 60529 - RNA, 4344 nt, Artificial Sequence
  derived and/or modified sequence opt3 from PDS5B__Homo_sapiens__NP_055847
auggcccacagcaagaccagaacaaacgacggcaaaaucacuuaucccccuggggugaaggagauuuccgauaaaauaucuaaggaagagauggucaggcggcugaaaaugguugugaagacguucauggacauggaucaggacucagaagaggaaaaggagcucuaccuuaaucuggcuuugcauuuagcaagugacuuuuuccugaaacacccagauaaggauguacgccuacucguggccugcugucuggcggacaucuuucgaauuuacgcuccggaggcccccuauaccagcccugauaaacuuaaggacaucuucauguuuauuacacgucaacugaaaggauuggaagauacuaaguccccacaguucaacagauacuuuuaucuccuggagaauaucgcaugggucaagucuuacaacauaugcuucgaacuggaggacucgaaugagaucuuuacccagcucuauaggacauuauucucagugauuaacaauggucauaaccagaaaguucacaugcauaugguggaucugaugagcaguaucauuugugaaggcgacaccgucucccaagagcuuuuggacacugugcugguaaaucuaguucccgcccacaagaaccucaauaaacaggcuuacgaucuggcaaaggcccuucugaaacggacagcucaggccaucgaaccuuacauaaccaacuuuuucaaucagguguugaugcucgggaagacgucuauuagcgaccuguccgagcacgucuuugauuuaauccuggaacucuauaacauugacucacaucuucuguugagugugcuaccacaacuggaguucaaacucaagagcaaugauaacgaggaacgccuucagguggucaagcugcuggcgaaaauguucggagcaaaggacucugaguuggccucccagaacaaaccccucuggcagugcuaccugggcagauuuaaugauauccacguuccuaucagguuagaaugugugaaguucgcuucacauugccugaugaaccacccagaccuagccaaagaucucacugaguaucugaagguacggagccacgacccggaagaggcaauucgccaugaugugauagucaguaucgugaccgcugccaagaaagacauucuuuugguuaaugaccaucugcucaacuuugugcgagagagaacacuggauaagagguggcggguccguaaagaagcgaugaugggucuugcccaaaucuacaagaaauaugcacugcagucugcugccgggaaggacgcugccaagcagauagcauggauuaaagauaaguugcuccacaucuacuaucaaaauuccaucgacgaucgccuguuaguggagagaauuuucgcccaguacaugguaccccacaaccuggaaacuaccgagaggaugaaaugucuauacuaucucuacgcuacacuggaccuuaaugcgguuaaggcauugaacgaaauguggaaaugccagaaucugcuccggcaucaggugaaggaucuguuagaccugaucaagcaaccuaaaaccgaugccagcgucaaggcuauauuuucgaaagugauggucauuacgcgaaaccuuccagaccccggaaaggcccaggauuucaugaaaaaguuuacucagguguuggaggacgaugagaaaauccgcaagcagcucgaaguucuggugucuccuacauguuccugcaagcaagcagagggcuguguaagagaaauuaccaaaaagcuaggcaauccaaaacagcccacuaacccguuccuggagaugaucaaguuucuccuggagaggaucgccccuguccacauugacacagaaucaauaagugcucuuaucaaacaggugaauaagagcauugacgggaccgccgaugacgaggaugaaggaguucccacggaccaggcaauccgggcggguuuggagcuguuaaaggugcucuccuucacccacccaauuucuuuucauagcgcugaaacauucgagucacugcuugccugccugaaaauggaugacgagaaggucgcagaagccgcuuugcaaaucuuuaaaaacacuggcaguaagauagaggaagauuucccucacauccgcuccgcccuccugcccgugcuacaucacaaaagcaagaaggggccacccagacaggcaaaauaugcuauucacugcauccaugccauuuucucuucaaaggagacccaguuugcgcagaucuucgaaccucugcacaaaagucucgacccaagcaaucuggagcaucuuauaacaccguugguaacuauuggacacaucgcccuguuagcucccgaucaauuugcagccccucucaagucccugguggcuaccuucauuguuaaagaccuucugaugaacgauaggcuaccaggcaagaagacaaccaaacucuggguccccgacgaggaagugucuccugagacuauggugaagauccaggccauaaaaaugaugguccguuggcuguuggguaugaagaacaaucauucgaaaagcgggacguccacacugcgguuacucaccacuauccugcacucagauggagaccuuaccgaacagggcaagauuaguaaaccagacaugucucgacugagauuggcagcgggcagcgccaucguuaagcucgcucaagagcccuguuaccacgaaauuaucacacuggagcaguaucagcuaugcgcccuggcaauaaacgaugaguguuaccaggugaggcaaguguuugcucagaaacuucauaaagggcucucccgccugcgguugccgcuggaauauauggccauuugcgcauuaugugccaaggacccuguaaaagagagaagggcucacgcgcgccagugccucgucaagaauaucaacgugcgacgggaauaccugaaacagcaugccgcaguuucagagaaacuucugagcuugcucccagaguacgugguccccuauaccauccaucugcuagcucacgauccugacuacgugaagguucaagauauugaacagcugaaagacgugaaggagugucuuugguucguacucgaaauccugauggccaaaaaugagaacaauucucacgccuuuauucguaagauggucgaaaacauaaaacagacuaaggaugcucagggacccgacgaugcaaagaugaaugagaaauuguauacagugugcgacguggccaugaacaucauuauguccaagaguacgaccuacagcuuagagucuccaaaagauccuguccugcccgcgagauucuuuacucaaccagacaagaauuucuccaacacaaagaauuaucucccgccugaaaugaagucauuuuucacccccgguaagccaaaaacaacuaacguucugggcgcugugaauaagccccuuaguagcgccgggaaacagucgcagaccaaguccucuaggauggagacgguaagcaacgcaucaaguuccucuaacccuagcuccccaggacgcaucaaaggccggcuggacucaagcgaaauggaucacagugagaaugaagacuacaccaugucuucccccuugccugguaaaaagagcgauaagagagacgauucggaccuagugaggucagagcuggagaagccgcgagggcgcaaaaagacaccagucacugaacaagaggaaaaacucggcauggaugaccugaccaaacuugugcaggagcagaagcccaagggaucucagcggaguagaaagaggggccauacagccuccgaaagcgaugagcaacaguggccugaggaaaaacguuuaaaggaggacauucuggaaaacgaggaugagcagaacucuccacccaaaaaggggaaacgcggacggccuccgaagccccucgguggcgggacuccaaaggaggaaccuaccaugaaaacgagcaagaaaggauccaagaaaaagucaggucccccagcuccugaagaggaagaggaggaagagagacagaguggcaauacagaacaaaagagcaaaucuaagcagcacaggguuucccgacgggcacagcagcgcgccgagucacccgaaaguagcgcgaucgaguccacccaaucuacuccacagaaagggagaggcaggccgucgaagacaccuagccccucacagccaaagaagaaugugcgggucggacgauccaagcaggcugccaccaaagagaacgacaguucugaagagguggauguuuuucaaggcagcucccccguggacgacauaccucaggaagagacugaagaggaggaagucucaaccguaaaugugagacgcaggucugcaaagcgugagcggagauga

SEQ ID NO: 60530 - RNA, 1248 nt, Artificial Sequence
  derived and/or modified sequence opt3 from PDSS1__Homo_sapiens__NP_055132
auggccagcagaugguggagguggcggcgcggcugcuccuggaagcccgcugcacgaucuccugggccaggaucaccgggucgugccggcccccuggggccuagugcggcugccgaggugagagcacagguccacaggcggaaaggacucgaccuuagccaaaucccauacauuaaccugguuaagcauuugaccuccgccugucccaaugugugccgcauaucuagauuccaccauacaacuccugauucgaaaacgcacucaggcgaaaaguauaccgacccauuuaaauuagguuggagggaucugaaggggcuauacgaggacauccggaaggaacuccugauuagcacaagugagcuuaaagaaauguccgaguauuacuucgauggaaagggcaaggcuuuucgccccaucauuguagcacugauggcccgagcuuguaacauccaucacaauaacucuagacacgugcaggccagccagagggcgauagcauugaucgccgagaugauucauacugcuucccucguccacgacgaugugaucgacgaugccucaagucggcguggcaaacauaccguuaauaaaauuuggggagaaaagaaggcagugcuggcuggggaccugauccucagcgccgcgucuauagccuuagcacgcauugguaacacaaccgucaucuccauucugacucaggugaucgaggaucuuguaagaggcgaguucuugcaacuggggucaaaagaaaaugagaacgaaagguuugcucacuaucuagagaagacauucaaaaagaccgccagccucaucgcuaauaguugcaaagccguuucugugcugggauguccugacccagucgugcacgaaauugcauaccaguauggcaagaacguggguauagccuuucagcuuaucgaugacguccuggacuucacguccugcagcgaucagauggggaaaccgacuucggcugacuugaagcucggacuggcgaccggccccguuuuauuugcaugucaacaguucccugagaugaaugccaugauuaugcggcgauuuucucugccaggcgauguggaccgcgcuagacaguacguacuccaguccgauggggugcaacagacaacuuaccuugcccagcaauauugccaugaagcaaucagggagauaucaaagcugcggcccaguccugagcgcgacgccuugauucagcuaagcgaaaucguccugaccagagauaaauga

SEQ ID NO: 60531 - RNA, 1200 nt, Artificial Sequence
  derived and/or modified sequence opt3 from PDSS2__Homo_sapiens__NP_065114
augaacuucagacagcugcuccuucaucugcccagguacuugggcgccagcggguccccucggcgcuuaugguggucuccaucacuggacaccaucaguagcgugggauccuggcgaggucguucuucgaagucaccggcucacuggaaucaagucguuagcgaggcagagaaaauugugggcuaucccacaaguuuuaugucccuaagaugccuccugucugaugaacuuagcaacauagccaugcagguaaggaagcugguggggacucagcacccuuugcucacgaccgcgcggggacugguccaugacuccuggaacucacugcagcuccgcggcuuagugguucugcuuaucaguaaagcugccgguccaagcucugugaauacauccugucaaaauuacgauauggucucagggauuuauagcugccagagaaguuuggcagaaaucacugagcugauucacaucgcccuacucgugcauaggggaauaguaaaccugaaugaacuucagucuuccgacggcccccugaaggauaugcaguucggcaacaaaaucgcuauuuugagcggggacuuucuccuggcaaaugccuguaacggauuagcucugcuccaaaauaccaagguuguggagcuucuggccucggcguugauggaucuaguccaggguguguaccacgagaacucuacauccaaggaaucauauaucaccgacgauauuggcaucaguacuuggaaagagcagacauuccugagccacggggcacuccuggccaaguccugccaggcugccauggaacuugcaaaacaugacgcugaggugcaaaauauggccuuucaguacggaaagcacauggcgaugucucauaaaauaaacagcgauguccagccuuucauuaaggagaagaccucagacaguaugacguuuaaucugaacuccgccccaguuguguugcaccaagaguuccucggccgggaucuguggaucaaacagauuggugaagcacaggaaaaggggcgcuuagacuaugcuaaacugcgagagagaaucaaggccggaaaaggcguaacuagcgcuaucgaccuauguagguaccacggcaacaaggcccucgaagcacuggagucuuuucccccuucagaggcccggagugcucuugaaaauauuguguucgcggucacccguuuuagcuga

SEQ ID NO: 60532 - RNA, 852 nt, Artificial Sequence
  derived and/or modified sequence opt3 from PDX1__Homo_sapiens__NP_000200
augaacggcgaggaacaguacuaugccgcuacccaacuguacaaggaccccugcgcauuccagagagggccugccccagaguuuagcgcguccccgcccgcuugucucuauaugggaaggcagccuccacccccuccaccccacccuuucccaggugcccuuggcgcacuggaacaggggucuccgcccgauaucucaccuuacgaggugccacccuuggccgacgauccugcugucgcacauuuacaccaucaucugccagcccaacuagcucucccccacccgccugccggacccuuuccagaaggcgcggagccugguguucuggaggaacccaaucgggugcagcuuccauuccccuggaugaaaaguacaaaggcacacgccuggaaagggcagugggcuggaggcgccuaugcagcugagccugaagagaacaagcgcacucgaacggccuacacccgugcgcagcuguuggagcucgaaaaagaguuucuguucaauaaguauauuagcagaccaaggcggguagaacuggccgugaugcucaacuuaacagagcgccacauaaagaucugguuucaaaauagaaggaugaaauggaagaaagaagaggacaagaaacggggcgggggaacugcagucgguggcgggggaguggcugagccggaacaggauugcgccguuaccuccggcgaggaacugcuugcuuugcccccuccacccccuccagguggggccgugcccccggcagccccugucgcugcgcgcgagggacgacugccacccggccuaucugcaucgccucagcccucaagcguggccccaagaaggccucaggaaccccgguga

SEQ ID NO: 60533 - RNA, 2283 nt, Artificial Sequence
  derived and/or modified sequence opt3 from PDXDC1__Homo_sapiens__NP_001272374
auggacgccagccuggagaagaucgcugaucccacccucgcagaaaugggcaaaaaccuuaaggaggccgugaaaaugcuggaagacucccagagaacagaggaagagaaugggaagaaauugauuucuggagauauaccugguccauuacaaggcaggauccagaacauuggggagcagggacacauggcgcugcuaggccauucacucggugcuuacaucaguacucuggacaaggaaaaacuucggaagcugacgacccgcauuuugagcgauacaacucucuggcugugccgaaucuuccguuaugagaaugggugugccuacuuucacgaagaggagagagaaggacuggcaaagauaugcaggcucgccauccauucccgguaugaggacuucgucguugauggcuuuaacguguuauacaauaaaaagccgguaauuuaucugucugcugcagcccgccccggccuugggcaguacuuguguaaccaacugggacuaccuuucccaugccucuguagagugcccugcaauaccgucuuugguucgcagcaccagauggacguggcuuuccuggaaaaacuuaucaaggaugacauugagaggggccggcugccuuugcuccugguugccaacgcggggacagcagccgugggacauaccgauaagaucggccgcuuaaaagaacugugugagcaguaugguauauggcuccacgucgagggggugaaucuugcuacucuggccuugggauacguaucaagcaguguucuagcagcugccaagugcgacuccaugacaaugaccccaggccccuggcugggccucccugcggugccagccgucacgcuguacaaacacgaugacccggcacuuacucugguggcuggguugaccucuaacaagcccacagacaaacuccgagcccugccuuuauggcugagccuacaauaucucggacuggaugguuuuguggaaagaauuaagcaugcuugucagcuuucccagagguugcaggagucacugaaaaaggucaauuacaucaagauucucguugaagacgagcugaguagcccagugguaguguuccgguuuuuccaagaacuucccggcucugauccugucuuuaaagccgugccaguucccaacaugacuccguccggggugggacgugagcgccacucaugcgacgcacugaauagaugguugggcgagcagcucaagcagcuggucccugccagcgguuuaaccgugauggaucuggaagcugaggggacaugucuaagguucaguccccucaugaccgcggcaguacugggcacgcggggagaagacguugaucaacuuguggccugcaucgagucuaaauugccaguccugugcuguacucuccagcugcgagaagaguuuaagcaggagguggaagcuacagccggcuuacuguaugucgacgauccuaacugguccgggaucggagugguucgcuacgagcaugcaaaugacgauaaaagcucgcuuaagucugaccccgaaggugagaacauucacgccggcuugcucaagaaacugaacgagcuagaauccgaccugaccuucaagauagggccagaguauaaaucaaugaagaguugccucuacgugggaauggcuagcgauaauguagacgccgcagaacuggucgagacuaucgcggcuacagccagagaaauugaggagaacuccaggcuuuuggaaaauaugaccgaggugguucggaaaggcauccaggaagcacaaguggagcugcagaaggccucugaggaacgcuuacucgaggaagguguccugagacagauacccgugguagggagcgugcuuaacugguucucaccuguucaggcucugcaaaagggcaggacguuuaauuugaccgccggaagucucgaguccacagaaccaauuuaugucuacaaagcacagggcgcuggggugacucugccgcccaccccuagcggaucucguacaaagcagcggcuaccaggucagaaacccuucaagcgaucacugagaggcagugaugcccucagcgagacuuccucugugucgcacaucgaagaccuggagaaagucgagaggcuuagcuccgggccugaacaaaucaccuuggaggcgucaaguacagaaggacauccaggcgcccccucuccgcagcacaccgaucagacugaggcuuuucagaaggguguuccucauccagaggacgaucacagccaaguggaagggcccgagucccugcgcuga

SEQ ID NO: 60534 - RNA, 939 nt, Artificial Sequence
  derived and/or modified sequence opt3 from PDXK__Homo_sapiens__NP_003672
auggaggaagagugcagagugcugagcauccagucccacgucauuaggggcuacguugggaaccgggccgcuaccuucccccuccaagugcuuggauuugaaauagacgcaguaaauucugugcaguucucaaaccauacagguuaugcccacuggaagggccagguccugaauagugaugaguugcaggaauuauacgaggggcugcgccuaaacaauaugaacaaauaugacuacgugcucacuggauauacgcgagauaagagcuuucuggcgaugguuguggacaucguccaagagcuuaaacagcagaauccucgucugguguacguaugugauccaguuuugggcgacaagugggauggugaaggguccauguaugugccggaggaccuccugcccgucuacaaagaaaagguggugccucuggcugauauuaucaccccaaaccaguucgaggccgagcucuuaucuggaagaaagauucauucgcaagaagaggcacugagggucauggacaugcuucacucaaugggccccgauacaguugugaucacuagcagugacuugccuuccccacagggcucuaauuaccugauaguacuagggagccagcggcgcagaaaccccgccggauccguggucauggaaaggauccggauggauauucgcaaaguggacgcuguuuuuguggguaccggcgaccucuucgcagccaugcugcuugcuuggacacauaagcacccuaauaaccugaaagucgccugcgagaagaccgugucaacuuugcaccauguacuccagcgaacaauccaaugugcgaaagcacaggccggggaaggaguuagaccaaguccgaugcagcuggaguuaaggauggugcaaagcaagcgggauauugaggaccccgaaaucgucgugcaggcuaccguccuguga

SEQ ID NO: 60535 - RNA, 891 nt, Artificial Sequence
  derived and/or modified sequence opt3 from PDXP__Homo_sapiens__NP_064711
auggccagaugcgagaggcugcggggcgcugcacuccgcgacgugcuugggcgagcccagggaguccuguucgauugugacgguguuuuguggaacggcgaacgugcggugcccggggcuccugaguuacuggaaagacuagccagggcaggaaaggccgcucucuuuguaagcaauaacucccggcgcgcaagaccagagcuggcccuuagguucgcucggcugggcuuugguggguugcgcgccgaacaacucuucucuucagcgcugugcgcagcccgacugcucagacagagguuaccgggacccccugaugcuccaggcgccguguuuguccugggcggggagggacuucgggcagaguugcgugcugccggucugcgccuagcgggcgaccccagugccggggauggagcagcuccuagagugagggccguucucgugggcuacgacgaacacuucagcuuugcuaaacugcgggaggccugugcacaucuucgagauccagaaugccuguuggucgccaccgaccgcgaucccuggcacccucucuccgacgguucuagaacaccagggacuggaucgcuggcugcggcaguggagacggccucaggcaggcaggcuuuaguaguuggcaagccgagccccuauauguucgaguguaucaccgaaaauuuuaguauugauccugcccggacacugauggugggggaccgccucgagacugauauacuuuucggacauagaugcgguaugaccacaguccugaccuugacuggcguguccaggcuagaagaggcacaggccuaccuggcugccgggcaacacgaccucgugccacauuauuacgucgaaucuaucgcagaccugacagagggacuugaggauuga

SEQ ID NO: 60536 - RNA, 765 nt, Artificial Sequence
  derived and/or modified sequence opt3 from PDYN__Homo_sapiens__XP_011527552
auggccuggcagggccuggugcucgcugcaugccuucugauguuccccagcaccacagccgacuguuuguccagaugcucuuuaugugcggucaagacucaagaugggccuaaaccaaucaacccgcugauuugcucacuacagugucaggcugcccuccugcccagugaggaaugggagaggugccagagcuuucuuuccuucuuuacgccuucuacccugggauugaaugacaaggaagaucucgguucgaaaucaguuggcgaggggccauacagcgaacuggcaaagcugaguggauccuuccucaaagaguuagagaagucuaaguuucugcccagcauauccacaaaagaaaacacucuuucaaagaguuuggaggaaaaacugcggggccuaagcgacgguuuccgcgagggggccgagucugaacucaugcgagaugcucaacugaaugacggagcaauggagaccggcacacuuuaucuggccgaagaggauccuaaggaacaggugaaacguuacggcggguuuuugagaaaguauccaaagagguccucagagguagcuggagagggugacggcgauagcauggggcacgaagaccucuacaaacgguauggaggcuuccugcgcagaaucaggcccaaguuaaaaugggauaaccagaagcgguacgguggguuucugcgccgacaguucaaaguggucaccagaagucaagaggacccuaaugccuauucuggagaacucuuugaugcguga

SEQ ID NO: 60537 - RNA, 8520 nt, Artificial Sequence
  derived and/or modified sequence opt3 from PDZD2__Homo_sapiens__NP_835260
augcccaucacccaggacaacgccgugcugcaccucccucuucuguaccaaugguugcagaauagcuuacaggagggcggggauggaccagaacagagacugugccaagcugcgauucagaagcuacaggaguauauacagcucaacuucgccgucgacgaauccacuguuccgcccgaucacucuccuccagagauggaaaucuguacuguguaccugacgaaggagcuuggugacaccgagacaguaggccugucauuugggaauauucccguguucggagauuauggcgaaaagagacggggugggaagaagcgcaaaacucaccaaggaccugucuuggacgugggcugcaucuggguuaccgagcuccgaaagaacaguccagcgggcaagagcgggaaagugcgucugagagaugaaauucugucccucaauggacaguuaauggucgguguggacguaucuggcgcuucguaccuggccgagcaguguuggaacgggggauuuaucuaucuuauaauguugaggcgguucaagcauaaagcacacucaacauacaauggcaacagcaguaauuccucugagcccggugaaaccccuacucuggagcuaggggaucgcacagccaagaaaggaaagagaaccaggaaguuuggcguuaucagccggccaccggcuaacaaagcacccgaagaguccaagggcucagccgggugcgaagugaguagcgacccuucuacggagcucgagaauggaccagaucccgaacuggguaacggccaugucuuccagcuugagaaugggccugacucccugaaagaaguggcuggaccacacuuggagcgcucagaaguggaucgaggcacugagcacaggauucccaagaccgacgccccgcucacaacuagcaacgacaaaaggcgguuuaguaagggugggaaaaccgauuuccaaucuuccgacugucuggcgcgugaggaagucggccgcaucuggaagauggaguuacugaaggaaagcgauggacucggcauucagguuagcggugggagagggucuaaaagguccccucaugcaaucgugguaacacaggugaaggagggcggggccgcucaccgggacggacgacuuucacugggcgaugaauugcuagucauaaauggucaucugcucguggggcugagucacgaggaggccguugcaauucuucgcagcgcuaccggcauggugcaacuggucguggccuccaaagaaaacucugcggaggacuugcucagacugacgagcaagucauuacccgaucugacaaguuccguagaagacguuagcucuuggacagauaacgaggaccaggaggccgauggagaagaggacgaaggcaccucaaguagcgugcagagggcaaugccagggacugacgagccucaggaugucugcggagcugaagaguccaaagguaaucuagagucucccaagcaaggcucgaacaagaucaaacucaagagccggcuguccgggggagugcaccgccuugaaucagucgaggaauauaaugaguugauggugagaaacggcgacccaaggauucguaugcuggaaguuagucgggauggucgaaaacauucucucccccagcugcuugacagcuccucagccagccaggaguaccacaucgugaagaaaucuacaagaucccugaguaccacgcagguagagagcccuuggagguugauccgcccaucugucauuuccauaaucgggcucuacaaggaaaagggcaaaggacugggcuuuucaauugcugggggacgggauuguaucagaggccaaauggguauauucgugaagaccauuuuuccgaaugggagugccgcagaggacggaagguuaaaagaaggcgaugagauccuggacguuaacgguauccccauuaagggccuaacauuccaggaagccauccauacuuuuaaacagauucgcagcggacucuucgugcugaccguccgaacaaaacuugugucgccuuccuugacuccaugcucuacccccacacacaugagccggucagcuaguccuaauuucaacaccuccggaggcgcgucugcagggggaagcgaugagggcuccucaagcagucugggucguaagacuccagggcccaaagacagaauaguaauggaggugacgcucaauaaggaaccgaggguuggacugggcaucggugccuguugcuuagcucuggagaacucuccuccaggcauuuauauccauucccuugcccccgggagcgucgcaaaaauggaaucgaauuugucacgcggagaucagauccucgaggugaacucugugaauguccggcacgccgcucugaguaagguucacgccauucuauccaaauguccucccggcccagugagacuggugauagggaggcauccuaaccccaagguaagcgagcaagaaauggacgaggucaucgcacgaucuacauaccaggaaagcaaagaggcaaauuccucaccaggacucggcaccccgcugaagaguccuagccuugcuaagaaagauucuuugauuuccgaaucagagcugagucaguauuuugcccacgacgugcccgguccauuaagcgacuucaugguugcaggguccgaggaugaagaccaucccggaucuggcugcucgacuagcgaggaagguucacucccuccauccaccaguacacacaaggagcccggcaaaccucgcgccaacucucuggugacccuugggagccaccgggcuuccggacuguuucauaagcaggucacuguggccagacaagcaucauugccgggcucuccacaggcucucaggaacccccugcuacgucagcgcaaaguugggugcuacgaugccaaugacgcgagcgaugaagaggaguucgaccgggaaggagauuguaucagucugccuggcgcccucccaggucccauuagaccucuguccgaggacgauccgaggcgagugagcaucucuucauccaaggggauggacguacacaaccaagaggaacggccccgcaagacacuugucaguaaagcuauaagcgcaccauugcugggaucgucuguggauuuagaagaguccaucccugagggcaugguggacgccgcuagcuaugccgcaaaucucacggauucagcggaagcccccaagggcaguccagggucuugguggaaaaaggagcuguccggaagcucaagugcuccuaaacuugaauacaccgucagaacugacacacagagccccaccaacacagguuccccaucuagcccgcagcagaaguccgagggccuggggucaaggcaucggccuguugcccgagugucuccccacugcaagagaagugaggcagaagcuaaaccaucgggaagccaaacuguaaaucuaaccggccgcgccaacgaccccugugaucucgacuccagggugcaggcaacgucugucaaggugaccguugccgguuuucagccugggggagcuguggagaaagaaucacugggcaaguugacaacuggcgaugcgugcgucagcaccuccugugagcuggccagugcauuaucucaucucgacgcuagccaccugacagaaaaucuuccaaaagccgccucagagcuggggcagcaacccaugacugaguuggauuccaguagcgaccucauuucuuccccuggaaagaagggugcugcacacccggauccaucaaaaaccagcguggacacgggccagguuucgcgucccgaaaacccuucucagcccgccaguccacgggugacaaagugcaaagcgagauccccugucaggcugccccaugaggggagcccaucaccuggagaaaaggcugccgcaccgcccgauuauuccaaaacccgcucugccagcgagacaaguacaccacacaauacccgaagaguagcugcacuacggggcgccgguccuggggcggaaggaaugacucccgcuggcgccgugcugccaggcgacccucuuaccucccaggagcaaaggcagggggcacccggaaaccauagcaaggcccucgagaugacagguauccacgcuccggaaucuucacaggagccaagucuguuggaaggcgccgauuccguuagcucucgcgcaccucaggcuucgcugucaauguuacccagcacggacaauaccaaagaggccugugggcauguguccggacacugcuguccaggcgguagucgugaaucucccgucacugacauugauagcuucaucaaggagcucgacgcguccgccgcaagaucaccuaguucucagacaggggauagcggaucccaggagggcucagcucagggccacccgcccgccggggcuggagguggcagcucuugccgggcagaaccagugccugggggacaaaccuccagucccaggcgcgccugggccgcuggcgcgccugcauacccacagugggccagccagcccucgguacuggacuccauaaacccugauaagcauuuuacagugaauaaaaacuuccuuucuaauuacucacgaaacuuuagcaguuuccacgaggacuccacuucucugagcgguuugggggauucaaccgaaccaucccucaguagcauguauggagacgcugaggauucuucauccgaccccgagagccugacggaagccccgagagcaucugcccgggauggcuggaguccuccaaggucgcgcgucucccuacauaaggaggaccccagcgaaucagaggaggaacaaauugagaucuguucuacaagaggcugcccuaacccacccagcuccccggcucaucugccuacccaagcggccauuugccccgcaagugcuaaaguucuuucacucaaguacucuacuccaagggaaagcguggccuccccucgggagaaagcagccugucugcccgggaguuauaccagcggaccagauuccucucagcccucaucguuguuagaaaugucgucccaggagcacgaaacacaugcugacaucaguacuucucagaaucaccguccuagcugcgccgaggagaccacagaagugacgucagcguccucugcaauggagaacaguccacugagcaaggucgcccgccauuuucacuccccgcccauaauccucucaagcccuaauauggugaacggucuggaacaugaccuucuggaugacgagaccuugaaucaauacgaaacuucuauuaacgcugccgcuagucuauccagcuucucaguugauguaccaaagaauggcgagucugugcuggagaaccuccacaucuccgaaucgcaggaccuggaugaccuuuuacagaaacccaagaugauugcacgaagaccuaucauggccugguuuaaagagauaaauaagcacaaccaggggacacaucugaggagcaaaaccgaaaaggagcaaccacucaugcccgcucggaguccugauucuaagauucagauggucuccagcucacagaaaaagggagugacuguuccgcacaguccaccccaaccuaaaacaaauuuggagaacaaggaccuguccaaaaagagccccgccgaaaugcuccugaccaauggccagaaggcaaaaugugguccaaaacuuaaacgccugucuuugaaggggaaagcgaaggugaacucagaggccccugcugccaaugcagucaaggcuggcggaacggaucauagaaaaccccuaaucagcccacagacuucccacaagacccugucuaaagccgugagucagaggcuccacguagcagaccaugaagauccggaccggaacacaaccgccgcuccucgaucgccccaaugcgucuuagagagcaagccaccccuggcgacuuccggcccucuuaaaccaucagugucugauacaagcaucagaaccuucguuaguccccugacauccccuaagccggugccagaacaggggauguggucacgcuuccacauggccguccucucugagcccgacaggggauguccuacuaccccaaaaagccccaagugccgggcagagggucgugcuccuagagccgacuccggccccgugaguccagccgcaagcaggaacgggaugucuguugcuggaaaucgccagucagaaccgcgguuggccucccauguggcggcugauacggcccagccucgacccacaggcgagaagggugggaacauuauggcaagcgacagacuggaaaggaccaaucaacucaaaaucgucgagauuagugccgaagcugugucugagacuguauguggcaacaagccagcagaguccgaucgccggggaggcugccuggcccaggggaauugucaggaaaaaucggagauaagacuuuaucgucagguggcggaaagcucaaccucccacccuucuagucuacccagccaugcuucacaagccgagcaggaaauguccaggagcuuuucuauggcaaagcuggccaguuccagcucaucuuugcagacagcuauccggaaagccgaguacucgcaaggaaagagcuccuuaaugagugacucucgcgguguuccacgaaacucaauuccuggcgggcccagcggagaggaucaccuguauuucacuccgagaccagcaaccaggacguacuccaugccugcucaguuuaguucucacuucggccgggaaggucaucccccacacagccucgggcgcuccagagacucacagguccccgugacaagcucuguggucccugaggccaaggcguccaggggcggacugccgagucuugccaauggccaggggaucuacucaguaaaaccacugcucgauaccagccgaaacuugcccgcaacugacgaaggagauauuaucucggugcaagagacauccugccugguuaccgacaagauaaaagugacucggcgucauuauuguuacgagcagaauuggccucacgaaucuacuagcuuuuucagcgucaagcagagaaucaaaucauuugagaaccuagcuaaugccgaucgccccguggcaaaguccggcgcuucuccauuccugagcguuaguuccaagccucccauugguaggcggagcucugggucaaucguguccggaagccucggccacccaggugacgccgccgcgagacuucugcgcaggaguuuaucuucaugcuccgaaaaccagagcgaggcuggcaccuugcugccucaaauggcaaaaucgccgucuauuaugacgcucacuaucagucgacagaaucccccagaaaccuccagcaaggggucagacucugagcugaaaaagagccuuggaccucugggcauacccacaccaaccaugacacucgccuccccugucaaacggaacaagaguucagugagacauacucagcccagcccgguauccaggucuaaguugcaggagcugcgcgcuuuaaguaugccagaucuagacaaacugugcagcgaagauuauuccgccgggccuucagcagugcucuuuaagaccgagcuugaaauuacgccccgucggucuccaggacccccugccggcgguguuucgugucccgagaaagggggaaauagagcuugcccaggcgguagcggcccuaagacauccgcggccgaaacuccgaguucugcaagcgacaccggggaggcugcccaagaucugcccuucaggcgcucaugguccgucaacuuggaccagcugcucgugagcgcaggagaucagcagcgacugcaaucugugcuuaguuccgucggcucaaaaagcacaauccucacccugauccaggaggccaaggcucagucugaaaaugaggaagacguuuguuuuauuguguugaaccggaaagaggggucgggacugggcuucuccguagccggugggacugauguggaaccaaagaguauaaccguccacagaguguuuagccaaggagcggcaucacaggagggcacaaugaacaggggcgacuucuuacuaucuguuaauggggccucccuggcuggacucgcccaugguaacgugcuuaagguccugcaccaggcacaguugcauaaagaugcucugguagugaucaagaaaggcauggaccaaccucgccccagcgccagacaggagccaccuacggcuaaugggaagggacuccugagucggaaaacuauuccccuugaaccgggcaucgguaggucaguugccgugcacgaugcauuaugcgucgaggugcugaagaccuccgcggggcucggauugagccuggacggcggcaagucuagugucacaggggacggaccucuagugauuaaacguguuuacaaggguggcgccgcugaacaggccgggaucauagaggcaggagaugagauccuggcuauuaacggcaaaccacucgugggucuuaugcacuucgacgccuggaauaucaugaagaguguacccgaagggccugugcagcuguugauucgaaaacaucgcaacuccucuuga

SEQ ID NO: 60538 - RNA, 2328 nt, Artificial Sequence
  derived and/or modified sequence opt3 from PDZD4__Homo_sapiens__NP_001290441
augggcugcaacaugugugugguccagaagcccgaggaacaauacaaaguuaugcuccaggugaaugggaaggagcugagcaaacuuucccaggaacagacccugcaagccuugagaucuucaaaggagccuuuaguaauccaggugcugaggcggaguccacgccuacgaggagacagcuccugccacgaucuccagcuggucgacucugguacacagacugauauuacguucgaacauauaauggcucuuggcaaacugcguccgcccaccccuccaauggugaucuuggagcccuauguucucucggagcugccuccaauuucacacgaauacuaugaccccgcagaguuuauggaagggggaccucaagaggccgauagacuggacgagcucgaauacgaggaaguggaguuauauaagagcagucauagggauaagcugggccuuauggucuguuaccggacagacgaugaagaggacuuggguaucuaugugggggagguaaacccaaauuccauugcggcuaaagauggacgcaucagagaaggcgacaggauaauccagauuaacggcguugaugugcagaaucgggaggaagccgucgcaauccugucucaggaggaaaacacuaauauuagccuacucguggcccgcccggagucccaacuggcuaagcgauggaaagacucagacagagaugacuuccuugaugacuuugggagugagaacgaaggagagcugagggcacggaaguugaaaucucccccugcccagcagccagguaaugaagaggaaaagggcgcucccgaugccgggccuggacucagcaacucccaagagcuggacucaggcgugggucguaccgaugagagcacacgcaaugaagagaguucugaacacgacuuacugggggaugagccacccuccagcaccaacacuccgggaucgcucagaaaguucggccuucagggcgacgcgcugcagucuagggauuuucauuucuccauggacucauugcuagcagagggggccggacuggguggcggggacgucccuggacucacagaugaagaguacgaacgguaccgagagcugcuugaaaucaaaugccaccuggagaauggcaaccaguugggucuccuguuuccccgcgcuagugggggcaauagcgccuuagacguuaacagaaacgagucccugggacacgaaauggcaaugcuagaggaagaacucaggcaucuggaguucaagugucggaauauacuucgcgcucagaaaaugcaacaguugagagagaggugcaugaaggccuggcugcucgaggaagagucucuguaugaucuugcggccagcgaaccuaaaaagcacgagcugucagacauuagugaauugccagagaaauccgauaaggacagcaccucugcauacaacacgggcgagucaugucguaguacuccccuccugguggaaccauuacccgagagcccucugcggcgagcuauggccggaaauuccaaccuaaauagaaccccaccggggcccgcuguagccacuccugcaaaggccgcuccacccccugguucuccagcgaaauuuaggucgcucagccgcgaucccgaagcaggccggagacagcaugccgaggagagggggcgccgaaacccgaagacaggacugacccuugaacgggugggcccugaguccucaccauauuugagucguagacacaggggucaagggcaggaaggcgagcacuaccauucuugcguccagcuggcucccacacgcggacucgaagaacugggccacgggccuuuaagccuggccggagguccccgggugggcgggguugcagccgcugccaccgaggcaccaagaauggaauggaaagugaaggucagguccgacggaacgcgauauguggcgaaacgcccuguacgggauagacuuuugaaggcuagggcccucaagauccgugaggaacgcucaggcaugacuacagacgaugacgcaguuagcgagaugaaaaugggucgguacuggucuaaggaagagagaaaacagcaucugauuagggcccgagagcaacggaagcgcagagaguucaugaugcaguccaggcuagagugucugcgggaacagcagaauggggauaguaaacccgagcucaacaucaucgcucugagccaccgaaagaccaugaagaaaagaaauaagaaaauucuugacaacuggauaacuauccaagaaauguuggcccauggcgcacgcucugcugacggaaagaggguguauaauccacuguuauccgucacaaccguguga

SEQ ID NO: 60539 - RNA, 3102 nt, Artificial Sequence
  derived and/or modified sequence opt3 from PDZD7__Homo_sapiens__NP_001182192
auggcccagggcuucgcugugggguuugacccccugggacucggugaucuuagcuccggcucucugucaaguuugagcuccagagggcacuuaggaucugacucgggcucaaccgcaacaagguaccugcuacggaagcaacagcgccuccugaacgguccuccacgagggauccgugccagcaguccgaugggaagagucauucuuauaaauucccccaucgaggcgaacucugaugaaagcgacauuauccauuccguuaggguggagaaaucacccgcuggccggcugggcuucaguguacgcgggggaagcgaacacgguuugggcauuuuugugucuaaggucgaggaaggguccucagccgagagagcaggacucugcgugggcgauaaaaucacugagguuaauggucugagccuggaaaguacgaccauggggucugccgugaagguccucacauccagcucgagguuacauaugauggugcggcgcaugggacgaguaccaggcauaaaauucucuaaggagaagacuaccuggguugacguggucaacagaaggcuggugguggaaaaauguggcuccacacccucagauaccaguagcgaggacgggguccggcguaucguucaccuuuauacuacauccgaugacuuuugcuugggauucaauauucgcgguggcaaggaguuugggcugggaaucuacgugucuaaaguagaucauggcggucuagcugaagagaacgggauuaaggugggcgaccagguccucgcagccaauggagugagauucgaugacaucagccacucacaggcuguugaagugcugaaaggccaaacccacauaaugcuuacgauuaaggagacugggagguauccugccuacaaggaaauggucagugaguauuguuggcuggaccgguuguccaacggagugcuccagcagcugagcccagcgucugagucaaguagcuccguaucuucgugcgcaagcuccgcccccuacucaagugguucuuuaccuagcgaucgaauggacaucugucugggccaggaggagccagggucccgcggaccgggcugggguagagcugauaccgccaugcaaacagaacccgacgcagggggcaggguugagacuuggugcucagugcggccuaccgucauucuccgcgauacagcuaucagaagcgacggaccacaucccggcaggcgucuugauucugcccuguccgaaaguccuaaaaccgcguugcuacuggcccucagccggccacgacccccgaucacgagaucucaguccuaucugacucuuugggaggagaagcagcagaggaaaaaggaaaaaucagggaguccuggagagaagggugcacugcaacgcagcaaaacauugaugaaucucuuuuucaagggcgggcggcagggaagacuggcuagggacggccgccgagaagccuggaccuuagauucggguucccuggcuaagacuuacccccggcuagacauugagaaagccgggggcgugggaccaguccagaaguuugugacauggcgucucagaagggaucaagaacgcggccgggcacugcuuucugccagaagcgggucaccuaguucccaguugcccaacguugacgaacaggugcaggcuugggagucuaggcgaccacugauacaagaccucgcgcagcgccugcuuaccgaugacgaaguacuggcagucacgcggcacuguagcagauacgugcaugagggaggcaucgaagauuugguuaggccccuccuggccauuuuagaccguccugagaaacugcuacuccugcaggauauccgcuccguggucgcuccaaccgaccuuggucgguucgauucaauggugauguugguagagcuggaagccuuugaggcacucaagagcagagccgugaggccgcccgcucugcgaccugcccggcaggacacaccacccaaacgccacuuaauaacuccuguuccagauaguagagggggauucuaucugcuucccgucaauggcuucccggaagaggaagacaacggugaguugagggagcggcucggcgcacugaaggugucuccuuccgcgagcgcuccacgacacccccauaaggggauuccuccccuacaagaugugccagucgacgccuuuaccccucugagaaucgcaugcacacccccaccgcagcucccucccguugccccacgcccccugaggccuaauuggcuuuugacugaaccacugucgcgugagcacccuccucagucacagauccggggcagagcucaaucuaggagucgcucccgaagcagaucucggagcagguccucacgcggacaggggaaaaguccgggacguagaagcccaucucccgugccuaccccagcccccuccaugacaaacggccgguaccauaagccuaggaaagcacgcccgcccuuaccacgaccucucgauggugaagcugccaaggugggggcgaaacagggacccucagagaguggcaccgaagguacugccaaggaggcugcaaugaagaauccaagcggcgagcugaaaacgguaacacuuuccaagaugaaacagucucuggggauuucgaucagcggaggcauugaaucaaagguccaaccuauggugaaaauagagaagaucuuccccgggggagccgccuuuuuguccggcgcucuccaggcagguuucgaacugguugcgguggacggggagaaccuagaacaggucacccaccaaagagccguggacacuauucggagggcuuaucgcaacaaggccagagagccaauggagcugguugugaggguaccgggaccuaguccccggccaucucccagcgauuccucagcacucaccgacggcggucugccugcugaucaucuuccagcccaccagcccuuggacgcagccccugucccggcucacuggcugccagaacccccuacaaauccccagaccccaccuacugaugcgcguuuacuccagcccacaccaucuccugccccgagccccgcacugcaaacgccagacaguaaaccugcucccuccccacgcaucccuuga

SEQ ID NO: 60540 - RNA, 3465 nt, Artificial Sequence
  derived and/or modified sequence opt3 from PDZD8__Homo_sapiens__NP_776152
augggccugcuccuuaugauccuggccagcgcuguguugggguccuucuuaacccugcuagcacaguuuuuccuccuguacagaaggcaacccgagccuccagccgacgaagcggcucgggccggagaggguuuucgcuauauuaagccgguccccggccuucuguugcgagaauaccucuaugggggaggccgugaugaggaaccuucuggugcagccccagaagggggagcuacacccacugcagccccugagacgccagcucccccuaccagagaaacaugcuacuuccugaacgccacuauacuguuucucuucagggaguuacgggacaccgcgcugacacgcagauggguuaccaaaaagaucaaaguggaauuugaggagcuuuugcagacuaagacagcaggcaggcugcuagaaggccucucacugcgggauguauuccuuggggagaccgugccauuuauuaaaacgauccgccugguccgaccggugguucccagugccacuggagaaccugacgguccagagggcgaggcuuugcccgccgcauguccugaggagcucgcuuucgaagccgagguggaauauaaugggggauuucaccuggcgauugaugucgacuuaguguucggcaagagcgccuaccuguuuguaaagcucuccagaguuguggguaggcuucggcuggucuucacccgugugccauucacacauugguuuuucucuuuuguggaggaucccuugaucgacuucgaaguccgcucgcaguuugaggggagaccgaugccucagcuaacuucaauaaucguuaaccaacugaaaaagauuaucaaaaggaagcacacccuccccaauuauaaaauucgguucaagccauuuuucccuuaccagacacugcagggauuugaggaagaugaggaacauauccacauacagcaaugggcacuuaccgagggccgacugaaggugacguugcucgaaugcagccgccuguuaauuuucggcaguuacgacagagaggcuaacguacauuguacucuggagcuauccucuagcgugugggaagagaaacagagguccucaaucaagacagucgaacucauuaaagggaaucugcagagugugggacuuaccuugcggcugguucagagcacugaugguuaugccggccacgugaucaucgagacagucgcucccaacucuccagccgcaauugccgaccuccaacgcggggauagacugauagcuaucggaggcgugaagauuaccuccacgcuucagguacugaaauugaucaagcaggcgggugacaggguucucguguacuaugagcgucccgucgggcaaucaaaucagggcgcagugcugcaggacaacuuuggacaguuagaagagaauuuccugagcaguucuugccaauccggcuacgaagaggaagccgcugggcuaaccgucgauacagagagccgggagcucgacucggaauuugaggaucuggccucugacgugcgagcacagaacgaguucaaagaugaggcccagucccuuucacacaguccuaagagaguuccaacuaccuugagcauaaagccgcugggagcuauuucccccgugcucaauaggaaacuggccguagguucucauccuuuaccacccaagauccagagcaaagacggcaacaagccuccaccccugaaaacaucagaaaucacugauccggcacaagucaguaagccuacccagggguccgcguucaagccacccgugccuccccgcccacaggcuaaaguuccucuucccagcgccgacgcaccaaaucaggccgagccggauguguuggucgagaagccugaaaaagugguacccccaccccucguggacaagucugcugagaaacaagccaagaacguugaugcaauugacgacgcugccgcgccuaagcaguuucuggccaaacaggaagucgcuaaggaugugacaucagagaccaguuguccaacuaaagacagcuccgaugaccggcagacgugggaaucuucggagauccuauauagaaauaagcugggaaaauggacaaggacccgcgcaagcugccucuucgauauugaggccugucaccgauaccugaacauagcucuuuggugccgggaccccuuuaaguugggcggucugaucuguuuagggcaugugucccucaagcuggaagaugucgcccuuggcugccuggcaacuucaaacaccgaguauuugaguaaacuccgucuggaagcgccuucuccgaaggccauuguuacaagaaccgcucuaaggaaucugagcaugcaaaaaggauucaacgacaaguuuuguuacggcgauaucacuauccacuucaaauaccucaaggagggggaguccgaccaccauguggugacaaauguagaaaaagagaaggaaccacaccuggucgaggaagugucaguucuucccaaggaggagcaguuugugggacagauggguuugacggaaaacaaacauagcuuccaagauacccaguuucagaauccuacuuggugcgacuauugcaagaaaaaggucuggacaaaagccgcaucucaguguauguucugcgcuuacgugugucacaagaagugccaagagaaaugucuggccgaaaccuccguuugcggcgcaacagaucgccggauugacagaacuuuaaagaaccucaggcuggaggggcaggaaacccuucugggacuaccaccccgaguggacgccgaggcuaguaaaagcguaaauaagacgaccggccucacacgccauauaaucaacacuucuucccggcuguugaaucugagacaggucucaaaaaccagguuaagugagccugguacagaucucguggaaccgagccccaagcacacuccaaacaccucggacaaugagggguccgauacggaaguguguggcccuaacucucccagcaagcguggaaauucaacaggcauuaaacugguccgcaaggaagggggacuugacgauaguguuuuuaucgcggugaaagaaauuggccgggaccuguauagagguuugccaaccgaggagaggauccagaagcucgaguucaugcuggauaaacuacaaaacgaaauagaccaggaacuggagcacaauaacucccuuguacgagaggaaaaggagacuacagauacccggaagaaaucucuccugagcgccgcauuggcuaaguccggggaacgccugcaggccuuaacucuccugaugauccauuacagagccggaauugaggacaucgaaacccuugagucacugagcuuggaucagcacaguaaaaagauuucuaaauauacagacgauacggaggaagaccucgacaacgagaucucccaacugauagauagccagccuuuuucgucaauuucugacgaucuauucggccccagugaauccguguga

SEQ ID NO: 60541 - RNA, 1539 nt, Artificial Sequence
  derived and/or modified sequence opt3 from PDZK1__Homo_sapiens__XP_011507918
augaccagcacauucaaccccagagagugcaagcuguccaaacaggaaggccaaaauuacggguuuuuccucaggaucgagaaggacacugaaggacaccuugugcgggucguugagaaauguucuccugccgaaaaggcuggucugcaggauggcgaccgcguguugcgaauuaacgggguauuuguggauaaagaggagcauaugcaggucguggacuuaguucguaagucaggaaauagugugacgcugcuaguccucgauggcgacagcuaugaaaaggcagugaaaaccagaguagaucugaaggagcuuggucagucccaaaaagaacaggggcugucugacaacauauugucgccaguuaugaauggaggcgugcagacauggacucagccgaggcucugcuaccuggucaaggagggcgggucauauggauucagccugaaaaccgugcaagguaagaagggcguguacaugacagauaucaccccucagggggucgccaugcgggcgggaguucucgcugacgaucacuuaauugaggugaacggcgaaaauguagaggacgccagucaugaagagguggucgaaaaagugaagaaauccgguucucgcguuauguuucugcuuguggauaaggagacugacaaaagacacgucgagcagaagauccaguucaaaagggaaacagccagcuugaagcugcuaccucaucaaccacggauuguggagaugaagaaaggguccaacggauauggcuuuuaccuccgcgcaggcucagaacagaaggggcagaucauaaaagacaucgauaguggaagccccgcugaggaagcaggucugaagaauaacgaccuuguaguugccgugaauggcgagucugucgagacccuggaucacgacuccguggucgaaaugauucgaaaagggggagaucaaacgucauugcucgugguugacaaggagacugauaacauguauagacuggcucacuucagccccuuuuuauacuaccagagucaggaacugccaaauggcucugugaaggaggcccccgcgccuaccccaacaucccucgaaguaagcucgccgcccgacacuaccgaggaggucgaucauaaaccuaaacuuuguaggcuggcaaaaggugaaaacggguauggcuuccacuugaaugccauccggggacuaccaggcucuuuuauuaaggaggugcagaaagggggacccgcugaccuggccggucucgaagaugaggacguuaucauagaggugaacggcgucaacgugcuggacgaaccuuacgagaagguaguggaucguauucaauccucagggaagaauguuacacuucuggucugcggaaagaaggcauaugacuacuuccaggcuaaaaagaucccaauugugaguagcuuggccgauccccucgacaccccgccugauuccaaagaaggcaucguggucgagucuaaccaugacagccacauggcgaaggaacgccuguauacgaucgccguuaauuguauguuauga

SEQ ID NO: 60542 - RNA, 2367 nt, Artificial Sequence
  derived and/or modified sequence opt3 from PDZRN3__Homo_sapiens__NP_001290070
augaagauggagcacaaaagaaugauccuccuguucagcaaguuuacccuuauucauaaaccccacggcgggaggugguaccuggugaacggacgggacuugucccgcgccacacaugaucaggcugucgaagcauucaagacugccaaagagccuauaguugugcaaguauuacgacguacgccaagaaccaagauguuuacaccgcccucugaaucacagcugguggacacugguacccagacagauaucaccuucgagcacauuauggcgcuaacuaagaugaguagcccuuccccacccguccucgacccuuaucugcuuccagaagaacaucccucugcucacgaguacuaugauccuaaugacuacaucggcgauauucaccaggaaauggacagggaggaacuggaguuggaggaaguggaucucuaucggaugaacucgcaagacaaacuggggcugacaguuugcuaccgcaccgaugacgaggaugacaucggaauauauaucucagaaauugacccaaauagcaucgccgcaaaggauggcagaauuagggagggugaccggaucauacagauuaacgggaucgaagugcagaaucgcgaggaggccgucgcucucuuaacgagugaagagaacaaaaauuuuucccugcuuauugcacgaccggaauugcagcuggaugagggauggauggacgaugacagaaacgauuuccuagacgaucuccauauggacaugcuggaggagcaacaccaucaggccaugcaguuuacugcuucugugcuucagcaaaagaaacacgaugaggacggcggcaccacagacacugccaccauccugagcaaucagcacgaaaaggauuccgggguaggaaggacagacgagucaacccggaacgaugaaaguagcgagcaggaaaauaacggugacgaugcgacggcaucuuccaaucccuuggccggccaacguaagcucacuuguucacaggacacacuggggagcggagauuuaccuuucaguaacgagucuuuuaucuccgcugacugcaccgaugccgacuaccugggcauuccaguugaugagugugaacgcuucagagagcuccuugaacugaaaugccaggucaagagcgcaacucccuacgguuuguauuacccuucggggccacuagacgcuggaaaaucugaucccgaguccguggacaaggagcuggaacuccugaaugaggaacuuaggucaauagagcuggaauguuugaguaucgugcgggcccauaaaaugcagcaacucaaggagcaguaucgagagagcuggaugcugcacaacuccggcuuucgcaacuacaauacaucuauugacgugagaaggcaugaauuaagcgauaucaccgagcugccggaaaaaucagacaaggauaguuccagcgcguauaacacgggcgagucuugccggucaaccccucuaacacucgaaauaagucccgacaauagccugcgcagagccgcagaggggauuuccuguccaucuucggagggagcugucgguacuaccgaagccuacggcccugcuagcaagaaccuuuuguccaucacagaggaucccgaaguugggacuccaaccuauucacccagucugaaagagcucgacccuaaucagccacuggaaucuaaggagaggcgugccagcgauggaucccggucaccgacacccagccagaaacuuggcucugcauaccugccuuccuaccaccauaguccauauaagcacgcccacauccccgcucaugcgcaacacuaccagagcuauaugcaguugauucagcaaaaaucugcaguggaguacgcccagucccagaugucacucguaaguaugugcaaggaccugagcucgccuaccccauccgaaccccgaauggaguggaaggugaaaaucagaucugaugguacuagguauauuacgaagcgcccgguccgggacagauuacugagggaacgcgcucuaaaaauacgagaggagcggagcgggaugacaaccgaugacgaugccgugucagaaaugaagaugggccguuacuggaguaaagaggaaagaaagcagcaucucguuaaggcaaaagagcaaaggcgccggagagaguucaugaugcaguccaggcuggacugucuuaaggaacagcaagccgcugacgaucgaaaagagaugaacaucuuggaacugucucacaagaaaaugaugaagaagcgcaauaaaaagauuuuugacaacuggaugacuauccaggagcuccugacccacggaacaaaaagcccugauggcacccggguguauaauuccuucuuaucagucacuacaguguga

SEQ ID NO: 60543 - RNA, 3111 nt, Artificial Sequence
  derived and/or modified sequence opt3 from PDZRN4__Homo_sapiens__NP_001158067
augggcuucgcccuggagagauuugcugaagcaguggaccccgcccucgagugcaaacuuugugggcagguccuggaagaaccuuugugcaccccauguggacacguuuucugcgcgagcuguuuacugccgugggcugugaggcggcgccgaugcccccuacaaugucagccucucgccccaggugaacuguaccguguacuuccccugagauccuugauccagaagcucagggugcagugcgauuaucgggcacgcggcugugggcauucugucagacugcacgagcuggaggcccauguggaacacugcgacuuuggaccugcuaggcggcuccgcucacgaggcgguugugcaaguggguuaggaggcggcgagguuccagccagagggggaugcggucccacaccuagggcuggccgugggggaggcgcccggggugggccaccgggaggccgcuggggcagagggaggggacccgguccucgggugcuggcguggcgacgcagagaaaaggcacuuuuggcccaacugugggcucuacagggcgagguccagcucacugccaggcgguaccaggagaaauucacgcaauauauggcacaugugcgcaacuuuguaggggaucugggaggcggucacagaagggacggggaacacaagccauucaccauuguucuugagcgugaaaaugauacacugggcuuuaacauaaucggaggccggcccaaucagaacaaucaggaggggacuagcaccgaaggaauuuacguguccaaaaucuuggagaacgguccugcugaccgagccgauggccucgagauucaugacaagaucauggaagucaaugggaaggaucugucuaaagcgacacacgaggaagccguggaggcauucagaaacgcuaaggaaccaauagugguccagguuuuaaggcgcacuccccugucgcggccggccuauggaauggcuucagaggugcaacucaugaaugccagcacccagacagacaucaccuuugagcauauuauggcacuugccaaacugagaccucccacgccaccuguacccgauaucugcccauucuugcuaagugacuccugucacucucugcaccccauggaacaugaguuuuacgaagauaacgaguauauuagcucccucccugcugacgcggacaggacugaagauuucgaguacgaggaaguggagcugugccgcgucucaagucaggaaaaacuuggccugaccguguguuaccgaacagacgaugaggaggacacugguaucuauguuagcgaaguggauccaaauucuauagcagccaaggacgggcggauucgugagggcgauagaaucuugcaaauuaacggagaagacguccagaauagggaggaagcuguggcccuccuguccaacgaugagugcaagcgcaucguauuacugguugcacggccggagauccagcuagacgaaggcuggcucgaggaugaaagaaaugaguuucuggaggagcuuaacuuggagaugcuggaagaggaacacaacgaggccaugcagcccaccgcuaaugaaguggagcaaccuaagaaacaggaggaagaggaagggacaaccgacacggccacuucaagcaguaacaaucaugagaaggacucuggagucgguaggacagaugagucccuccgaaacgacgaaagcucggagcaggaaaaugcagcggaggauccaaacucuaccucccugaaaucaaagcgcgaccuuggccagagucaagauacucuggggagcguggaauugcaguacaaugagucccucgucucuggagaguauauugacagcgauuguauaggcaaccccgacgaagauugcgagcgguucagacagcuguuagaacugaaauguaagaucaggaaucacggugaguacgaccuauauuacucaaguuccacaauugaaugcaaccagggggagcaagagggcguggaacaugagcuccagcugcuuaaugaagaguugcguaacaucgaacuggagugucagaauauaaugcaggcucaccgccuccaaaaaguuaccgaucaguauggagacauuuggacgcugcacgauggcggguuccggaacuacaauaccagcaucgacaugcagagaggaaaguuagacgauaucauggagcauccugaaaagucugacaaagauucaaguagcgccuacaacacagcagaguccugcaggucuacuccacugaccguggaccgaucgcccgauagcucccuuccgcggguaauuaacuugacaaauaagaaaaaccuccgcucaacuauggccgcuacccaaaguucuagcggccaguccucaaaggaaagcacaucuaccaaagccaagacuacggagcaggguuguuccgcagagaguaaggaaaaaguccuggaggggagcaagcuaccugaccaggaaaaagcugugucugagcacaucccauaucugucccccuaccauucaaguagcuauagauacgccaauauuccugcgcacgccaggcacuaucaaucguacaugcagcucauacagcagaaguccgcuguugaauaugcacaaucucagcugagccuugugucaaugugcaaagagagucagaagugcuccgagcccaagauggaauggaaagucaagauccggucugauggaacacgauacauuaccaaaagaccagugcgcgacaggaucuugaaggagcgugcccugaaaaucaaggaggaacggagcggcaugacuaccgaugacgauacaauguccgaaaugaagauggguagauacuggucaaaagaggagaggaagcagcauuuaguacgcgcuaaagaacaacgaagacggagggaguuuaugaugcgcagccgucucgaaugucugaaggagaguccucagucuggcuccgaagggaaaaaggagauuaacauaaucgagcuuagccacaaaaagaugaugaagaaaagaaauaagaaaauucuggacaacuggaugaccauccaggaauugaugacucauggagccaagucgcccgauggcacacgggugcacaaugcauuccucucaguuacgaccgucuga

SEQ ID NO: 60544 - RNA, 456 nt, Artificial Sequence
  derived and/or modified sequence opt3 from PEA15__Homo_sapiens__NP_001284505
auggaggacgaaggcaacaagcugugccaggcucccccuuggccagggcaaaccagcccggugauggccgaguacggaacacuccuucaggaucugacuaauaacaucacguuggaagacuuagagcagcugaaauccgcauguaaggaagauauucccucugagaaaucagaggaaauaaccacagguagugccugguucagcuuucuagagucccacaauaagcucgacaaagauaaccugucuuauaucgaacauauuuucgagaucucgagaaggccugaccuucugacuauggucguugauuaccggacccgcguguugaagauuucagaggaagacgagcucgauacaaagcugacccgaaucccaagcgcgaaaaaguauaaagacauaauccgucagcccagugaagaggaaauuaucaagcuggcuccuccacccaaaaaggccuga

SEQ ID NO: 60545 - RNA, 5241 nt, Artificial Sequence
  derived and/or modified sequence opt3 from PEAK1__Homo_sapiens__NP_079052
augagcgccugcaacaccuucaccgagcacguguggaagcccggagaauguaaaaauugcuuuaagccuaaaucccugcaucaacucccaccggaccccgagaaggcuccuaucacucacgggaacgucaaaacgaaugcaaaccauucuaauaaccacagaauuaggaauaccggaaacuuccggccacccguugccaagaagccuacaauagcggugaaaccaacuaugaucguggcugauggucaaucaauuuguggcgaacuuagcauccaggagcauugcgaaaauaagcccgugauuaucggguggaaccgcaaucgagccgcacugagccagaaaccuuugaacaauaacaaugaggacgaugagggaauaucccacgucccaaagccguacggcaacaacgacucugccaaaaagaugucggauaauaacaaugguuuaaccgaagugcugaaggagaucgcugggcuagacacagcaccccagauucguggaaacgaaaccaauucaagagagacuuuucucggcaggaucaacgauuguuauaaacggagccuggagcgcaaacuuccuccaagcugcaugauuggcgggaucaaagaaacacaaggaaagcacguuauacuguccgguucuaccgaggugauuagcaaugaaggcgggagauucuguuaccccgaguuuuccucaggagaagagagugaggaagacgucuuguucagcaacauggaggaggaacacgaaucuugggaugaguccgacgaggaacuccuggccauggagaucaggaugcggggccagccucgcuuugcuaauuuccgagccaacacgcugucaccagugagauuuuucguggauaaaaaguggaauacuauuccccucaggaacaagagcuuacagcggaucugcgcgguugacuaugaugacaguuacgacgaaauccugaaugguuaugaggaaaacucuguggucuccuacgggcagggaagcauucaaucgauggugucuuccgauucaaccaguccggacagcucccuuacagaggagucucguagcgaaacugcaucaaguuugucccagaagauauguaauggcggccugagcccugggaaccccggagauucuaaggacaugaaagagaucgaaccaaacuaugagucaccuaguagcaauaaccaggauaaggacuccucucaggccucgaaaagcuccauuaaggugcccgagacccacaaagcuguccuagcccuccgccuggaagagaaggaugguaagaucgcaguucaaacagaaaaagaggaaucaaaggcuaguaccgacguggccggccaggcgguaacgauaaaucuugugccaacugaggagcaggccaaacccuacagagucgugaaccuggaacaaccuuugugcaagccauacacaguuguggaugucucugcagcuauggccagcgagcaucucgaagggccgguaaauucccccaaaaccaagucaaguucuuccacuccuaacaguccaguaacaaguucuucccugacccccggacagauuucagcucacuuucagaagaguagcgccaucagguaucaggagguuuggacgucguccaccucuccucggcagaaaaucccaaagguggaauuaauuacaagcggcacuggucccaaugucccgccucgcaaaaacugucacaagucagcaccaaccagucccacagccacuaauaucuccucuaaaaccauuccuguaaagagccccaaccuguccgagauaaaguucaauucauacaacaaugcugggaugccaccuuuucccaucauuauccaugacgagccaacauaugcgagaagcaguaaaaacgcaaucaaggucccgauugugauaaauccuaacgccuacgauaaccucgcuaucuauaaaucuuuccuuggcaccuccggagaacugagcguuaaggagaaaacuacgucggugauuucacacacauacgaagagaucgaaaccgagucuaagguacccgacaauacuaccaguaaaacaaccgacugcuugcagacuaagggcuucuccaacagcacagagcauaagagagggucugucgcccagaaagugcaggaauuuaauaacugccuaaauaggggacaaagcuccccacagcggucauauaguagcucucacuccucacccgcaaagauucagcgcgccacgcaggagccuguugcuaaaaucgaagguacccaagagagucagauggugggcagcuccucuacuagagagaaggccucgacaguccugagccagauaguggcaucaauccagccaccccaauccccuccggaaaccccacagagugggcccaaagcguguucuguagaggaacucuacgcuauuccuccagaugccgacguggcaaagagcacacccaaguccacuccuguuaggccgaaaucacuguucaccucucagcccagcggagaggccgaagcuccacaaacgaccgauaguccuacaacuaagguccagaaagaccccuccaucaagccagugaccccuagccccucuaaacuugugacaucaccacaguccgagccgccugcccccuuuccacccccucguaguacuagcucgccauaccaugcaggcaaccuguugcagcggcacuucaccaauuggacgaagcccacaucuccuacccgauccacugaggcugaaagcguccuccacucagaggguaguagaagggccgcggaugccaagccgaaacgcuggauuucuuuuaaguccuucuuucggagaaggaaaacagacgaagaggaugacaaggaaaaagagcgcgagaaggggaagcugguuggcuuagauggaaccgugauccauaugcugccacccccucccgugcaacgacaccauugguucacugaagcuaaaggcgagagcucagaaaagccagcaauaguauuuauguaucggugcgacccugcccaggggcagcuaagugucgaucagagcaaagcucguaccgaccaagccgcagugauggagaagggacgagcggaaaacgcccuccugcaggauuccgagaaaaagaggucucacagcucccccucacagauucccaaaaagauccuuucucacaugacacaugagguuacggaagacuucaguccucgcgacccgcggaccguggucgguaagcaggauggcagaggguguacuucggugacaaccgcuuugagccugcccgagcucgaaagggaggacggaaaagaggauauuuccgacccaauggauccuaaucccugcucugccacauacucaaaccugggccaaagccgagcagcuaugaucccaccuaagcagccccgccagccgaaaggugccguugacgaugcaauagccuuugggggcaagacugaccaagaagcuccaaaugcgucccagccuacaccaccaccccuuccuaaaaagaugaucauucgggccaacacggagccgaucaguaaggaucugcagaaaucuauggaaagcucauugugugugauggcaaaucccacauaugacauugauccaaacugggacgcuuccagugccggaagcucuaucuccuacgagcucaagggccuggauauagaaucauaugacagcuuagagagaccucugaggaaagagcgucccguaccuucggccgcuaauucuauuaguucccuaaccacucucagcaucaaggaccgcuucucaaacuccauggaaucucugagcagucggagagggccauccugcaggcagggacgaggcauccaaaaaccccagcggcaggcacuuuaccgcgguuuggagaacagagaagaggucguggggaagauuaggagccugcacaccgaugcccucaagaaacuggcggugaagugugaagacuuauuuauggcuggacagaaagaucaacugcgguucggcgucgacucuuggucagauuuccgacuuacaagugacaagccuugcugugaggccggugaugcaguuuauuacacugccuccuacgcuaaagacccauugaauaacuaugcagugaagaucugcaagagcaaagccaaggagucucagcaguacuaucauucgcucgcgguaagacagucacuggcugugcacuuuaauauucaacaggauuguggccauuuccuagccgaaguccccaaccgccugcucccgugggaggacccugaugacccagaaaaagacgaggaugacauggaagagaccgaggaagaugcaaagggggagacagacggcaaaaaucccaagccuugcagcgaagccgcuuccagucagaaggagaaccagggcgugaugucuaaaaagcaaaggagccacguuguggucauaacgcgugaggugccaugccugaccguugccgauuuugugcgggacucccuugcacagcacgggaaaucacccgauuuguacgaaagacaggucugucuguuacuccugcaacuuugcaguggacuggagcauuugaagccguaucacguaacucauugugaccucaggcuggaaaaucuacugcucgugcacuaccagccuggcgguacagcucagggguucggacccgccgagccaucuccuaccagcuccuaucccacucgccugaucguuucaaacuuuagccaggcgaaacaaaagucucaucuuguggauccagaaauuuugcgagaccaguccagacuggcccccgagaucauuacagcaacccaguacaaaaagugcgaugaguuccagacgggcaucuuaauauacgaaaugcuccaucugccuaauccauuugacgagaacccggaacuuaaggagcgggaauauacuagggcugaucugccccgcaucccuuuccguaguccauacagcagaggucuacaacagcucgccucgugucuguugaaucccaacccuuccgagcggauucugaucucugacgcuaaaggcauuuuacagugccuccugugggggccaagggaggaccuuuuucagaccuucacagcaugucccucacugguccaacgcaauaccuugcuccagaacuggcuggauaucaagcgaacucuacugaugauaaaauuugccgaaaagagccuugacagagagggaggcauuagucucgaagauuggcugugcgcccaguauuuggcuuucgcgacaaccgacucccugucuuguaucgugaaaaucuuacaacaccgguga

SEQ ID NO: 60546 - RNA, 3114 nt, Artificial Sequence
  derived and/or modified sequence opt3 from PEAR1__Homo_sapiens__NP_001073940
augagcccuccccugugcccacuccuucuguuggccgugggcuuaagacuggcugggacccuaaacccguccgaccccaauacauguucuuucugggagucauuuacuacgaccacaaaggaaagucacagcaggccuuucucccuccugccaucugagcccugcgaacggccuugggagggaccacauacuuguccccagccuaccgucguuuaccgcacaguguaucgacaaguagugaaaaccgaucaccgucagagacuucagugcugucaugguuuuuacgaaucgaggggcuucugcgucccacugugugcacaggagugcgugcacgggcgguguguugccccgaaccaaugccagugugugcccggauggcgcggcgacgauugcucaagcgagugcgcgccugguaugugggggccacagugugacaagcccugcaguuguggaaauaacuccucuugcgauccuaaaagcggcgucuguuccugcccaucaggcuugcagcccccgaauugucuccaaccuugcacucccggguauuacggaccagcuugucaguuuagaugccagugucauggugccccuugcgacccccagacaggcgcaugcuucuguccagccgaaaggaccgggcccaguugcgaugugagcuguucucaaggaacguccggcuuuuucugcccuucaacucacagcugucagaacggugggguauuucagaccccacaaggaaguugcucuuguccgcccggcuggaugggcacaaucugcucccugccuuguccagagggguuccacggacccaauugcagccaggaaugucggugccauaacgguggccugugcgaccgcuuuacugggcagugucgaugcgcuccuggauauaccggcgauagauguagggaggagugcccaguuggucgguucgggcaggacugugcagaaacaugcgauugugcccccgacgcucguugcuuuccggccaauggcgcgugucucugcgagcacggauucaccggcgaucgcuguacggacagauuaugcccugacggguucuacggacugucgugccaagcaccauguacuugcgauagggaacauucucuuuccugucaccccaugaacggugagugcucauguuugccuggcugggccgggcugcacugcaaugaaaguuguccccaggacacacauggaccaggcugccaggagcacugucuaugccuccaugguggggugugucaggcuaccagcggccugugccaaugcgccccuggauauacuggcccccacugugcaucccuuugcccaccggauacauacggggucaacuguucugcucggugcagcugugagaaugccauugcgugcucaccuauagacggagaaugugugugcaaggaggguuggcagcgaggcaacuguagugugcccugcccacccgggaccuggggauuuuccuguaaugccagcugccagugcgcacaugaagcugucuguucuccucagacgggcgccugcaccuguacaccagguuggcacggggcucacugccaacugcccuguccuaaaggccaguucggagagggcugcgccucacgcugugauugcgaccauagugaugggugugacccgguucacggaagaugccagugucaggcaggcuggaugggugccaggugccauuugagcuguccagaagggcucuggggagugaacugcuccaacacuugcaccuguaagaauggcgguacaugccugcccgagaacggcaauuguguaugcgcuccuggguuucggggaccaucuugucaacgcucgugccagcccggcagauacgggaagaggugugugccuugcaaaugugcgaaccacagcuucugccacccguccaauggaacuuguuauugcuuagcaggcuggaccggucccgauugcucacagccauguccucccgggcauuggggagagaacugcgcccaaacaugucagugccaccauggcgguaccugucacccacaggacggcaguugcaucuguccucugggguggacuggacaucacugccucgaaggcuguccccuugggacguuuggagcuaauugcucucagccaugucaaugcggcccgggugagaagugccacccugaaacaggggccugugucugucccccaggacauagcggcgcacccugccguauugguauccaggagccuuucaccgugaugccaacuacccccguugccuacaacucccugggcgcugugauugggaucgccgucuugggaagccuagugguagcacugguugcgcucuuuauaggcuaucggcacuggcagaaagggaaggaacaucaccaucuggcuguggccuacagcucuggacgacuugauggcuccgaguaugucaugccugacgugccgccaaguuacagccacuauuacucuaaucccuccuaccacacacugucacagugcaguccuaaucccccaccucccaacaaagucccagguccuuuguucgcaagccuccaaaacccggagagacccgggggagcccagggccaugacaaucacaccacucugccagcugauuggaagcauaggcgcgaaccucccccaggcccuuuagaccgggggucguccagacuggauaggucuuauagcuacucauauaguaacggacccgguccguuuuacaauaagggccuaaucuccgaggaggaacucggggccucuguggcaagccuguccucagagaacccauaugcuacaauucgcgaccuuccuagcuugcccggaggcccacgagaaaguucuuacauggagaugaaaggucccccuuccgggagcccgccccggcagccaccucaguucugggauucgcaacguagaaggcagccccagccucaacgcgacucaggaacguaugaacagccaucuccccugauccacgaucgggacaguguuggcucccagccuccacugcccccgggccucccuccagggcacuacgauagccccaagaacucucauauuccuggacacuacgaccuuccacccgugagacauccgccuucacccccacugaggcgacaggaucgcuga

SEQ ID NO: 60547 - RNA, 564 nt, Artificial Sequence
  derived and/or modified sequence opt3 from PEBP1__Homo_sapiens__NP_002558
augcccguggaccugagcaagugguccggcccucucucucuucaggaggucgaugaacaaccacagcacccgcugcauguuaccuacgccggggcugcaguggacgaguugggaaaaguauuaacacccacucaggugaagaacagaccuacgucaaucaguugggauggucuggacagcggcaaacuauauacccucguccugacagauccagacgcccccuccaggaaggauccuaaauaccgggaauggcaccauuuccuugugguuaauaugaaggggaacgacauuucuucgggaacugugcugucagauuaugucggcagcgguccacccaaggggaccggauugcaccgcuacguguggcucguauaugagcaggaccgaccucugaaaugcgaugaaccaauacugaguaaucguuccggcgaccauagaggcaaguuuaaaguugcgucuuucaggaagaaauacgagcuccgggcuccgguggccgggacauguuaucaagcagagugggaugacuacguccccaaguuauacgaacagcugagcggaaaguga

SEQ ID NO: 60548 - RNA, 684 nt, Artificial Sequence
  derived and/or modified sequence opt3 from PEBP4__Homo_sapiens__NP_659399
augggcuggaccaugagacuggugacagccgcucuccuucugggguugaugauggucguuacuggagacgaggaugaaaacagccccugcgcacacgaggccuuacuggacgaagauacgcuauucugucagggucucgagguguuuuacccugaacugggcaauaucgggugcaagguagugccagacuguaacaauuauaggcagaaaauuaccuccuggauggagccgauagucaaguuccccggagcgguggauggcgcuacauacauccuuguuaugguggacccugaugccccaucucgggcagagccccgccaacgauuuuggcgucauuggcuggucacugacauuaaaggugccgauuugaagaaagggaagauccagggacaggaacucucagcuuaucaagcaccuaguccacccgcccacagcggcuuccauagauaccaguuuuucguguaucugcaggagggcaagguaauuucccugcucccuaaagaaaacaagaccagggggucuuggaaaauggaccgguuuuuaaaucgcuuccaccugggagagccagaggcuucgacacaguuuaugacccaaaacuaccaggauucaccgacucuucaggcccccagagaaagggcgagcgagccuaagcauaaaaaucaggcagaaaucgccgcuugcuga

SEQ ID NO: 60549 - RNA, 2160 nt, Artificial Sequence
  derived and/or modified sequence opt3 from PECAM1__Homo_sapiens__XP_005276938
augcagcccagaugggcccaaggcgcuaccauguggcugggggugcuccuuacacuguuguuaugcagcucccuggagggacaggaaaacucuuucacuaucaauucagucgacaugaagagucuaccugauuggacgguucagaacgguaaaaaucucacccugcaguguuuugcagacgugagcacaacuucccacguaaagccacaacaucagaugcuuuucuacaaagaugacgugcuguuuuauaacauuucuucgaugaagucaaccgagagcuacuucauaccggaagucaggaucuaugauaguggcacauacaaaugcaccgugauuguuaauaacaaggagaagacuacagccgaauaucagguguuggucgagggggugcccuccccucggguaacccucgacaaaaaggaggcgauccagggaggcauuguucgcgugaauuguucugucccagaagagaaagcucccauccacuuuacgauagaaaagcuggagcugaacgagaaaauggugaagcucaagcgagaaaagaauagccgugaucaaaacuucgugaucuuagaguuuccugucgaggaacaggacagaguucuguccuucaggugccaggcccggauuaucucagguauucauaugcagaccagugaaagcacuaagucugagcuugugacaguaacugaguccuuuucaaccccaaaauuccacaucagccccacagggaugauaauggaaggagcacaauugcauauuaaguguaccauccaggugacgcaccuggcccaggaguuuccugaaauuaucauccaaaaagauaaggcuauugucgcacacaaucgccauggcaacaaagccguguacaguguuauggcuaugguggagcacucuggcaauuauacuugcaaggucgaauccagcagaauaucgaaggugucuuccaucguaguuaacauuacagagcuauucucaaaaccagagcucgaaaguagcuuuacccaucuggaccagggggagaggcuuaaucuguccuguucuaucccgggagcgcccccugccaacuucacuauacagaaggaagauacaauugugagccagacccaagacuucacgaaaaucgcaucaaagagugauuccgguaccuacaucugcacagccggcauugacaaagucgugaaaaagagcaacacuguccagaucgugguuugugagauguugucucagccacggauuucauacgacgcucaguuugaagugauaaaagggcaaaccaucgagguacgcugcgagaguauuagcggaacacuccccaucuccuaucagcuguuaaagacuucuaaaguccuggaaaauucgaccaagaacagcaaugauccugccguguucaaagacaacccaacagaggauguugaauaccaguguguggcagacaauugccacucccacgcuaagaugcucucagagguccuucgagugaagguaaucgcccccguggaugagguucagauuaguauacugucuagcaaagucguggaauccggcgaggacaucguguugcaaugcgcggucaacgaagguucagggccgauuaccuauaaguuuuacagagagaaagaaggaaagccuuucuaucagaugacuagcaaugccacgcaggcauuuuggacaaaacagaaggcuucuaaggagcaagagggcgaauacuauuguaccgccuucaacagggcuaaucaugccuccaguguuccccggagcaaaauccuaacugugcgugugauucuggcaccauggaagaaaggccucaucgccguagucauaaucggggugauuaucgcucugcuuauuaucgcggcaaagugcuacuuucugcgcaaagccaaggcuaaacagaugccuguugagaugucuagacccgccgugccauugcucaacuccaauaacgaaaagaugucagaucccaauauggaggcaaacagucacuacggacauaaugacgaugucaggaaccacgccaugaagccuauaaacgacaauaaagaaccacugaacagcgaugugcaguauaccgagguucaagugucguccgcugagucucauaaggacgccguagaaagccgguacucacgaacagaggguaguuuagacggcaccuga

SEQ ID NO: 60550 - RNA, 912 nt, Artificial Sequence
  derived and/or modified sequence opt3 from PECR__Homo_sapiens__NP_060911
auggccagcugggcuaagggcagauccuaccuggcacccgggcuccuucagggacaaguggccaucgucaccgguggcgcgacagggauuggaaaagcuauaguuaaggagcuguuggaauuaggcucuaacgugguaaucgccucaaggaaacuggagcggcuaaagagugcagccgacgaacuccaggcuaaucugccuccaacuaaacaggcacgcgugauuccgauccagugcaacauucgaaaugaggaagaggucaacaaucuugugaagaguacgcuggauaccuucgguaagaucaacuuuuugguuaauaacgggggaggccaauuccucucccccgccgagcacauaucuucgaaaggcuggcaugcugugcuggaaacaaaucugacugggaccuuuuauauguguaaggccgucuacucaagcuggaugaaagagcacggagguaguaucgugaacauuaucguaccuacaaaggcgggcuucccacucgcaguucauuccggggccgcucgugccggaguguauaauuuaaccaaaucucuggcacuugaaugggcuugcagcggcauuagaaucaacugugucgcccccggugugauauacucccagacugcgguggagaauuaugggucauggggacagagcuuuuucgagggcagcuuucagaagauuccugccaagaggaucggcgucccagaagagguuucuuccgugguaugcuucuugcugucacccgcagcuagcuuuauuacagggcaaaguguggacgucgauggaggucggucucuauacacccacuccuaugaagugccugaccaugauaacuggccaaaaggcgccggggaccucagcguugugaagaaaaugaaggagacguucaaagaaaaggcuaaacuguga

SEQ ID NO: 60551 - RNA, 978 nt, Artificial Sequence
  derived and/or modified sequence opt3 from PEG10__Homo_sapiens__NP_001035242
augaccgagagaaggcgggacgaacugagcgaggaaaucaacaaucuccgcgagaaggugaugaaacaguccgaagagaacaauaaccuucaaucucagguccagaagcugacagaggaaaauacuacguugcgagagcagguugaacccaccccugaggaugaggacgaugacauugaauuacguggcgccgcugcagccgcggcuccaccgcccccuauagaggaagagugcccagaagaucugcccgagaaauucgacgggaacccugauaugcuagccccauuuauggcacaaugucagaucuucauggagaagucaacaagagacuuuaguguggauaggguacgggugugcuucgucacuagcaugaugaccggacgcgccgcuagaugggcauccgccaaacucgaaaggucucacuaccugaugcauaauuaucccgcuuuuaugauggagaugaagcacguguucgaagacccucagcggcgcgagguugccaagcgaaaaauuagaaggcuucggcaggguaugggcucggugaucgauuacucaaacgcguuucaaaugauugcacaggaccuggauuggaaugaaccagccuugaucgaccaguaucaugaggggcucagcgaccacauacaggaggaacugagucaucuggaggucgcuaagucccucucugccuuaaucggacaauguauucacaucgaacgucgccuggcaagagcugccgcggccaggaaaccgcggagcccuccccgagcacuuguguugccacacauugcuucccaucaccagguagaucccacagagccuguuggcggugcccgcaugagacugacccaggaagagaaggagaggcggcgcaaacuaaaccucugccuguacugugggacuggaggccauuaugcugacaauugcccagccaaggcaucaaagaguagccccgccggcaacucuccggcuccucuuuga

SEQ ID NO: 60552 - RNA, 4389 nt, Artificial Sequence
  derived and/or modified sequence opt3 from PEG3__Homo_sapiens__NP_001139657
auguaccagcccgaggacgauaacaauagcgacgugaccuccgaugacgauaugacaagaaacaggcgggaaucuucaccuccacacaguguccauagcuucuccgaccgcgauugggaccgacguggcagaucuagggauauggagccgcgggaccgcuggucgcacacuagaaaucccaggucacggaugccuccacgcgaucugagccuccccguuguggccaagacgaguuuugaaauggaccgagaggaugacagagacuccagggcuuaugaaucucggagccaagaugcagaguccuaccagaacguaguggaccuugccgaggaucguaaaccucauaauaccauccaggacaacauggaaaauuaucgcaagcuguugucauuaguccagcuggcggaggaugacgggcacagucauaugacacaaggacacagcucuagauccaaaaggucagcuuacccaagcaccagucggggucuaaagacuaugcccgaagccaaaaagucuacacaccgacgcggcauuugcgaggaugaguccagccauggggugauaauggaaaaguucaucaaagacguuucgagaucuuccaagucaggaagggcacgggagaguagcgaucgcucccagagauuuccuaggaugucugacgauaacuggaaagacauuagccucaauaagcgugaaucagugauccagcagcgggucuaugagggcaacgccuuccgagguggguuuagauucaauaguacccugguguccaggaaacgcguacuugaacggaagagaagguaccacuuugacacugauggaaagggcagcauucaugaccaaaaaggcuguccacgcaagaaaccguucgagugcgggucugagaugcgaaaggcuaugucaguuaguagccuguccucuuugucgagccccuccuuuacagaaucacagccuaucgauuucggagcaaugccauaugugugugacgagugcggucggaguuuuucugucauaagcgaguucguggagcaccagaucaugcacacccgugaaaaccucuacgaguacggcgaguccuuuauucauucaguggccgucagcgaaguucagaaaucucaaguagggggaaagagauucgaguguaaagauugcggcgaaacguucaauaaguccgcugcccuggcggagcacaggaagauccaugcacgcgguuaucugguggaauguaaaaaccaggagugcgaggaagccuuuaugcccaguccuacuuucagcgagcuccagaagauuuacgggaaagacaaguuuuaugaaugucgggugugcaaagagaccuucuuacacucuuccgcucugaucgagcaucaaaagauacacuuuggagaugacaaggauaaugaaagagagcacgaaagggagcgagaacgcgagcggggcgagacauucagaccaucacccgcccuuaacgaauuucagaaaauguacggcaaggagaaaauguaugaauguaaggucugcggggagacuuucuugcauaguagcucgcugaaagaacaccagaagauucauaccaggggaaacccguuugagaauaaggguaaagugugcgaggaaacauucaucccuggccagucccuaaagcgucgccagaaaaccuacaacaaggagaaacucugugacuuuacggaugggcgggacgcauucaugcaaucuagcgaacugucagagcaccagaagauucacaguagaaagaaucuuuuugaaggaaggggcuaugagaaauccguuauccauucuggucccuucacugagagccagaagucccacacaaucacccgaccacuggaaucagaugaggacgaaaaagccuucacuauuagcaguaacccuuacgagaaucaaaagauacccacaaaagagaacguguacgaagcuaagucuuaugagcgguccgucauccauagcuuggcgucgguggaagcccagaaaucacacucuguagcagggccaaguaagcccaagguuauggcugaguccaccauucagagcuuugacgccaucaaucaucagcgcgugagagcuggcggaaacacgucugaaggcagggaguacagccgguccgucauacacucacucguggccaguaaaccuccacgaagccacaaugggaacgagcuggucgaaucuaaugagaagggagaauccucaauuuauaucagugauuuaaacgacaaaagacaaaagaucccggcacgcgagaaucccugcgaagguggcagcaaaaacaggaauuacgaggauuccgugauucagucuguuuuccgugccaagccucagaagucggugccaggggagggaagcggcgaauuuaaaaaggacggugaguucucaguacccuccaguaacguccgggaauaucagaaagcuagagcgaagaaaaaguacaucgagcauaggucuaacgaaaccagcgugauucacucccugccuuuuggggagcaaacauuccgcccacgaggcaugcucuaugagugucaggaaugcggagaguguuuugcacauucaucugaucuuacugaacaccagaagauacaugacagagagaaacccagcggcagucggaauuacgagugguccguuaucaggagccuggccccgaccgauccucaaacaucuuacgcucaggaacaguaugccaaggagcaggcacgcaacaaaugcaaggacuuccgucaauuuuucgccacuucagaagauuugaauaccaaccagaaaauuuacgaccaggagaagucccacggggaagagagucagggagagaauacagauggugaagagacccacagcgaagagacucauggccaagaaacgaucgaggacccagugauccaggggucggauauggaggacccccagaaggacgauccugacgauaaaauuuaugaaugugaggacugcggacuaggcuuugucgaucugacagaccucaccgaucaccagaaggugcauucuagaaaaugucugguagacucccgggaauacacucacagcgugauacacacccauucaaucagugaguaucaaagggauuacacaggugaacagcuuuaugagugccccaaguguggggagucuuucauucacuccagcuuucuguucgaacaucagcgcauccacgagcaagaccaguuguacucaaugaaaggcugcgaugacggauucauugcucuccugccaaugaagccucgaagaaaccgggccgcagaaaggaaucccgcguuagcuggcagugccauccgcugccugcuaugugggcagggauuuauacauagcuccgcacucaacgagcacaugagacugcacagggaggacgaucuuuuggaacagucucaaauggccgaggaagcuaucauuccaggccuggcccucaccgaguuccagcggagccagacugaagaacgucuguuugagugcgcaguuuguggugaauccuucgucaauccggcugagcuugccgaccaugugacagugcacaaaaacgaaccuuacgaguaugggucaucuuacacgcauaccaguuuucugacugaacccuugaagggagcgaucccauucuaugagugcaaggauuguggcaaaucguuuauucacagcacaguccucaccaagcacaaagagcugcauuuagaagaggaagaggaagacgaggccgcugcagccgcugccgcagcggcccaggagguugaagcuaaugugcacgugccccaaguaguccugcgcauccagggucuaaacguggaggccgcagaaccugagguugaggcugccgaaccagagguggaagcagccgagcccgaagucgaggcugcggagccuaauggcgaagccgaggggccggauggagaagcagcugagccaauaggcgaagccgggcagcccaacggagaggccgagcagccuaauggcgacgcugaugaaccagacggugcagggauugaggaucccgaagaacgagccgaagaaccugagggaaaggcggaggagccggaaggcgacgcugaugagcccgacggugugggcaucgaggauccagaagagggggaagaccaagagauucagguugaggagccuuacuaugacugccaugaguguacagaaacuuucaccuccucuacggccuuuucagagcaccucaaaacccaugcaagcaugaucauauucgaacccgccaacgcuuuuggagagugcuccggcuacaucgaaagagcaaguacaucuacugggggagccaaccaggcggaugagaaguauuucaagugugacgugugcggccagcuguucaaugauaggcuuagcuuggcucggcaccaaaacacccacacagguuga

SEQ ID NO: 60553 - RNA, 1257 nt, Artificial Sequence
  derived and/or modified sequence opt3 from PELI1__Homo_sapiens__XP_011531296
auguucagccccgaccaggagaaccacccuuccaaggccccagugaaauacggcgaacugaucguccucggguauaauggaucucuuccgaacggugauagaggcaggcggaagucacgcuuugcucuguucaaacgacccaaggcaaaugggguuaaaccuaguaccgugcauauugccugcacaccacaagcggcuaaggccauaagcaacaaggaccagcacuccaucucuuacacuuugucgcgugcacagacgguaguggucgaguauacccaugauucaaauacagacauguuucagauuggaagaagcacugaaagucccaucgauuucgugguuaccgacacagugccuggcucccaaucuaacagcgauacccaguccguccagucaacuauuaguagguuugccugucggaucauaugcgagcgcaauccacccuucacagcuagaaucuacgcagccgguuuugacagcucuaaaaacauuuucuuaggggaaaaggcugccaaauggaagaccuccgauggacagauggacggccugacgacuaauggcgugcuaguaaugcacccuaggaacggguuuaccgaggauucaaaaccaggaaucuggcgggagauuagcguuugugguaauguguucagucuccgcgaaacacgaucugcgcaacagagaggcaagauggucgagaucgaaacuaaccagcugcaggacgggucccuuauagaucugugcggagcaaccuugcucuggaggacagccgagggccugagccauaccccgacggugaagcaccuggaggcucuccggcaagaaauuaaugccgcacguccccaguguccuguggguuuuaacacuuuagcuuucccaucgaugaaacgcaaggacgucguugacgagaaacagcccuggguguaucugaauugcgggcacguacauggauaccacaacuggggcaacaaggaagagagagauggcaaagacagggaauguccuaugugccggucuguggggccauaugucccccuuugguugggaugugaggccgguuuuuacguggaugcgggcccgccuacacaugccuucucccccugcgggcacguuuguucagagaagaccacugcauacuggagucaaaucccacugccucacggaacacauaccuuccacgcugccugccccuuuugcgcucaucagcuagccggcgaacaggguuauauucgacucaucuuccaggggccacuggacuga

SEQ ID NO: 60554 - RNA, 1263 nt, Artificial Sequence
  derived and/or modified sequence opt3 from PELI2__Homo_sapiens__NP_067078
auguucagccccggccaggaggaacacugcgccccuaacaaggagccagugaaauacggggaacuggucguucucggauauaauggugcacuuccgaacggcgacagagggaggcggaagucccgcuuugcucuguacaaacgacccaaggccaauggagugaaaccuucuaccguacaugugaucucaacaccacaagcgaguaaggcuauuagcuguaagggccagcacuccauaucuuauacuuugucgcguaaccagacggucgugguugaguacacccaugauaaagacacagauauguuccagguggguagaucaacugaaagccccaucgacuuugucgugaccgauacaauuagugggucccaaaauaccgacgaggcccagaucacucagucuacaauuagcagguucgcaugccggaucguaugugaucgcaacgagccuuauaccgccagaauauuugcugcaggauucgacuccucaaagaauaucuuuuuaggcgaaaaagccgcuaaguggaaaaacccagauggccacauggacgggcugacgacuaauggaguucuagugaugcaucccagggguggcuucaccgaggaaagucagccuggggucuggcgggagauuagcgugugcggagauguguacacacuccgcgagacucgaucugcccaacagagaggcaagcuggucgaauccgagaccaacguucuucaggacgguucacugaucgauuuguguggggcgacacuccuguggaggaccgcagacggacuguuucacacgccaacucagaagcacauugaagcccuccggcaagagaucaaugcugcccguccgcagugccccgugggcuuaaacacacuggcauucccuagcauaaaucgcaaagaaguaguggaggagaagcagccaugggcuuaucuuaguuguggccauguccacggguaccauaacuggggacacagaucugacaccgaagccaaugagagggaaugccccaugugucggacuguggguccuuacguuccauuguggcugggcugcgaggcgggguuuuauguggaugccggacccccgacacacgcauucaccccuuguggccaugucugcuccgagaaaagcgcuaaguacuggucgcaaauuccccuaccacacgguacgcaugccuuucacgcugccugcccuuucugugcaacccagcucgugggggaacagaacugcaucaaacugauuuuccagggccccaucgacuga

SEQ ID NO: 60555 - RNA, 2721 nt, Artificial Sequence
  derived and/or modified sequence opt3 from PELP1__Homo_sapiens__NP_001265170
auggagcuggccguggcuguccucagagaccuucugagguacgcagcccaguugcccgcguuauuccgggauaucagcaugaaccaucugccuggccuacucaccucccugcuugggcugcgcccagaaugcgagcaaucugcuuuggaaggaaugaaggccuguaugacauauuuuccgcgagcaugcgguucacucaaaggcaagcuggccaguuucuuucugagccguguugacgcucucucuccccaguuacagcagcuggcaugugagugcuacuccagacuuccuucguugggggccggauucucacaaggccugaaacacacugaaagcugggagcaggagcuacacagucuccuggcuucccuucauacgcuguugggugcccucuaugaaggggcggagaccgcaccagugcagaaugaaggacccggcguagagaugcuguuaucuagcgaggauggcgacgcccacgugcugcuccagcuuaggcaacgguuuuccgggcuggcucgcuguuugggacuaaugcugucaagugaguucggugccccugucagcgugccaguucaggaaauucucgauuuuauaugcagaacacugucuguguccucaaagaacaucagccuucauggcgacgggccccugagguugcuccuguuaccuaguauucaccuggaagcacuagaucuccugucugcucuuaucuuggccuguggaucccggcugcuccgcuucggcauucugaucggucgacuucugccacaggucuugaauagcuggucgauagggagagacucucucuccccgggacaggagaggcccuacucaacugugcggaccaaaguauaugcgauccuggaauuauggguucaagugugcggcgccagugcaggcaugcugcaagggggagcuagcggugaggcccuacucacacaucugcuuuccgauauuucuccuccagcugacgccuugaagcugcguagcccccgcggcucaccugaugggagucuccagaccggaaagccauccgcacccaaaaagcugaaauuagacgucggcgaggccauggcuccgccuagccacagaaagggugauucuaacgcaaauucagacgugugugcagccgcucugagggggcuuagucggacuaucuugaugugcggcccccucauuaaagaagagacacaccgacgccugcaugaccuagugcugccacucgucaugggaguucagcagggcgaagugcuggggagcuccccuuacaccucuucgagauguaggcgggagcuuuauugcuugcuguuagcccuccugcuugcacccagcccacgcugucccccuccacuggccugcgcuuugcaggccuuuucccucggacagagagaagauucacuggagguaaguucuuucugcagcgaggcgcuagugacgugugcggcucugacucacccgagggugcccccucuccaaccaauggguccuaccugccccacaccagcccccgucccgccuccagaagcacccuccccuuuucgugcucccccauuccacccucccggcccaaugccgucaguugggagcaugccuucugccggacccaugccauccgccggccccaugccuagugcagguccagugcccagcgcucggccugggccgccaacuaccgccaaccaucugggccuuucuguccccggauugguguccguaccuccacgacuguuacccggcccugagaaucacagagcggggucaaacgaagacccgauccucgcccccaguggaacaccaccucccaccauaccaccugaugagacguuugguggcaggguuccccgcccagcuuucgugcauuacgacaaggaagaggcaagcgaugucgagauuucgcuggaauccgacucugaugacagcguggucaucgugccggaggggcuuccuccccugccacccccuccacccucaggagccacuccuccgccaauugcucccacaggcccucccaccgccaguccaccuguucccgcaaaggaggaaccagaggaacuaccugcggccccggguccccucccaccucccccaccucccccgccaccugugcccgggccaguaacucugcccccuccgcaguugguccccgagggcacaccaggaggcgggggaccucccgcucuggaagaggauuuaaccgugaucaauaucaacuccucugacgaagaggaggaagaggaagaggaagaggaggaagaggaagaggaagaggaggaagaggaagaggauuucgaggaagaggaagaggacgaagaggaguacuuugaagaggaagaggaagaggaggaagaguucgaagaggaauuugaggaggaagagggcgaacucgaggaggaagaggaagaggaagacgaggaggaagaggaggaacuggaagagguugagcgggaaggugagagcccugccgcagggccacccccucaggaacuuguggaggaggaaccauccgcucccccgacgcuguuggaggaagagaccgaagauggaucagacaaaguccagccuccacccgagacuccugccgaggaagagauggaaacagagaccgaagcagaggcccuccaagagaaggaacaggaugacacagcugcgaugcuggccgauuucauugacuguccacccgaugacgagaaaccgccucccccaacugaaccugauagcuga

SEQ ID NO: 60556 - RNA, 645 nt, Artificial Sequence
  derived and/or modified sequence opt3 from PEMT__Homo_sapiens__NP_001254480
augaagagaagcggcaaccccggggccgaggcugacuucugcgugaugaccaggcugcucggauacgucgauccucuugacccauccuuuguugcagccgugaucacaauuacuuucaauccgcuguauuggaacguaguggcgcggugggaacacaaaacgcgcaaguugucucgagcuuuugguucacccuacuuagccuguuauagucugagcgucaccauacuacuccugaauuuccuucguucccauugcuuuacacaggcaaugcugucucaaccuagaauggagucguuggauacuccagccgcuuacucacucggccuggcacugcucggguuaggagugguucuggugcuuagcaguuucuuugccuugggcuucgcugguaccuuucugggggacuauuucggaauccuaaaagaagccagggucacaguguuucccuucaacauucucgauaauccuauguacuggggcuccaccgcgaacuaucugggcugggcaaucaugcacgccucuccaacugggcuucuguugacaguacucguugcucugaccuacauuguggccuuacuguacgaggaacccuuuacggcagagaucuaucggcagaaggcuagcggaucccauaaacgcucauga

SEQ ID NO: 60557 - RNA, 804 nt, Artificial Sequence
  derived and/or modified sequence opt3 from PENK__Homo_sapiens__NP_001129162
auggccagauuccugacccucugcacauggcuucuguuguuaggccccgggcugcuagcuacugugagggcagaguguagccaggacugcgccacguguuccuaccggcucguccgcccugcggauaucaacuuucuggcuugcguuauggaaugugagggaaaacuuccaucucugaagauuugggaaaccugcaaggaguugcuccaacugucaaaaccggaacugccccaggacgguacaaguacucuccgagagaauagcaagccugaggaaucccacuuacuggccaaacguuauggcggguucaugaagagauacggaggcuuuaugaagaaaauggaugagcuuuauccaauggaacccgaggaggaagcaaacgguucugagauauuggccaagagguacgggggauucaugaaaaaggacgcugaagaggaugacucgcuggcaaauucaagcgaucuacucaaagaacugcuugagaccggcgacaaccgggagcgcagucaucaccaggauggcuccgacaaugaagaggaagugucuaagagauaugggggauuuaugaggggucugaagcggagcccucaguuggaggaugaagccaaagagcuccaaaagcgcuacggcggguucaugcgaagaguaggaaggccagagugguggauggacuaucagaaacgguacggcgguuuucugaagcguuucgcugaagccuuacccuccgaugaggaaggggagucauacaguaaagaagugccugagauggagaagcgcuauggaggcuuuaugagauucuga

SEQ ID NO: 60558 - RNA, 1482 nt, Artificial Sequence
  derived and/or modified sequence opt3 from PEPD__Homo_sapiens__NP_000276
auggccgcugcaaccggccccagcuucuggcuggggaacgagacacucaaggugccucuugcccuguuugcguugaauagacagagguuaugcgaacggcugcgcaaaaacccagcuguccaagccggauccaucguugugcuacaggguggcgaggaaacucagcgauacuguacggacaccgggguacucuuccgucaggagucauuuuuccacugggcauuuggagugacagaaccgggcugcuauggugucauugauguggacacugggaagucuacccuguucguucccagacuuccugccagucaugcuacauggaugggaaaaauacacagcaaggagcauuuuaaagagaaguacgcaguggaugacguccaauauguggaugaaaucgccuccguacugaccucucagaagccaucgguuuugcucacucugaggggcgugaauacagacucaggcagcgucugucgggaggcuaguuucgaugggauuuccaaauuugaagugaacaauaccauccugcaccccgagauuguggagugccgcgucuucaagacggacauggaacucgagguuuuaagauacacuaacaaaaucucuagcgaagcccauagggaggugaugaaggcgguaaaagugggaaugaaggaauaugagcuggagucccuuuuugaacacuacuguuauucacgggguggcaugcgccacaguagcuauaccugcauaugugggucuggagaaaauuccgcagucuugcauuacggccacgccggugcuccuaacgaucgaacaauccagaauggggacaugugccuguucgauaugggaggcgaauacuacuguuuugccucagacauuacuugcagcuucccagcaaacggcaaguucaccgcugaucagaaagccguguaugaggcgguucuaagaaguucuagggccgugaugggggcaaugaagcccggagucugguggccugacaugcaucggcucgcugaccguauccaccuggaggagcuugcccacauggguauucuguccggcagcguggaugcuaugguacaagcccauuugggggcaguuuuuaugccacacggacucggccauuuccuggguaucgacgugcacgaugucgggggcuacccggagggaguggaacgcauagacgagcccggcuuaagaucgcugaggacagcccggcaucuccagccugggaugguccuuaccguggaaccaggaauuuauuuuaucgaucaccuguuggacgaggcucuagcggaucccgcacgagccucuuuccugaaucgcgaaguucuccagagauuuagggguuucggcggggugcggauugaggaggacguagucgugacggauuccggaaucgaacugcuuacuuguguuccucgcacaguggaggaaaucgaggcuugcauggccggcugcgacaaagcauuuaccccauucucaggucccaaguga

SEQ ID NO: 60559 - RNA, 3873 nt, Artificial Sequence
  derived and/or modified sequence opt3 from PER1__Homo_sapiens__NP_002607
augagcggcccccuggagggggccgacggagguggcgauccuagaccaggggaauccuucugcccgggaggcgugcccucuccugguccaccccagcacaggccuuguccagggcccucacucgcugacgauaccgacgcaaacaguaauggaagcuccggcaacgagucuaauggccaugaaucgcggggcgccucacaacgcagcagucacuccucuagcuccggaaacgguaaggauucagcgcuucuggagacaacugaaaguagcaaaucuacaaauucccagucaccuagcccaccgaguucuuccaucgcuuacagcuuguuaucggccucuuccgagcaggacaaccccucaaccaguggcugcagcuccgagcagucugcacgagcccguacacaaaaggaacugaugacugcucuaagagagcucaaacugaggcuuccuccagaacggcgcgggaagggaagaagcggcacccuggcaacauugcaguaugcccucgcuugugucaaacagguucaggccaaucaagaguacuaucagcaguggucacuggaggaaggugagcccugcaguauggauauguccaccuacacucuggaggaacucgaacauauuacaagcgaguauaccuuacagaaccaagacacguuuucuguggcgguaucauuccugacugggaggauaguguacaucagugagcaggcagccguccuuuugcgguguaagcgcgauguguuucgaggaaccagauucagcgaacugcuagcuccucaggacguuggcguguuuuauggcuccacagccccaucuaggcuccccacuugggggaccggagcaucggcugguagcggccugcgggauuucacacaagagaaguccgucuuuugccguauucgcgggggaccggacagagauccuggccccagguaccagccauuccggcuuaccccuuacgugacgaaaauccgaguaucagacggugcccccgcgcagccauguugccuguugauugccgaacgcauccacaguggguaugaggcacccagaauaccuccagacaagaggaucuuuacuacacggcauaccccgucuugucucuuccaggauguugacgaacgcgcugccccacuguuaggcuaccugccucaagaucuccuuggagcuccagugcuguuguuucuacaccccgaggacagaccucugaugcucgccauucacaaaaagauccugcagcuugcaggccagccauucgaucauagccccauuagguuuugcgcccguaauggggaguaugucacuauggacacauccugggcuggauucgugcacccguggucacggaaaguggcguucguccugggucgacauaagguuagaaccgcaccuuugaacgaagauguguuuacgccacccgccccuagccccgcuccaucucucgacaccgauauccaggagcuguccgaacaaauacacagguuacugcuacagccuguacacagucccagcccaacaggccucuguggggugggagccgucacuucuccgggcccucugcauucccccgguucaaguagcgacucgaaugggggcgaugcagagggaccagggcccccugccccagugaccuuccagcagauuugcaaggacguucaccuugugaaacaucaagggcagcaguuguuuaucgaaucccgcgcucggccccagucuagaccuaggcugccggccacaggaacuuucaaggcaaaagcgcucccaugccaaagccccgacccugagcuggaggcugguucagccccaguccaggcaccccuugcccuggugccugaagaggcugaacgcaaggaggccaguuccuguucuuaccagcaaauuaacugcuuggauagcauccuccgauaucuggaguccuguaauuuaccgucaaccacaaaacggaagugcgcaagcaguucuuccuacaccacuagcucggcuucagacgaugaccgucagagaacgggccccguaucuguugggacgaaaaaggauccaccuagugccgcgcuguccggagaaggcgccacccccaggaaggagccaguggucggugggacucuaagcccucucgcucuggcaaacaaagccgaaucuguggucagcgugaccucccaguguucauuuaguagcacaaucguucacgugggcgacaagaaacccccagagucugauauuauaaugauggaagaccuuccgggauuggcuccuggccccgccccaucccccgcaccuucaccaaccguagcgcccgauccugccccggacgcuuaucgcccagucgggcugacuaaggccgugcucagucugcauacacagaaagaggagcaagcauucuuaagccgguuuagagaucugggaaggcuucgaggcuuggacuccucuucgacggcucccagcgcccucggugaacgcgggugccaccacggaccugcacccccaucacggagacaucacuguagguccaaggccaagcguagucgccaucaccagaauccucgggcugaggcgcccugcuacguuucucacccaagcccugugccgcccuccaccccauggccuacucccccagccacaaccccuuuccccgcagucgugcagccguacccacugccuguauuuucacccagaggcgguccacagccccuaccuccggcucccacaucugugcccccugccgccuuccccgcuccucugguuacuccaauggucgcacucgugcugcccaacuaucuuuuuccuaccccaagcaguuaccccuauggcgccuugcaaacgccggcggaagggccuccaacccccgcuucccauagcccuucuccaucacugcccgccuuagcaccguccccuccccacaggccagauaguccucucuucaacagccgauguucgucuccccugcagcuuaaucuguugcagcucgaggaacugccacgggccgagggagcugcaguggccggcgggcccggauccagcgcgggcccuccaccgcccucagcugaggccgcagaaccugaggcccgccuagcugaagucacagagaguucuaaccaggacgcccuguccgguagcucagaccuccuggaacuuuugcugcaagaggauaguagaagcgggacuggauccgcagcuucuggcagcuuagguuccggccucgggucaggaucuggcagugggucgcaugagggaggcagcaccuccgccucuaucacaaggucaagccaguccagucacacuucuaaauacuuugguagcauugacucauccgaagcggaggccggggcagcucggggaggcgccgaaccaggugaucagguuaucaaguaugugcugcaagaccccauauggcuucugauggcuaaugcagaucagcgagugaugaugaccuaccagguaccuaguagagacaugacgagcguccuaaaacaggaucgcgagaggcuccgugccaugcaaaagcagcagccacgguucucugaggaccagagaagggaacugggcgccgugcauuccuggguucgcaaagggcaauugccccgagcucuggaugugauggcgugcgucgacuguggaucaagcacacaggauccuggccacccggacgauccauuauucucggagcucgacgggcugggacuugaacccauggaggaaggcgguggggagcagggaucuaguggcggcggguccggagagggugaaggcugcgaggaagcacaagggggagccaaggcuagcucaucccaggaccuggccauggaggaagaggaggaaggcagaucuagcaguuccccugcauugcccaccgccgguaacugcacuagcuga

SEQ ID NO: 60560 - RNA, 3768 nt, Artificial Sequence
  derived and/or modified sequence opt3 from PER2__Homo_sapiens__NP_073728
augaacggcuacgccgaguucccaccuagcccauccaauccgaccaaggaacccguggagccucagccaucucaagucccccugcaggaagacguugauaugucaagugggagcuccggacacgagacaaacgaaaauugcucuacugguagagacucgcagggcucagauugugacgauagcgggaaagagcucggaaugcuuguggagccuccagacgcuaggcagagucccgauacguuuucccugaugauggcaaagucugaacauaacccuagcaccuccggcugcucaagugaccaaagcucuaaaguagauacacacaaggaguugaucaaaacuuuaaaggaacugaaggugcaucuaccagccgacaaaaaggcgaaagguaaggcuuccacccucgccacacugaaauaugcacuucggucagucaaacaggugaaggccaaugaggaguacuaucagcuguugaugagcagugaagggcacccguguggagcugauguucccucuuacaccguggaggaaauggaguccgucacuagcgaacauauugugaagaacgcagacauguucgccguagcuguuucgcucgugucuggcaagauacuguauaucuccgaucaggucgccucaauuuuucacugcaaacgcgacgcguucagugacgcaaaguuuguggaguuccuggccccucacgaugugggcgucuuucauagcuucacauccccauacaaacuccccuuauggucuauguguagcggggcugacucauuuacccaagagugcauggaagagaagaguuucuuuugucgaguuuccgugcguaaaagccacgaaaaugagaucagauaucauccuuucaggaugacgccauaccugguaaaggugcgggaucagcagggagccgaaucucagcuuugcuguuugcugcuagcagagcgcguccacucagguuacgaggcucccaggauuccgccugaaaagagaaucuuuacuaccacacacacucccaacugccucuuccaagacguggaugagcgggccguuccacugcuuggcuaucugccucaggacuugauagaaacccccgugcucguccagcugcauccaagugaucgccccuuaaugcuggcgauccacaaaaagauucuccaaagcgggggacagccuuucgacuacuccccaauccgauuuagagccaggaauggcgaguauauuacacuugauaccucuuggucgagcuucaucaacccguggucccggaaaauaucauuuauuaucggucgucauaaggugcgcguagggccccugaaugaagacguuuucgcagcucacccuuguacggaggagaaagccuugcauccaaguauucaggaacuaacugagcagauccacagacugcuccugcaacccgugccucacucuggaagcuccggcuacggcucacuugggagcaacggaucucaugaacaccugaugucccagacaaguagcucugauuccaauggucaugaggacucaaggcggcgacgcgcugagaucugcaagaacggcaauaagaccaaaaacagaagucacuauagccacgaaucgggggagcagaagaaaaaguccgucacugaaaugcagacaaacccacccgccgagaaaaaggcagugccggccauggaaaaggacucuuugggagucagcuuuccugaggagcucgcuugcaaaaaucaaccaaccuguucauaccagcagauuaguugccuggauuccgugauaagguauuuagaaucuuguaacgaggcggcaacgcugaagcggaaaugcgaguuccccgccaauguuccugcucuacgcagcuccgacaagagaaaagccaccgugucacccggcccacaugcuggugaagccgaaccucccagcaggguaaacagucguacaggggucggcacucaccucaccucucuggcacuuccaggaaaggccgaguccguggcaagccuuacaucgcaguguucauacucuaguacuaucguucaugugggcgauaagaaaccgcaaccugagcuggaaauggucgaggacgcggcuuccgggcccgaaagccucgauugccuggccggaccagcacuugccuguggucugucucaggagaaggaacccuuuaaaaaguugggccucaccaaagaggugcuggcugcccacacacagaaggaggaacagagcuucuuacaaaaauuuaaggagauucggaagcuguccaucuuccagucacauugccacuacuaucuacaggaacgaaguaaagggcaaccuagcgagagaaccgcaccaggacucaggaauacuucuggcauagacucccccuggaagaaaacggguaagaaccgcaaacugaagucaaagcggguaaaaccuagagauaguagcgaguccacagggucuggcggaccggugucggcuaggccaccccuuguuggcuugaaugccaccgcguggagcccuucagacacuucccagaguucuuguccagccguccccuuuccugcuccggugcccgcagccuacagccugccaguguucccugcucccgggaccgucgccgcacccccugcgcccccacacgccuccuuuacaguuccggcugugccuguggaucuccagcaucaguucgccguacaacccccacccuucccugcaccacuggcucccgucauggccuuuauguuaccuucauauucuuucccgagcggaaccccaaaccugccccaggcauuuuucccuagucagccccaguuuccaucccacccuacucuuacaagcgaaauggccucugcuucacaacccgaguucccaucccgcacgaguauuccucgacagccgugcgcgugucccgccacccgggcaacuccaccuagcgcuaugggucgugccucgcccccauuguuucagucuagauccagcucaccucuccagcugaaucuacugcaacucgaagaggcccccgaaggcgggacaggagcuaugggcaccacaggugcaacugagaccgccgcggugggggcugacugcaagccgggcacgaguagggaucagcagccaaaagccccucugacccgcgacgagcccucugauacacaaaacuccgacgcacuuagcacuucaaguggauugcugaauuuacuccugaacgaagaccuuugcagcgccuccggcucugcugcaagcgagucccuggggucaggaucuuugggcugugaugccaguccaucgggugcggggagcuccgacaccucucauacaucaaaguacuucggaagcaucgauuccagugaaaauaaccacaaagcuaagaugaauacuggcauggaggaaucugagcauuuuaucaagugcguucuccaggaccccauuuggcugcuaauggccgaugcagacagcucagugaugaugaccuaucagcugccuucccggaaccucgaggccguccugaaagaagauagagagaaguugaaauugcugcagaaguuacaaccgagguucacggaaagucagaaacaggagcuccgagaagugcaccaguggaugcaaacagguggccugcccgcugccaucgacguugcagaguguguguacugcgagaacaaggaaaaggggaauauuuguauaccauaugaggaagauaucccuagccuuggacugucugagguauccgacaccaaagaggaugaaaacggcucaccccuaaaucaccgcauugaggaacagacuuga

SEQ ID NO: 60561 - RNA, 3576 nt, Artificial Sequence
  derived and/or modified sequence opt3 from PER3__Homo_sapiens__NP_001276790
augcccagaggcgaggccccugggccaggaaggcggggugcuaaggacgaagcacugggcgaggaaagcggggagcgcugguccccggaguuccaccuccagcgaaaacuugccgauucuucacauagugaacaacaggaccguaacagagugagcgaggaacugaucauggucguucaggagaugaagaaauacuuucccuccgaaaggcggaauaagccuucuaccuuggaugcguuaaacuaugcucugcgcugcgugcacucgguacaggccaauucagaguucuuucaaauucuaagccagaacggagcaccacaggccgacgugaguauguacucccucgaggaacuggcuacaauagcaucugagcauacuagcaaaaauacggauaccuucgucgccguguuuuccuuccuuucaggcagacugguucacaucagugaacaggcugccuugauucucaacaggaagaaggacgugcuggcgagcucucauuuugucgaucugcucgcaccccaagacaugcggguguucuaugcccacacagcucgcgcccaguuaccuuuuuggaauaacuggacucagcgagcagcugccagauacgagugugcgccaguaaaacccuucuuuugcaggauccgggguggggaagaucguaagcaggagaaaugucacuccccuuuccgcauuaucccauaucugauacauguucaccauccggcccaacccgagcuugaaucagagccuugcuguuugaccguggucgaaaagauccacagcggauacgaggcaccaagaauacccgugaauaaaaggaucuuuacaaccacucacacaccuggcugcguguuccuggaagucgacgagaaggcuguuccacuacucggcuaucugccccaggaucuuauugggaccaguauccugucuuacuugcauccggaggaccggucccucaugguggccauacaccagaagguacugaaauacgcuggacauccucccuucgaacacagcccaauucgauuuuguacgcaaaacggugauuauaucauuuuagacucgucuugguccucauucgugaauccuuggagucgcaagaucagcuuuaucauuggcagacauaaagucaggacuagcccccugaacgaggacguguucgccaccaagauuaaaaagaugaaugauaacgacaaagauaucacagaacuccaggagcagauuuacaagcuccuguugcagccaguucacgugucugucagcucaggguauggaagucuaggcuccagcgguucucaagaacagcuggugucaaucgcaaguagcuccgaggccucugggcaccggguagaggaaacuaaggcugagcagaugacccuccagcaaguuuacgcgucggugaauaaaauaaagaaccugggacagcagcuuuauauugaaagcaugacaaaauccucauuuaagcccgucaccggcacgcgcacugagccuaacggcgggggagagagugcaaaugguggcggggaaugcaaaacauucaccucuuuucaucagacucugaagaacaauagcguguacacagagccaugugaagacuugagaaacgaugagcacuccccgucauaucaacagaucaauugcaucgacagcgucauuagguaccucaagucuuacaacauccccgcccugaaacguaaguguauuuccugcaccaauacgaccaguuccucuuccgaagaggauaaacagaaccauaaggcugacgaugugcaggccuuacaagcaggacugcagauaccugccaucccaaaaucagagaugcccacaaauggccggaguauugacacuggugggggcgcuccucagauccuaagcaccgccaugcucucgcugggauccggcaucucucaaugcggguauagcucaacaauuguucacgugccacccccggaaacugcacgagaugcgacccuuuucugugagccuuggacauugaacaugcagccagcuccccugaccagugaagaguuuaagcacguaggacucacugccgcaguccuguccgcccauacgcagaaggaggaacagaauuacguggacaaauucagagagaagauacuuucuagcccuuauuccucauaccugcaacaggaaagcaggaguaaagcuaaguauucuuacuuucagggugacuccacaagcaaacagacccgcucggccggcugccggaaggggaagcacaaaagaaagaaauugcccgagccaccugauucaucuaguuccaacacuggaagcggccccaggcgcggugcacaucaaaaugcucagccauguugcccgucugccgcgagcuccccucacaccucaagucccacauucccacccgccgcuaugguuccuagccaggcaccauaucucgugcccgccuuuccucugccggcugccaccucuccagggcgagaauacgcagcgcccggcacugccccugagggauuacauggccugccacuauccgaagggcuccagcccuacccugcuuucccguuccccuaucuggacacauuuaugacggucuuccuuccagauccucccguguguccauugcugucaccuaguuuucuccccugcccauuccugggagccaccgcaagcuccgcuaucucuccgucgaugagcucagccauguccccuacuuuagaucccccacccaguguaacaucucaacggcgugaggaggaaaagugggaggcacagagcgaaggucacccuuuuauuaccuccagaucaucuagcccacugcagcuuaacuugcuccaagaggagaugcccaggccuagugaauccccggaccagaugcgccggaauacauguccacagacugaguacugcgugaccggcaacaacgggagcgaaucuucacccgccacgaccggagcucuguccacaggcaguccucccagagagaauccaagccacccuacugcgucggcccuaucuaccgguuccccacccaugaaaaacccuagccauccgacagcaucaacucugaguauggggcuucccccaucuaggaccccuucccaccccacggcuacaguucugagcaccggcucaccaccuagugaaagccccucccgaacuggaucugccgccagcggcuccucagacucuaguaucuaucuuacaucgagcgucuacuccucuaagauuucacagaaugggcaacagagccaggaugugcagaaaaaggagaccuucccgaacguggcugaggaaccaaucuggcgcaugauacggcaaacuccugagagaaucuugaugaccuaucagguccccgaaaggguuaaggagguggugcugaaagaagacuuagagaagcucgaguccaugcgucagcagcaaccacaguuuagucauggacagaaagaggaacuggcaaagguauacaauuggauucagucucaaacagucacgcaggaaaucgauauucaggccugugugaccugcgagaacgaagacagcgcggauggcgcugccacuucauguggucaaguucuuguggaggacuccugcuga

SEQ ID NO: 60562 - RNA, 2091 nt, Artificial Sequence
  derived and/or modified sequence opt3 from PERM1__Homo_sapiens__NP_001278296
augcccacccaggacggccaacugagaaggccugcccggccaccggggccccgcgcuuggauggagccucgaggagguggcagcucccaguucucuucaugcccagggcccgcaaguagcggagaucagaugcagcgucuccuucaaggcccugccccaagacccccuggugaaccaccggggucccccaagucuccuggacacucgacaggcucacagaggccacccgacagcccuggcgcgccaccccggaguccgucccgcaaaaagagaagggcugugggggccaaaggagguggccauacuggggcaucugccagcgcucagacgggauccccucuguugcccgcagccucaccagagaccgcuaaguuaauggccaaagcgggccaggaggaacuggguccugggcccgcaggagccccagaacccggcccucggaguccaguccaagaggaucgcccgggccccgggcuaggacucagcacaccuguuccagugacugagcaggguaccgaccagauccgaacacccagaagggcuaagcugcacaccguaucuacuacagugugggaagcccuuccugaugucucccgggcaaagucagacauggcugugagcaccccagccagugagccccagccggaucgugacauggcgguuucuacgccugccuccgaaccacaaagcgaucgcgacauggcagugucgacucccgcuucugagccucagcccgauaccgacauggccgucuccacaccagcuucagagccucagcccgauagagacauggccgugaguauuccagcaagcaaaccgcaauccgacacugccguaucuaccccugcuagcgaaccccagucaaguguugcgcuguccacaccaauaagcaagccccaguuggauaccgacguggcagucucuacgccugccucaaaacauggccucgauguggcucugccaacugccgggcccguggcaaagcuggaggucgccaguagcccuccgguuuccgaagcugugccaaggaugacagagucuucgggacucguaagcacccccgugccucgggccgacgcagcgggcuuagcuuggccacccacucgacgcgccgguccugaugucguggaaauggaggcaguuguguccgagccgucagccggggcucccggcuguugcaguggagccccagcacugggccuuacacaggucccuaggaaaaagaaggugagauuuucuguagcugggcccagcccaaacaaaccuggauccggucaagccucagcgcggcccagcgccccacagaccgcuacgggcgcacacgggggaccgggcgccugggaagcuguugccguggguccucgcccccaucagccaagaaucuugaagcaucugcccaggccuccacccucugcagucacccguguggggccuggcuccaguuucgcggucacacuaccggaggccuacgaauuuuucuuuugugacacuauugaggaaaaugaggaggcugaagccgcagcugccggacaggauccagcaggcgugcaauggcccgacaugugcgaguucuuuuucccugauguuggggcccagcggagccgaagaaggggaucucccgaaccacucccucgcgcugaccccgugccagcgccuaucccgggugaucccguaccaauuuccaucccugaggucuaugaacacuuuuucuuuggcgaggaccggcuggagggggugcuuggacccgccguuccacugccuuugcaggcacucgaacccccgagaucagcuagugagggcgccgguccagggaccccucugaaacccgccguggucgaaagguuacaccuggcucuccgccgagcaggcgagcuucggggaccagugcccagcuucgccuuuucgcagaacgacaugugucugguauucguggcguucgcuacaugggccguucguacuuccgauccucacaccccggacgcauggaagacagccuugcuagcuaaugucggcaccauaucugcaaucagauacuuuaggcgccaaguggggcagggacggagaagccauucacccaguccauccucuuga

SEQ ID NO: 60563 - RNA, 582 nt, Artificial Sequence
  derived and/or modified sequence opt3 from PERP__Homo_sapiens__NP_071404
augaucagaugcggccuggccugugagaggugccgguggauucucccccuucuguuguuaagcgcuauagcauucgacaucauugcccuggcggggcgcggauggcuacaguccucugaucacggucaaacuucaagucucugguggaaguguagccaggaaggcgggggauccggcucuuacgaggaagguugccagucgcugauggaguaugcuugggggcgagccgcagccgcuaugcuguuuuguggauucaucauucuugugaucugcuuuauauugucauucuuugcacucuguggcccucagaugcuggucuuccugcguguuaucggcgggcucuuagcccuggcugccguguuucaaauuaucagccuuguaauuuacccagugaaauauacacagacuuucacguugcaugcgaacccggcagucaccuacaucuauaauugggccuacggauuugguugggcugccacaauaauucugaucggcugcgcauucuuuuucuguugccuacccaacuaugaagacgaucuccuggggaaugcuaagccuagauacuuuuacaccagugccuga

SEQ ID NO: 60564 - RNA, 1752 nt, Artificial Sequence
  derived and/or modified sequence opt3 from PES1__Homo_sapiens__NP_001230154
augggcgggcuggagaagaaaaaguacgaaagaggaagcgccaccaacuauaucacaaggaauaaagcucggaagaaacuccagcuuucccuggcagacuuccgccgauugugcauuuuaaaggguauauacccccacgagccuaagcauaaaaagaaagugaacaagggcucuacugccgcgcguacguuuuaucugaucaaagauauuagauuccuacuccacgaaccaaucgucaauaaguuuagggaguacaagguuuucgugcggaaacugcgcaaggcuuaugggaaaucagaauggaacaccguagagagacuuaaggacaauaaaccgaacuacaagcuggaucauauuaucaaagagagguaucccacauuuauagacgccuugcgggaucucgacgaugcacugaguauguguuuccuguuuagcacuuucccucgcaccggaaagugccacgugcaaacaauccagcucugucgaagauuaaccgucgaauuuaugcauuacauuaucgccgcuagggcacugcggaagguguuccuuuccauuaaaggcaucuacuaucaggccgagguuuugggucagccaauaguguggauuacucccuacgcuuuuucucacgaccacccuacagaugucgacuaucgugugauggccaccuucacggaauuuuacacuacccugcuaggguucguaaauuuccgccucuaucaacugcuuaaccugcauuacccacccaaguuggagggacaggcgcaggcagaggccaaagcuggcgaaggcacauaugcccucgauucggagucaugcauggaaaagcuggcagcuuuaagcgccagucuggcgagaguuguggucccugccacugaggaagaggcagagguggacgaauuuccaaccgauggggaggaagacaggcggaaagagcucgaagcucaggagaagcacaagaaacuuuucgagggacugaaguuuuucuugaaucgagaagugccgcgcgaggcccuagcuuuuaucauuagauccuucgguggcgaagucucuugggacaaaagccuguguaucggggccacauacgauguuaccgacuccaggaucacgcaucaaauuguggaucggcccggacagcagacuucaguaauaggccgcugcuacgugcagccucaaugggucuuugacagugugaacgcaagacuccugcuuccaguugccgaguauuucagcggugugcagcugcccccucacuugucuccauuugucacagaaaaggagggggauuacgugcccccggagaaacucaagcuguuagcucugcagaggggagaagacccuggcaaucuaaacgaguccgaagaggaggaagaggaagaugacaauaacgagggcgauggggacgaagagggagagaaugaagaggaagaggaagaugcggaggcagguucagagaaggaagaggaagcccgucucgcugcccuggaggaacaacggauggagggcaaaaagccccgaguaauggcagggacccuuaaauuggaggacaagcagagacuggcccaggaagaggaaagcgaggcuaaaaggcucgccaucaugaugaugaagaagcgcgagaaauaucuguaccagaagauuauguucggaaaacggagaaagaucagggaagcaaacaaacuugcggagaagcgcaaagcucacgacgaagccguucgaagugagaagaaggccaaaaaggcacggccagaauga

SEQ ID NO: 60565 - RNA, 222 nt, Artificial Sequence
  derived and/or modified sequence opt3 from PET100__Homo_sapiens__NP_001164626
augggcgugaagcuggagaucuucagaaugauuauauaccucaccuuucccgucgccauguucuggguuagcaaccaggcugaaugguuugaggacgaugugauccagaggaaacgggaacuuuggccuccagagaagcugcaggaaauugaggaguucaaagaacgcuugcgaaagcguagagaggaaaaauuacugagggacgcacagcaaaauuccuga

SEQ ID NO: 60566 - RNA, 246 nt, Artificial Sequence
  derived and/or modified sequence opt3 from PET117__Homo_sapiens__NP_001158283
augagcagauccucuaaggugguccugggccucucaguucuucugaccgccgcuacaguggcagggguacacgugaaacagcagugggaccagcagagguugcgggauggagucauccgcgacauugagcgacagauacguaagaaagaaaacaucagauuacugggugagcaaauuauccuaacugaacagcucgaggccgaaagggagaagaugcugcuugcgaaaggcagucaaaagagcuga

SEQ ID NO: 60567 - RNA, 744 nt, Artificial Sequence
  derived and/or modified sequence opt3 from PEX11A__Homo_sapiens__NP_003838
auggacgccuucaccagauuuacaaaccagacucaaggcagggaucggcuguuccgcgcuacgcaguauaccugcaugcuccuucgauaccuguuggagcccaaggcagggaaagaaaagguggucaugaaauuaaagaaacuggagagcuccguuucuacaggacguaagugguuuagacuagguaaugugguacacgccauccaggcgacugaacagucaauucaugcuaccgaccucgugccuaggcugugucuuacacuggccaacuugaaucgggucauauacuucaucugcgauaccauucucugggugcgcaguguuggccugacuagcgggaucaacaaggagaaauggagaacaagggcagcccaccauuauuacuauucccugcucuuaucucuggugcgggaccuuuacgaaauuucguugcaaaugaagcgcgucaccugugaucgagcuaaaaaggagaaaucagcaagccaggacccacugugguuuaguguggccgaggaagagacggaauggcuacaguccuuccuccugcuucuguuuagaucuuugaagcagcacccgccccuccuguuagauacuguaaagaaucugugcgacauccucaacccucuugaucaacugggaauauauaaaagcaauccaggcaucauuggucuagggggauugguuuccucaaucgcuggcaugauuaccguggccuacccccagaugaagcugaaaacaagguga

SEQ ID NO: 60568 - RNA, 1080 nt, Artificial Sequence
  derived and/or modified sequence opt3 from PEX12__Homo_sapiens__NP_000277
auggccgagcacggcgcucauuucaccgcagccagcguggcggacgaucagcccuccaucuuugaagucguugcucaagacucucugaugacagccgugagaccugcacuccagcacguagugaagguccuugccgagucaaacccaacucauuacggguuccuguggaggugguuugaugaaauuuucacguuguuagaccugcuacuccagcagcacuaucugagucggaccagcgcuuccuuuucugagaauuucuacggacuuaaacgcauagugaugggugauacacauaagucgcaacgacuggcaucagccggcuugccgaaacagcagcucuggaaaagcaucauguuucugguucugcuccccuauuuaaaggugaagcuggaaaaacuugucaguuccuugcgugaggaggacgaauacucuauucacccuccaagcuccagauggaagagguucuaucgggcuuuucuggccgcguaccccuucgugaacauggcaugggaggggugguuucuaguacagcaacuccgcuauauccugggaaaggcccagcaccauucaccucuucugagauuggcuggcguucagcucgguaggcugacugugcaggauauucaagccuuagaacacaaaccagcaaaggcuaguaugaugcagcagcccgcccggagcgucucugagaaaaucaauuccgcgcugaagaaggccgucgggggaguggcacucucacuuagcaccggccugagugugggcguuuucuuuuugcaauuccuagacuggugguacucuuccgagaaccaggaaacaauaaaaagccugaccgcucucccuacuccaccgcccccugugcaucuggauuacaauucggacucuccacuucugcccaagaugaaaacaguaugcccuuugugucgcaagacccgagugaacgauacgguccucgccacuuccggguauguguucugcuacagauguguuuuucacuaugugaggucacaccaggcuugcccaaucaccggauaccccacagagguccagcaucugauuaaauuauauaguccggaaaauuga

SEQ ID NO: 60569 - RNA, 1212 nt, Artificial Sequence
  derived and/or modified sequence opt3 from PEX13__Homo_sapiens__NP_002609
auggccagccagcccccuccaccgcccaagccuugggagaccagaaggaucccaggcgcugggcccggaccugguccaggccccacauuccaauccgcagaccuggggccuacucucaugacgcggccaggacagccggcccuuacccgcgugcccccuccaauucugccccgaccuucucagcagacaggcucaaguagcgucaacacuuuucguccagcguacuccucuuucucgucagguuauggggcuuacggaaauagcuuuuauggcggcuacagucccuauuccuacggguauaacggauuggguuacaauagauuaaggguugaugaccugccgccuucucgguucgugcaacaggccgaagagagcucccgcggcgcauuucagucaauagaaaguaucguacacgccuucgcuagcgugucuaugaugauggaugcaaccuuuuccgccgucuacaacucauucagagcugugcuagacguugccaaucauuuuagcaggcucaaaauucacuucacaaagguguuuagugcguucgcacugguccggaccauccgcuaucuuuaccgaagacugcagaggauguuggggcuccggcguggaucugagaacgaagaucugugggccgaguccgagggcacuguggcuugccugggugccgaagaccgcgcagcuacaagcgccaaaucguggcccauuuuucucuucuucgcgguaaucuuagggggaccauaucugauauggaaacuuuugucuacccauuccgaugagguuacggacucaaucaauugggccaguggcgaagaugaccacguggucgcaagagcugaguacgauuuugccgcugugagcgaggaagagauuuccuucagggccggcgacaugcugaaccuagcacucaaggaacaacagccuaaggugcggggguggcugcuugccucucuggauggacagacuaccgguuugauccccgcuaauuaugucaagauucucggcaaacgaaaggggcgcaaaacaguugagagcucaaaggugaguaaacagcaacaguccuuuacuaacccaacccugacaaagggagcgaccguagcagacagcuuagacgaacaggaggccgcuuucgagucuguguuugucgaaacgaauaaggugcccguugccccugauucaaucggcaaagacggugagaagcaagaucuguga

SEQ ID NO: 60570 - RNA, 1077 nt, Artificial Sequence
  derived and/or modified sequence opt3 from PEX14__Homo_sapiens__XP_011539880
augcugaacaagcucaucugccuuaugauugccaccgcugugaaauuccugcagaauagcagagucaggcaaucccccuuggcaacacggcgcgccuuuuuaaagaaaaagggccugacugacgaggaaauagauauggcguuccagcagucugggacggcugccgacgagccuucaagucuaggaccagcaacccagguugugccgguacaacccccucaccucaucagccagccauacucccccgccgguucucgauggcgugauuauggcgcucuggcaauuaucauggccgggauugcuuuuggauuccaucagcuuuacaaaaaguaucuguugccucucauccugggcgguagagaagacaggaagcagcuggagcggauggaagccgggcucucggaguuaucaggaagcguggcgcaaacagucacucagcugcagaccacacuugcaagugugcaggaguugcugauacaacagcagcaaaagauccaggaacuagcccacgagcucgcugccgcaaaggcuaccacuuccacaaacuggauucuggaaucucagaauaucaacgagcuuaaaagcgagauuaauucccugaagggcuugcuccugaaccgcagacaguuuccacccucaccuagugccccaaaaaucccgagcuggcaaauacccguuaagucuccuuccccaucaagccccgcggccgugaaucaucacaguucuuccgauauuagcccugucucgaacgaaucuaccuccucaaguccaggcaaggaggggcauagccccgaaggauccacggugacuuaccacuuacuggguccgcaggaggaaggcgaggggguaguugacgugaaaggacaggucaggauggaggugcagggcgaagaggaaaagcgggaggauaaagaagacgaggaggaugaagaggacgaugacgugucucacgucgaugaagaggacugucucgguguucaacgcgaagaccgaagagggggagauggccagaucaaugaacagguggagaaacuuaggcggccugagggcgcaagcaacgagucagaacgugacuga

SEQ ID NO: 60571 - RNA, 1011 nt, Artificial Sequence
  derived and/or modified sequence opt3 from PEX16__Homo_sapiens__NP_004804
auggagaagcugagacuccuuggccugagguaccaggaauaugugacccggcaccccgccgcuacagcacaauuggagacugccguccgcggguucagcuacuuacuggcgggacgauuugcugacucccaugaacuaucugagcucguuuauucagccaguaaccugcuugugcuguugaaugaugguauccuccguaaagaacugagaaagaaacugccuguaagccucucccagcagaaguuacugacguggcuuucuguguuggagugcgucgagguguucauggaaaugggcgcagccaaaguuuggggagagguggggagguggcuggucauugcucuaauacagcucgcaaaggccgugcugcggaugcuucuguugcucugguuuaaggcuggccugcaaaccucgccaccgaucguacccuuagaccgcgaaacacaggcccagccuccagauggugaccacucacccgggaaccaugagcagagcuacguuggaaaaagaaguaauagggugguccggacucugcaaaacaccccuucccuccacucucgccauuggggcgcgccacagcagcgagagggcagacagcaacagcaccacgaggaacuuagcgcaacacccaccccucugggguugcaggaaacuauugccgaguuccuauauaucgcuaggccacugcuccaucugcuuucccugggauuguggggucaacggucauggaagccguggcuccuggccggcgugguggaugucacaaguuuaagccugcuaucugaccguaaagggcucacccgcagagaaaggcgggagcugcgacgcagaacgauucuuuugcuguacuaucuccugaggucccccuuuuacgaucgguucucagaggcacgcauccuuuuucuguugcagcuccuggcugaccacguuccuggagugggcuuaguaacuagaccacugauggauuaccuacccaccuggcagaagauauauuucuacagcugggguuga

SEQ ID NO: 60572 - RNA, 840 nt, Artificial Sequence
  derived and/or modified sequence opt3 from PEX19__Homo_sapiens__NP_001180573
auggccgcugcagaggaaggcugcagcgugggggccgaggcggacagagaacuggaggaacuccuugaguccgcucuggaugacuucgauaaggccaaacccucuccugcaccaccgucaaccacaacugcccccgacgcuaguggaccucagaagaggagcccaggugauacggcaaaagacgccuuguuugcuucccaagagaaguucuuucaggaauuauucgauucugagcuggccucgcaggcgaccgcagaauuugagaaagccaugaaggagcuagcugaagaggaaccccaccucgucgagcaguuccaaaagcugucagaagccgcaggccggguugggagcgacaugacaagucagcaggaguuuacuuccugucuuaaagagacccugucuggauuggcuaagaacgccacagaucuccagaauagcuccaugucagaagaggaacugaccaaagcgauggagggccuggguauggacgaaggggauggagagggcaacauccucccuauuaugcaaaguauaaugcagaauuuacugagcaaggacgugcuuuacccaucuuugaaagagaucacugaaaaguaucccgaguggcugcagucccaucgcgaaucacuaccuccagagcaguucgaaaaguaccaagagcagcacagcguaaugugcaaaauuugugagcaguuugaagccgagacaccgaccgauagugaaacgacucaaaaggcacgauucgagauggugcucgaccugaugcagcagcuucaggaccugggccaucccccuaaagaguuggcuggggaaauggucccagugguuaacucuguguga

SEQ ID NO: 60573 - RNA, 3852 nt, Artificial Sequence
  derived and/or modified sequence opt3 from PEX1__Homo_sapiens__NP_000457
auguggggcagcgacagacuggccggggcuggagguggcggggcagccgugaccgucgcguucacaaacgcuagggauugcuuucuccaccuuccccggcgccugguugcccaguugcauuuacugcaaaaucaggcaaucgaggugguauggucccaccagccugccuuccuaucuuggguggaaggacgacauuuuucagaccagggcgagaacgucgcugaaauuaaucgucaagugggucagaagcucgggcugaguaacggaggccagguuuuccuuaaaccauguagccacguggucuccugccagcaaguggagguagaaccgcugucugcagaugacugggagauauuggagcuccaugccguuucgcuggaacagcaucugcucgaucagaucagaauuguguuucccaaggcuaucuucccugucuggguggaccagcaaacuuacauuuuuauccagauaguggccuuaaucccagcggcaucauauggcaggcuggagacggauaccaaacuuuugauucagcccaagacacggcgcgccaaagaaaauacuuucagcaaggcugacgccgaguacaagaaacugcacaguuaugggagagaucaaaagggaaugaugaaagagcuacagaccaagcagcuccaguccaacacagucgguaucaccgaaucuaaugagaacgaaagcgagauuccuguugacuccucaaguguggcaagccuguggacuaugaucggcucuauauuuuccuuccaaucagagaaaaagcaggaaacaagcugggggcuuaccgagauuaaugcuuuuaagaacaugcagaguaaaguagugccacuggauaauaucuucagggucuguaagucucagcccccuuccauuuacaacgccagcgcgacgucgguguuucacaaacacugcgccauccauguuuucccaugggaccaagaauauuucgauguggagccgucuuuuacugucaccuacggaaaguuggugaaacuccugucccccaagcagcagcagucaaaaacaaagcaaaauguauuaaguccugaaaaggagaaacagaugagcgaaccacuggaccagaagaaaauccgguccgaccacaacgaggaggaugaaaaggcauguguucuccagguggucuggaauggccuugaggaacugaacaacgcuauuaaauauacuaagaauguggaggucuugcaccuagguaagguguggauacccgacgaucugcgcaaacgacucaacaucgaaaugcaugccguugugagaauuaccccuguagaggucacaccaaagauccccaggucucugaaacuucaaccgcgggagaaucugccuaaggacauaagcgaagaggauauuaaaaccguguucuacucaugguugcagcagaguacgacuacaaugcucccccugguuaucuccgaagaggaguuuaucaaguuagaaaccaaggacgggcugaaagaguucagccuaucuauugugcacucaugggaaaaggagaaagauaagaacaucuuucuccugaguccaaaucuuuugcagaaaacuacaauucaaguccugcucgacccuauggugaaggaagagaacagcgaggaaauagauuucauccugcccuuucuuaagcuguccucuuugggaggcguaaauucgcucggcgugagcucccuggagcauauuacccacucauuacuggggcguccacuaagucgccagcucaugucucugguugcuggacuuagaaacggugccuugcugcucacgggcgggaaaggaagcggcaaguccacccuggcaaaagccaucugcaaggaggcuuucgacaaauuagaugcgcaugucgaaaggguggacuguaaggcacugcgggguaaacgacuugaaaauauccagaagacauuggagguggccuuuucagaggcugucuggaugcaacccagcguugugcuccuggacgaucuagaccugauugccgggcucccugcagugccagaacacgagcacucuccggaugccguacagucccagcgccuggcucaugcccuuaacgacaugauaaaggaguucaucaguaugggcagcuuggucgcacugauugcgacuucucagucccaacagucauuacacccccuccuggugagugcucagggaguucauaucuuucagugcgugcaacacauucagccuccaaaucaggaacaaagaugugaaauccuuugcaacgucaucaaaaauaagcuggauugugacauaaacaaauucaccgauuuggaccuccagcacguggccaaggagacaggcggguuuguugcaagggauuucacugugcugguagaccgggccauucauagccgccuaucgagacaguccaucucuaccagggagaaacugguccucacaacccuggauuuccagaaggcccuucguggauuuuugcccgccagccugcggucagugaauuuacacaagccucgagaccucgguugggauaaaauuggcgggcugcaugaagugagacaaauccuuauggacacuauacagcugccagcaaaguaccccgagcuauucgcuaaccucccgauuaggcagcgcacgggaauccuguuguauggcccuccagguacagggaaaacccuguuagccggcgucauugcgcgggaaaguagaaugaacuuuaucuccguuaagggacccgagcuccugucuaaauacauaggcgccagcgagcaggcugugagggacaucuucauucgcgcacaagccgcuaagccuugcauccuguuuuucgaugaauuugaguccauugcuccccgacgggggcacgacaauacuggaguaaccgaucguguggucaaccagcuuuugacacagcucgacgguguggaaggccugcaggggguuuaugugcuagcagcgaccucaagaccagaucugaucgacccugcccuucucaggcccggacgccuggauaagugcgucuacuguccaccgccugaccaagugagccgguuggagauacugaauguuuuaagugauucucucccccuggcugacgauguggaccuucagcaugucgccuccguaacugauagcuucacaggcgcagaccugaaggcuuugcucuauaacgcccagcuggaagcacuacacgguaugcugcuuucgucagggcuccaggacggcucuaguuccagcgauucugaccugagcuuguccucaaugguguuuuuaaaucacaguagcggaucugaugacuccgccggcgauggggagugcggacuggaccaaucacucguuagucuggagaugagcgaaauucuuccagaugaguccaaauucaacauguacagacuguauuuugguucuucguacgaaagcgaguugggcaaugggacgucauccgaccuaaguucucagugucugagcgcucccuccucaaugacccaggaucucccuggagugccaggcaaagaccaacuguucucucagcccccuguccuuaggacugcgagccaggaagguugccaggaguuaacacaagagcagcgagaucagcugcgcgccgacaucaguaucauuaagggccgguacagaucccagagcggggaagacgagucuaugaaccaaccgggaccaaucaaaaccaggcucgcaauuucacagucccauuugaugacagcucugggccacacucgucccaguauaagcgaagaugacuggaagaauuuugccgagcucuaugaaucguuccagaacccuaagcgccggaaaaaucagucugggaccauguucagaccaggacaaaaggugacgcuggccuga

SEQ ID NO: 60574 - RNA, 918 nt, Artificial Sequence
  derived and/or modified sequence opt3 from PEX26__Homo_sapiens__NP_001121121
augaaaagcgacuccucuaccucagccgcuccccugagaggccucgggggaccucuuaggaguagcgagccagugcgggcagucccggcccgcgcgcccgcuguugaucuguuggaagaggccgcagacuuacuggugguacaccuagauuuccgagccgcucucgaaacaugcgagcgugcauggcagucccuggccaaccaugcuguggccgaggaaccugcggguacuucucuugaggucaaguguucgcugugcgugguuggcauccaagcauuggccgaaauggacagauggcaggaggugcucucauggguccugcaguacuaucaggugccagaaaagcugcccccuaaaguacucgaguuauguauucugcuuuacagcaagaugcaagagccaggggcuguuuuggauguggucggagccuggcugcaggaccccgcaaaucagaaccuaccugaauauggcgcucucgccgaguuucacgugcagagggugcugcuuccacuggguugcuugagugaagcggaggaacucgucguuggguccgccgcauucggagaggagcggcgccuggauguguuacaagcuauacauacggccagacagcagcagaaacaagaacacucuggcagcgaggaagcucagaagccgaaucuggagggcuccguaucacauaaguuucucagucuucccaugcuggugaggcaguugugggacagcgccgucucucacuucuuuucccuaccuuucaaaaagucacugcucgcagcccugauccuuugucuguuggugguucgguuugauccagcuagccccaguucucuccacuuccuguacaaauuagcgcaacuguuucgcuggauucgaaaggcagccuucuccagacuauaucagcucaggauccgggacuga

SEQ ID NO: 60575 - RNA, 918 nt, Artificial Sequence
  derived and/or modified sequence opt3 from PEX2__Homo_sapiens__NP_001165558
auggccagcagaaaggagaacgcuaaauccgcaaauagggugcugcggaucucucagcucgacgcccuugaacugaacaaggcguuggagcaauuagucuggucacaguucacccagugcuuucacggcuucaaacccgggcugcuagcucgcuuugaaccugagguuaaggccugucucuggguguuccuguggcgauuuacaauuuacaguaaaaaugcaacuguaggacagagcgugcuuaacauaaaguauaagaaugauuucuccccaaaccugcguuaccaaccgcccucuaaaaaucagaagaucugguaugccgucugcacgauugguggcagaugguuggaagagagguguuacgaccucuuucggaaccaucaccuggcuucguucgggaaagugaagcagugcguuaauuuugugaucggacugcucaaauuaggcggucugauuaacuuccuuaucuuuuugcagcgcgggaaguucgcaacccugacagagagacuacucggaauacauucagucuuuuguaagccucaaaauaucagggaagugggcuucgaguauaugaaccgggaacugcuuuggcacggcuucgccgaguuucugauuuucuugcucccacugaucaauguacagaaauuaaaggcuaaacugagcaguuggugcauuccccucacuggggccccuaacuccgauaauacccuugcgacaucuggaaaggagugugcacugugcggugaauggccaaccaugccccauacuaucggcugugagcacauauuuugcuacuucugugccaaaagcuccuuuuuguucgacguuuauuuuacaugcccuaagugcgggaccgaagugcacucacuacagccacugaaaaguggaauugagaugagcgaagucaacgcucucuga

SEQ ID NO: 60576 - RNA, 1122 nt, Artificial Sequence
  derived and/or modified sequence opt3 from PEX3__Homo_sapiens__NP_003621
augcugagaagcguguggaacuuccucaagaggcacaaaaagaaaugcaucuuucuuggcaccguccugggagggguuuacauuuuggguaaguauggccagaaaaagauacgggagauccaagaacgcgaggccgcugaauacauugcacaggcccgacgucaguaucauuucgaguccaaucagagaacauguaacaugacuguguuaucuaugcugcccacgcuaagggaagcgcucaugcaacagcuuaauucagagagucugaccgcucuguugaagaaccggccuagcaauaaacucgagaucugggaagaccugaagauuaucuccuuuacacgcucuacuguagccguguacucgaccugcaugcuggucgugcucuuaagaguucagcugaacauaaucgggggauauauuuaccuugauaaugcagccgugggcaaaaacgguacaaccaucuuggcuccaccggacguccagcaacaguaucugucaagcauucagcaccuacucggggauggacugacugagcuuaucacagugauaaagcaggcaguacaaaaaguucugggcaguguguccuugaagcauucucucagccuguuagaccuggaacagaagcucaaagagauuaggaaucuugucgagcagcacaaguccucaaguuggaucaacaaagauggcagcaagccccuguugugucauuacaugaugccugacgaagagaccccacuagccgugcaggcuugcgggcugucuccccgggauauuacgacuaucaaacuccugaaugaaacccgcgacaugcuugaguccccugauuucucaacagugcugaacacuuguuugaaucgaggauuuagcagacuccuggacaacauggccgaguucuuuaggccaaccgaacaagauuuacagcacgguaauaguaugaacucucuguccagcgucucgcuaccccucgcgaagaucauuccuauaguuaacggccagauccacucugugugcuccgagacaccaucacauuucguacaagaccugcuuaccauggaacaggugaaagauuuugcagccaaugucuacgaggcuuucaguacgccgcagcaguuggaaaaguga

SEQ ID NO: 60577 - RNA, 1896 nt, Artificial Sequence
  derived and/or modified sequence opt3 from PEX5__Homo_sapiens__NP_000310
auggccaugagagagcugguggaagcugagugcggcggggcaaacccccucaugaagcuggccggacacuucacccaggacaaagcgcugaggcaagaagguuugcggccuggcccauggccgcccggggcuccugccagcgaggcagccuccaagccauuaggagucgcuucugaagaugagcugguugcagaguuucuacaggaccagaaugcuccccucgugucacgcgccccucagacauucaaaauggaugaccugcuugccgaaaugcaacagaucgagcagaguaacuuucgacaggcgccacaacgugcacccggcguagccgaucuggcuuugagcgaaaauugggcccaggaguuccucgcagcuggugacgccguggaugucacucaggacuacaacgagacggauuggucccaggaauuuauuucugaggugaccgacccucugucgguuucaccagcgagaugggccgaagaguaucuggaacaaagcgaggagaagcucugguuaggggaaccggagggaacagcaacugauaggugguacgacgaauaucaucccgaggaagaucugcagcacaccgcuagugacuucguggccaaagucgacgauccuaaguuggcuaauuccgaguuuuugaaguucgugcggcagauaggcgagggccaaguaucucuggaaagcggggccggauccggucgcgcacaggccgagcagugggcugcggaauuuauccagcaacagggcacaucagacgcauggguugaucaguucaccagaccagugaacacaagugcccuagacauggaguuugaaagggcuaaaagcgccauugagcuccaggcagagcuggaagagauggccaagcgggaugcugaagcccaucccuggcuuucugacuacgaugaccugacauccgcaaccuaugauaaaggguaccaauucgaggaggaaaauccuuugcgcgaccacccacagcccuuugaggaaggacuccgaagacugcaggagggcgauuuaccgaacgcgguccuucucuucgaagcugccgugcagcaagacccuaagcauauggaggcauggcaguaucuugguacgacucaggccgagaaugaacaggagcuguuggcuaucucagcccuaaggcggugucuggaacucaaacccgacaaccaaaccgcacugauggcucuugccgugagcuucacaaaugagagucugcagcgucaggcgugcgaaacuuugcgcgauuggcucagauacaccccagccuacgcucaccuggucacuccugcagaggagggggccggaggcgcuggcuuagggcccucuaagaggauucugggaucccuacucagcgacucgcuguuucuugaaguuaaggaguuguuccuggccgcagugcggcucgauccaaccucuaucgaccccgauguacaauguggucugggcgugcuuuuuaaccuguccggggaauaugacaaagcggucgauugcuucacggccgcuuugucagugcgaccuaaugacuaccuccuguggaacaaguuaggagccacucuggcaaauggcaaccagagugaggaagcuguugccgcauaucgcagagcccuagagcuccagccagguuacauaaggagccgguauaaccuggggaucuccuguauuaaucuuggcgcucaccgcgaggcgguggaacauuuucuugaggcccugaacaugcagagaaaaucuaggggaccgcguggcgaagggggagcaaugagcgagaauaucuggucaacacuccggcuggcuuuaaguaugcugggucaauccgaugccuacggcgccgcugacgcacgagaucuuagcaccuugcucacuauguucgggcugccccaguga

SEQ ID NO: 60578 - RNA, 1875 nt, Artificial Sequence
  derived and/or modified sequence opt3 from PEX5L__Homo_sapiens__NP_001243679
auguaccagggccacaugcaaguggucgggguuacccugaagaaaaaguggcauugccuccagaaaagcgaccuuacacuggccuugggaaaggguuccagagcugcagauaaagccguggcgaugguaaugaaggagauccccagggaagagucugcugaagagaagccuuuacugacuaugacgucacagcuagugaacgaacagcaagagagucggccacuccugagcccguccauugacgauuuccuuugugagaccaaaucugaagccauagcacgccccgucacaucgaauacugccgugcugaccacaggcuuggaccuccuggaucugucagagccuguuagccagacccagacuaaggcuaaaaagagugaaccauccucuaaaacaagcucccucaagaagaaagcagacgggucagauuuaaucaguaccgacgccgagcagcgaggacaaccccugcgugugccugagacgagcucucuugauuuggacauucagacucagcuggaaaagugggaugacgucaaauuucacggcgauagaaacaccaagggucauccaauggcugagaggaaauccucaagcagucggacagggucuaaggaacuacucugguccagcgagcaccgcucgcagcccgaacugucuggaggcaaauccgcccuuaauucagagagugcgagcgagcuggaauugguggcaccuacucaagccagacucaccaaggagcauagguggggcuccgcucuguuaucucggaaccacagccuggaagaggaguucgaacgcgccaaggcagcuguagagucagacacagaauuuugggacaaaaugcaggccgagugggaagagauggcgcgaagaaauuggaucagugaaaaccaggaggcccaaaaucagguuaccauuuccgcaagcgagaagggguauuacuuccacacggaaaacccauuuaaagauuggccgggagcuuucgaggaaggucucaagaggcuuaaagagggcgaccugcccgugacuaucuuguuuauggaggccgcuauacuacaggauccuggggacgccgaagcauggcaguuccugggaaucacacaagccgagaaugaaaacgagcaggcugcgauugucgcacuccagcggugccuggaacuucagccaaauaaccugaaggccuugauggcucucgccgugucuuauaccaauacuggccaucaacaggaugcaugugacgcccugaagaacuggaucaaacagaaucccaaguacaaauauuuagugaagaguaaaaaggguucaccugggcugacacgucgcaugagcaaguccccagucgauucuucgguucuagagggagugaaagagcucuaccuggaagcugcccaccagaacggcgacaugauugaucccgaccuucaaaccggcuuggggguacuguuucaucucagcggagaguucaacagagcaaucgaugcguuuaaugcugcccugacggugaggccggaagacuauucccuuuggaaccggcugggugcaaccuuggccaauggcgaccgaucagaggaagcugucgaggccuacacacgcgcacucgagauacagccuggguucauuagaaguagguacaaccugggaaucucuugcauuaauuuaggcgcuuaucgggaagccgugagcaacuuucugacugcgcuaucccuccagcgcaagucaagaaaucagcaacagguuccccacccagccaucagcgguaacaucugggcugcacugaggauugcccuuucuuugauggaucagccugagcuguuccaagcugccaaucucggggaccuggauguguuacugcgugcauucaaccuugaccccuga

SEQ ID NO: 60579 - RNA, 2943 nt, Artificial Sequence
  derived and/or modified sequence opt3 from PEX6__Homo_sapiens__NP_000278
auggcccuggcugugcucagaguccuugagcccuucccuaccgaaacaccaccgcuggcaguuuuguuacccccuggcgggccauggcccgccgcggagcugggauuggugcucgcucugaggccugccggugaaagcccagcaggccccgcccuucugguagcugcauuggaggggccugacgccggaacugaggaacagggcccagguccgccccaacuccuggugucccgggcucugcuccgcuuacuggcccuugggucuggagcguggguccgagcacgugccgugagaaggccuccagcuuugggcugggcccugcuaggcacgucacucgggcccggacuggguccucggguuggcccacuucuggugcgcagaggggagaccuugcccgucccgggaccuagggugcucgaaacacggcccgcacugcagggcuuacuggguccagggacucgccucgcuguaaccgagcuucgaggcagagccaggcugugcccugaaaguggcgauagcucccggcccccacccccuccaguugugucuucguuugcggucucaggcacagugcgucgcuugcagggggugcuaggagguaccggcgacagccugggggucaguagauccugucucaggggacugggccuuuuccagggugaguggguuuggguggcccaagcacgggagucuagcaacacuucccagccgcaccuggcucgaguacagguguuggaaccccgcugggaucucucagacagacuggggccuggcaguggaccauuaggcgagccccuggccgaugggcuagcucucgucccugccacacuggcauuuaaucuuggaugcgacccauuggaaaugggugagcugaggauccagcgguaccucgaaggcagcauugcccccgaggauaaggggucuuguucccugcuuccgggaccuccauucgcucgcgagcugcauauagaaaucgugucaagcccccacuauaguaccaacggcaauuacgacgguguuuuguauagacauuuucaaauuccuagggugguccaggagggggaugugcucugcguacccacgaucggccagguugaaauucuggagggaucuccagaaaaauuaccucguuggcgggagauguucuuuaaggugaaaaagacugucggcgaggcgcccgacgggccagcauccgccuaccuggcugauaccacacacacuagccuauauauggugggaucgacccucucuccggucccuuggcugcccuccgaagagucaacacuuuggaguagcuuguccccacccggucuggaagcccucgugucugagcugugugcaguuuuaaaaccucgacugcagccaggcggggcccuuuugaccggaacgagcucagugcuccugagaggacccccugguugcgggaagacuacaguagucgcugccgcauguagucaucuaggccugcaccuccugaaggugccgugcuccagccuuugugcggaaucuucaggagcuguugagaccaaauugcaagccaucuucaguagggcacgccggugcagaccagccgugcuguuacucacugcugucgaccugcuuggcagggaucgcgacgggcugggagaggacgcccgagugauggcaguauugcggcaccuccugcuaaacgaagauccccugaauagcuguccuccacucauggugguugcuacaaccucccgugcccaggaccugcccgcggauguccagacggccuuuccucaugagcuugaagugccggcuuugucugagggccaaagacugucgauauuaagggcacucaccgcccaucugccccuuggucaggaggugaaccuggcucagcuagcccgccggugcgcaggguucgucguuggagaccucuacgcgcuguugacacacagcuccagagccgcuugcacuaggaucaaaaauucaggccuggccgguggcuuaaccgaagaggaugaaggggagcucugugcagcuggauuuccacugcuugccgaagacuucggccaggcacuggagcaauugcagacagcccacagucaggcugugggggcgccuaagauucccucugugagcuggcacgauguaggaggccuccaggaggucaagaaagaaauccuggagacuauucaacuaccacuggaacauccugagcuucucucccuggguuugcgacgcucagggcuguuacuccacggacccccaggcaccgguaagacacugcuugccaaggcaguggcuaccgaaugcagccugacuuuucuaucuguuaaaggcccggagcucaucaacauguauguggggcaguccgaggaaaauguccgggagguguucgccagagccagggcugcagccccuuguauaauuuucuuugacgaacuggauagucuagcgcccagccguggacgcucuggcgacuccgggggaguuauggaucgggugguaucacagcugcuugcugagcucgacggccugcauaguacgcaggacgucuucgugaucggugccacaaacagaccagauuuguuagaccccgcacugcucaggccugggcgauuugauaagcugguguucgucggagccaaugaagaccgggcuagccaacuucgcguucugucggcaauuaccagaaaauuuaaguuggagccauccgugucucuaguaaacgugcuggauugcugucccccucagcucacuggcgccgaccuguacagccuuugcucagaugcgaugaccgcugccuuaaaaaggcggguccacgaccuggaggaaggucucgagccgggcaguuccgcauugaugcugacaauggaagaucuccugcaggccgcugcccgacuucagccaucugugagcgagcaagagcuguugagauacaagcgcauccagaggaaauucgcagcuuguuga

SEQ ID NO: 60580 - RNA, 972 nt, Artificial Sequence
  derived and/or modified sequence opt3 from PEX7__Homo_sapiens__NP_000279
augagcgccgugugcggcggggcugcaagaaugcugaggacccccggacggcacgguuacgccgcggaguucuccccuuaucucccaggccgccuugcuugugccacagcacagcauuacgggaucgccggaugcggcacucuguugauuuuagacccggaugaagcuggucugcgacuauuucguucuuucgacuggaacgaugggcucuuugacgucacguggucagagaauaacgaacacguucugauaaccuguaguggagauggcagccuucaacugugggacacagcaaaggccgcuggcccccuccagguguauaaagagcaugcccaggaaguauacuccguggauuggucucagacuagaggggagcaauuggucgugucgggaucaugggaccagaccguuaagcugugggauccuacaguggguaaaagccugugcaccuucaggggccacgagaguaucauuuauuccacuaucuggucuccacauauucccggguguuuugcgagcgcauccggagaccagacacuccggaucugggaugucaaggccgcuggcgugcgcauaguaaucccugcccaccaggcagaaauuuuaucaugcgacugguguaaauacaaugagaaccugcuuguuaccggugcuguggauugcaguuugagagggugggaccugaggaauguccggcaaccaguguucgaacuacucggacacacguaugccauccgccgagugaaguuuagccccuuccaugcgucuguccuggccuccuguucauacgacuuuacuguuagauucuggaacuuuagcaagccugauagucuucuggagaccguggagcaccauacagaguucacuugcggcuuggacuuuucucuccaguccccaacccagguagcagauuguagcugggacgaaacaauuaaaaucuacgauccggcuugccugaccauacccgccuga

SEQ ID NO: 60581 - RNA, 306 nt, Artificial Sequence
  derived and/or modified sequence opt3 from PF4__Homo_sapiens__NP_002610
augagcuccgccgcuggcuucugcgcaucuagacccgggcugcucuuucuuggacuguuguuacugccucuaguggucgccuucgcgucagcugaggccgaagaggacggugaucuccagugucugugcguuaagaccacaagucaagugaggccacggcacaucacuagccuugaaguaauuaaagcaggcccgcauugucccacggcccagcugauagcuaccuugaagaacgggcgcaaaaucugccucgaccugcaggcaccucuguacaagaaaauuaucaagaagcucuuagaguccuga

SEQ ID NO: 60582 - RNA, 315 nt, Artificial Sequence
  derived and/or modified sequence opt3 from PF4V1__Homo_sapiens__NP_002611
augagcuccgccgcuagaucuaggcugacccgggcaacacgccaggagaugcuuuuccucgcccuguuguuacugcccguggucguugcguuugcucgagccgaagcagaggaagacggcgaucuacaaugccucugugugaagacuacgucacagguacguccuagacacaucaccagucuggaggugauuaaagccgggccacauugcccgacagcucagcuuauagcaacucugaagaacggaaggaaaaucuguuuggaccuccaggcccugcuguacaagaaaauuaucaaggaacaccucgagagcuga

SEQ ID NO: 60583 - RNA, 405 nt, Artificial Sequence
  derived and/or modified sequence opt3 from PFDN4__Homo_sapiens__NP_002614
auggccgcuaccaugaagaaagcagccgcggaggacgugaacgucacauucgaagaucagcaaaagaucaauaaauuugcuagaaacacuagcaggauuacggagcugaaggaagagauagaaguuaaaaagaagcagcuccagaaucuugaggacgccugcgaugacaucaugcuggcagaugacgauuguuugaugauucccuaccagaucggcgacguguucauuucccacucucaagaggaaacccaggagauguuagaagaggccaaaaagaaccugcaggaggaaaucgaugcucuagagucacggguagaaaguauacagcgcgugcucgcagaccugaaaguccaacuuuaugccaaguuugggagcaauaucaaccuggaggcugaugaauccuga

SEQ ID NO: 60584 - RNA, 465 nt, Artificial Sequence
  derived and/or modified sequence opt3 from PFDN5__Homo_sapiens__NP_002615
auggcccagagcaucaacauuaccgagcugaaucucccccaacuugaaaugcugaagaaccaguuggaccaggagguggaauuuuuauccacaucuauagcucagcugaaagucguucaaacuaaguacguggaggcaaaagauugccuaaauguacucaacaagucaaaugaaggcaaagagcugcuugugccucugacgaguagcauguaugucccagggaaguugcacgacguggagcauguucucaucgaugugggaaccgguuacuaugucgaaaagacagccgaggacgcgaaagauuucuucaagagaaaaauugacuuucugacuaagcagauggagaaaauccagccggcucugcaggaaaagcacgccaugaagcaagcagugauggagaugaugucccagaaaauucagcagcucaccgccuuaggcgcugcacaagccacagcuaaggccuga

SEQ ID NO: 60585 - RNA, 390 nt, Artificial Sequence
  derived and/or modified sequence opt3 from PFDN6__Homo_sapiens__NP_001252525
auggcugagcugauccagaagaaacuccaaggcgaaguggagaaguaccagcagcuucagaaagaccugagcaaguccaugucugggagacaaaaauuggaagcucaguuaaccgagaacaauauugucaaggaggaacuggcacuacucgauggaucaaacguuguguucaagcugcuuggucccguacuggugaaacaggaguugggcgaagccagggcgacagucgggaagcggcucgacuauauaacugcugagaucaaacgcuacgaaagucagcugcgagaucuggagcgucaaagcgagcagcagagagaaacgcucgcccaguuacaacaggaguuucagagggcacaagccgcuaaggcaggagccccuggcaaagccuga

SEQ ID NO: 60586 - RNA, 1350 nt, Artificial Sequence
  derived and/or modified sequence opt3 from PFKFB1__Homo_sapiens__NP_001258733
augagccccgagaugggcgaacugacccagacaagacuccaaaagaucuggauuccucacuccucugggucaaguaggcuucagcggcgccgaggaagcuccauaccacaguucacuaacucuccgacgauggugaucauggucggucugcccgcccguggcaaaaccuacauuucgacaaaguugacuagauauuuaaauuggaucgggaccccuacaaaagacaacauggaggcucugcagauuaggaagcaaugcgcacuagccgcgcucaaagauguucauaauuaccugucacacgaagagggacauguggcuguauuugacgccaccaacacuacacgggaacgcagaagccuuauccugcaguucgcaaaggagcacggcuauaagguguuuuucauagagaguaucuguaaugauccagguauuaucgccgaaaacauuaggcaggucaaauuggggucccccgacuacaucgauugcgaccgggagaaggugcucgaagauuuucugaaacgcauagaguguuaugagguuaauuaccagccucuggacgaggaacucgauucucauuuaagcuauauuaagaucuucgacgugggaacccgauacauggucaacagagugcaagaucacauucaguccaggacgguauacuaucugaugaauauccacguuacuccacggucaaucuaccuuugccgucauggcgaaagugaguugaacauucgcggcagaauagggggagacagcggucugucugugaggggcaaacaguaugcuuacgcacuagccaauuuuauccagucccaagggauuucaagccucaaggucuggaccagucacaugaagcggacaauccagacugcugaagcccugggagugcccuaugagcaguggaaagcgcuuaacgagauagaugcaggcgugugugaagagaugaccuacgaagagauucaagaacauuauccugaggaguucgcccugcgagaccaggacaaguaccgcuacagauauccaaaaggugaaucuuacgaggauuugguccagaggcucgaaccgguuaucauggagcuggaacggcaggagaauguguuaguaaucugccaccaagcugugaugcgcugucugcucgccuauuuucuugacaaguccagcgaugagcugcccuacuugaaaugcccucuacacacaguccugaagcucaccccaguggcauauggguguaaaguugaaucgauuuaccugaacguggaggcugucaauacgcauagagaaaagcccgagaacguggacaucacuagggagccugaagaggcccuugauacaguaccagcgcacuauuga

SEQ ID NO: 60587 - RNA, 1416 nt, Artificial Sequence
  derived and/or modified sequence opt3 from PFKFB2__Homo_sapiens__NP_001018063
augagcggcgccuccucuucagagcagaacaauaacaguuacgaaaccaagacacccaaucugagaaugagcgagaaaaagugcuccugggcuucuuauaugacuaacucgccuacgcucaucgugaugauugggcuuccagcaaggggaaaaaccuacgucucaaagaaacugacacgguauuugaauuggauagguguuccgacuaagguguucaacuuaggcguauaccgccgagaagccgugaaguccuauaaaaguuacgacuuuuuccgucacgauaaugaggaagcgaugaagaucagaaaacaaugugcucuggucgcccuagaggacgugaaggcauaucucaccgaggaaaacgggcagauugccguuuuugaugcuacaaauaccacuagggagcggcgcgacaugauccugaacuucgcagaacagaauagcuuuaaaguguucuuugucgagucugugugcgaugaccccgauguaauugccgcuaacauccuugagguuaaggugagcuccccugacuacccagaaagaaauagggagaacgucauggaagauuuccugaagcggauagaguguuacaaagugacauaucgccccuuggacccugauaauuacgacaaggaucucucauuuaucaaagugauuaacgucggacagcgauuccugguuaacagagugcaagacuauauccagaguaagauuguauacuaucugaugaauauccaugugcagccaaggaccauauaccucugccggcacggcgaaagcgaguuuaacuuacuggguaaaauugggggagacucuggccuuuccguccguggcaagcaguucgcccaagcguugcgcaaauuucuggaggaacaggagaucacggaucuaaagguguggacuucacagcucaagagaaccauucagacagcagaaagccuggggguucccuaugagcaauggaaaauccuuaaugaaaucgacgccggagugugugaggagaugacuuacgcugaaauugagaagagguacccugaagaguucgcccugcgggaucaggaaaaauauuuguaccgauauccagguggcgagaguuaccaggaccucguccaacgccuggagccggugauaauggaauuagagagacaggggaacguacugguuaucucucaucaggcagugaugaggugccuccuugcuuauuuccuggauaagggagccgacgaauugcccuaccuacgguguccucugcacaccauuuuuaaacucacaccagucgcguauggcugcaagguggagaccaucaagcugaaugucgaggccgugaacacgcaucgcgauaaacccacugcagcugaaacaacccuugccguuagaaggcguccuuccgcugccagccugauguugccauguuga

SEQ ID NO: 60588 - RNA, 1503 nt, Artificial Sequence
  derived and/or modified sequence opt3 from PFKFB3__Homo_sapiens__NP_001138915
augcccuucagaaaggccugcggcccuaaacugaccaacagcccaacagugaucgucaugguugggcucccggcuaggggaaagacuuacauuuccaaaaagcugacgcgguaucuuaauuggauaggugugcccaccaaaguauuuaacgugggcgaguaccgccgagaagcagucaagcaguauucuucauacaauuucuuucguccugacaacgaggaagccaugaaggugagaaaacaaugugcguuggcugccuuaagggauguuaagaguuaucuggcaaaagaagggggacagaucgccguguucgacgcuacaaauacuacccgggaacgcagacacaugauucuacauuuugcaaaggagaacgauuucaaagccuuuuucaucgagagcgucugcgacgauccaacagugguagcuuccaauauuauggaaguuaagaucucuucgcccgacuacaaggauuguaacucagccgaggcgauggacgauuuuaugaaaaggauaagcugcuaugaagcaaguuaccagccucucgacccagauaagugugaccgggaucugucccuuaucaaagugauugacgucggccgccgauuccuggugaauagagugcaggaccacauccaaucuaggauugucuacuauuugaugaacauccauguucagccccggaccauauaccucugccgucacggugagaaugagcauaaccugcaggggcgcauuggaggcgauagcggccuguccucaagagggaagaaauuugccagugcucucagcaaguucguggaggagcagaauuuaaaagaccugaggguauggacuucucaacuuaaguccacaauccagaccgccgaagcauugcggcugccuuaugagcaguggaaggcucuaaacgaaauugaugccggagugugugaggagcucacguacgaagagauccgagacacuuauccagaagaguacgcgcugcgcgaacaggauaaauauuacuacagauauccgaccggugagucauaccaagaccuuguccagaggcuggagcccgugaucauggaauuggagcggcaggaaaauguucucgugauuugccaccaagccguccugcgcuguuuacuggcauauuuucucgauaagagcgcugaggaaaugccuuaccuuaaaugcccacugcacacaguguugaagcuaacucccguagccuauggcuguagaguugagaguauauaccugaacguggagucugucugcacccauagggaacguuccgaggacgcuaaaaaggggccuaacccacucaugcggcgaaauagcgugacaccccuggccucgccggaaccuaccaagaaacccagaaucaacucuuucgaggagcacgucgcauccacgucagccgcgcuuccaaguugccugccucccgaagugccaacucaguugcccggacagaauaugaagggcagcagguccucugcugauagcucacgcaaacauuga

SEQ ID NO: 60589 - RNA, 1410 nt, Artificial Sequence
  derived and/or modified sequence opt3 from PFKFB4__Homo_sapiens__NP_004558
auggccagccccagagagcugacccagaacccucucaagaaaaucuggaugccauacuccaauggcaggccggcacuucacgcuugccaacgcgggguguguaugacaaacugccccacucugauugucaugguuggauugccugcccgggguaagacguauauaucuaaaaaguuaacccgauaccugaauuggaucggcgugccaacacgugaguucaacguagggcaguauagaagggacguggucaaaacuuacaagucauuugaguucuuucuacccgauaaugaagagggacucaagauucggaaacagugugcgcuggcugcccuucgcgacgugagaagguuccugagugaagagggcggucauguugcaguguuugaugccaccaacacaacccgggagcgccgagcuacuaucuucaauuuuggggaacagaacggauauaagacauucuuugucgagagcauuugcguggacccugaaguaaucgcagccaauauaguucaagugaaauugggcuccccagauuacgucaacagagacucugaugaggcuaccgaggacuucaugaggcggaucgaauguuaugaaaauucguacgaaucacucgaugaggaccuggaucgugaccugagcuacauuaagaucauggaugugggccagaguuauguggucaaccgcguugccgaccacauucaguccagaaucguguacuaucucaugaauauacauguaacgcccaggucuauuuacuuaugccggcacggggaaagcgagcugaaccuuaaaggacgaaucgguggcgacccuggguuguccccacgcggaagagaguuugcgaagucacuggcacaguucauuagugaucaaaauaucaaggaccuaaaaguguggacuagccagaugaagaggaccauccagacagccgaagcucucggcgucccguaugagcaguggaaagugcugaacgaaauugaugccgguguuugugaggaaaugacuuacgaggagauacaagacaacuauccccuugaauuugcacugcgggaucaggacaaguaccgcuacagauauccuaaaggggagucuuacgaagauuuggugcagaggcucgagccagucaucauggaacuggagcgucaagagaauguguuaguaauuugccaucaggcuguuaugcggugucugcucgccuauuuccuugacaaggcggccgaacagcugcccuacuugaaaugcccucuacacaccgugcugaagcucacaccagucgcauauggauguaagguggaguccaucuuccugaacgucgcugccgugaauacccaccgagauagaccccagaacguugacauaucaaggccgccugaagaggcucuugugacgguacccgcccaucaauga

SEQ ID NO: 60590 - RNA, 2343 nt, Artificial Sequence
  derived and/or modified sequence opt3 from PFKL__Homo_sapiens__NP_002617
auggccgcuguggaccuggagaagcucagagcaagcggcgccgggaaagcgaucggaguccuuaccuccgguggcgaugcucaggggaugaacgccgcaguuagggccgugacacggaugggaauuuacguaggcgcuaagguguuccugauauaugaagguuacgagggguuggucgaaggaggcgagaauaucaaacaagcaaacugguuaucugugucaaauauuauccagcugggcgggacuauuaucggaagugcccgcugcaaggcuuuuacgacccgagaaggucguagagccgcggcauauaaccuaguucagcacggcauaacaaaucucugugugaucgggggagacggcagccugacuggugccaacauuuucagguccgagugggggucucuucuggaggaauuggucgcugagggaaaaaucucggaaaccacagcccggaccuacucacaucucaauauugcaggccuggugggcagcaucgauaacgacuuuugcgggacugauaugacaauaggaaccgacagugcucugcaccgcauuauggagguaaucgaugccauuacgacuaccgcgcagucccaucaaagaacauucguucucgaggugauggguaggcacuguggcuauuuagcccuggucucugcacuugcuagcggggccgacugguuguuuauccccgaagcuccuccagaggauggaugggaaaauuucaugugcgagcggcugggcgaaacucgcucccgagguucaagacuaaacaucauuauaaucgccgagggggcaauugacaggaauggcaagccgaucaguagcucuuacgugaaggaucucgugguccagcggcugggauuugacacccguguuacagugcuuggccauguacagcgcgggggaacccccuccgccuucgauagaauacugucaagcaaaauggguauggaggcugugauggcguugcucgaagcaacgccugacacuccagccugugucgugacacugaguggcaaccagucuguuagguuaccccugauggagugcgugcaaaugaccaaggaaguccagaaagcuauggacgauaagcgguuugacgaggccacucagcuccgagggggauccuucgaaaauaacuggaauauuuauaaacuucuggcacaccagaagccuccaaaggagaaaagcaacuuuucguuggccauccuaaacgugggcgcucccgccgcagguaugaaugcggcuguacgcucugccguuagaacagggaucucccacggccauaccguguacgucgugcacgauggauucgagggccuggcaaaggggcaaguccaggaagugggauggcaugacguugccgguuggcucggcaggggagggucaaugcugggcacgaaacggacccuuccuaagggucagcuggagaguauuguggaaaacauccgcauuuacgggauacacgcuuugcucguagucggcggauuugaggccuaugaaggcgugcugcaauuaguugaggcaagagggagguacgaggaacuguguaucgugaugugcgucauuccagcuacaaucagcaauaacgugccgggaacugauuucucccuaggcucugacaccgccguaaaugcggccauggagagcugugaucguaucaaacagucagcuagugguacaaagcggcgaguguucauuguugaaacuaugggaggguauugcggcuaccucgcaaccgucacagguauagccgugggcgcugacgccgcauauguguuugaggaucccuucaacauccacgaccugaaagucaauguugagcauaugaccgaaaagaugaagacugauauucagagagggcuuguguugaggaacgagaaaugucacgacuacuauacgacagaauuucuguacaaucucuacuccagcgagggaaagggcguguucgacugccgcaccaacguacuggggcaucuucagcaaggaggcgcgccuacuccauuugaucggaauuaugguaccaaacugggggucaaggccauguuguggcucucugaaaaacugagagagguguacaggaagggacgcguuuucgcuaacgcccccgacucagcaugcgugaucggcuuaaagaaaaaggcugucgccuuuaguccugugacagagcugaaaaaggauaccgacuucgaacaccgaaugccacgggagcagugguggcuaagccuccgucugaugcuuaaaauguuggcacaguauagaauuuccauggccgcuuacguuucuggugaacuggagcaugugacuaggcgcacacucucgauggauaagggcuuuuga

SEQ ID NO: 60591 - RNA, 2556 nt, Artificial Sequence
  derived and/or modified sequence opt3 from PFKM__Homo_sapiens__NP_001160158
augcacaaggacgaguuccaucugaaauuuuucaugugcgugauccagagcagacaacucgucaggacaccccagcggaccgccggcgaggcuuccacuucuucaaugcuuauuccuaagccaccgcccaaaacggauauacugaagaguuuggacaccauggaugacccugauacaguugggagcaucccaguguuuaaaacugaguggauuaugacccacgaagaacaucacgcagccaagacauuaggaaucgguaaggcgauugcuguacugaccuccggcggggacgcccagggaaugaacgcagccgugcgcgcugucgugcgaguuggcaucuucacuggugcacguguguuuuucguccaugaaggguaccagggacugguggauggcggcgaccacauaaaagaggccacaugggagucuguaucgaugaugcuccaacuagggggaaccguuaucgguucagcuagauguaaggauuuuagggaacgggagggccgccuuagagccgcguauaaucuggugaaaagggggauuacgaacuugugcgucaucggaggcgacgguagccucacuggggcagauaccuuccggagugaaugguccgaccugcugucugaucuccagaaggccggaaaaauuacagacgaggaggcuacuaagagcuccuacuuaaauaucgugggccuggugggcucaauagacaacgauuuuugugggaccgacaugacaauuggaaccgauagugcccuucaccgcaucauggaaauugucgacgcaaucacgacuacagcucagagccaucagcgaaccuucguuuuggaggugauggguagacacugcggcuaucuggcccuaguaacuucucucuccuguggggcggauuggguguuuauccccgaaugcccuccagacgaugacugggaggaacaucuguguaggcggcuuucagagacacguacccgcggaagcagacugaauauuauaaucgucgccgagggcgcaauugauaagaacgguaaacccaucacgagugaagacauaaagaauuuggugguuaaaaggcucggguacgauacccgggugacaguccugggccacgugcaacgaggaggcacuccuucugcuuucgaccgcauuuuaggguccagaaugggaguagaggccguuauggcucugcucgaagguaccccagacacaccggccugcguggucagccuuucgggcaaccaggcagugaggcugcccuugauggaguguguccaggugacuaaggauguuaccaaagccauggacgaaaagaaauuugaugaggcucuaaagcugcgggggcgcucuuucaugaauaacugggagguguauaagcuccuggcgcacguaagaccuccagucuccaaaucaggaagucauacaguggcaguuaugaaugugggcgcccccgcugccgguaugaacgcagccgucaggagcaccgugcguaucgggcuuauccagggcaaucggguacuggugguucacgacggauucgaaggcuuggcuaaggggcaaauugaggaagccggaugguccuacgucgguggcuggacugggcagggaggcucuaaacucgguacgaagcgaacacugccuaaaaagagcuuugagcagaucucagcaaacauuaccaaguucaauauacaaggguuagugaucauuggcggauuugaagcguauacuggcgggcuggagcuaauggagggaagaaaacaguucgaugaacucugcaucccauuuguggucauccccgcuaccguuaguaacaacgugccgggcuccgacuucagcgugggugccgauacagcacugaauaccauuuguacuacaugcgacaggauaaagcagucugccgcugggacgaaacgccggguauuuaucauugagaccaugggaggcuacugcgguuaccuugccacuauggcaggcuuggcugccggggcggaugccgcuuauaucuucgaggaaccuuuuacaauuagagaccugcaggcaaacgucgagcaucucgugcaaaagaugaaaaccacaguuaagaggggacuggugcuucgcaaugaaaaguguaacgagaauuacacuaccgauuucaucuuuaaccuguauucagaagagggcaaagggauauucgacagucgaaagaaugucuugggacacaugcagcagggcgguagccccacgccauuugaucggaacuucgccaccaaaaugggggcuaaggccaugaauuggauguccggaaaaaucaaggaaucuuaccguaacggcagaauuuucgcaaauacaccugacucggguugcgugcucggcaugaggaagcgcgcgcugguuuuucagcccguggccgaguuaaaagaccaaacugauuucgagcaucggaucccaaaggaacagugguggcugaaacuaagacccauucucaagauccuggcuaaauaugagauagaccuugauaccagcgaccacgcccacuuggaacauauuacaaggaagcgauccggggaggcagcuguauga

SEQ ID NO: 60592 - RNA, 2331 nt, Artificial Sequence
  derived and/or modified sequence opt3 from PFKP__Homo_sapiens__NP_001229268
augugcggcuacgagagauguaggcccugccgaggggcccacggauaucugcgcgguggccagggggugcuccaucuucgaggacugccuggccacggugggcguagauugaagcauaggcggggacgcuuaggcgaaugucugcaacacccagcuagcggcgcagucagaggggacuggagggagaaaccgggaugcuggucccaucgguuccccuguccuggucgccacgcccuaguuggcgggaccaucauuggaucugcgcgaugccaggcuuuuagaacaagggaaggccggcucaaggccgcauguaaccugcuucagcgugguauaacuaaucugugcgugaucgggggagauggcucauugacgggcgccaaccucuuccgcaaagaguggagugggcugcuggaagaacucgcuagaaauggacagauugacaaggaggcaguacaaaaauacgccuauuuaaacguggucgguauggugggcagcaucgauaaugacuuuugugggaccgauaugacaauuggaacugacuccgcucugcacaggaucauagaaguuguggaugccaucaugaccacagcgcagucucaucagcggaccuucguccuugaggugaugggccgacacugcgguuacuuggcacugguaucggcccuagcuuguggggccgacuggguuuuucucccagaaucacccccugaggagggcugggaggagcagaugugcgugaagcugagcgaaaaccgcgcaagaaagaaaaggcuuaauauuaucauugucgcugagggagccaucgauacucaaaacaagccaauaacaagugagaaaauuaaggaacugguggugacccaguugggcuaugacacgcgggucacuauccucgggcauguucagcgcggagguacccccuccgcguucgauagaauuuuagccucuaggaugggcguggaggcaguaaucgcuuuacuggaagccacaccugacacuccagcuugcguggucagccucaaugggaaccacgccgugcgucuuccgcugauggaguguguucagaugacccaagaugugcagaaagcaauggacgaacggcgauuucaggacgccgucagauugaggggacgcuccuucgcuggcaaucuaaacacauacaagcggcuggcgaucaagcuccccgaugaccaaauuccuaaaaccaauugcaacguggcaguaauaaauguuggugccccagcugccgggaugaacgcagccgugagaucagcugucagggugggcaucgccgauggacaccgcaugcuggcaauuuaugacggcuuugauggguucgcgaagggacagaucaaagagauagguuggacggacgucggcggguggacuggacagggcgguaguauucuugggacaaagcgagugcugcccggcaaauacuuggaagagaucgcuacccagaugcggacucauagcaucaacgcccuccugauuaucggaggcuuugaggcauacuuagggcugcuagaacucucugccgcucgugagaagcacgaagaguucuguguuccuauggugaugguaccagccacagucuccaauaacgugcccggaucagauuuuagcauuggcgcagacaccgcucugaauacgauaaccgauacaugcgacagaaucaaacaaagugccucugguacuaagaggcgcguuuucauuaucgaaaccaugggaggguauuguggcuaccuugcgaacauggguggcuuggccgcuggggcagaugccgcuuauaucuucgaggagccguuugacauucgggaccugcaguccaauguggaacaucucacagagaagaugaaaacuaccauacagagaggacugguccuuaggaacgaaagcugcucggagaauuacacaaccgauuucaucuaucagcuguacucugaggaaggcaaggggguguuugacugucggaaaaacguauugggacacaugcaacagggcggugccccuucccccuucgaucgcaauuuugggacuaagauuucagcacgggcgauggaguggaucacggccaaacucaaggaagcuagaggaaggggcaagaaauucacaaccgacgauaguauuugcgugcuggguaucagcaagcguaacguuauauuucagccagucgccgagcugaaaaagcagacugacuucgaacaucgcaucccuaaagagcaaugguggcugaagcuacggccccucaugaagauucuggcaaaauauaaggcuuccuacgaugugucugacagcggccagcuugagcacgugcagccauggucagucuga

SEQ ID NO: 60593 - RNA, 423 nt, Artificial Sequence
  derived and/or modified sequence opt3 from PFN1__Homo_sapiens__NP_005013
auggccggcuggaacgcuuacaucgacaaucugauggcagaugggaccugccaggacgccgcgauugugggauauaaggauagccccuccgucugggcugccguuccugguaaaacauucgugaacauaacuccagcagagguaggcgugcucgucgggaaggacagaucuucauuuuacgugaauggacuuacgcugggcggucaaaaauguaguguuaucagggauagcuuguuacaggacggggaguucuccauggaucugcggaccaagucuacaggaggcgccccgacuuuuaacgugaccgucacaaaaaccgacaagacucuagugcuccugaugggcaaggaagggguacacggaggucuuauuaauaaaaagugcuaugaaauggcuucgcaucugcgccgaucacaguacuga

SEQ ID NO: 60594 - RNA, 423 nt, Artificial Sequence
  derived and/or modified sequence opt3 from PFN2__Homo_sapiens__NP_002619
auggccggcuggcagagcuacguggacaaccugaugugcgauggguguugccaagaggcugcaaucgucggauauugugacgccaaguacguuugggcggcuaccgccgguggcguguuccaguccauuacacccauagaaaucgauaugauuguagggaaagacagagagggauuuuucacuaauggccucacgcuuggugcaaagaaaugcucugugaucagggauucacuguaugucgacggggauuguaccauggacauucggacaaagagucagggaggcgaaccuacuuacaacguggccguuggccgcgcugggcgagcauuggugaucgucaugggaaaagagggugugcacggcgggaccuuaaauaagaaggccuaugaacuggcucuauaccuccguagaagcgauguauga

SEQ ID NO: 60595 - RNA, 1167 nt, Artificial Sequence
  derived and/or modified sequence opt3 from PGA3__Homo_sapiens__NP_001073275
augaaguggcugcuccuucugggcuugguggccuuaagcgagugcaucauguacaaagucccccugauuagaaagaaaucccuaaggcggacccucucugaacgcgggcugcuuaaggacuuccugaaaaagcacaacuugaauccugcucgaaaguauuuuccacaguggaaagcaccgacacucguugaugagcaaccccuggaaaacuaccuggacauggaguauuucggaacuauagguaucggcacgccugcccaggauuuuaccgugguauucgacacagggucaaguaaucucugggugccaagcgucuacuguuccucuuuagcgugcacuaaccauaaucguuuuaaccccgaagauucgucaaccuaucagagcacaagugagaccguguccauuacuuacggaacaggcucuaugaccgguauccugggguaugacacgguucaggugggaggcauuagcgauacuaaucaaaucuucggccuuuccgagaccgaaccugggucauuuuuguacuacgcuccauucgacggaauacugggucuagccuaucccaguaucucuucuuccggcgcaacaccugucuuugauaacauuuggaaucaggggcucgugucacaggaccuguucagcguauaccuuagugccgaugaccagucuggauccguugugaucuuuggcgguauugauagcucguauuacacugggucucugaacugggucccagugaccguggagggauauuggcaaaucacagucgacuccauaaccaugaauggcgaagcuauugcaugugccgagggcugccaggcuaucguugacacggggacuucauugcucacaggaccgaccagucccauugccaacauccagagcgauaucggugcguccgagaauagcgacggcgauauggugguaagcuguucagcaauuaguucccugccugacauaguguucacuaucaacgggguccaguacccagugcccccuagcgccuauauuuuacaaucugaaggaucaugcaucaguggcuuucaggguaugaaucugccaacagagagcggggaacucuggauacuuggcgauguuuucauuagacaguacuucaccguguuugacagggcuaacaaccaagucggacuggcccccguggcauga

SEQ ID NO: 60596 - RNA, 1167 nt, Artificial Sequence
  derived and/or modified sequence opt3 from PGA4__Homo_sapiens__NP_001073276
augaaguggcugcuccuucugggcuugguggccuuaagcgagugcaucauguacaaagucccccugauuagaaagaaaucccuaaggcggacccucucugaacgcgggcugcuuaaggacuuccugaaaaagcacaacuugaauccugcucgaaaguauuuuccacagugggaggcaccgacacucguugaugaacaaccccuggagaacuaccuggacauggaauauuucggaacuauagguaucggcacgccugcccaggauuuuaccgugguauucgacacagggucaaguaaucucugggugccaagcgucuacuguuccucuuuagcgugcacuaaccauaaucguuuuaaccccgaggauucgucaaccuaucagagcacaagugagaccguguccauuacuuacggaacaggcucuaugaccgguauccugggguaugacacgguucaggugggaggcauuagcgauacuaaucaaaucuucggccuuuccgaaaccgagccugggucauuuuuguacuacgcuccauucgacggaauacugggucuagccuaucccaguaucucuagcuccggcgcaacaccugucuuugauaacauuuggaaucaggggcucgugucacaggaccuguucagcguauaccuuagugccgaugaccagucuggauccguugugaucuuuggcgguauugauagcucguauuacacugggucucugaacugggucccagugaccguggaaggauauuggcaaaucacagucgacuccauaaccaugaauggcgaggcuauugcaugugccgagggcugccaggcuaucguugacacggggacuucauugcucacaggaccgaccagucccauugccaacauccagagcgauaucggugcguccgaaaauucugacggcgauauggugguaagcuguucagcaauuaguucccugccugacauaguguucacuaucaacgggguccaguacccagugcccccuagcgccuauauuuuacaaucugagggaucaugcaucaguggcuuucaggguaugaaucugccaacagaaagcggggagcucuggauacuuggcgauguuuucauuagacaguacuucaccguguuugacagggcuaacaaccaagucggacuggcccccguggcauga

SEQ ID NO: 60597 - RNA, 1167 nt, Artificial Sequence
  derived and/or modified sequence opt3 from PGA5__Homo_sapiens__NP_055039
augaaguggcugcuccuucugggcuugguggccuuaagcgagugcaucauguacaaagucccccugauuagaaagaaaucccuaaggcggacccucucugaacgcgggcugcuuaaggacuuccugaaaaagcacaacuugaauccugcucgaaaguauuuuccacagugggaggcaccgacacucguugaugaacaaccccuggagaacuaccuggacauggaauauuucggaacuauagguaucggcacgccugcccaggauuuuaccgugguauucgacacagggucaaguaaucucugggugccaagcgucuacuguuccucuuuagcgugcacuaaccauaaucguuuuaaccccgaggauucgucaaccuaucagagcacaagugagaccguguccauuacuuacggaacaggcucuaugaccgguauccugggguaugacacgguucaggugggaggcauuagcgauacuaaucaaaucuucggccuuuccgaaaccgagccugggucauuuuuguacuacgcuccauucgacggaauacugggucuagccuaucccaguaucaguucuuccggcgcaacaccugucuuugauaacauuuggaaucaggggcucgugucacaggaccuguucagcguauaccuuagugccgaugacaaaucuggauccguugugaucuuuggcgguauugauagcucguauuacacugggucucugaacugggucccagugaccguggaaggauauuggcagaucacagucgacuccauaaccaugaauggcgagacgauugcuugugcagagggcugccaagccaucguugacacugggacaucauugcucaccggaccgacuagccccauugcuaacauccagagcgauaucggugccuccgaaaauucugacggcgauauggugguaagcuguucagcgauuaguucccugccugacauaguguucacaaucaacgggguccaguacccagugcccccuagcgcauauauuuuacagucugagggaucaugcaucaguggcuuucaagguaugaauguuccaaccgaaagcggggagcuguggauacucggcgauguguucauuagacaguacuucacggucuuugacagggccaacaaccaggugggacuugcucccguagccuga

SEQ ID NO: 60598 - RNA, 765 nt, Artificial Sequence
  derived and/or modified sequence opt3 from PGAM1__Homo_sapiens__NP_002620
auggccgcuuacaagcuggugcucaucagacacggcgagagcgcauggaaccuugaaaauagguucuccgggugguaugacgccgaucugucucccgcgggacaugaggaagcuaaacgggguggccaggccuugcgcgacgcaggguacgaguuugauauuugcuucaccucaguccaaaagcgagccauacguacauuauggacuguucuggacgcuaucgaucagauguggcuaccugugguaagaacguggaggcucaacgaacggcacuauggaggccugaccggucuuaauaaagcagagacagccgcuaagcauggggaggcccaggugaaaauuuggcgcagaaguuacgacgucccaccgcccccuauggaaccagaucaccccuuuuauagcaacaucuccaaggacaggcgguacgcggaucugacugaggaccaguugccuucuugugaaucgcucaaggauaccauugcacgcgcccugccauucuggaaugaggagaucgugccccaaauaaaagaaggaaagcgaguucugaucgcugcccauggcaacucacucagaggcauugugaaacacuuagaggggcugagcgaagaggcaaucauggaacuuaauuugccuacagguauuccaaucgucuaugagcuggacaagaaccuaaaaccgauaaagcccaugcaguuucucggagaugaggaaaccgugaggaaggcuauggaggccguagcggcccagggcaaagcaaagaaauga

SEQ ID NO: 60599 - RNA, 762 nt, Artificial Sequence
  derived and/or modified sequence opt3 from PGAM2__Homo_sapiens__NP_000281
auggccacccacagacuggugauggucaggcauggcgagagcacauggaaccaggaaaaucgguucugcgggugguuugacgcugagcucuccgaaaagggaacugaggaagcaaaacgcggugccaaggcgaucaaagaugcuaagauggaguucgacauuuguuacacgucuguucuuaaacgagccauacguacccugugggcaaucuuggauggcacagaccaaaugugguuacccgugguaagaacuuggaggcugaacgagcggcacuaugggggacuaaccggccucaauaaggccgaaacagcugcaaagcauggugaggaacaggugaaaauuuggcgcagaucauuugauaucccuccaccgcccauggacgagaagcacccuuacuauaacaguauuagcaaagagaggcgguacgccgggcugaagccaggagaacuuccuaccugcgagucccugaaagauacuaucgcucgcgccuugcccuucuggaaugaagagauagucccacagaucaaggcgggcaagcgagugcucauugcagcccauggcaacucucugagagggaucguuaaacaccuggaaggaaugucggaccaggcuauuauggagcucaauuuacccacagguaucccuauaguguaugagcugaacaaggaacuuaaaccaaccaagccgaugcaauuuuugggcgaugaggaaacggucaggaaagccauggaggcaguggcugcccaggggaaggcgaaauga

SEQ ID NO: 60600 - RNA, 765 nt, Artificial Sequence
  derived and/or modified sequence opt3 from PGAM4__Homo_sapiens__NP_001025062
auggccgcuuacaagcuggugcucaucagacacggcgagagcaccuggaaccuugaaaauagguucuccugcugguaugacgcagaucugucucccgccgggcaugaggaagcgaaacggggaggucaggcuuugcgcgacgccggcuacgaguuugauauuuguuuaacaucaguccaaaagcgaguuauacguacucuguggacggugcuagacgcaaucgaucagauguggcucccuguagugagaaccuggaggcugaacgaacggcacuaugggggacuuacaggccugaauaaagccgagacugcugcaaagcauggugaggcccaggucaaaauuuggcgcagaaguuacgacgugccaccgcccccuauggaaccagaucaccccuucuauagcaacaucuccaaggacaggcgguacgcugauuugaccgaggaccagcucccuucuuaugaaucgccaaaggauacaauugcccgcgcgcugcccuuuuggaaugaggagaucguuccucaaauaaaagaagggaagcgagugcugaucgcagcccauggaaacucacuccagggcauugcuaaacacgucgagggcuuaagcgaagaggccaucauggaacugaaucuuccaaccgggauuccgaucguguacgaguuggacaagaaccugaaacccauaaagccuaugcaguuccuaggagaugaggaaacuguaugcaaggcaauugaggcuguugccgcgcaggguaaagccaagaaauga

SEQ ID NO: 60601 - RNA, 2769 nt, Artificial Sequence
  derived and/or modified sequence opt3 from PGAP1__Homo_sapiens__NP_079265
auguuccugcacagcgugaaccucuggaaucuugccuuuuacgucuucaugguuuuucuggcuaccuugggcuuaugggacguguucuuuggguucgaggaaaacaagugcuccaugucuuauauguuugaguaccccgaauaucagaaaaucgagcugccuaagaaacuagcaaagagauacccagccuaugaacucuaccuguauggagaggguucauacgcggaggaacauaaaauucuuccgcugacaggcauacccguauuguuccucccugggaaugcuggaaguuacaagcaagugaggagcaucggcuccauugcccugcggaaggcagaggauaucgacuuuaaauaucacuucgauuucuucucugucaacuuuaaugaggaacugguggcccucuacggugggucguuacagaagcagacuaaauucguucaugaguguauuaagacgauccugaaacuuuauaagggacaggaauuugcuccaaagucaguggcaauaaucggccacagcaugggcggguuggucgcccgcgcucugcuaacccucaaaaacuuuaagcaugaccugauuaaucuucugaucacacaagccacuccccacguggcgccuguaaugccauuggaucgauucauuaccgacuuuuacacaaccguuaacaauuauuggauccucaacgcacgucacauaaaucugacuacauuaaguguggccggagguuucagagauuaccaggucagguccggccugaccuuucuccccaaacuuucucaucacacgagcgcucuguccguggugucaagugccgucccuaagacuuggguuagcaccgaccauuugucuauuguguggugcaaacagcuacagcugacaacuguacgggcauucuuugaucucaucgacgcugauaccaagcaaauuacacagaacuccaaaaagaagcugucagugcuuuaucaccacuucauccgccauccaagcaaacacuuugaggaaaauccggccaucauuagugaccugaccgggacgucuaugugggucuuggugaagguuuccaaauggacuuacguggcguacaacgagagcgaaaagauauauuucacauuuccccucgagaaucauagaaaaaucuacacccacgucuauugucagucgacuaugcuggauacaaacucuuggauuuucgccugcaucaacuccaccucaauguguuuacagggaguggaccugaguuggaaggcagagcuacucccuacgauaaaguaccugacccuuagguugcaagacuauccaagccugucccaucucguaguuuacgugcccucuguccggggcagcaaauuuguggucgauugcgaguucuucaagaaagaaaagcgcuauauucagcugccugugacacaccuguuuucauucggucuuaguucccgaaaaguuguguugaauacuaacgggcucuacuacaaucuggaauuacugaacuuuggacagaucuaucaggcuuucaagaucaauguagucagcaaguguucugccgugaaagaggaaauuaccucaaucuacagacuacacauuccauggaguuaugaggacagccucacaauagcucaagcccccuccucuacugagaucucgcugaaacuucauauugcacagccggaaaacaauacccacguugccuuguuuaaaauguacacaagcuccgauugcagguaugaggugaccgucaagacuucauucagucagauccugggccaagugguacgguuucauggcggggcucucccugcguacgugguuucuaacauccuguuagcauaucguggacagcuguacagccuuuucuccacggguuguugcuuggaauacgccacaaugcucgacaaagaggcuaagcccuauaaggucgauccauuugugauuauaaucaaauuccugcuaggcuacaagugguuuaaagaacugugggacgugcuccugcuuccugaguuggaugccgucauucugaccugucagucaaugugcuuccccuuaaucagccucauucuguuucuuuucgggacuugcaccgcauauuggucuggacuguuguccagugccagcguucgccuccugucuucccuauggcuggcucucaagagaccaucagagcugcccaaagacaucaagaugauaaguccugaucuuccauucuugacaaucgugcugauuaucgugagcuggaccacuuguggcgccuuagcaauucuccugucguaccuuuauuacguauuuaaagucgugcaucugcaggcgucccuaacaacguucaaaaauucucaaccgguuaaccccaagcacagcaggcggucagaaaagaagaguaaucaccacaaggacuccucuauccaucaccuccgacugagcgcuaacgaugccgaggacuccuugcgcaugcauucaaccgugauaaaucuguuaacuuggauuguccuccugagcaugccuagucuuaucuauuggcugaagaacuugagauacuacuuuaaacucaauccagaccccugcaagccucuggcauucauucuaaucccaacaauggccauacuggguaacaccuauacagugucuaucaaguccagcaaacuucucaagacuaccucgcaguuuccccugccguuggcuguuggggugauugccuucggcucagcacaccuguacagguuaccuuguuuuguauucaucccacuccugcuucacgcucugugcaacuuuauguga

SEQ ID NO: 60602 - RNA, 924 nt, Artificial Sequence
  derived and/or modified sequence opt3 from PGAP2__Homo_sapiens__NP_001138910
auggccagacugggcagcaccgggggaguguccgguagggucguuacacagcaccgggacucugcucccuuccucggcgcaccucgccuugggcugcgagaguugggaccaauccguggcacugccccggaauggcaugguagauggaacgcggcugagaggucagauaagauguaccaagugcccuuaccucuggaccgggaugggacgcuaguacgccucagauuuaccaugguggcccuggucacagugugcuguccacuuguugcauuccuguuuugcauuuuguggagucuccuguuccacuuuaaagaaacuaccgccacacauuguggagugcccaauuaucugccuagcgucuccucugcuauaggcggcgaggugccacagagguacguauggcgguucugcaucgggcuccacucggcaccccgcuuuuuaguugccuucgcuuauuggaaccauuaccugucauguaccagcccuugcaguuguuaucgaccacuuugcagauugaauuuuggacugaacguggucgaaaaucuagcccuccuggugcuuacuuacguguccucuagcgaggacuucacaauucacgagaacgcguuuaucgucuucauugcauccucacugggucacauguugcucaccuguauccuguggagguuaacgaagaaacauacugaucggaagaguuauagcuggaaacagcgucuguuuauaaucaauuucauuucuuucuuuuccgcccucgcuguuuacuuccgccacaacauguacugcgaagccggcguguauaccaucuuugcaauucuugaguacacaguagugcugacuaauauggcuuuccauaugaccgccuggugggacuuugggaacaaggaauugcuaaucacaucacagccggaggagaagagauucuga

SEQ ID NO: 60603 - RNA, 810 nt, Artificial Sequence
  derived and/or modified sequence opt3 from PGAP3__Homo_sapiens__NP_001278655
auggccggccuggcugcaagacucgugcuucuggccggggcggcugccuuggcaagcggaucccagggugacagggagcccgucuaccgggauugcguuuuacaaugugaagaacagaacugcucuggcggggcccugaaucacuuccgcucacgacagccuaucuauaugagucuagcuggauggaccugucgugacgauugcaaguacgaauguaugugggugacaguaggccucuaucugcaggagggucauaaagugccacaauuucacgggaaggucagccuuaacgcaugguucugguccacuguguuucauacgagagacaccgaucugacagagaaaauggacuacuucugcgccucuacuguuauuuugcacucgauauaucucuguugcgugaggaccgucggacugcagcauccggcugugguaucagccuuucgggcgcugcucuuacugaugcuuacaguucacgugagcuacuugagucugauccgcuucgauuauggcuacaaucuagucgcaaacguggccauuggccucgugaaugucguuugguggcuggcuuggugucuuuggaaccagagaaggcugccccacgugcggaagugcguaguggucguguugcuccugcagggguuaucccugcucgagcuucuggacuuuccuccauuguucuggguucuagaugcccaugcaaucuggcacauuucuaccauccccgugcauguccuguuuuucagcuuucucgaggacgauucccuguaccuucugaaagaaucagaggacaaguucaaguuggauuga

SEQ ID NO: 60604 - RNA, 2430 nt, Artificial Sequence
  derived and/or modified sequence opt3 from PGBD1__Homo_sapiens__NP_001171672
auguacgaggcccugcccggcccugcuccagaaaacgaggacgggcucgugaaggucaaagaagaggauccgaccugggaacagguuugcaauagccaagagggauccucucacacacaggagaucuguagacuuagguuccggcauuuuugcuaucaggaagcacacgguccccaggaggcccuggcgcaauugcgcgaauuaugucaucaguggcugcgaccugagaugcacacuaaggagcagauuauggaacuacucgugcuggagcaguuccuuacgauacugccaaaagaauugcaacccugcguaaagaccuacccucucgagucaggcgaagaggcugugacaguccuggagaaccuggaaacugggaguggagacaccggccagcaggccagcguguauauccagggucaagauaugcauccaaugguugcagaguaccagggggugucccucgaaugucagucuuuacaacugcuucccggaauuacaaccuugaaaugcgagccuccacagcguccgcagggcaauccccaggaagucucgggcccugugccacacgggucagcccaccuucaagagaagaaccccagagacaaggcuguaguuccuguguuuaauccagucaggagccagacucuagugaaaacagaggaagagaccgcacaggccguggcugccgaaaaguggagucaucucucccugacgcggcgcaaccuuuguggaaauucugcgcaggagacugucaugagccugucccccaugaccgaagagaucguuacaaaagauagauuguucaaggcaaaacaagagacuucagaagagauggaacagaguggugaggccagcggcaagccgaacagggagugcgcuccucagauucccuguucuaccccaaucgccacagaacggaccguggcacaccucaauacgcugaaggaccgccauccuggggauuuaugggcucgaaugcacauauccucacuggaguaugccgcgggagacaucacuagaaaaggcaggaagaaagauaaggcccggguaagcgaacuccuucagggucugaguuuuucuggggacuccgauguggagaaagacaacgaacccgagauucaaccagcacagaagaaauugaaggucagcugcuuccccgagaagucguggacaaaacgugauaucaagccuaauuuuccaucuugguccgcucuagacucaggacugcucaaccugaaaagugaaaagcugaauccgguggagcuguucgaauuguuuuucgacgaugagaccuuuaaccucauuguuaaugaaacuaacaacuacgccagccagaaaaaugugucccuggaggucacagugcaggagaugcgcuguguauucggcguuuuacugcuaucuggcuuuaugagacaccccaggcgggaaauguauugggaggugagcgacaccgaucaaaaccucguccgagacgcuauccgcagagauagguucgaacugauauucucaaaucuucauuuugccgacaacgggcacuuggaucagaaggacaaguucacgaaacugcggccucucauuaagcagaugaauaaaaacuuucugcuuuacgcaccacuggaggaauacuauugcuucgauaagaguaugugcgaguguuuugacuccgaucaauucuugaauggaaaacccauccgcauugguuacaagaucuggugcggcaccacaacucagggguaucucgugugguuugagccuuaccaggaagagagcaccaugaaggucgacgaagacccagaucugggauuaggcgguaaccuggugaugaauuucgccgacguucuacucgagagagggcaguaucccuaccaucuguguuuugauucuuucuuuacaucagugaaacuuuugagugcucugaagaaaaagggcguaagggcgacuggaaccauccgugagaaccggacagaaaaaugcccgcucaugaaugucgagcacaugaagaagaugaaacgaggcuauuucgacuuuagaauugaagagaacaaugaaauaauccuguguaggugguacggggauggaauuaucagcuuaugcuccaacgcaguggguauagagccuguuaaugaggugucuuguugcgacgccgauaacgaagagauuccacaaaucucgcagcccagcaucgucaagguguacgacgaauguaaagagggcguagcuaagauggaucagauuaucuccaaauaucgcgugcggauuagaucaaagaaaugguacaguauacugguuucuuauaugaucgacgucgccaugaacaaugcauggcagcuucauagggccugcaacccuggggcuagcuuggauccccucgacuuccgccgauucguggcccacuuuuaccuggaacacaaugcacaucuauccgauuga

SEQ ID NO: 60605 - RNA, 1575 nt, Artificial Sequence
  derived and/or modified sequence opt3 from PGBD5__Homo_sapiens__NP_001245240
auggccgagggcgggggaggugcuagaaggcgggcacccgcccugcucgaagcggcucgcgcccgauacgagagccuucacaucuccgacgauguguucggcgaaucugggccugacucaggaggcaacccauuuuauaguaccagcgcagccucccguucuucgucagcugcaagcagugaugacgagagagaaccgcccgguccuccaggggccgcucccccuccacccagggccccugaugcgcaggagccagaggaagacgaggcaggagccggcugguccgcugcccugcgggaucgcccgcccccuagauucgaagacacaggcgggccaacuaggaagaugcccccuucugcaagcgcugucgauuucuuccaauuguuuguuccagacaaugugcugaaaaacaugguagugcagacgaauauguacgccaagaaauuccaggagcgguuuggauccgauggugcgugggucgaggugaccuuaacagaaaugaaggccuuccuaggcuauaugauuucaacuucuauaagccauugcgagucuguucucuccaucuggucagggggauuuuacagcaaccgcagucuggcacuugugaugucucaggcucgauucgagaaaauucugaaguauuuucacgucguggccuucagauccagccaaaccacacauggcuuguacaagguacagcccuuucucgacucgcugcagaauaguuucgauuccgcuuucaggccgucacagacccaaguucugcacgaaccucucaucgacgaagaccccguguuuauugccacuuguacagagcgggaguuacguaaacgcaagaaaagaaaguucagucugugggucaggcagugcagcuccaccgguuuuaucauacagaucuaugugcaucuuaaagaagggggaggcccagauggcuuggacgcacugaagaacaagccucagcuacacucuaugguggcccggagccucugucgaaaugcugcggggaaaaacuacauuaucuucacgggacccucaauuaccagucugacucuuuuugaggaauuugagaagcaagguaucuacugcuguggccuguugcgcgcaagaaaauccgauugcacagggcucccacugagcauguuaacuaaucccgccaccccuccagcuaggggacaguaucagauaaagaugaaaggcaacaugucucugauuuguugguacaauaagggucacuuucgguuccucacaaacgccuauucaccgguccaacaggggguuaucauuaaacgcaagaguggcgaaauccccugcccucuugcaguggaggccuuugcugcccaucugagcuacaucuguagauaugacgauaaguacuccaaauauuucauuucucacaagccaaauaaaaccuggcagcagguauuuugguucgcaauaucgaucgcgauuaacaaugcuuacaucuuguacaagaugagcgacgccuaucaugugaaaagguacucccgugcacaauuuggagagcggcuaguccgagaacugcucggccuggaggaugccucacccacgcacuga

SEQ ID NO: 60606 - RNA, 948 nt, Artificial Sequence
  derived and/or modified sequence opt3 from PGC__Homo_sapiens__NP_001159896
augaaguggaugguggucguucuggugugccuccagcuucuggaggccgcuguagugaaaguccccuugaagaaauucaagagcaucagagaaaccaugaaagagaagggcuuacugggggaauuucuaaggacacacaaguacgacccugcauggaaauaucgguucggagaucucuccgugacuuacgagccaauggccuauauggacgcggcuuacuuuggugaaauuucuauaggcacgccgccccaaaacuuccugguucuuuuugauaccgggucaaguaaucugugggugccuagcgucuauugucagucccaggccugcacaucucauucgcgcuucaacccaucagagagcaguacuuacuccaccaauggacagacauuuucuuugcaauauggcagcgguucccucaccggguucuuuggauacgacacucugacagugcagucaauccagguacccaaccaggaguucggccugagugaaaaugagccuggcaccaacuuuguuuacgcacaauucgaugggauuaugggacucgccuauccagcuuuaagcguggacgaagcaacgacugccaugcaggguaugguccaggagggcgcucugaccucucccguguuuuccguguaccuuucaaauuugguccuggagagcagugggcuaggaccucuccugacaccaucucgagccgcgccgcccuccagcacucuucagcugccugaaaagccauuggagcaaaccuggaacauccucacacccuucaccaaaacgcugccuguuucgaauuuaucucguaaggugacuuccugggcaggcguagguauuccagugacaugucugcccgaagccgggucaggaggcgagagaagggcugaaugcggccucggggucccgaccacucggggaccuccccgcagucagcaccauagcggugccuga

SEQ ID NO: 60607 - RNA, 1386 nt, Artificial Sequence
  derived and/or modified sequence opt3 from PGD__Homo_sapiens__NP_001291380
auggcccaggcugacaucgcacugauuggccucgccgugauggggcaaaaccuuauacugaauaugaacgaucacggauucgucguuugcgcguuuaauagaaccgugagcaagguagacgauuucuuggcuaacgaggccaaagguacaaagguggucggcgcacaguccuuaaaagaaauggugucuaagcugaaaaagcccaggcggaucauucuacucguuaaggccgggcaggcuguggacgauuuuaucgagaaacugcgccgaugucgugaccuuaaggcaaaaggcauucuguucgucggaucaggugugagugggggagaagagggcgccagauacggcccuagcuugaugccagggggaaauaaggaggcuuggccgcauaucaaaacuauauuucaggguaucgccgcgaagguaggcacgggggaacccugcugugauuggguuggagacgagggcgcaggucacuucgugaagaugguccauaacgggauugaauauggagauaugcaacucaucugcgaggccuaccaccugaugaaagacgugcugggcauggcucaggaugaaauggcccaggcauuugaggacuggaauaagaccgagcucgauuccuucuuaauugaaaucacagcuaacauacugaaauuucaggacacugacggcaagcaucuuuugccuaaaauuagggauucugccgggcaaaagggaaccgguaaauggacagcgaucucggcccuggaguauggcgugccagucacccuaauuggggaagcaguuuucgcucggugucucucaagccugaaggacgagcgcauccaggccaguaagaaacuuaagggaccccagaaauuucaguucgauggcgacaagaaauccuuucuggaagauaucagaaaggcuuuguacgccucuaagauuauaagcuaugcacaagguuucaugcuccugaggcaggccgcuacugaguucggguggacauuaaauuacggcggaaucgcgcugauguggcggggcgggugcauuauccgcuccguguuucucggaaaaauaaaggacgcauucgaucgaaacccugagcuucagaaucuguugcuagacgacuuuuucaaaucagccguagaaaacugucaagauaguuggagaagggcugugagcaccgguguccaggccggcauuccaaugcccugcuuuacgacugcacugucuuucuaugauggguaccggcacgagaugcucccugccucccugauccaggcucagcgugacuacuuuggagcccacaccuaugaacuucuggcaaagccaggccaauucauccauacaaauuggacuggucacgggggcaccgugucaagcaguucuuacaacgcguga

SEQ ID NO: 60608 - RNA, 450 nt, Artificial Sequence
  derived and/or modified sequence opt3 from PGF__Homo_sapiens__NP_001193941
augcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagauguggcgaugcagugccaaggcgguga

SEQ ID NO: 60609 - RNA, 1134 nt, Artificial Sequence
  derived and/or modified sequence opt3 from PGGT1B__Homo_sapiens__NP_005014
auggccgcuaccgaggacgaaagacuggcaggcagcggggagggagaaaggcucgauuuccuucgggaccgccacgugcgauuuuuccagcguugccugcaagucuugcccgagagauacuccucuuuagaaacaucaaggcugacuaucgccuuuuucgcgcuaaguggucucgauaugcuggacagccuugauguugugaacaaggacgauauuauagaguggaucuauucccugcagguauugccuacggaggaccggucuaaucucaaccgcuguggcuuuagagggucgucauaccugggcauuccauucaauccgagcaaagcucccggaaccgcccauccuuaugauaguggucacaucgcaaugacauacacugggcuguccugccucgugauuuuaggagacgaucugucuagggucaacaaggaagccugucuugcuggcuugcgggcacugcagcuagaggacggcagcuuuugcgccgugccagaaggguccgagaaugauaugcgcuucguuuauugugcuucaugcaucuguuacaugcucaacaauuggaguggaauggacaugaaaaaggccauaaccuauauccgaagaagcaugucuuacgacaacggucuggcgcagggcgcagggcuugagucccauggaggcucaacauuuugcgguauugccagccuguguuugauggggaaacucgaagagguguucagugaaaaggagcugaauaggaucaagcgguggugcauuaugcgucaacagaacggauaccacggccgccccaauaaaccugucgauaccuguuauucuuuuugggugggcgcuacuuuaaagcugcucaaaaucuuccaguacacaaacuuugaaaagaauagaaacuauauacuuuccacccaggacaggcugguagggggauucgccaaauggccagauagccaucccgacgcauugcacgcuuacuucgguauuugcggccuaucgcugauggaggagucugggaucugcaagguucacccugcccucaauguguccacgcggacuucagaacgacugcuugaucugcaucaaaguuggaagaccaaagacagcaagcaguguuccgagaacguccacauuucuacauga

SEQ ID NO: 60610 - RNA, 1254 nt, Artificial Sequence
  derived and/or modified sequence opt3 from PGK1__Homo_sapiens__NP_000282
augagccuguccaacaagcucacccuugacaaacuggaugugaagggcaaaagagucguuaugaggguggacuucaauguacccaugaagaacaaucagaucacaaacaaucaacggauuaaagccgcugugccuucuauaaaguuuugcuuggauaacggggcaaagucagucguguuaaugagucaccugggacgcccagacgguguuccgaugcccgauaaauacagccuagagccuguggccgucgaacucaagucccugcuuggcaaagacgugcuguucuugaaggauuguguagggccagagguugaaaaagcgugcgcuaaucccgccgcaggaucugugauccuccuggagaaccugcgauuucaugucgaagaggagggcaaggguaaggacgccucggggaauaaagugaaggcugaaccugcaaaaauugaggccuuccgugcuucacucagcaaguuaggagauguguaugucaacgacgccuuuggcacugcgcacagagcacauaguuccaugguuggcgugaaucugccacagaaagccgggggauuccuuaugaagaaagaauugaacuacuuugcuaaggcccuggagucucccgagaggccuuuccuagcaauccucgguggcgcuaagguagccgauaaaauucagcugaucaauaacaugcuugacaaggugaaugaaaugauaaucgggggaggcauggcguuuacguuccugaaagucuugaacaacauggagauugguaccagccucuuugaugaagagggggccaagaucgugaaagaccugauguccaaggcagaaaagaauggaguuaaaauuacauuaccaguggacuucgucacugcugauaaguuugacgagaacgccaaaaccggccaggcuacaguggccucaggcaucccggcaggguggaugggacuggauuguggucccgagaguagcaagaaauaugccgaagcuguaacccgggcgaagcaaauaguuuggaauggcccugugggggucuucgagugggaagcauucgcccgcggaacuaaggcucucauggacgagguggucaaagccacaucuagaggcugcauuaccaucauuggugggggcgauacggcaacuuguugcgccaaguggaacaccgaagacaaagugucccacguuucaacaggaggcggggcuagccuugagcuguuggagggaaaggugcuaccagguguagaugcccugaguaauaucuga

SEQ ID NO: 60611 - RNA, 1254 nt, Artificial Sequence
  derived and/or modified sequence opt3 from PGK2__Homo_sapiens__NP_620061
augagccuguccaagaaacucacccuugacaagcuggaugugagaggcaaaagggucaucaugcggguugacuucaacgugcccaugaagaaaaaucagauuacaaacaaucaacgcauaaaggccucuaucccuucaauuaaguacugcuuggauaacggggcuaaagcaguaguguuaaugagucaccugggacgaccagacggugucccgaugcccgauaaguauagccuagccccuguggcgguugagcucaaaucccugcuuggcaaggacgugcuguuuuugaaagauugugucggggcugaaguggagaaggccugcgcaaauccagcccccggaucuguaauccuccuggaaaaccugcguuuccauguugaggaagagggcaagggucaggacccuucggggaaaaagauuaaagcugagccagauaagaucgaagcauuuagagccucacucagcaaauuaggagacguguacgucaaugaugcuuucggcacugcccacagggcgcauaguuccauggugggcgugaaccugccccacaaggcaucuggguuucuuaugaaaaaggaguuggacuauuucgccaaggcucuggaaaauccuguccggccauuucuagccauacucggaggugcaaaaguugcugauaagauccagcugauuaaaaacaugcuugacaaggugaaugagaugaucauuggcgggggaauggccuacacguuccugaaaguauugaacaauauggagaucggcgcgagccucuuugacgaagagggugccaagauagugaaggauauuauggcaaaagcucagaagaacgggguccgcaucaccuucccgguggacuuuguuacaggagauaaauucgacgaaaaugcccaagugggcaaggcuacugucgccuccggcauuucacccggguggaugggacuggauugugguccugagaguaacaaaaaccaugcacaggugguagcccaggcuagauuaaucguuuggaauggcccacuggggguguuugaaugggacgcguucgcaaagggaaccaaggcccucauggaugagaucgucaaagcuacaagcaagggcugcauuaccgugauaggugggggcgacacugccacauguugcgcaaaauggaacaccgaggauaaggucucucacguguccacgggaggcggggccucacuugaacuguuggagggaaaaauccuacccgguguugaagcucugagcaauauguga

SEQ ID NO: 60612 - RNA, 777 nt, Artificial Sequence
  derived and/or modified sequence opt3 from PGLS__Homo_sapiens__NP_036220
auggccgcucccgcaccuggccugaucagcguguucuccucuucacaggagcucggggccgcgcuugcucaacuggucgcccagagagcagccugcuguuuggcuggagcaagggcccgguuugcuuuaggucugaguggcgggagccuaguuuccaugcucgcccgcgaacugccagcggcaguggccccggcuggacccgccucucuugcacgauggacccugggcuucugcgacgagcguuugguaccuuuugaucacgcugaaucgacauacggucucuauagaacucaucugcugucaaggcucccaauucccgagagccaggugauaacgaucaacccugaauuaccagucgaggaggccgcggaagacuacgccaagaaacugcggcaggcauuccaaggggauaguauucccguguuugaccuuuugauccugggaguuggcccugauggccacaccuguucccuauucccagaccauccgcuccugcaggagcgcgaaaagauuguggcucccaucucugauagcccuaaaccacccccucagagagucacacuuacucugccaguguugaaugccgcuaggaccguaauauuuguugccacaggggagggaaaggcagccgugcucaaacggauccuggaggaccaggaagagaaccccuuaccggcugcgcugguccaaccucacaccgguaagcucugcugguuccuugaugaagcagccgcucgccuguugacugugcccuuugagaagcauuccacacuauga

SEQ ID NO: 60613 - RNA, 591 nt, Artificial Sequence
  derived and/or modified sequence opt3 from PGLYRP1__Homo_sapiens__NP_005082
augagcagaagguccaugcugcucgccugggcacuucccucucuguugcgguuaggcgcugcccaggagaccgaagacccugcgugcuguucaccaaucgugccgcgcaacgaguggaaggcucuggccagugaaugcgcacaacaccuaagccucccccugcgauacgucguugugucccauacagccgggucuucguguaauacuccugcuucaugccagcagcaggcacguaacguacaacacuaucauaugaaaacgcuuggauggugugauguggguuacaauuuccugauuggcgaggacggguuggucuaugaaggaagaggcuggaacuuuaccggugcccacagcgggcaucucuggaauccaaugaguauaggaaucuccuucaugggcaacuacauggauagggugcccacaccucaggcuauucgggccgcgcagggccugcuggcaugcgggguugcccagggagcucuccgcucuaauuauguguuaaagggucacagagacguccaaaggacucugagcccaggcaaccagcuuuaccacuugauccagaauuggccccauuaucgguccccuuga

SEQ ID NO: 60614 - RNA, 1731 nt, Artificial Sequence
  derived and/or modified sequence opt3 from PGLYRP2__Homo_sapiens__NP_443122
auggcccagggcgugcuguggauccuccuugggcuguuguuauggagcgaccccggaaccgcuucccugccucuacucauggauucugucauucaagcacuggccgagcuugaacagaagguuccagcggcuaaaacaagacacacugccucagcauggcugaugagugccccgaacagcgguccccauaauagguuguaccacuuccuccugggcgcuuggucccugaacgcaacggagcucgacccuugcccauuaucucccgaacugcuuggguugaccaaggagguggcccggcaugauguacgcgaaggaaaagaguauggcgugguccuggcuccugacgguucgacaguggccguugagccacuacucgcggggcuggaagcaggacuucagggccgacgugugauaaaucugcccuuggauucaauggccgcuccuugggagacuggcgacaccuuuccagaugucguggccaucgcaccggacguaagagcuacaagcagucccgggcucagggauggauccccugacguuaccacugccgauauuggugcgaacacaccagacgccaccaagggcugucccgaugugcaggcaucucugccugacgcuaaagccaagagcccacccacgauggucgacuccuuacuggcugugacucucgccgggaaucuuggacugaccuucuugcggggcucacaaacacagagucacccggaucuagguacugaagggugcugggaccagcugagcgcaccucgcaccuuuacacuccuggaucccaaggccucucuucugaccauggcuuucuugaacggagcgcucgacggcgugauccugggcgauuacuuauccagaacgccagagccuaggcccucacugagccaucuacucagucaguauuacggggcaggagucgcccgggacccagguuuucgcucuaauuuccgaagacaaaacggcgcugcccugacuuccgcaagcauucuugcccagcagguuugggggacauuggugcugcuccagaggcuggagcccguacaccuucaacugcaguguaugucgcaggaacaauuggcucagguggccgcaaaugcgaccaaagaguuuacugaggcuuuccucggaugcccugccauccacccacggugucguuggggcgcagccccguaucgcgguagacccaagcuguuacagcugccucuaggguuucucuacguccaucacacauaugugccagcucccccuugcaccgauuucacgaggugugccgcaaacaugcggucuaugcagcgauaccaucaagacacccagggcuggggagauauaggcuacuccuuuguuguggggucagacggauaugucuacgaaggucgcggcuggcacugggugggggcucacacacugggacauaauaguagaggcuucgguguagccaucguugggaacuauacugcggcccuuccaaccgaagcugcauugaggacagugcgggauacucugcccagcugcgccguccgcgcuggccuccugagaccggacuacgccuuacugggacacaggcagcuugugcguaccgacuguccuggcgaugcauuguuugaccuccugcggacauggccacauuucaccgcgacugucaaaccccgaccugccagauccgugucuaagaggagccgccgggagcccccaccuagaacgcuacccgcuacagaucugcaguga

SEQ ID NO: 60615 - RNA, 1026 nt, Artificial Sequence
  derived and/or modified sequence opt3 from PGLYRP3__Homo_sapiens__XP_011507421
augggcacccugcccuggcuccuugccuucuuuauccugggguugcaggcuugggacacaccuacuauugugagcagaaaggaguggggagcaaggccauuagccugccgggcgcugcuaacgcucccggucgcuuacauaaucaccgaucaacugcccgguaugcagugucagcagcaauccguuugcucucagaugcuucgcggccugcagucacacaguguguauacaauuggguggugugacguagccuacaacuucuuggugggagaugacggccgagucuaugaaggugugggguggaauauccagggacuccauacucaaggcuacaacaauauuagccugggcaucgcauuuuucgggaacaaaauaggauccucuccuucgccagccgcucugucagcagccgagggucucaucagcuaugcuauucagaagggccacuuaaguccccguuacauccagccucugcuuuugaaagaagagaccugccuggauccacagcaucccguuaugccuagaaagguguguccaaauauuaucaaaagguccgccugggaagcgcgggagacacacugcccgaagaugaaccuacccgcaaaguaugucauaauuauccauaccgccgggacuucuuguacagugagcaccgacugccaaacgguaguucgcaauauucaguccuuucacauggauacuagaaacuucugugacaucggauaccacuuucucgugggccaggaugguggggucuacgagggagugggcuggcauauccaaggcucacacaccuauggguucaaugacauugcucugggaauagccuuuaucgguuacuucguggaaaaaccuccaaacgcagcugcccuugaggcggcccaggaucugauucagugcgcagucguugaaggcuauuugacacccaauuaccuccugauggggcauagugacgugguaaacaucuuaagcccuggacaggcucuguauaauauaauuucuacuuggccacacuuuaagcacuga

SEQ ID NO: 60616 - RNA, 1122 nt, Artificial Sequence
  derived and/or modified sequence opt3 from PGLYRP4__Homo_sapiens__NP_065126
augcugcccuggcuccuuguguucagcgcccugggcauccaggcuuggggagacuccucuuggaacaagacccaagcaaaacaggucucagagggguugcaguacuuauuugaaaauauuagucagcugacagagaagggucuaccuacugauguuagcacgaccguguccagaaaagccuggggcgcggaagcuguagggugcucuauacaacucacaacuccagugaacguccuggugauccaccauguuccgggacuugagugucacgaccagaccgugugcucgcagaggcugcgggaauugcaggcccaucacguccauaauaacucaggcugugauguggcauauaauuuccucguaggugacgaugggcgcguuuacgagggagugggcuggaacauucaaggcguccacacacagggguauaauaacaucagccugggauuugccuucuuugguaccaagaaaggccacagucccuccccugcugcacugucugccauggagaaucucauuacuuacgcugugcagaaggggcauuuaagcuccucauaugugcagccacugcuuggaaagggcgaaaacugcuuggcgccccgacagaaaacaagucugaagaaagccuguccuggugucguuccacguagcguguggggagcaagagagacccacugccccaggaugacgcuaccugccaaguacgggaucauaauccauacugcuggccggaccuguaauauuucugacgaaugccgccuccugguaagagauauccaauccuucuauauugacaggcuuaaaucaugugauaucggcuacaacuuucugguggggcaggacggagccauauacgagggugucggcuggaaugugcaagggagcaguacaccaggauaugaugacauugcauugggcaucacuuucauggguaccuuuacagggauuccgcccaacgcugccgcgcucgaggccgcacaggaucugauccagugcgcuaugguuaagggcuacuuaaccccuaauuaucugcucgugggacacucugacgucgcccggacgcuuuccccaggccaggcucuguacaacaucauuagcacuuggccccacuucaagcauuga

SEQ ID NO: 60617 - RNA, 1701 nt, Artificial Sequence
  derived and/or modified sequence opt3 from PGM3__Homo_sapiens__NP_001186848
auggaccugggcgccaucaccaaguacagcgcucuccacgcaaaacccaacgggcuuauucugcaguauggaacagccgguuucagaacuaaggcggagcauuuggaucacgugauguuuaggaugggcuuacuggcuguccuacgguccaaacaaacgaagucuaccauagggguuauggugacagccucacauaauccugaagaggacaacggaguaaaacucguggauccacugggcgaaaugcuugcaccgaguugggaggaacacgccacuugccuggcuaaugcagaggagcaggacaugcagcgcgucuugaucgauauuagcgaaaaggaggccgugaaccuccagcaagacgcuuucguugugaucggucgagauacccgucccuccucugaaaagcugucgcagucagucauugacggggugacaguacugggaggccaguuucaugauuacggccucuuaaccacuccucagcugcacuauaugguuuacuguagaaauacagggggaagguaugguaaagccaccaucgagggcuacuaucaaaaacuuagcaaggcguucguggaguugacgaagcaggcaaguugcuccggggacgaauaccggucucugaaagucgauugugccaacggaauaggcgcucuaaagcuccgcgagauggaacacuacuuuagccagggucuguccgugcagcuuuucaaugacgggucaaagggaaaacugaaccauuugugcggcgccgauuuugugaagagucaccaaaaaccaccccagggcauggagaucaagagcaaugaaagauguugcucuuucgacggggacgcagauaggauugucuauuacuaucaugacgcugauggacacuuucaccucaucgacggugauaaaauugccacucugaucuccucauucuuaaaggagcugcucguugagauaggcgaaagccuuaacauuggggugguacagaccgcguacgccaauggaaguucuacacgguaucuggaggaagugaugaaagucccuguguacuguacuaagaccggcguuaagcauuugcaccauaaagcacaagaguuugacaucgguguguauuucgaagcuaacgggcacggcacagcccuauuuuccaccgcugucgagaugaagauuaaacagagcgccgagcagcuggaagauaagaaacgcaaggcagccaagaugcucgagaauaucaucgaccuguucaaccaggcugcgggagaugcaauuucggacaugcuugugauagaagccauccuggcuuugaaaggccucacgguacaacagugggaugcccuguacacugacuuaccaaaucgacagcugaagguucagguggcagacagaagggucauuucuacaaccgaugccgagcggcaagcugugacucccccugggcuacaggaagccaucaacgaccucgucaaaaaguacaaacugucccgugcauucgugcgcccaucaggaacagaggauguugugagaguauaugcggaggcugacagucaggaaagcgccgaucaucuugcacacgaggucuccuuggccguguuucagcuggcugguggcauaggggaaaggccgcaacccggauacaaggccgcagagaccacgcacaacauuaauaacgcuuucggcccugguaccgccaaugagcauacaguuccauga

SEQ ID NO: 60618 - RNA, 630 nt, Artificial Sequence
  derived and/or modified sequence opt3 from PGPEP1__Homo_sapiens__NP_060182
auggagcagcccagaaaggccguggucguuaccggcuucgggccuuuuggagaacacacagugaacgcuagcuggaucgcaguacaagagcuggaaaaacucggucuuggcgacuccguggaucugcaugucuacgagauuccaguggaauaucagacuguucagagguugauaccggccuuaugggagaagcacucuccccagcuggugguccauguggggguaucaggaauggcgacgaccguuacacuagagaaaugcggccacaauaaggguuacaaagggcucgacaacugucgguucugcccuggaagucaauguugcguggaagauggcccagagagcaucgacuccauuaucgauauggacgcugucuguaagcgcgugacuacccugggccuugaugugucugucacaauuucgcaggacgccgggcgauaucugugcgauuuuaccuacuauacuucauuguaccagagccauggacguagugcauucguucacgugcccccucucgguaagccauauaaugccgaccagcugggcagagcucugagggcaaucauagaagagaugcucgauuuacuggagcaauccgaagggaaaaucaacuacugucacaagcauuga

SEQ ID NO: 60619 - RNA, 966 nt, Artificial Sequence
  derived and/or modified sequence opt3 from PGP__Homo_sapiens__NP_001035830
auggccgcugcagaggccggcggggacgaugcgagaugcgugaggcugagcgcugaacgggcccaggcacuccuugccgacgucgauacccuguuguucgacugugauggaguuuuauggcgcggugagacagcugugcccggcgcaccugaagcccugcgagcucuacgugccagagggaagaggcucggauuuaucacuaacaauuccucuaaaacgcgggcggcauacgccgagaagcugcgcagacuuggcuucggugggccagcuggaccgggcgccucacuggaaguauuuggcaccgcauauugcacagcuuuguaccucaggcaacggcuggccggggcgcccgccccuaaagcauaugugcugggaaguccagcucucgccgcugaguuagaggccgucgguguggcaagcguuggcguggggcccgaaccucugcagggagagggcccaggugacuggcuucacgcccccuuggaaccugauguccgcgcugugguaguuggguucgacccacauuuuuccuacaugaagcugacuaaagcgcuacgauaucuccagcagccgggaugucugcuugugggcaccaacauggauaauagacugcccuuggagaacggcagguucauugcagggacaggaugccucguccgggccguggagauggcugcccaacgucaggcagacauaaucgguaagccuucucgcuuuauuuucgauugugugucgcaggaauacggcaucaauccagagagaaccgucaugguuggggacaggcuggauacugacauuuuacugggagccacaugcggccucaagaccauccuuacgcugacuggugugucaaccuugggggacgugaaaaacaaucaggaaagcgauuguguaaguaagaaaaagaugguccccgacuuuuauguggauuccauagcugaccuacugccugcccuccaaggcuga

SEQ ID NO: 60620 - RNA, 2802 nt, Artificial Sequence
  derived and/or modified sequence opt3 from PGR__Homo_sapiens__NP_000917
augaccgagcugaaggccaaaggccccagagcuccucacguggcagggggaccaccgagccccgaagucgguuccccucuccuuugcaggccagccgcgggccccuucccugggucucagacaucagacacucugccagagguuagugcuauccccauuagcuuggauggauuacuguuuccucggccaugucaaggccaggacccguccgaugaaaagacgcaggaccagcaaucucuaucggauguggagggugccuacucacgcgcagaagccacccgaggggcuggaggcagcaguuccucucccccugagaaagacagcggccuccuggauuccguacuugacacacuguuggcaccaucagggcccggacagagucagccuagcccacccgccugcgaggugacuucuuccuggugucucuucgguccggaacugccugaggaucccccagcugccccugcgacccagcguguccugucaccccucaugagcagaaguggcugcaaggugggggacucuuccggaacagcagccgcucauaaaguuuuaccaaggggccugagccccgcccggcaacuuuugcugccugcaucggaaucuccacacugguccggugcuccggugaagcccucaccucaggccgcggccgucgagguggaggaagaggaugggagugaaagcgaggaauccgcaggaccacuacucaagggcaaaccccgcgcucugggcggggccgcugccggagguggcgcagccgcuguaccuccaggggcggcagccggaggcguugcucuugugcccaaggaggacucuagauuuagcgccccgagggucgcacugguggagcaggaugccccuauggcuccaggucggucacccuuggccaccacugugauggacuucauacaugucccuauccucccccugaaccacgcauuacuggcggcucgcacacgacagcuccuugaagacgagaguuaugaugggggcgccggagcagccuccgcuuuugccccaccuagaagcucucccugugcaucaaguaccccaguugcugugggcgacuucccggauugcgccuacccucccgacgcggaaccaaaagaugacgccuauccccuguacagcgauuuucaaccuccagcuuugaagauuaaagaggaagaggagggggcagaagccuccgcuaggucuccccggucguaucuaguagccggagcaaauccugcggccuucccggacuuuccacugggucccccuccaccccucccuccgcgugcuacgcccagccgcccaggcgaggccgcagugacugcugccccugcauccgccucagucaguucugcuagcuccucagggagcacccuggaauguauccuuuacaaggcggagggagccccaccccagcagggcccuuucgcacccccaccgugcaaggcuccuggugccucugggugucuguugcccagagauggccucccauccacaagugccagcgcugcagccgcgggagcugcccccgcacuguauccugccuuaggccugaacgggcuaccacaacucggauaccaggcugcagugcugaaagaaggucuuccccagguuuacccuccguauuugaauuaccugaggccagacucugaggccucccagucaccccaauauaguuuugagagccucccucagaagauuugccugaucuguggcgaugaagcgucggggugccauuacggagugcuuacuugcggcuccuguaaagucuucuuuaagcgggcuauggagggucagcacaacuaucugugcgccgggcgaaaugacuguauaguggacaaaauccgcagaaagaacugccccgcauguagguugcggaaaugcugucaggccggcaugguacucggaggccgcaaguucaagaaauucaauaagguuagaguggucagggcucuggaugccguggcauuaccacaaccugucggggugcccaacgaaucucaggcucugagccagcguuuuaccuucucaccaggacaggacauucaacuaaucccuccgcucauuaaucugcuuaugaguaucgagcccgauguuauauacgccggccacgacaacacaaaaccagauaccuccucuagcuugcugacgucccucaaucagcugggugagcggcaguuacugucagugguaaaguggagcaaaagucuuccuggguuucgaaacuugcauauugacgaucagaucacucucauucaauauucuuggaugucccugauggucuucggacuaggcuggagaagcuacaagcacgugucgggucagaugcuguacuuugcgcccgaccucauccugaaugaacagaggaugaaggagucaucuuucuauagucuuugcuugacaauguggcaaaucccacaggaauuuguuaaauuacaggugucccaggaggaguuccuguguaugaagguccuccugcuucugaacaccauuccuuuggaaggccuccgcagccaaacucaguuugaggaaaugcggucuagcuacauaagagagcugaucaaagccauugggcuaaggcagaagggagugguauccucaagucagcgcuucuaucaacugacaaaacuccuggauaaucuucaugacuuggugaagcagcugcacuuauacugccucaacaccuuuauccagagccgagcacugucuguugaguuccccgaaaugauguccgaagucauagcugcccagcuuccgaagauucuggcuggcauggugaaaccacuacucuuucacaagaaauga

SEQ ID NO: 60621 - RNA, 432 nt, Artificial Sequence
  derived and/or modified sequence opt3 from PGRMC1__Homo_sapiens__NP_001269550
auggccgcugaggacguggucgcaaccggcgccgaucccagcgaccuggaauccgggggacuccuucacgagaucuucacaucuccucugaacuuguuacugcuaggucucugcauuuuucugcuuuacaagauaguuagaggcgaucagccagcggcuucaggggacagugaugacgaugaaccgcccccucugccaagguugaaacggcgcgacuucacucccgccgagcuccgacguuuugauggagugcaagacccuagaauccugauggcaauuaauggcaagguauucgaugugacgaaagguaggaaguuuuaugggccagucaaauaccaucacgugggaaagcugcucaaggaaggcgaggagcccaccguuuauagcgacgaagaggaaccuaaagaugaguccgcccggaagaacgacuga

SEQ ID NO: 60622 - RNA, 744 nt, Artificial Sequence
  derived and/or modified sequence opt3 from PGRMC2__Homo_sapiens__NP_006311
augggcggggccggaagaggugugggcgaggggaggggacggggcggugggggacgccgauggcgugcugucauggcagccggcgacggcgauguuaagcuggggacccucggaagcgguuccgaaucuucaaacgacggcgggagugagagccccggagaugcgggcgcugccgcagaaggugggggaugggccgcugcagcccuugcucuguugacaggcggcggggagauguuacugaauguggcccuaguagcgcucgugcugcuuggagcauacagacugugggucagguggggucggcgcggcuugggggccggagcuggcgccggugaagaguccccugcaacuucucucccaagaaugaaaaagagggacuucucgcuggagcagcugcggcaauaugaugggucacgcaacccgcgaauccucuuagcugugaauggcaaaguuuuugacgugacgaagggaagcaaauucuacggccccgccgggccuuauggaauuuuugcggguagagaugccaguaggggccuggcaaccuucugccuugacaaggaugcuuugcgggacgaauacgaugaccuguccgaucuaaacgccguccagauggagucugugcgugaaugggagaugcaguuuaaggagaaauaugacuacguagggcgccuccugaagccaggagaggaacccagcgaauauacagacgaggaagauacuaaagaccacaauaagcaggauuga

SEQ ID NO: 60623 - RNA, 1743 nt, Artificial Sequence
  derived and/or modified sequence opt3 from PHACTR1__Homo_sapiens__NP_001229577
auggacuaccccaagauggauuauuuccuggacguggagagcgcccacagacuccuugaugucgaauccgcucagagguuuuucuacucucaaggcgcacaggcccggcgcgcgacccuguuguuaccuccaacacugauggcugccucaagugaggacgauaucgaccgacguccgauuagaaggguucggagcaaauccgauacucccuaucuagcagaagcccgcauaucuuuuaaccucggggcugcagaggaaguggagagacuggccgcuaugaggucggacucacuuguaccuggaacgcauaccccacccauccggcgccgaagcaaguucgccaaucuggguagaauuuuuaaaccuuggaaguggaggaaaaagaagagugagaaauucaagcacacauccgcggcauuggaacggaaaaucucuaugcgucagagccgcgaggaacucauuaagagaggcgugcugaaagagaucuacgauaaggacggggagcuguccauaucaaacgaagaggauagucucgaaaauggacagagcuuaucuuccucacaacugagccuuccagccuugagugagauggaacccgucccuaugccaagggacccgugcucuuaugaggugcugcagcccuccgauaucauggacggcccugacccaggugcucccguuaagcuaccuugucucccagugaaacugucgcccccgcuuccucccaagaaagucaugauuugcaugccaguagggggaccugaucugagcuuggugucuuacacugcccagaaguccggccagcaaggcguugcacagcaucaccauaccgugcuccccucacagauccagcaccaacugcaguaugggagucacggacagcauuuaccaagcacaaccgguucccugcccaugcacccuucuggcugucggaugauugacgagcucaacaaaacucuugcuaugacaaugcaacgacuggaaagcucagagcagcgcgucccaugcaguaccuccuaccauagcucuggguugcacucaggagauggcgugacgaaggccgguccgauggggcuacccgaaaucagacaggugccuacugucguuauagagugugacgauaauaaagaaaacgugccacacgagagugacuacgaggauagcuccugccuguauaccagggaagaggaagaggaagaggaggacgaagaugacgauucuucgcucuacacaagcucccuggcgaugaagguaugucggaaggacucacuugccauuaaacugaguaaucgccccucuaagagagaguuggaagagaaaaacauccucccuaggcagacugacgaggaacgucuggaguuacggcaacagauuggaaccaagcugacacgaagacuaagccagaggccaaccgcagaagaacucgaacagcgcaauauccugaaaccccggaacgagcaagaggaacaggaggaaaagagagagaucaagaggcgccuuacgcgaaaauugucccagcggccgacuguggaggagcugcgugagagaaagauucucauaagguuuucagauuaugucgaaguggcugacgcccaggauuacgaccgccgggcugauaaaccuuggacaagacugaccgccgcagacaaggccgcuaucaggaaagagcuuaaugaguucaagagcacugaaauggaaguucaugagcugucucgacacuugacacgcuuucaucggccauga

SEQ ID NO: 60624 - RNA, 1938 nt, Artificial Sequence
  derived and/or modified sequence opt3 from PHACTR2__Homo_sapiens__NP_001093634
augggccagaccagcguguccacacugucuccccaaccugggucagucgacggacucgauaaggccaguaucgcuaacagcgacgguccaacugcaggcucccagacgccgcccuucaaaagaaaggggaaacuuucuaccauuggaaagauauuuaaaccuuggaaguggaggaagaaaaagacaucggauaaauuccgggagacuucagccguucuggaacgcaagaucagcacccgacagagucgugaggaauugauuagaaggggcguguuaaaagagcugccagaccaggauggugacguaacagugaauuuugaaaacuccaaugggcacaugauccccauuggagaggagucuacccgggaagagaacgucgucaagagcgaagagggcaauggcuccguuucagagaagacuccuccacuagaagaacaagcggaagauaaaaaggagaacacagaaaaucauagugagacccccgcugccccugcacucccaccgagcgcucccccuaaaccacgccccaagccuaaaccaaagaaaucucccgugccgccuaagggggccacggcaggagccucccacaagggugacgaggugcccccaaucaaaaagaacacuaaagcuccuggcaagcaggcccccgugccacccccuaaaccagcgucaagaaauaccacaagggaagcagccgggagcagucauucuaagaagacuaccggauccaaagcuagcgccucgccgucuacauccucaaccaguagccggcccaaggcauccaaagagacgguaucuagcaaggcuggcacuguugguacaaccaaagggaagcgcaagacugauaaacagccuauaacaucacaccugaguuccgacaccacgaccagcggaacaucugaucuuaagggcgaaccagccgagacucgaguggaaucauucaaacuggagcagaccguccccggcgcggaggaacaaaacacagggaaguuuaaaaguauggugccuccacccccgguggccccugcaccaagccccuuggcuccuccccucccacuggaggaccagugcaucacugccuccgauaccccugucguucuggugucuguaggagcugaccuccccgugucggccuuagacccaagccagcugcuuugggcagaggagccgacaaauagaaccacuuuguacuccgguacgggccugucagucaacagggaaaaugccaaguguuucacaaccaaggaggagcuagggaaaacugugccucagcuccugacccccggacuuaugggcgaaaguucugagagcuuuuccgcuucagaagaugagggucaucgggaguaucaagcgaacgacagcgauucugacgggccaauucuguacacagaugacgaagaugaggacgaagaugaggacggcuccggagaaagugcauuggccagcaagauccgucgcagagauacccucgcuauuaaacugggcaauaggcccucuaagaaagaguuagaggacaagaacauccugcagcggacuuccgaagaggaacgacaggagauacgccaacagauugggacaaaacucguuagaaggcuuucacagcggccuacgaccgaggaacuggagcagcgcaacaucuugaagcaaaagaaugaagaggaggaacaggaagccaaaauggagcuaaagagaaggcugagucguaaacucagccugcggccaacuguggcagagcuucaggcccgaaggauucugagauucaacgaauaugucgaggugacagacucgcccgauuacgaccgccgggcugauaagccuugggccagauugaccccggcagacaaagcggcuaucaggaaggaacucaaugaguuuaaguccacagagauggaaguacacgaggaaucucgccaguucacucgauuucaccggccauga

SEQ ID NO: 60625 - RNA, 1671 nt, Artificial Sequence
  derived and/or modified sequence opt3 from PHACTR3__Homo_sapiens__NP_001186434
augagaggcaggggagggggucgggcccgcugccccgcuccucugcgaagccuccuuggcgcauucggggcccgugacgcggcugccgcagccagagauccagcucaggacgagauggaucaaaccccgcccgcaaggccugaauaccugguguccggaauccggacaccacccguccgcagaaacucuaaguuggccacuuuaggcaggauuuuuaaaccuuggaaguggcggaaaaagaaaaaugagaagcugaagcagacgaccucagcucuagagaaaaagauggccggucgccaggggcgagaggaacucaucaaaaagggacugcuugagaugauggagcaggacgcggaaaguaaaacauguaacccagauggcggccccagaagcguucaauccgagccuccaacuccgaagucugaaacccugacaucggaggacgcacagcccgggucaccuuuggccaccggaacugaucaggugagccucgacaagccacugaguuccgcugcccaccuggaugacgcagcuaaaaugcccucugccagcuccggugaggaagcggaugccggcucacucuuaccuacaaccaaugagcugagucaggcacuugcuggggccgacagcuuggauucuccacccaggccgcuggaacgguccguaggacaacuaccuucacccccacuccugccuacgcccccacccaaggcuagcaguaaaacuaccaagaacgugacaggccaggccacucuuuuccaggcaucuuccaugaaaagcgccgacccuucgcugcguggucaguugucuaccccaacaggguccccgcaucucaccacgguccaccgcccccugccuccaucaagagugauagaggaauuacauagggcucuggcgacuaagcaccggcaagacaguuuucagggacgagagagcaaaggcucccccaagaagcgccucgauguuagacuuucuaggacaagcucaguggagcggggcaaagaacgcgaggaagcauggaguuucgacggggcccuggagaauaagagaaccgcugccaaagaauccgaggagaacaaggaaaauuugauuaucaacagcgagcuaaaagaugaccugcuccuguaucaggaugaagaggcacuuaaugacucuauuaucucaggaacucugccuaggaagugcaagaaagaauugcucgccgucaagcugcguaaccggccaaguaaacaagaguuagaggaucgaaauauauuucccagaaggacagacgaagaacgccaggaaauccggcagcagauugagaugaagcugagcaaaagacuaucccaaaggccggcuguggaggaacucgagcgccgaaacauccugaagcagcggaaugaucagaccgaacaggaggaacguagagagauuaagcaaaggcuuacgcgcaaauugaaccagcggccuaccguagacgagcugagagauaggaagauccucauacgauucucugacuacguugaaguggccaaagcacaggacuaugaucgccgggcggacaagccauggacaagacugucggcugccgauaaagcagccauuaggaaggagcuuaaugaauacaagagcaacgagauggaaguccaugcuuccucaaaacaccugacucguuuucaccgccccuga

SEQ ID NO: 60626 - RNA, 900 nt, Artificial Sequence
  derived and/or modified sequence opt3 from PHB2__Homo_sapiens__NP_001138303
auggcccagaaccugaaggaccucgcuggaagacuucccgcagggccuaggggaauggguaccgcccugaaauuguuacugggcgcgggggcuguggccuacggaguccgggagagcguuuucacaguggaaggcggucaccgcgcaaucuuuuucaaucgaauugggggaguacaacaggauacuauacuagccgagggccuccauuuucguaucccaugguuccaguauccgauuaucuacgacauuagagcuaggccccggaagaucuccucuccuacgggcucaaaagaucugcagauggugaacauaagucuucgcguccugagcagaccaaaugcacaagaauugcccuccauguaucagaggcucgggcuggacuacgaggaacgggugcugccuucuaucguuaacgaggugcucaagucggucguggccaaauuuaaugcuucacaguuaauuacccagcgcgcccaaguaagccugcuuauccgaagagaguugacagaaagggcgaaggauuucagucugauucuagacgauguugcaaucacugagcucuccuuuucucgggaauauaccgccgcuguggaggccaagcaggucgcacagcaggaggcucaacgugcccaguuccugguggaaaaagcgaagcaggagcaacgccagaaaauagugcaggccgaaggagaggcagaagcugccaagaugcuuggugaggcucugagcaaaaacccaggcuacauuaaguugagaaagaucagggccgcacagaauauuuccaaaacaaucgccaccucacaaaaccggaucuaucucacugcugacaaucuggucuuaaaccugcaggaugagaguuuuacacgagggagcgacucucucauuaagggcaaaaaguga

SEQ ID NO: 60627 - RNA, 468 nt, Artificial Sequence
  derived and/or modified sequence opt3 from PHB__Homo_sapiens__NP_001268426
auggccgcuaagguguucgagagcaucggcaaauuugggcuggcacucgccgucgcgggagguguugugaacuccgcucuuuacaauguagacgccggccacagagcagugauuuucgauagguuucgcgggguccaggacauagugguuggagaaggcacccauuuccugauccccugggugcaaaagccuauuaucuuugauugccggucucgaccacguaacgucccggugauuacagguucaaaagacuugcagaauguaaacaucacuuuaagaauacuguucaggcccguugccagucagcuaccucggaucuuuacgagcauuggggaggauuaugacgaacgcgugcucccauccaucaccacagagauucugaagucugucguggcuagauucgaugcaggagaacuuaucacuuaccugcccgccggccagucgguguugcuccaacugccucaguga

SEQ ID NO: 60628 - RNA, 3015 nt, Artificial Sequence
  derived and/or modified sequence opt3 from PHC1__Homo_sapiens__NP_004417
auggagaccgaaagcgagcagaacuccaauucuacaaacggcucaaguagcuccgggggaucuucgagaccccaaaucgcccagaugucacuguacgaaaggcaggcugugcaggcacuccaagcccuucagcggcagccuaaugcggcucaguauuuccaccaauuuaugcugcagcagcaguugagcaacgcccaauuacauagucuggcagccguccagcaggcuacuauugcagccucccgccaagccucuagcccaaauacguccaccacacagcagcagacuaccacaacccaagccucaauaaaccuagcgacuacaagugcagcccagcucaucagccgaucucaguccguuucaagcccgagugcuaccacgcugacucagucugugcuucuggguaauaccacauccccucccuugaaccaaagccaggcccagauguaccuccguccacagcugggcaaucugcuccaaguaaacagaacuuuagggaggaaugugccccuggcaucgcagcuuauuuugaugccuaacggagcugucgccgcggugcagcaggagguuccaucugcccaaucccccggcgugcacgcagacgcugaucagguccagaaucuggccgugcggaaccaacaggcuucagcccaggguccucagaugcaagggaguacccagaaggcaaucccaccgggagccagccccguauccucucuaagccaggcuucaagucaggcgcucgcaguugcccaggcuuccagcggcgccacaaaucagucucugaaccuuucacaggcaggcgggggaagugguaacagcauuccuggcuccauggggccaggaggcggugggcaggcccauggaggccugggccaauugcccucuucggggaugggagguggcagcugcccucgcaaagggaccggagugguccagccacuccccgcugcccagacggugacugugucccaaggcucacagacagaagcagagagugcggcugccaagaaagcagaggccgacgguucugggcagcagaaugucggcaugaaccugaccagaacugcuacaccggccccuagccaaaccuuaaucuccucagcaacguauacccagauacagccccacagccugauccagcaacagcagcagauucaucuccaacagaagcagguugugauccagcaacagauugcuauccaccaccagcaacaguuccagcauaggcagucucaacuucugcacacagccacucauuugcagcuagcgcagcagcaacagcagcagcaacagcagcaacagcagcagcaacagccacaggccaccacacugacugcuccucagcccccacaaguacccccuacccaacaggugccaccgucccagagucaacagcaggcacagacacucgucgugcaacccaugcugcagagcucuccucuuucccugccacccgaugccgcuccuaaaccacccauaccgauucagucaaagccuccaguugcccccaucaagccuccccaauugggagcagcgaaaaugagugccgcucagcagccaccuccccacauuccagugcaggucgugggcacccggcaaccggggacugcccaggcacaggcucucggacuggcccaguuagcagccgcuguaccuacgagccgcgguaugcccggcacaguucaaucggggcaggcgcaccuggccuccucuccacccagcucacaggcaccuggagcucuacaggaauguccacccacccucgccccuggcaugacucuggccccggugcaagguaccgcucaugucgugaaagggggcgcaacaaccaguuccccagucguggcccagguucccgcggcuuuuuacaugcagucugugcaccuuccuggaaagccacaaacuuuggccguaaagcgaaaagcagacagcgaggaagagagagaugacgucuccacacugggcucaaugcuccccgccaaggcuagcccuguggcagagaguccgaagguuauggaugaaaaaucuucccugggggagaaggccgaaagcguggcgaaugucaacgcuaauacgcccucgucagagcuuguggcccugaccccagcaccuucuguacccccaccuacuuuggccauggugaguaggcagaugggagacuccaaacccccacaggcuaucguuaagccgcagauccucacacauauuauagaagguuucgucauccaagagggcgccgagccuuuucccguggggugcagccagcuguuaaaagaaucugagaagccacugcagaccggacuacccacaggccucacugaaaaccagagcggugggccucugggcguggauuccccaucagcagagcuugacaaaaaggcuaauuugcugaagugugaauauugcggaaaauacgcccccgcggagcaauuccggggcaguaagcguuuuuguagcaugaccugcgccaaacgcuauaacgucucuuguucccaccaguucagacucaagaggaaaaagaugaaggaguuucaggaagcaaauuacgcucggguucgacgcagagggccuaggcggucaaguagcgauauugcccgcgcuaaaauccagggaaagugccauagaggccaagaggacuccucuagggguucggauaacagcucauacgacgaagcacuguccccgacgaguccagggcccuuaucugugcgugccggacacggcgagcgggaccuggguaauccuaacaccgcucccccaacaccugaacuucacggcauaaaucccguguucuugagcuccaacccaucacgauggucuguagaggaggucuaugaauuuauugcuagccuccaggggugucaggagaucgcggaagaguucagaagucaagagaucgauggacaggcacugcuacugcucaaagaggaacaucugauguccgccaugaauauuaaacuuggcccugcuuugaagaucugcgccaagauuaacgugcugaaggaaacuuga

SEQ ID NO: 60629 - RNA, 861 nt, Artificial Sequence
  derived and/or modified sequence opt3 from PHC2__Homo_sapiens__XP_011539177
augaccagcggcaacggaaauuccgccucuucaaucgcugggacagcaccccagaacggugagaauaagccuccacaagccauugugaaaccgcagauacugacucacgucaucgaaggcuucguuauucaggagggggcggaacccuuuccugugggaagaaguagccuccuuguaggcaaccugaagaaaaaguacgcucaggguuucuugccagagaaauuaccccaacaggaccauacgaccacaacugauuccgaaauggaggagccuuaucugcaggaaucuaaggaggaaggggccccacuaaagcucaaaugcgagcuguguggaaggguggacuuugcauacaaguucaaacggucgaagcgcuuuugcucaauggccugugcuaaacgauauaaugucggcugcaccaagcgugugggccuuuuccacagcgauagaaguaagcugcagaaagcaggggccgcuacacauaacaggcggcgcgccuccaaggcgucuuugcccccucucaccaaagacacuaagaaacaaccaacaggaaccguuccgcugagcgugacggcagcccugcagcucacucacucccaggaggauucaaguagauguagcgacaauucuuccuacgaggaacccuuaucaccuaucagcgcuaguucuuccaccagcaggcggcgccagggucaacgagaucuggaacuuccagacaugcauaugagagauuuggucggcauggggcaccacuuucugcccucggagccuacaaaguggaacguggaagacguauaugaguucauuaggucucuaccagaguacccccaucggcaccagaucccggauucccucguuccuuga

SEQ ID NO: 60630 - RNA, 2988 nt, Artificial Sequence
  derived and/or modified sequence opt3 from PHC3__Homo_sapiens__NP_079223
auggccgaggcugaguucaaggaccacagcaccgcaauggauacagagcccaacccuggcacuuccucugugucaacgaccacaaguagcacuaccacaaccacuaucacaaccuccucuucgagaaugcagcaaccacagauuucagucuacagcgggagugacaggcaugccguucaggugauacagcaagcgcugcaccggccgcccuccucugcugcccaguaucuccagcagauguacgcagcccaacagcagcaucuuaugcugcacacggcugcauugcagcaacagcauuuaagcuccucacagcugcaaagucuagccgcuguacaggccagccucucuuccggacgcccuucaacuagcccaaccgguagugugacacagcagucuuccaugagccaaacuucgaucaaucugucuaccucccccaccccugcgcagcuuauuucacgaagucaggcaagcuccucuacaagcggcucaaucacgcagcaaacuaugcuguuggggaguacauccccaacccucacugccagccaggcucagauguaucugcgugcccagaugcugauuuuuacacccgcaaccacggucgcugccgugcaaucugauaucccuguugugucaaguagcuccucuucgagcugccaguccgcggccacccagguccagaaccucacauuaagaucacaaaaacugggagugcuuaguucuagccagaauggcccaccgaaguccacuucacagacccaaagccuuacaauaugucacaacaaaacuaccguaacaucuuccaagaucagucagagggaccccagcccugaaucuaauaaaaagggugaguccccaucacuggaaagucggagcaccgcaguuacucgcacgucguccauucaccagcuaaucgcucccgccucuuacagcccuauucagccacauucacucaucaagcaccaacagauaccccugcauaguccgccuuccaaagugucucaccaccagcuuauucugcagcaacagcagcagcaaauccagcccauuacauugcagaacagcacccaagauccaccucccucccagcauugcaucccacuccagaaucacgggcugcccccugcuccaucaaacgcccagagccaacauuguaguccgauccagucucaccccuccccuuuaacugucagcccaaaucagucgcagucagcacaacagucugugguggucagucccccuccaccccauuccccgagccagucuccuaccauuauaauccacccacaggcccugauucaaccccacccucucguuagcuccgcuuugcagcccggaccaaaccugcagcagucaacagcgaaucaagugcaggcaaccgcccaguugaaccuaccuagucaucugccccucccagcuagcccgguagugcacaucggcccuguccaacagucugcccuggugucccccggccagcagauaguuucaccaagucaucaacaguauagcucccuucagucuucgcccauuccuaucgcaagcccaccccagaugucaacuuccccuccggcccaaaucccaccccugccuuugcagaguaugcagucucuccaggugcaaccagagauucugagccaggggcaggucuuagugcaaaaugcucugguauccgaggaagaacuacccgccgcagaagcgcucguucagcugccuuuccagacacuuccgcccccacagacgguggcugucaacuugcaagugcagccucccgccccagucgacccucccgugguuuaccagguggaggauguaugcgaggaagagaugccagaagagucagacgaaugugucagaauggauaggaccccgccucccccaacucugucucccgcagccaucacagugggacggggugaggaccucaccagcgagcacccucugcuugaacagguugagcugccagcuguggccagugucuccgcaagcgugauuaagucucccucagauccuucccacguaagugugccgccacccccuuugcuccugcccgcugccacaacucgcagcaauucgaccucuaugcauuccagcauaccaucaaucgaaaacaaaccuccccaagcgauuguuaagccacagaucuuaacgcacgucaucgagggcuuugugauucaggaagggcuggagccuuucccggugagucgaucuucccuacucauagagcagcccgucaaaaagagaccacugcuugacaaccaaguuaucaauagcgugugcgugcagccugaauugcagaacaauaccaagcaugccgauaacucaagugacacagagauggaagacaugauugcugaggaaacucuggaggagauggauagcgaacuccugaaaugugaguuuugcggaaagaugggcuaugcaaaugaguucuuaagguccaaacgguuuuguaccaugucuugcgccaagcguuacaacguaagcuguuccaaaaaguucgcucugucacgcuggaauagaaaacccgacaaccagucucuuggucacagggggcggcgaccaaguggaccugauggcgccgcacgcgaacauaucuugagacaacuccccauuacauacccgucggcggaggaagaccuggccagccacgaggauuccgucccaucugcuaugacuaccaggcuacggcgccagucagaaagagagagggaacgugagcugcgggacgugcgaaucagaaagaugccugagaauagcgaucuccugcccguugcccagacggaaccauccauauggacaguggacgaugucugggcauuuauccacagucuucccggcugccaagacauugcugaugaguucagggcccaggaaaucgacgggcaggcauugcuguuacucaaggaggaccaucugaugucugccaugaacauuaaacuuggaccugcucugaagaucugcgcgcgcauaaauagcuugaaagaaucauga

SEQ ID NO: 60631 - RNA, 2250 nt, Artificial Sequence
  derived and/or modified sequence opt3 from PHEX__Homo_sapiens__NP_000435
auggaagccgaaaccggcagcuccguggagacagggaagaaagcuaacagaggaacuaggaucgcacuggucguuuucguggguggcacgcucguacuugggaccauucuguuuuuggugucucagggauuacugucacuacaagccaagcaggaauacugccucaaacccgaguguauagaagcggcugccgcaauccugaguaaggucaaucuuagcguggacccuugcgauaacuucuuucgguucgccugugacggcuggauuuccaauaacccaaucccggaggauaugcccucuuaugguguuuacccuuggcugcgccacaauguggacuugaaacucaaggagcugcuggaaaagucgauuucacgacguagagauacagaggcuauccagaaagcaaagauacucuauagcaguugcaugaacgaaaaagccaucgagaaggcugacgccaaaccauuacugcauauucuuaggcacucccccuuucgguggccugucuuggagucuaauaucgggccagaaggaguguggagcgagcgcaaguucucccugcuacagacucucgcgaccuuuagaggccaauacucaaacaguguauucauuaggcuguauguuagccccgaugacaaggcaucuaaugaacauauccuuaaacuggaucaggccacauugucccucgcugugcgggaggacuaccuggauaacucaaccgaagccaagagcuaucgcgacgcauuauacaaauuuauggucgauacugcugugcugcucggcgccaauaguucucgagcggagcacgacaugaaguccgugcuuagacuggagauaaaaauugccgaaaucaugauuccucaugagaacaggacaagcgaagcaauguacaauaagaugaacaucucggaguugucugcuaugaucccacaguucgacuggcuaggguauauuaaaaaggucauagauacccggcuguacccgcaccucaaggacaucucccccucagaaaauguugugguacgugugccucaguauuuuaaagaucuguuccgcauucuuggaagugagagaaagaaaacgaucgccaacuaccuggucuggaggaugguguauagccggauaccaaacuugucccgacgcuuucaauacagauggcucgaguucucuaggguuauucaggguacuaccacacuguuaccccagugggacaagugugugaauuucaucgaaagcgcucugccuuaugucgugggcaaaauguuuguagauguuuacuuccaggaggacaagaaggaaaugauggaggaacucguggaggggguccggugggccuuuaucgauaugcucgagaaagaaaacgaguggauggacgcaggaacuaagcgcaaagccaaggaaaaagcuagagcggugcuggcaaaggucggcuacccagaguucauuaugaaugauacccacgugaacgaggaccuuaaggccaucaaauuuucagaagcugauuauuucgguaauguuuugcaaacaaggaaguaccuggcccagagugacuuuuucuggcuccguaaagcagugcccaagaccgagugguuuacgaacccgacuacaguaaaugccuucuauuccgcuagcaccaaccagauucgguuuccugccggggaacugcaaaaacccuucuuuuggggaacugaguacccacgaucucuuucauauggcgcaauaggcgucaucguggggcaugaguucacacacggauucgacaauaacgguagaaaguacgauaagaauggcaaccuggacccuugguggaguaccgagagcgaggaaaaauuuaaggagaaaacgaagugcaugauuaaucaguauuccaacuacuacuggaaaaaggcgggguugaauguuaaaggaaagaggacccucggcgaaaacaucgcugauaacggugggcugcgcgaggccuuccgggcauauagaaaguggaucaaugacaggcgccagggcuuagaagaaccccugcuaccaggaauuacauuuacuaacaaucagcuauucuuucugucuuacgcccaugugcgauguaacucguaucggcccgaggcugcccgugaacaaguccagauaggcgcacacagcccuccacaguucagagugaauggggcuaucuccaacuuugaggaguuccagaaagccuuuaauugcccgcccaacucaaccaugaauaggggaauggauaguugucgccuuugguga

SEQ ID NO: 60632 - RNA, 1497 nt, Artificial Sequence
  derived and/or modified sequence opt3 from PHF10__Homo_sapiens__NP_060758
auggccgcugcagccggccccggggcggcucugagcccuagaccaugcgacuccgauccggccacccccggagcacagucuccuaaggacgauaacgaggacaauucaaacgaugguacacaaccaaguaaaaggcggcgcaugggcagcggggacuccucucgaucgugugaaacuucaagccaggaucucggauucaguuacuaucccgccgagaaucuuaucgaauacaaguggccuccagacgagacgggcgaauauuacaugcugcaggaacagguguccgaguauuugggugucaccucuuuuaaacguaaguaccccgauuuagaaagaagggaccugagccacaaagagaagcuauaucuccgggaacugaacguuauuacagagacucaaugcacccuugggcugacagcuuugcgcuccgaugaggugauagaccucaugaucaaggaauacccugcaaaacaugccgaguacucaguaauucugcaggaaaaggagagacagaggaucaccgaucacuauaaagaauacagucagaugcaacagcagaauacucagaagguggaggcuagcaaagucccagaguauauuaagaaggccgcgaaaaaggcagccgaguucaacucuaaucugaaccgggagcgcauggaagagagacgagcuuacuuugaccuccaaacacaugugauccagguuccgcagggaaaauauaagguguuacccaccgaaaggacgaaagucuccucauacccuguggcccugauaccaggccaauuccaggaguauuacaagcgguacagccccgacgagcuucguuauuugccucugaauacugcacuauacgaaccaccccucgauccggagcugccugcucuugacagugauggcgacucugaugacggggaagauggacgcggugacgagaaaagaaagaacaagggcaccuccgauagcucgucugggaauguauccgaaggagagucacccccagacagucaggaggauagcuuucagggcaggcaaaaauccaaggacaaagccgcgacaccucggaaggacggucccaaacgaucuguucugagcaagucagugccaggguauaagcccaaagucaucccuaacgccauuuguggaaucugcuugaagggcaaagaaaguaauaagaaaggcaaggcagagucccucauucacuguagccagugcgaaaacucugggcauccaucaugucuggauaugacuauggaguuagugaguaugaucaagaccuacccguggcagugcauggaguguaaaacaugcauaauuuguggacagccccaccacgaagaggaaaugauguucugcgacaugugcgaucgcgguuaucauaccuuuugugugggccugggggcuaucccuagcggaagauggauuugcgacuguugccaaagggccccacccacgccucggaaggucggccgcagagguaaaaauuccaaggagggguga

SEQ ID NO: 60633 - RNA, 996 nt, Artificial Sequence
  derived and/or modified sequence opt3 from PHF11__Homo_sapiens__NP_001035533
auggcccaggcuucucccccuagaccagagagggugcugggcgcauccucuccggaagcccggcccgcgcaagaggcucuccuucugccuaccggggucuuccagguugccgaaaagauggagaaacgcacaugcgcauuguguccaaaggacguggaauacaacguauuauauuuugcccagucagagaauaucgcugcacacgagaacugccugcuauacaguagcggacucguggaaugugaggaucaggacccccugaauccugaucgauccuucgacgucgaaucugugaaaaaggagauucaacgugguagaaaacuuaagugcaaguuuugucauaaaaggggcgccacuguugggugcgaucugaagaacuguaauaaaaacuaucacuucuuuugcgcuaagaaagacgaugccgugccacagucggacggaguccggggcauauacaaguugcucugucagcagcaugcgcaauuccccaucauugcacagucagccaaguuuagcggugugaaacgcaagagagggaggaaaaagccucugaguggaaaucacguacagccaccggagacgaugaaaugcaacaccuucauccggcagguuaaggaggaacauggccgccacacagaugcuacugugaaaguccccuuucugaagaaguguaaagaagccggccucuuaaauuaucugcuugaggaaauuuuggacaaggugcacuccaucccugagaaacugauggaugagaccacaucugaaagcgacuacgaggaaauaggguccgcacuauucgauugccgacucuuugaggacaccuucgugaacuuucaagcugccaucgaaaagaaaauucaugcgucacagcagagauggcaacagcugaaggaggagaucgaacuucugcaggacuugaagcagacucucugcaguuuccaagagaauagggaucugaugagcagcuccacaucaauuagcaguuuaucuuauuga

SEQ ID NO: 60634 - RNA, 3015 nt, Artificial Sequence
  derived and/or modified sequence opt3 from PHF12__Homo_sapiens__NP_001028733
augugggagaagauggaaaccaaaacaaucguguacgaccuggauacuagcggcgggcucauggagcagauucaagcccuucuggcucccccuaagacggacgaagcagagaaaagauccaggaagccagaaaaagagccgcggcgcucuggacgagccaccaaccacgauucaugcgacaguuguaaggaggguggcgauuuguuaugcugugaccauugccccgcggcuuuccaccuccaguguugcaauccuccacuaagcgaagagaugcugcccccuggggaauggaugugucaucguugcacagucagaaggaagaaacgggagcagaagaaagagcugggacacguuaacggccuuguggauaaguccgguaaacgcacuaccucuccaucgucagacacagaucuguuggacagaagcgccaguaagaccgaacucaaggcaauagcccaugcuaggauccuggagcggcgcgcaucccgacccgggacuccuacaucuagcgccuccaccgaaacgccaacuucagagcagaaugauguagacgaagauauuaucgacguggacgaggagccggucgcugccgaacccgauuaugugcaaccucagcugagaaggccauuugagcucuuaauugcggcagccauggaacggaaccccacccaguuccagcugccuaaugagcuuacauguacuaccgcuuugccaggaaguagcaaacgucgcagaaaggaagagacaaccggcaaaaacguuaagaaaacgcaacacgagcuggaccacaauggccuagugccccucccggucaaggugugcuuuacuuguaacaggucuugccggguagccccucugauccagugcgauuacuguccccuucuguuccauauggacugcuuggaaccaccucucacagcaaugccccuggggcgauggauguguccaaaucacauagagcauguuguguuaaaccagaaaaauaugacccuguccaaccgcugccaggucuuugauagauuccaagacacugugucacagcacguggucaagguugauuuucucaauaggauccacaagaaacaucccccuaaccggcgcgugcuucagagcguaaagagaaggagucugaaagugccagacgcuauuaagucucaauaucaguucccgcccccuuugaucgccccagcggccauucgugauggagaacuaaucuguaaugguauacccgaggaaucccagaugcaccuguugaacagcgagcaucuggcaacacaggcugagcaacaggaauggcuuugcucggucguggcccugcaguguucuauuuugaaacaccucuccgcuaagcagaugccuucacauugggacagugagcaaaccgaaaaggccgauaucaaaccaguuauugugacggacagcuccgucaccacaucucugcagacugcagacaagacccccacaccgagccacuacccuuuaucaugcccaaguggcaucuccacucagaacagccugucuuguucacccccucaccagagucccgcccuagaggauaucgggugcagcuccugugcugagaaaucuaagaaaaccccaugcggaacagcgaauggcccugugaacaccgaaguaaaggcaaaugguccccaucucuauucgagcccaacugacuccacggauccgcggcgacugccuggggccaacacaccccuuccaggauugucacacagacaaggcuggcccaggccucugaccccacccgcugccggcgggcuccagaaucauacuguuggaauuauagugaagaccgagaacgcaacagguccuaguucuugcccgcagcgcagccuggucccagugcccucccuuccuccaucaauccccagcucuugugccuccauugaaaauaccaguacucugcagcggaaaacaguccaaagccagaucggcccuccguugacggacucuagaccccucggguccccaccuaacgcuaccagggugcugacucccccacaggccgcaggagauggcauauuagcgacaaccgcuaaucaacgcuuuucaaguccugcccccagcucggacgguaagguuuccccagggacacugucuauuggcagcgcacuaacugugccgucauucccugccaacaguaccgcuaugguagaucucaccaauucccugcgagccuuuauggacgucaacggagagaucgaaaucaauaugcuugaugagaaauugauuaaguuccuggcacuccagcggauccaccagcuguuucccucucgugugcagccaagccccggcuccguugggacgcaccaauuagcuucaggaggucaucacauugaggugcagagaaaagaaguccaggccagggcgguguucuacccucugcuuggccucgggggagccguaaacaugugcuaucgcacacucuacauaggcacuggugcugacauggaugugugucugaccaauuacgggcauugcaacuauguuagcggcaagcacgcauguaucuucuacgacgagaacacaaagcauuaugaacuacugaauuacagugagcacggaacuaccgucgauaacgugcucuauucuugcgacuuuuccgaaaagacgccacccacaccuccgagcucgauuguggccaaaguccagucaguuauccggagaaggcgacaccaaaaacaggacgaggagccaucugaagaggcugccaugaugaguucccaggcacagggcccccaacgccggccuuguaauugcaaggcgagcucuagcucccugaucgggggaucaggugccggcugggaagggaccgcucuuuugcaucacggaaguuacauuaaacugggcuguuuacaguucguguuuagcauaacugaguucgccacaaagcagcccaaaggugaugcaucucuccugcaagacggggugcuugcugaaaagcuguccuugaagccacaucagggcccuguacucagaucaaacaguguccccuga

SEQ ID NO: 60635 - RNA, 624 nt, Artificial Sequence
  derived and/or modified sequence opt3 from PHF19__Homo_sapiens__NP_001009936
auggagaacagagcccuggaccccggcaccagggauagcuacggggcuacaucccaccucccuaauaagggagcacuugccaaagugaagaacaauuucaaagaccugaugucuaaguugacugaaggucaguaugucuuaugccgguggacggauggccuguacuaucuagggaaaaucaagcgcguuucaaguagcaagcaauccugucucgugaccuuugaggacaacucuaaauacuggguacuguggaaggauauucagcaugcgggagugccaggcgaggaaccgaaaugcaauauaugucuugguaagacaucggggccccugaacgaaaucuugauuugcggaaaauguggccucggcuaucaccagcagugccauaucccuauugcugggucagccgaccaaccacugcugacucccugguucugucgacguugcaucuuugcacucgccgucagagugagcuuaccuaguuccccaguucccgcuucuccugcaagcuccucaggagccgaucagaggcugccaagucagagccuuucuuccaagcagaagggucacaccugggcuuuggagacagacucagccagcgcgaccgugcugggccaagaucuauga

SEQ ID NO: 60636 - RNA, 1374 nt, Artificial Sequence
  derived and/or modified sequence opt3 from PHF1__Homo_sapiens__NP_002627
auggcccagcccccuagacugagcagguccggcgcuucuucacucugggacccagcaaguccggcccccaccagcgggccucggccacgccuuugggagggacaagaugugcuggcgcgauggacagacgguuuguuauaccugggcacuaucaagaaagucgauuccgcucgugaaguuugccuagugcaguucgaggacgauucucaguuucucguacuguggaaggacauuucgcccgccgcacuuccuggggaagaacuguuguguugcguguguagaucagaaacggucgugccaggaaacaggcucguuagcugcgagaaaugucggcacgccuaucaucaggauugccacgugccccgcgcuccugcaccaggcgagggugaagggaccaguugggucuguagacaaugcguguucgccauagcuacaaagaggggaggcgcccugaaaaagggcccguacgcgcgggcaaugcuggggaugaagcucuccuuacccuauggacugaaaggucuugacugggaugccggccauuugucuaaucgccagcagagcuacuguuauugcgggggaccuggcgaguggaaccugaagaugcuacagugucgauccugccuccaaugguuucacgaggcuugcacucagugucugucaaaaccacuucuguacggugacagauucuaugaguuugagugcuguguaugcaggggagggcccgaaaagguucggcguuugcagcuccgcuggguggaugucgcccaucugguguuauaccaccugaguguguguugcaaaaagaaguacuucgacuuugauagagagauccucccuuucaccagcgaaaauugggacucucuucuguugggcgagcuauccgacacaccaaaaggcgaaaggucaagcaagcugcucagugcacugaacucucacaaagaucgguuuauuuccgggcgagagaucaagaaacgcaagugucuuuucggacugcaugcuagaaugcccccgccugucgagcccccaaccggugacggcgccuugacuagggcggggccuuggggacggggccucacaagccccggugaagccccagaggcaggggcucgcgcccccgaagaggaagcugagggcgagucgggaggcgccggggcaacccugucuuccgcccagucagcuagagcgccuggagcagaaggugccggcaguagcgcugaggggacggccgcagccccauccggaugcuuacugccgucuacucuacuccccgcuccucaaggcccacuggguaccguugauccccagacagggcacccuuggaauuuuacucuugugagcccacagaccucauugaaaguacccccgacaagguga

SEQ ID NO: 60637 - RNA, 3039 nt, Artificial Sequence
  derived and/or modified sequence opt3 from PHF20__Homo_sapiens__NP_057520
augaccaagcaucccccuaacagaaggggcaucagcuucgaggugggggcccagcuggaagcucgggaccgccucaaaaauugguacccagcacacauugaggauauagacuaugaagagggaaagguccuuauccacuuuaaacgauggaaccaucguuacgaugaaugguucugcugggacuccccguaucugagacccuuggagaagauucaauuaaggaaagagggucugcacgaagaggauggcagcucagaauuucagaucaaugagcagguucuagccuguuggagugacugccgguucuacccugcgaaggugacagcuguaaacaaggaugggacuuauacggugaaauuuuacgacggagucgugcagaccguuaagcauauucacgugaaagccuucagcaaggaucaaaauaucgucggcaacgcacgcccaaaagagacagaccacaagucccucucuucgucacccgauaagagagaaaaauuuaaggagcagaggaaagccacugugaauguaaagaaagacaaggaagauaaaccucugaagaccgagaagcggccaaaacagcccgacaaggaagguaaacuuauauguagcgagaaggggaaaguuagugagaagucccugccuaagaacgaaaaagaggacaaggaaaauaucucugagaacgaucgcgaauauagcggagacgcucagguggauaaaaagccagagaaugacauugucaaauccccgcaagagaacuugcgagaacccaagagaaagaggggccggccuccaucaaucgcacccacagccguggauaguaauagccagacccuccagccuauuacucuggagcugcgucgcagaaaaaucucuaagggcugcgaagugccacucaaaaggccccgguuagacaagaacuccucacaggagaaaagcaagaauuacagugaaaacacagauaaggaccugucucgacgcagauccagcaggcuuucgaccaacgggacgcaugagauauuggauccggaccuggucguuucugaucuaguggacacugacccucuccaagauacccuguccucaacaaaagagagugaagagggacagcuuaagagcgcucuggaagccggucagguauccucugcguugacuugucacagcuucggcgacgggucaggagcagccggccucgagcugaauugccccaguaugggugagaacaccaugaaaacagaaccaaccuccccuuuaguggagcugcaagaaauuagcacggucgaggugacuaauacauuuaagaaaaccgaugacuucgggucuucaaacgcucccgccguugaucucgaccauaaguuucgguguaaaguggucgauugccuuaaguucuuucgcaaggcaaaacuguugcacuaccacaugaaguauuuccauggaauggagaaaagucuagaaccagaggaaagccccggcaagagacacgugcagacuaggggcccuuccgcuucugacaaaccaucgcaggagacacugacccguaagcggguaagcgccuccucaccgacgaccaaggauaaagaaaagaauaaagagaagaaauucaaggaauuuguucgagugaagcccaaaaagaaaaagaaaaagaagaaaaagacaaaaccugaguguccaugcagugaggaaaucucugacacuagccaggagcccuccccuccaaaggcguucgccgucaccagaugugggucaagccauaaacccggagugcacaugucuccgcaacuccaugguccugaauccggccaccacaaggggaaagucaaggcacuggaggaagauaaccuuagugagucuucuuccgagucauuucuguggagugacgaugaauacggacaggacguggacguuacaacuaauccagaugaggaauuggacggcgaugacagguaugauuucgaggugguacgcugcauuugcgagguccaggaagagaacgacuuuaugauccagugugaagagugccaauguuggcagcauggugugugcauggggcuccuggaagagaauguucccgagaaguacaccuguuaugugugccaggauccucccggccagcggccaggauucaaauacugguaugacaaggaaugguuaagcagaggccacaugcaugggcuggcuuuucuagaggaaaacuacucgcaccaaaaugccaaaaagaucgucgcuacacaccagcuccugggagaugugcagaggguaauugaggugcuucaugguuugcagcugaaaauguccauacuccaaucucgcgaacacccugaccugccccuuuggugucagccauggaagcagcauagcggcgaggggcgaucacacuuccggaacaucccgguuaccgauacucguaguaaggaggaagccccuuccuacagaacgcugaauggagcagucgagaaacccaggccauuggcccucccccugccucgcucuguggaagagagcuauauuacauccgaacauugcuaccaaaagccacgggcuuauuaccccgcgguggagcagaaauuagucguugagaccagaggcucagcacuggacgaugccgugaacccucuacacgaaaauggugacgacagccucaguccgaggcugggguggccacuugaucaggaccgaucuaagggcgauuccgaccccaaaccuggaagcccaaaggugaaggaguauguaucgaaaaaggcuuugcccgaagaggccccugcacgcaaacugcucgaucggggcggggagggacuguuaucaucucagcaccaauggcaguuuaaccugcuuacucaugucgaaaguuugcaggacgaggugacccacagaauggauuccaucgaaaaggagcucgacguucuggaaagcuggcuagauuacacaggugagcuggagccgcccgaaccacucgccaggcugccucagcuuaaacauuguauaaagcaauugcugauggacuuaggcaaggugcagcagauugcucucugcuguucuaccuga

SEQ ID NO: 60638 - RNA, 2043 nt, Artificial Sequence
  derived and/or modified sequence opt3 from PHF21A__Homo_sapiens__NP_001095272
auggagcugcagacccuccaagaagcccuuaagguggagauccagguccaccagaaacugguugcucagaugaagcaagacccccagaacgcagauuugaaaaagcaguuacaugaacugcaggccaaaauuacagcgcuaagcgagaagcaaaagagagugguagaacagcucaggaaaaaucugauagugaagcaggagcagccugacaaauuccaaauccagccacuuccgcaguccgagaacaagcugcaaacugcucagcagcagcccuugcaacagcuccagcagcaacagcaguaccaccaucaccaugcccagcaaucugcagccgcuucaccuaaucugacggcaagucagaaaaccgucacaacugccagcaugauuaccacaaagacccugccacucguguuaaaggcugccacugcgacaaugcccgcauccguugugggccagcggccuaccaucgccauggucacggcuauuaacucucagaaagccgugcugucgacugauguacaaaauaccccaguuaaccuucagacaucaagcaaggugacugggcccggagcagaagcuguccagaucguggccaaaaauaccgugacauugguccaagcgaccccuccacagccgauaaagguuccccaguuuaucccuccaccccgccugacgccucgaccaaacuuccuaccccaggugcguccgaaaccuguagcccaaaauaacauucccaucgcaccagcuccucccccaaugcucgccgcuccccagcugauucagagaccugugaugcuuacuaaguuuacaccaaccacucugccgacaagucaaaauuccauccaccccgucagggugguuaacggucagaccgccacgauagcaaaaaccuucccuauggcccaguugacaucuauugugaucgcuacuccaggcacccggcucgcggggccccagacaguccagcugagcaagccuuccuuagagaagcaaacugugaaaucacacaccgaaacagacgagaagcagaccgagagucgcacuauuacgccacccgcagccccgaaaccuaagagagaagagaauccacagaaacuggcuuuuaugguaagccucggacuuguuacacaugaucaccuggaagagauccaaucuaagaggcaggaacggaagcgccgaaccacugccaaccccguguauuccggcgcagucuucgagccugagaggaaaaagucagccgugaccuacuugaauagcacaaugcaucccgguaccagaaaacgggggcguccaccuaaguauaacgcuguccuaggauuuggcgcccugacucccacaaguccacagucuucccacccggacagcccugaaaacgagaaaacggaaaccacuuucacauuucccgcaccagugcagcccguuucgcucccuucuccaaccuccacagauggcgacauccacgaggauuucugcucagugugucgcaagagugggcaacugcuuaugugcgacacuuguagcagaguauaccaucuggauugcuuggaucccccucucaagaccauuccgaaaggaauguggauauguccaaggugccaggaccagaugcugaagaaagaagaggcgauccccuggccugguacguuagcuauuguccacuccuauaucgccuacaaggcagccaaagaggaagagaagcagaagcugcuaaaauggucuagcgaccucaagcaagaacgggagcagcuggaacagaaagugaagcagcuuucaaauaguauauccaaauguauggagaugaagaacaccauuuuggcucgacaaaaagagaugcauagcucucuggaaaagguuaagcagcucauccgccugauccacggcauugaccuuucaaaaccaguggauagugaggccacagucggggcaaucagcaauggacccgacugcacuccuccggcuaacgccgcgaccuccacacccgccccaucuccuucgagccaguccuguacugcuaauugcaaccagggcgaagagaccaaguga

SEQ ID NO: 60639 - RNA, 1200 nt, Artificial Sequence
  derived and/or modified sequence opt3 from PHF23__Homo_sapiens__NP_001271447
augcccggcgacugcagaagggauccuccaccgacccugaagcccgagacacagccuccagaaaaacggcgccgaacuaucgaggacuucaacaaguuuuguagcuucgugcucgccuacgcuggguauauucccccuuccaaagaagagucugauuggccagcaucaggaaguagcucuccccuucguggugaauccgccgcggacucggauggcugggacucagcuccuagcgaucugagaacgauacaaaccuuugucaagaaagccaagaguuccaagaggcgggcagcccaggcugggccaacacagccgggacccccucgcucuacuuucagcagauugcaggcaccagacuccgccaccuuacuggagaaaaugaagcuaaaagauucacucuuugaccuggauggccccaagguugcuaguccucuuagcccaacaucucugacccacacuuccaggcccccggccgcguugacaccugugccccucucacaaggugaccugagccauccaccucggaaaaaggaucgcaagaaucgaaaacuggggcccggagcaggcgccggcuucgggguacucagaaggccacggcccaccccuggagacggugagaagcguagucgcaucaaaaagucuaaaaagagaaaauuaaagaaggcugaaaggggcgaccggcugccaccgcccgggccuccacaggcacccccuuccgauacggacagcgaggaagaggaggaagaggaagaggaagaggaggaagaggaaauggccacuguggucggaggcgaggcuccagugcccguucuuccgaccccuccagaagcgccccgaccucccgccacagugcacccagagggugucccucccgccgauucggagucuaaagaagugggguccacugagaccucacaggacggagaugcaaguagcuccgaaggcgagaugcgcguaauggacgaagauauuaugguugagucuggcgacgauagcugggacuugaucacaugcuacuguagaaagccauuugcugggaggccgaugauugagugcucacuguguggaaccuggauccaucuaaguugcgccaaaauaaagaaaacgaacgugccugauuucuuuuauugucagaagugcaaggaacuccggcccgaggcucgcagacuggguggcccacccaaauccggggaaccuuga

SEQ ID NO: 60640 - RNA, 3291 nt, Artificial Sequence
  derived and/or modified sequence opt3 from PHF2__Homo_sapiens__NP_005383
auggccaccgugcccgucuacugcguuuguagacugccuuaugacgugacaagguucaugaucgagugcgaugcuuguaaggacugguuucacggcagcugcguagggguggaagaggaagaggcaccagauauugacauauaccauuguccgaacugcgaaaagacucacggaaaguccacgcucaaaaagaaacggaccuggcauaagcacggucccggccaggccccugaugucaagccagugcaaaaugggucucagcuuuucaucaaagagcugcgcucacgaacauuucccagugcggaggacguuguggcucgugucccuggaagccaguugacuuuaggcuauauggaagaacaugguuucaccgaaccaauucuggugcccaagaaagaugggcuaggacucgccguaccugcaccaacauuuuacguuuccgacguggagaacuaugucggcccggagagaucuguggaugugaccgacgucacuaagcagaaagauuguaagaugaagcugaaagaguucguugacuacuauuacucgacaaauaggaagcgggugcuuaacguaaccaaucuggaguuuucagauacgcgcaugagcaguuucguggaacccccugacaucgucaaaaaguuguccuggguggagaacuacuggccagacgaugcccuccuggcuaaacccaagguuacuaaauauugccugauuugugugaaggacucuuacaccgauuuucacaucgacagcggcggggcauccgccugguaucacguccucaagggagagaaaacauucuacuuaauaagaccugcuucagccaauaucagucuguaugagagguggcggagcgcgucuaaccauuccgagauguuuuucgcagaucaaguggacaagugcuacaaauguauuguaaagcagggucagacucuuuuuaucccaucaggcuggauuuaugccaccuugacacccguugauugccuggcuuucgccgggcacuuccuacauagccucaguguggaaaugcagaugcgcgcauacgaggucgaacgaagacugaaacuuggaucucugacccaauuuccgaauuucgagacggcuugcugguacaugggcaagcacuugcucgaagccuuuaaggguucccacaaaagcgggaagcagcugccuccccauuuagugcagggagcgaaaauccugaacggcgccuucaggucguggacuaagaaacaggcacucgcugagcacgaggacgaacuuccagagcauuuuaagccuucucaacugauaaaggauuuggccaaagaaauucggcuauccgagaaugcuucaaaggccguccgucccgaagugaacacaguugcaaguagcgacgaggugugugauggcgaccgcgagaaagaagaaccacccuccccuaucgaagccaccccaccgcagucucugcucgagaagguaagcaaaaagaagacucccaaaacagucaagaugccuaaaccaucaaagauucccaaaccuccaaagcccccgaaaccuccaagacccccuaagacccugaaacuuaaagacgggggaaagaaaaaggguaaaaagaguagggaguccgcuagccccacgaucccaaaucuggauuugcucgaagcgcacaccaaggaggcacugacaaaaauggaaccucccaagaaaggcaaggccacuaaaucuguguuaucaguuccaaacaaggacgugguccauaugcagaaugauguggagcggcuggaaauccgagagcaaaccaagaguaaaagcgaggcuaaguggaaauauaagaacuccaaaccggacucucuacucaagauggaagaggaacagaagcuggagaaaucgccucuugccgggaacaaggauaauaaauucagcuuuuccuucucaaacaagaaauugcugggaaguaaggcacucagacccccaacaucucccggcguauuuggugcccugcagaauuucaaagaagacaagccuaagccagugcgcgaugaguacgaguauguuagcgacgauggggaacuuaaaauugacgaguuucccauaaggcggaagaaaaacgcuccuaagcgcgaucuguccuucuugcucgacaaaaaggccguccugccgacuccagugaccaagcccaaauuagauucagcagcguacaagagcgacgacucuuccgaugaaggcagucugcacaucgacacagauaccaaaccuggaagaaaugcuagggugaagaaagagagcgggucuuccgccgcaggcauucuagaccuccugcaggccucagaagaggucggagcucuugaguauaacccaaguagccaacccccugccucgccguccacucaggaagcaauccaggguauguugucuauggcuaaucugcaggccagcgauucaugccuccaaacgacauggggcgcggggcaggccaagggaaguucccuggcugcacacggcgcccguaagaacggugggggcucuggaaaaagcgcuggcaagcgguuacugaaacgagccgcaaagaacuccguugaccuugaugacuacgaggaggaacaggaucauuuggacgcguguuuuaaagauucagacuauguguaccccagccucgagagugaugaagacaauccaauauucaagucuagauccaagaaaaggaaggggagcgacgaugccccuuacucgcccaccgcucgcgugggaccaucaguaccucggcaggacagacccgucagggaggguacucgcguggccucuauugaaaccggccuggcagcugccgcagccaaacuaagucaacaggaggaacagaaguccaaaaagaagaaaagcgcuaagcgaaaacugacaccaaauaccacuucuccgagcacauccacgucaaucagugcggggaccacuagcacaucuaccacuccugccuccacaacccccgcaucaacgaccccagcuaguacaagcacugccuccucucaggccucgcaagagggaagcucacccgagccuccacccgaaucccacaguucuagccucgcugaucaugaguauaccgcagccggcacauucacuggugcgcaggcugggcggaccucccagccuauggccccgggcguuuuucugacgcaacguagaccaucagcaucuagccccaacaauaacacagccgcuaagggaaaaaggaccaagaaaggcauggcaacugccaagcagcgccuugggaagaucuugaaaauucaccggaauggaaagcuguuacucuga

SEQ ID NO: 60641 - RNA, 2211 nt, Artificial Sequence
  derived and/or modified sequence opt3 from PHF3__Homo_sapiens__NP_001277189
auggacaucguggauaccuucaaccaccugauucccacagagcaucucgacgaugcccuuuuucugggcagcaauuuggaaaacgaggucugcgaagacuucuccgcuucucagaauguuuuagaggauucacugaagaacaugcuaagugacaaagauccuaugcucgggagcgcauccaaucaauuuugucugccagugcuugacucuaacgauccgaauuuccagaugcccugcucgacuguagugggacuggacgauauaauggacgaaggugucgugaaggagucaggcaacgauacgaucgacgaggaagaguugauucucccuaauagaaaccugagggacaaaguugaagagaauagcgugcggaguccacgcaagagcccccgacugauggcccaggagcagguccguucucucagacaaagcaccaucgcgaaaagguccaacgcugccccuuuaucaaauacaaagaaggcaagugggaaaacugugagcaccgccaaggcuggaguaaaacagccagaacggucucagguuaaggaggaaguguguaugucccugaaacccgaguaccacaaggaaaaccgcagaugcucaaggaauagcggccagauugaggucgugccugaggugagugucucuuccagccauucgucuguuuccucaugucuugaaaugaaggaugaggacgguuuggauaguaaacacaagugcaacaacccaggggaaaucgacgugccgagccaugagcugaauuguucccuacucucugaaacaugcguaaccauaggagagaaaaagaacgaggcacugauggaauguaaagccaagcccgugggcagcccucuuuuuaaauucucagauaaggaggaacacgagcaaaaugacaguaucuccggcaagacuggggaaacagucguggaggagaugauugcuacccggaaaguugaacaggauagcaaggagacggugaaacugucucacgaagacgaucauaucuuggaggacgccggaucaagugauauuagcuccgacgcggcaugcacuaacccaaauaagaccgagaacucucucgucggucugcccucguguguggacgaaguaacagagugcaauuuagaacugaaagauacuaugggcaucgccgacaagaccgagaacacacucgaacgcaauaagauagagccucuuggguauugcgaggaugcugaaagcaaccgacagcuggaguccaccgaauuuaauaaaucaaacuuggagguuguggacacgaguacuuucggaccagaaucuaauauucuagagaacgccaucugugauguccccgaccagaauagcaagcaacugaacgcaauugaguccacaaaaaucgaaucacacgagaccgcuaaccuccaggaugacagaaauagccagucuuccagugugagcuaccuggaaucuaaguccgucaaaucaaagcauacuaagccggugauccacaguaaacaaaacaugacaaccgaugccccuaagaaaauuguugcggccaaguaugaggugauacacagcaaaacgaagguaaaugucaagucggugaaaaggaacaccgacguucccgaaucccagcagaauuuucaucggccagugaagguccguaaaaagcagaucgauaaagagccuaagauucaaucuugcaacagcggcgugaaaucaguaaagaaucaggcacacagugugcuuaagaaaacacugcaggaccagacuuugguucaaaucuucaagccccucacccauucccugucugauaaaagccacgcucauccagguuguuuaaaggagccccaccacccugcccagacagggcaugucucccacucaagccagaaacagugccauaagccacaacagcaggcuccggccaugaagacuaacagucacgugaaagaggaacuggaacaccccggaguggagcauuuuaaggaggaagacaaacuaaagcucaaaaagccugagaagaaucugcagccacgccaaagaaggucuuccaaauccuucucgcuugacgaacccccuuuguuuauaccagauaacauugcaaccauccggcgagagggcucagaccacucuaguuccuucgaaagcaaguacauguggacacccucuaaacaguguggcuucugcaagaaaccgcaugggaaucgcugugucugcauguguguuuga

SEQ ID NO: 60642 - RNA, 333 nt, Artificial Sequence
  derived and/or modified sequence opt3 from PHF5A__Homo_sapiens__NP_116147
auggccaagcaccaucccgaccugaucuucugcagaaaacaggcuggcguggcaauugggaggcucugugagaagugcgauggaaaaugugucauaugcgacagcuacguucggccuuguacccuugugcgcaucugcgaugaauguaacuaugguuccuaccaaggccgaugcguaauuugugggggaccaggcgugucugacgccuauuacugcaaggaguguacaauccaggaaaaagaucgugacgguugcccgaagauugucaaucuggggucaaguaagacugauuuguuuuaugagaggaaaaaguacggauucaaaaagagauga

SEQ ID NO: 60643 - RNA, 939 nt, Artificial Sequence
  derived and/or modified sequence opt3 from PHF6__Homo_sapiens__NP_115711
augagcuccucuguggagcagaagaaaggccccaccagacaaaggaagugcggguucuguaaaucaaaccgggacaaggaaugcggacagcugcucaucagugagaaucagaaagucgccgcucaccauaaguguaugcuuuuuagcuccgcacugguuucuucgcacucagauaacgaaucuuuggguggcuucaguauugaggacgugcagaaggaaauaaaacgcgggacaaaguuaaugugcucccugugucauugcccuggagccacuaucggcugugauguaaaaacgugccaccgaaccuaccauuaucacugugcgcuacacgacaaggcucaaauucgugagaaaccaucucaggguaucuacaugguguauugcagaaagcauaagaaaacagcccacaauagcgaggcagccgaucucgaagaguccuuuaacgaacaugagcuggagccgucaagucccaagagcaaaaagaaaucuaggaaggggcggccucgcaaaacuaauuucaagggacuuuccgaagacaccagaucaacaagcagucacggcaccgaugagauggaaucuuccagcuacagggaccggucgccacaccgcagcucccccucagauacucgaccuaaguguggcuuuugccaugucggggaggaagagaacgaggcuagaggaaaacugcacauuuucaaugcaaagaaagccgcugcccauuauaagugcauguuguuuaguagcgguacagugcagcucaccacgacuuccagggcggaguucggcgacuuugauaucaaaaccguucugcaggaaauaaagcgggggaagcguaugguguguucuuucuacaucugcuaugcaacacugcaccucauuuguugcuuuaaauuccgcguccauccaaaguuuauccaaagcucagaaaacuuaaaauga

SEQ ID NO: 60644 - RNA, 3183 nt, Artificial Sequence
  derived and/or modified sequence opt3 from PHF8__Homo_sapiens__NP_001171825
augaacagaagcagggccaucgugcagcggggccgcguccugcccccuccagcuccgcucgacaccacaaaucuugcagggcgacguacucugcaagguagagccaagauggcguccguucccguguacugcuuguguagguuaccuuaugauguaacgcgguucaugauugagugcgacaugugucaggauugguuucacggaucuugcgugggcgucgaagaggaaaaagcugccgacauagaucuguaccauuguccaaacugcgaggugcuacacgggcccucaaucaugaagaaacgcagaggaaguagcaagggccaugacacccacaaagguaagccuguuaagacaggguccccaacuuucgugagggaacuccggucucgcaccuuugauucgucagacgaggucauucugaaacccacaggaaaucagcuuaccguggaguuccuggaagagaacagcuuuaguguaccuaucuugguucucaagaaagauggccugggcaugacucugccauccccgucuuucacagugcgagacgucgaacauuauguggggagcgauaaggagauugacgugaucgaugucaccagacaggcagacuguaaaaugaagcucggagacuuuguuaaguacuauuacuccgguaaaagggagaagguguuaaauguaauaucacuggaguucagugauacgcggcuuagcaacuugguggaaacucccaaaaucguccguaagcugucuuggguggaaaaucuauggccugaggaaugcguuuuugagcgcccaaacgugcaaaaauauugucucauguccgucagagacucauacaccgauuuccacauugacuuuggcgggacaagcgugugguaccacguacugaagggagagaaaaucuucuaucuuauuaggcccacuaaugccaaccugaccuuguuugaaugcuggaguucuuccagcaaucagaacgagauguucuucggcgaucagguugacaaguguuacaagugcucggugaaacagggucaaacacucuuuaucccuaccggguggauacaugcuguccugacgccaguggauugcuuagcauucggaggcaauuuucugcacucucucaacauugaaaugcagcuuaaggccuaugagaucgaaaaacggcuguccacugcugacuuguuccgauuucccaauuucgagacaauuuguugguacgucggcaagcauauccuagauaucuuucgcgggcugagagagaacaggcggcacccggccucauaucucgugcacggagguaaagcgcugaaccuugcauuccgcgccuggaccagaaaggaagcucugccugaccaugaggaugaaauucccgagacuguuaggacagugcaguugauaaaggaccucgcccgugaaauccggcugguagaggacauuuuucagcaaaaugucggcaaaaccaguaacaucuucggguuacagcgaauauuuccagcaggaagcauuccucugacgagacccgcucacuccaccucugugagcaugucaaggcuaagucucccauccaagaauggcagcaaaaagaaaggucugaagcccaaggagcuuuucaaaaaggccgaacgcaaagggaaggagucuucagcguugggcccugccggacagcugaguuacaaccucauggauacauauagccaucaagcacugaaaacuggcuccuuucagaaggcuaaguucaauaucaccggggccugccuuaacgacucugaugacgauucgccagaccuggauuuggacggaaaugaaagcccgcucgcucuguuaauguccaacgguucaacaaaacggguuaagagucugucuaaaagcagaaggacuaagaucgccaaaaagguggauaaagcacgccuaauggccgagcaggucauggaggacgaguucgaucucgacuccgaugacgaacugcagauugacgaacgacuuggcaaggagaaggcuaccuugaucauucggcccaaauuuccucguaagcugccaagagcgaaacccuguucagauccuaauagggugcgcgaaccaggggagguagaguucgacauagaagaggauuacacaaccgacgaagauaugguggagggaguugaaggcaagcucgguaacgggagcggcgcaggaggcauccuggacuuacugaaagccucucggcaagucgggggacccgauuacgcugcccuuacugaggcaccggccuccccuaguacgcaggaggcuauucaggguauguugugcauggccaaucuccagucuagcuccucaaguccagcaacaagcucgcugcaagcgugguggaccggcgggcaggacagauccucuggaagcucaaguuccggccuagguacugugucuaacagccccgcuucccagaggaccccugggaagcgacccaucaagcgcccagccuauuggcggacagaaucagaggaagaggaagagaaugcaagccuggaugagcaggacagucucggcgccuguuuuaaagaugcugaauacaucuauccuucucuggaguccgacgaugacgaccccgcccuuaagagcagaccgaaaaagaaaaagaacucggaugacgcaccauggucaccuaaggcuagggugacccccacuuugccaaaacaagaucgucccguccgcgaaggaacacggguugccucuauugagacgggccuggcggccgcugcagccaaguuagcucagcaggagcuccagaaagcccaaaagaaaaaguacauaaagaaaaagccucugcuuaaagaaguggagcagccaagaccccaggacaguaaucuguccuugaccgugccugcaccgacuguagcggccacaccacaacucgucaccagcucuagcccccugccuccacccgaaccuaagcaggaggcucuauccgggucacuggccgaucacgaauauacagcaaggccgaacgcuuucggaauggcccaggcaaaccgaaguacuacccccauggccccaggcguguuucucacgcagcggcgcccuagcguugguucucaauccaaucaggcugggcagggaaaaagacccaagaaaggccuggcgaccgccaagcagaggcuuggucggaucuugaagauucaucgaaacggcaaacuguuacucuga

SEQ ID NO: 60645 - RNA, 1308 nt, Artificial Sequence
  derived and/or modified sequence opt3 from PHGDH__Homo_sapiens__XP_011539533
augcugugguucaagagaagcucaccccucucuaccgcccaccaugaccuuacacaccagaggcaaaucccucaggcuacugcaucaaugaaagauggcaagugggagcggaaaaaguuuauggggacggaacugaacggaaaaaccuuggguauuuuaggccuggggcgcauaggacgagagguggccacacguaugcagaguuucggcaugaagacuaucgguuacgacccaauuaucagcccggaagucuccgcgucuuuugggguucagcaacuaccccucgaggaaauuuggccucugugcgauuucaucaccgugcauacaccacuucugcccucgaccacuggauugcucaaugacaacacauuugcucaguguaagaaaggcguaagaguggucaauugcgccaggggcgggauaguggaugagggagcacugcugcgggcccuccagucaggucagugugcuggcgcagccuuagacguuuucaccgaggaaccuccacgcgauagagcucugguggaccacgagaacgucaucagcugcccccaucuuggggccaguacgaaggaagcgcaauccagguguggagaggagauugcagugcaguuuguagauaugguuaaaggcaagucuuugacugguguggucaaugcccaggcucugaccagcgccuucuccccucacacaaaaccauggaucgggcuagcagaagcucucggaacucugaugcgggccugggcgggcucaccgaagggcaccauucaggugaucacacaagggaccagucuuaagaacgccggaaauugccugagccccgcagugauagucgguuugcucaaagaggcuucuaagcaggccgacguuaaccuggugaaugcuaaauuacugguaaaggaagccggccucaacgugacgacuucccacuccccugcagccccaggggagcagggauuuggcgaaugucuucuggcugucgcguuggccggugcacccuaucaagcuguggggcuaguucagggcacaaccccugugcugcagggacucaauggcgccgucuuccgcccagaggugccccugcgaagagaucuuccgcuguugcucuuuaggacucagacaagcgacccugcaaugcugcccaccaugauuggguuacuggccgaggcuggaguacggcuacucaguuaccaaacgucucugguuuccgauggugaaaccuggcaugugaugggcaucagcucgcuuuugccaucucuggaggccuggaaacagcacgucacagaagcauuccaguuucauuucuga

SEQ ID NO: 60646 - RNA, 5466 nt, Artificial Sequence
  derived and/or modified sequence opt3 from PHIP__Homo_sapiens__NP_060404
augagcugcgagagaaagggccuguccgaacucagaucugagcuuuacuuccugaucgcccgguuuuuggaagacgggcccugccagcaagcugcucagguguuaauucgcgaggucgccgaaaaagagcugcuaccucgacguaccgauuggacaggaaaggagcacccaagaacuuaucagaaucucguuaaauacuauaggcaucuggcgccggaccaccuucugcagauaugccaucgguuggguccccuccuggaacaagagaucccucagucagugccaggcguacagacgcugcucggggcuggacgccagaguuuacugagaaccaauaagagcuguaaacacguggucuggaagggcuccgcccuugcagccuugcauugcgguaggcccccugaaucuccagugaacuacgggucgcccccuucaauugcugauacacuguucagccggaagcuaaauggaaaauaucgccucgagcgacugguuccaacugcaguguaccaacacaugaagaugcacaaaagaauccuuggccaucugaguuccgucuauugugugaccuuugacaggacaggccggcguauuuucaccgggucugaugacugcuugguaaagaucugggccacugaugacggacgccuccuggcuacauuaagaggucacgccgcggagauaagcgauauggcaguuaacuacgaaaauaccaugaucgccgcuggcuccugugacaaaaugauuaggguguggugccugcggacgugugccccgcucgcaguccuucaggggcauucagcuaguaucacuagccugcaguuuucucccuugugcuccggaucaaagcgauaccuaagcaguaccggcgccgaugguacaauuuguuucuggcugugggacgcggggacucucaagaucaacccucgcccagccaaauuuaccgagagacccaggccuggagugcagaugauauguucuuccuucagcgcaggcggcauguuucuggcuacagggucgaccgaucacauuauccggguguauuucuuuggaucuggucaaccagaaaagauuuccgagcuugaguuccacacggacaaagucgacucaauccaguuuaguaauacuagcaaccgcuucguuuccggcucuagagaugggacagccaggaucuggcaguucaagcgucgggaguggaaaagcauucuguuggacauggcuacccgacccgccggacaaaaucuccagggcauagaggauaagaucacuaaaaugaaggugacaaugguagcaugggacagacaugauaacaccgugauuacggccgucaauaacaugacccugaagguguggaacucauacacaggucaguuaauccacguucugauggggcaugaagacgagguguuuguccuagaaccgcacccuuucgaucccagggugcucuuuagugcuggccaugacggaaacguaauaguuugggaucuggcgcgcggcgugaaaauucgguccuauuucaauaugaucgaggggcagggacacggugcagucuuugacugcaaguguagcccagauggccaacacuucgccugcacugacucucaugggcaccuuuugaucuuuggauucggcucaaguagcaaauacgacaagauugcugaucagauguuuuuccauuccgacuauagaccucugaucagggaugccaacaacuuugugcucgacgaacagacccagcaagcaccccaccugaugccacccccuuuccuugucgauguggacgguaauccacacccgucucgcuaccagcgacugguucccgggcgggagaacugucgugaggaacaguugauuccucagaugggcgugacaucgagcggacucaaucaaguacugucccagcaggccaaccaggagauaucaccauuagauaguaugauccaaagacugcagcaggaacaagaccuaaggcgcucuggcgaggcugggauuagcaauacuucccggcucucaagaggaagcaucucuuccaccagugaaguccauagcccaccuaacgugggucugaggcgaucuggccagaucgaggggguucgccagaugcacuccaaugccccacggucagagauugcaacagaaagagaucuuguggcguggaguaggcgugucgugguacccgaguugagcgcuggaguggccucgcgccaggaagaguggcggaccgcaaaaggcgaggaagagauaaagacuuauagauccgaagagaagaggaaacaucugacgguuccgaaggaaaacaaaaucccuacagucucuaagaaucacgcccaugagcacuuucucgaccugggugagagcaaaaagcaacagaccaaccagcacaauuaccgaacucggucagcuuuagaagagaccccacgccccagugaagagauugaaaacggguccucuagcuccgaugagggcgaggugguggccgucucaggaggcacaagcgaagaggaagagagagcauggcauagugacgggucuuccagcgauuacucgucagacuauucugacuggaccgcugaugccggaaucaaucugcagccucccaagaaaguuccaaagaacaaaacuaagaaagcggaaaguuccagcgacgaggaggaagagucugaaaagcaaaagcagaaacagauuaagaaagagaagaaaaaggugaaugaggaaaaagauggcccuaucagccccaagaagaaaaagccaaaagagaggaagcagaaacggcuugccgugggugaauugacagagaacgggcucacgcuggaagaguggcuaccguccaccuggauaacugacacaaucccucgaagaugccccuucguaccacaaaugggagaugaggucuacuauuuccgccagggccacgaggcuuacguggagauggcaaggaagaacaagauuuauucaaucaaucccaaaaagcagccuuggcauaaaauggaacugcgugagcaagaacucaugaagauuguugguaucaaauacgaggugggccugccaacccuuuguugcuugaagcuggccuuuuuagaccccgauacagggaagcucacuggaggcaguuucaccaugaaauaucacgacaugccugaugucauagacuuucuggugcuucggcagcaguucgaugacgcuaaguacagaagguggaacauuggggaucgcuuucgaagcguuaucgacgacgccuggugguucggaacgauugagucucaggaaccgcugcaauuggaguacccagauucccucuuucaguguuauaaugugugcugggacaacggcgauaccgagaaaaugucacccugggacauggagcugaucccuaauaacgcaguauucccagaagaacuagguacaagugucccccugacugauggggaguguagaagccucauauacaagccucuggacggagaauggggcaccaauccgcgggaugaggaaugcgagaggaucguggcggguauuaaccagcuuaugacauuggacaucgccuccgcuuuuguggcccccgucgaucugcaggcauauccaauguacuguacuguuguggcuuauccuaccgacuuaucuacgauuaaacaacgccucgagaaucguuucuacagacggguaucgagccugaugugggaagugagguauaucgagcauaacacacgcaccuuuaaugaacccggcucaccaauagucaaguccgccaaguucgugacugaucuucugcuacacuuuauuaaagaccagacaugcuacaacaucaucccucucuacaauaguaugaagaaaaagguucugucugacagcgaggaugaagagaaagacgcagaugugcccgggaccuccacucgaaagagaaaagaccaccagccacggaggcgcuugagaaacagggcccagucauaugauauucaggcuuggaagaagcagugcgaggaacuguuaaaucucaucuuccagugugaggacucugaaccguuccggcagccugucgaucugcuugaguaccccgacuaucgugauauuauagacaccccaauggauuuugcgacagugcgcgaaacgcuggaggccggaaacuacgagagccccauggaauugugcaaagacguucgacucaucuucaguaacuccaaggcauauaccccuagcaaaagaucuaggauuuacucaaugucccugcggcuaagugcauuuuucgaggaacauaucagcucggugcugucugauuauaaguccgcccuucgcuuucacaaaagaaauacuauuacaaagaggcggaagaaacgaaacagaagcucaagugucucuuccagcgccgcuucaaguccagagcgcaagaaaaggauccucaagccccaacugaaaagcgaauccucuaccagcgcauucuccacaccuacucggucaauaccgccacgucauaaugccgcgcagaucaacggcaagaccgagucuaguucgguagugagaacgaggagcaaucgcguuguggucgaccccgugguaacagagcagccuuccaccucuucagcugccaagacuuuuauuaccaaagcaaacgccagcgcuauccccgggaagacaauuuuggaaaauuccgugaaacacaguaaggcacugaacacuuuaucuagcccaggacaaucauccuucagucacggcacccggaauaacagcgccaaagagaauauggaaaaggagaagccugucaaacgaaagaugaaaucuuccguucuccccaaggcgucaacacugagcaaaucgucugcugugaucgagcagggugacuguaagaacaaugcccuugugccagggacgauacaggucaacggacauggcggucagccuaguaagcuggugaaaagaggcccggggaggaagcccaaaguugaaguaaauaccaacuccggagagauuauccacaagaaacgcggccggaagcccaaaaaguugcaauacgcaaagccugaagaucucgagcagaacaaugugcaucccaucagagacgaaguccugccaagcucaacuugcaacuuucuauccgagacaaauaacgugaaagaggaucugcuucagaagaaaaaucgugggggaaggaagccuaaacggaagaugaagacccagaaacucgacgccgaucuguugguucccgcuucugugaaggucuuacgccgaagcaacaggaaaaagauugacgauccgauagacgaagaggaagaguucgaagaacugaaaggcagugagccacacaugaggacucggaaucaaggucgcagaacagccuuuuacaacgaagaugacuccgaggaagaacaaaggcagcuccuguucgaagauaccagccuuacguucgggacuucuucacgaggacgggugcguaagcugaccgagaaggcaaaagcuaauuugaucggcugguga

SEQ ID NO: 60647 - RNA, 3633 nt, Artificial Sequence
  derived and/or modified sequence opt3 from PHKA1__Homo_sapiens__NP_001116142
augagaagcagguccaacucuggcgugcggcuggacggguacgcccgccucguccagcaaaccauccuuugccaccagaaucccguuacaggacuguugccugcuucauaugaucagaaggacgcaugggugcgagauaacguauacaguauuuuagccguguggggucugggccuagcguaucguaaaaaugcugacagagaugaggacaaggccaaagcauacgaacucgagcagagcgucgugaagcugaugagggggcuucugcauuguaugauacggcaaguugauaaaguggaauccuucaaguauucucagucgacuaaggacucauugcacgccaaauacaacacgaagaccugcgcuacagucgugggagaugaccaguggggccaucuccagcuggaugcaacuagcguauaucugcucuuuuuagcccaaaugaccgcuaguggucugcacaucauucauucccuugacgagguuaauuucauccagaacuugguguuuuacauugaagccgcguacaaaacagcagauuucgggaucugggagcgcggagacaagaccaaucagggcauaucugagcugaacgccagcuccgucggcauggcuaaagccgcacuagaagcucucgacgagcuggaucuuuuuggggugaagggagguccacagucagugauccacguccuggccgacgaaguucaacacugucagaguauuuugaauagccuccugccgagagcgucuacuuccaaggagguggaugccucauuacugagcguagugaguuuccccgcauuugcugucgaggacucucagcucguggaacuuacaaaacaagagaucauuaccaagcugcagggcagguaugggugcugucgguucuugcgcgauggauacaaaacgccuaaggaagacccaaaccgacuauauuacgagcccgccgaacugaaacucuuugagaauaucgagugcgaauggccucuguucuggacuuauuuuauacuugauggcguuuucuccgguaacgcugaacaggugcaggaguacaaggaggcccuggaagcagucuugauuaaagggaagaauggagugccacuccugcccgaguuauauagcguaccuccagacagaguugaugaggaauaccaaaacccgcauaccguggacaggguccccaugggcaagcugccucacauguggggccagucgcuauacauccucgggucucugauggccgagggauuucuugcuccaggugaaauugaucccuugaaucggcguuucuccacagugccuaaaccagacgucgugguucaggugucaauccuggcggagacugaagagaucaagaccauucucaaagacaagggcauauauguagagacaaucgcagaagucuaccccauucgcgugcagccggccagaauccugagucauauauauagcucccuuggguguaacaacaggaugaaacugucuggacggccuuaccgacacaugggcguuuuggguaccagcaagcucuaugauauucgcaagacgaucuucacuuuuacaccccaauucaucgaccagcagcaguuuuaccuggcuuuagauaauaaaaugauuguggagaugcugagaaccgaccuaucauaucucugcaguagguggcggaugacugggcaaccaacaaucaccuucccuauuucccacagcaugcuggaugaagacggcacgucucuuaacucaaguauauuggccgcacugcgcaagaugcaggauggauacuuuggcggggccagaguccagaccggaaaacucagcgaguuccugacaacuuccuguugcacccauuuaucuuuuauggaccccgguccagagggcaagcuguacucggaagauuaugacgauaauuacgacuaucuugagagcgggaacuggaugaaugauuacgacuccacaucacacgcuagguguggagacgaaguggcccguuauuuggaucaucuccuggcacacacugcgccccauccuaaacuagcuccaaccagucagaagggcggucuggaccgguuccaagccgcaguacagacaaccugcgaucucaugucucuggugacuaaggccaaagagcuucacguucagaacguccacauguacuugccgacgaagcuguuucaagcuagccgacccuccuucaauuuacucgacucaccucauccaagacaggaaaaccaggugcccagcgugagggucgagauccaucugccucgcgaucagucuggggagguugacuuuaaagcccuugugcugcaauugaaggaaacauccagucuccaggagcaggcagauauucuguauaugcuauacaccaugaaaggcccagacuggaauacugaacuguacaacgagcggagcgcuaccgugagagaacuccugacagagcuuuauggaaagguaggcgagaucaggcacuggggguugauccgcuacauuucuggaauacugcgaaagaaagucgaagccuuagaugaggcgugcaccgaccuccugucccaccagaagcaccuuacugugggucugcccccggaaccucgggagaaaacaaucucagccccacuacccuaugaagcucucacgcaacugauugaugaggcaagugagggcgacaugagcaucucgauuuugacccaggaaaucaugguuuaccuggccauguauaugcguacucagccuggguuauucgcugagauguuuagacucaggauaggacugaucauucaggugauggccacagaacuugcacauucccugcgcuguucugcggaggaggccaccgaaggcuugaugaaucucagccccucagcuaugaagaaccugcuacaccauauccugagugguaaagaguucggggucgaacgguccgugagaccaacagauucuaauguuagcccugccauuuccauccacgagauaggcgcagugggagcuacuaagaccgaaaggacgggcauuaugcaacuuaaaucagagaucaagcagagccccgggaccaguaugacaccaucuuccggcagcuucccgucggccuacgaccagcaaucaucuaaggacagucgacagggacaguggcagcgccggagaaggcucgauggugcacugaaccguguaccugucggguuuuaucaaaaaguguggaagguguugcagaaaugccauggacuguccgucgagggcuucguuuuacccagcucuacuacccgcgaaaugacaccaggugagauuaaguuuagcgugcacguagaauccgugcucaaucgggucccccagccugaguacagacagcugcuuguggaagccauccugguuuugacuaugcucgcugacauagagauccacucaauuggcaguaucauugcgguggagaaaaucguccauauagccaacgaucuguuccuacaagaacagaagacccugggggcagacgauacgaugcuugcuaaggacccagccagcggaauuuguacacuccuguacgauucugcccccuccggcagguuugggaccaugacuuauuugucaaaagcugcagccacauacgugcaggaguucuuaccucacaguaucugcgcgaugcaguga

SEQ ID NO: 60648 - RNA, 3708 nt, Artificial Sequence
  derived and/or modified sequence opt3 from PHKA2__Homo_sapiens__NP_000283
augagaagcagguccaacucuggcgugcggcuggacggguacgcccgccucguccagcaaaccauccuuugcuaucagaaucccguuacaggacuguugucagcuagucacgagcagaaggaugcaugggugcgagacaacauuuacagcauauuagccguauggggucugggcauggcguaucguaaaaaugcugauagagacgaagauaaggccaaagcauacgagcuagaacagaacguggucaagcucaugagggggcugcuucaauguaugaugcgccagguggccaaaguugagaaguucaagcauacucaguccacgaaagacucucugcacgcuaaguauaauaccgcaacaugcggaacuguggucggcgaugaccaguggggucauuugcaaguggaugccaccucgcucuuucugcuguuccucgcucagaugacagccucaggguuacggaucauuuuuacccuggacgaaguagcguucauccagaaccuuguuuucuacauugaggcagccuauaaaguggcugauuacggaaugugggagagaggcgacaagacuaaucagggcaucccugaauugaacgccagcagugucgggauggcaaaagcugcccuggaggcgauagaugaacuagaccucuucggagcccacgguggcaggaaguccgugauccaugugcugccagacgaggucgagcacugucaaucuauucuuuuuagcaugcugccgcgggcauccacaucaaaggaaaucgaugcuggguugcucaguauuaucagcuuccccgccuuugcuguugaggacgugaaucugguaaacgugaccaaaaaugaaauaauuucuaaguuacagggacgcuacggcugcugucgauuccugagagaugguuauaaaacgccuagggaggacccaaaccggcuccacuacgaucccgccgaacuuaagcuguuugagaauaucgagugcgaauggccugucuucuggacuuauuuuauuaucgacgggguguucuccggagaugcaguucaggugcaagaguaccgugaagccuuggagggcauccuaauucgcggcaaaaacgggauaagacuggucccagaacucuaugcugugcccccuaauaagguagacgaggaguacaaaaacccacauaccguugauagggugccgaugggaaaggucccccaccuguggggucagucacuuuauauccugagcaguuugcucgcggaaggcuuccuggcagccggggagauugacccuuuaaaccggcgauuuucuacauccgugaagccagaugucgugguucaggugacuguacuggcugaaaauaaccauaucaaagaccuacuccgcaagcacggagucaaugugcagagcauagccgacauucaccccauccaaguucagccuggcagaauccugucgcauauuuacgcaaaacuugguaggaacaagaauaugaacuugucugggcggccauaccgccacaucggcgugcugggaaccuccaaacucuaugucauuagaaaucagauauucacauuuacaccccaguucacggaucaacaucacuuuuaccuggcccuugacaacgagaugaucguggaaaugcugaggauugaguuggcuuaucucuguacuugcuggcguaugacaggccggccgacccugacuuucccuaucucacgaacaauguuaaccaaugaugggagugacauccauagcgccguacuguccacgauuagaaagcuagaggauggauacuuugguggcgcaagggugaagcucgggaaccugucugaauuucuuaccaccagcuuuuauacuuacuugaccuuccuggaccccgauugugacgagaaacucuuugauaaugcgucagaaggaacauucaguccagacuccgauagcgaccugguuggcuauuuagaggauacuugcaaccaggagucucaggacgaacuggaccacuacauaaaucaccuuuugcagucaaccagucuccgcagcuaccugccuccccuauguaagaacacagaggaucggcaugucuuuuccgcuauccacucuaccagagacauucugucggugauggccaaagcaaagggucucgaagugccauucguccccaugacucugccuacgaaaguucuuagcgcccauaggaaguccuugaaucugguggauucaccacaaccguuacucgagaaggugcccgaaagugacuuccaguggccucgcgaugaccacggggauguagacugcgagaaacuggucgagcagcuuaaggauugcucuaaccugcaggaccaagcugauaucuuguauauucucuacgugaucaaaggcccaagcugggacacaaaccuguccggacagcacggcguuaccgugcagaaucuacugggggaacucuauggaaaggccggucugaaccaagaguggggccuuauacgauacaucucaggguugcugcggaaaaaggucgaaguguuagcagaggcuuguacugaucuccugagccaucagaagcagcuuaccguuggacugcccccugaaccacgugagaaaauuaucucugccccacuaccgccugaggaacucacaaagcugauuuaugaggcguccggccaggacaucaguauagccguguugacccaagaaauuguagucuaccuggcuauguaugugagagcacagcccagcuuauuuguggagaugcucaggcugcgcaucggucuuauuauccaggucauggccacugaacuggcucggucuuugaauugcuccggggaggaggccucagaaagucucaugaaccugagccccuucgacaugaaaaaucuacugcaccauauacuuucgggcaaggaguuuggaguugaaagauccgugaggccuauccacucuagcacaucaagucccacgauuuccauccaugagguaggccacaccggggugacuaaaacagagcgaucuggaauuaaccgccuccggagcgaaaugaagcagaugaccagaagguucuccgcagaugagcaauuuuucucagucggccaggcggccagcaguucugcucacuccagcaaaucggcccguucaucuacaccaaguuccccuacugguaccagcucuagcgacuccgggggacaucacaucggcuggggugaacgccagggccaguggcugcggagaaggcgauuggauggggcaauaaaucgggugcccguuggauuuuaccaacgcguguggaagauucugcagaagugucauggcuuaucaaucgacggguacguccucccaaguagcacgaccagagagaugacaccgcacgaaaucaaauucgcugugcauguugagucugugcugaacagggucccucagcccgaguaucggcaacuucugguagaagccauuaugguguugacucuccuguccgauaccgagaugacaucaaucggaggcauuauacacguugaccagaucgugcagauggcaagucagcuauuucugcaagaucaggucagcauuggugccauggacacucuugaaaaggaucaggcuaccgggaucugccacuucuuuuacgacuccgcgccaucuggagccuauggcacgaugacauaccucacccgagcaguggcuucguaucugcaggaguuguuacccaauagcgguugucaaaugcaguga

SEQ ID NO: 60649 - RNA, 3282 nt, Artificial Sequence
  derived and/or modified sequence opt3 from PHKB__Homo_sapiens__NP_000284
auggccggcgcugcagggcugaccgccgaggugagcuggaagguccucgaaagaagggcgcggacaaaacgcuccggaucuguuuacgagccccuuaagucaaucaaccugccucgaccagacaaugaaacuuugugggauaaauuagaccacuauuaccguauugugaagaguacgcugcuacucuaucagagcccgaccacaggucuguuccccacuaaaaccugcggcggggaucaaaaggcuaagauacaggacucccuuuacugugccgcaggagccugggcucuggcauuggccuauagaaggaucgaugacgauaaaggccggacacaugagcucgaacacucugcuauuaagugcaugcgcgguauccuguacuguuauaugagacaggccgacaaaguacagcaauuuaagcaggauccuaggccaaccacuugccugcauucgguguucaacguccacacaggggacgagcucuuaucauacgaggaauacggacaucugcagauuaaugcggugagccuuuauuugcuguaccuaguugagaugaucaguuccggccuccagauaaucuauaacaccgaugaagugucuuuuauucaaaaucuggucuucuguguggagcggguauaccgcguucccgacuuuggcgugugggagcgagggagcaaauauaacaauggauccacggaacuucacucaaguagcgucggucuggcaaaggccgcuuuggaggccaucaacggcuucaaucucuuugggaaccagggaugcucuugguccgugauuuucguggaucuggacgcacacaauagaaacaggcagacuuuauguucacugcucccucgggaaagccguagucauaauaccgacgcugcccuucugccaugcaucucuuaccccgcguuugccuuggaugacgagguccuauucucccagacacuggauaagguugugcgcaaacucaagggcaaauaugguuuuaagagauuccugagggacggguaccggacuagccuugaagauccuaaccgauguuacuauaaaccagcagagauaaagcuguuugacggaauugagugcgaauuuccgaucuucuuuuuguacaugaugauugauggcguauuccgcggcaaucccaaacaagugcaggaguaucaggaccuccugaccccugucuuacaccauacaaccgaaggguacccagugguucccaaguauuacuaugugccugcugauuuugucgaguacgaaaagaacaacccaggaucgcagaaaagauuccccucuaauugugguagggacggcaagcuguuucuaugggggcaggcccucuacaucaucgcuaaacugcuugccgaugaguugauuuccccgaaggacauagacccugugcagcgguauguaccccugaaagaucagcgcaacguuucaaugagauucaguaaucaaggaccacucgagaacgaccuggugguccacguggcacuuaucgccgaaagccagaggcugcaggucuuuuugaauacguacggcauucagacucaaacaccucaacagguggagcccauccagauauggccacaacaggaacucguuaaggcuuaucugcaguuagguauuaacgagaagcuggggcuauccggccgucccgaucggccuaucggaugccucggcaccucuaaaaucuaccgaauuuuggggaagacugugguaugcuauccaaucauuuucgaccuuagcgauuuuuacaugucacaggacgucuucuugcugauagaugacaucaaaaaugcgcuccaauuuauuaagcaguauuggaaaaugcacggaagaccgcuguucuuagugcugaucagggaagauaacauccgcgguagucgguuuaaucccauucuugacauguuggcagcccucaagaagggcauaaucgggggaguuaaagugcaugucgauagacugcagacacuaauuuccggcgcugugguagagcaacuggacuuccucaggaucagcgauaccgaggaacugccugaguucaagucuuuugaggaacuugagccacccaaacacucaaaggugaaacgccagaguagcacgccuuccgccccagaauugggucagcagcccgacguuaacauuucugaguggaaggacaagccgacccaugaaauccugcaaaaauuaaaugauuguucgugccucgcaagccaggccauacugcuugggauccuguugaagcgagagggcccuaacuucauuacaaaagaaggaacugucuccgaccacaucgagcggguguaccguagagcuggcucacagaagcucuggcuggccgugagguacggggcagcguuuacccagaaauucaguucuagcauugcuccacauaucacaacuuuucuaguccacggaaagcaaguuacccugggugccuucggccacgaggaagaggugauauccaauccccucucaccucgcgugauucagaacaucauuuauuacaaauguaauacacaugaugaacgggaggcaguaauccagcaggaacuggucauacacaucggguggauuaucagcaacaaccccgagcuuuucucuggaauguugaagauuagaaucggcuggauaauucaugccauggaguaugaacugcaaaucagggguggggacaagccagcuuuagaucucuaccagcuguccccuagugaggugaaacagcuucugcuagacauccuccaaccccagcagaauggccgaugcuggcugaaccgccggcagauugauggaagccugaauagaaccccaacuggcuucuaugacaggguuuggcaaauccuggaacguacgccgaacgggauuauaguggccggaaagcacuuaccucagcagcccacacucucugauaugaccauguacgagaugaauuuuucccugcuugucgaagacacucugggcaacaucgaucagccacaauaucgccagauugugguugaguugcucauggugguaucaaucguccuggagcggaaucccgaacuagaguuccaggacaaaguggaucuggacagacuugugaaggaagcauuuaacgaguuccagaaagaccaaaguaggcucaaggagauugaaaagcaggaugacaugaccagcuuuuacaauacaccuccacuggguaaacgagggaccuguucguacuugacuaaggcugucaugaaccuguuacucgagggagaaguuaaacccaauaacgaugacccuugccugaucuccuga

SEQ ID NO: 60650 - RNA, 1260 nt, Artificial Sequence
  derived and/or modified sequence opt3 from PHKG1__Homo_sapiens__NP_001245388
augaccagagacgaggcccugcccgauagccacuccgcucaggacuucuacgaaaacuaugagccuaaggaaauccucggcaggggagugucuucagucguucggcgcugcauucauaaaccaacaagucaagaguacgcagugaagguaauagaugugacuggggguggcagcuuuuccccggaagagguccgagagcuucgugaagccacgcugaaagagguggacaucuugagaaagguuucugggcaccccaauauuauccaguuaaaagauaccuaugaaacaaacacuuucuuuuuccugguguuugaccuaugggaggauaccgacacaauggagauggaacagaaguggugucucggaugggauucgccuaagucaaccaauuucagggcgcagggccgggcucgcaugaaaagaggugagcuguuugacuaccuuacugaaaaggucacacugagcgagaaagaaaccaggaagauuaugcgggccuugcucgaggugaucugcacgcugcauaaacugaacauaguacaccgcgaucucaagccagagaauaucuuacuggacgauaacaugaauauuaaacuuacugacuucggguuuaguugucaauuggaacccggagagcgacugagagaaguuugcggcaccccuuccuaucuagcaccagagaucauugaauguucuaugaacgaggaccaucccggcuacgggaaggagguggauauguggagcacaggagucaucauguauacucuccuggccgguuccccuccauucuggcacaggaagcagaugcuuaugcugcggaugauaaugucaggcaauuaccaguuugggaguccggaaugggacgauuacagcgacaccgugaaagauuuggugucucguuuccucgucguucagccccaaaaccgcuauacagcugaggaagcacuggcccacccauuuuuccagcaguacuuaguggaggaaguaagacauuucuccccuaggggaaaguuuaaagugauugcucugaccguccucgccucagugcggaucuauuaccaguaucgacgcguuaagcccgugacgagagagauugucaucagggacccuuacgcgcuucggccacugcgcagauugaucgaugcauaugccuucaggauuuacggccacugggugaaaaagggucaacagcagaaucgugcugcccuauuugagaacacucccaaggcaguacugcucagccuggcugaagaggacuacuga

SEQ ID NO: 60651 - RNA, 1221 nt, Artificial Sequence
  derived and/or modified sequence opt3 from PHKG2__Homo_sapiens__NP_000285
augacccuggacgugggccccgaggaugaacucccugacugggccgcugcaaaggaguucuaccagaaauaugauccaaaggacgucaucgggagaggaguuagcuccgugguaaggcggugcgugcaccgcgccacaggucaugaauuugcggucaaaauuauggaggugacugcugaacgacuuucuccggagcaacuggaggaaguucgugaggccacgagaagggaaacccacauauugcggcagguagcaggccauccccacaucauuacauuaaucgauucauacgagaguagcuccuucauguuucuggucuucgaccuaaugcgcaagggggagcucuuugauuaucugacugaaaaaguggcccuuucugagaaggaaaccagaucgauuaugaggucacuguuggaggcugugagcuuccuccaugcaaacaauaucguucaccgggaccugaagccugaaaacauacugcucgaugacaauaugcagauccgcuuaagugauuuuggauucuccugucaccuggagccaggcgagaaacuucgagaauugugcgguacacccggguaccuggccccugagauucuaaaguguucuauggacgaaacccauccaggauauggcaaagagguggaucucugggcuugcggcgucauccuguuuacucuucuggccgggagcccucccuucuggcacagaaggcagauuuugaugcuccggaugaucauggaaggacaauaccaguuuuccucaccagagugggacgaccguaguagcacagugaaggaucugauaucucgcuuacuccagguggacccggaggcgagacugaccgcagaacaggcccuucaacaucccuucuuugagaggugugaagguucccagccuuggaaccugacgccacggcagcgauuccgcgucgcuguuuggacuguguuggccgcaggcagaguagcucuaucaacccacagggugcggccccugacuaaaaaugcccuccugcgcgauccuuaugcgcuuagaagcgucaggcaccugauugacaacugcgccuuccguuuguacgggcauugggugaagaagggagagcagcaaaaucgggcagcucucuuucagcaccgaccacccggcccguucccuaucaugggucccgaagaggagggggauagugccgcuauuacagaagacgaggccguucugguguuaggauga

SEQ ID NO: 60652 - RNA, 1206 nt, Artificial Sequence
  derived and/or modified sequence opt3 from PHLDA1__Homo_sapiens__NP_031376
augagaagggcccccgcugcagagcggcugcucgaacuuggcuucccuccacgcugcgggcgacaggagccgcccuuuccucugggagugacccgugguuggggcagauggccaauccaaaagaggcgggaaggggcccgccccgucccuuucagcgagagaucccaggaagacggaaggggcccagcggcucggucuucagguacauuguggcgcauucgaacuagauuaagucuguguagggaucccgagccuccaccgccccuaugccuccugcggguuagccuucugugugccuugcgugcagggggacgcggcuccagauggggcgaggacggggccaggcuccugcugcucccuccagcucgggcagccggaaacggugaagcugagcccucuggcgggccuucguacgccggacgaauguuagaaucaagcggcugcaaagcgcugaaggagggugugcuugagaaacgcagugauggguugcugcagcuauggaagaaaaaguguugcauacucacggaagagggacugcuucugaucccacccaagcaguugcaacaccagcagcagcaacagcagcagcaacagcagcaacagcagcagcaaccgggccagggcccugcagaacccucccagccaucugggccugccguagcuagccucgagcccccagugaaacugaaggaauuacauuuuuccaauaugaaaaccgucgacuguguggagagaaagggaaaauauauguacuucacaguugugauggccgaggguaaggaaauugauuuuaggugcccccaggaccaaggcuggaacgcagagaucacucugcagaugguccaguauaagaaucggcaggcuauucucgccgugaaaucaacccgccaaaagcagcagcaccuuguacagcaacagccuccaagucagccgcaaccccagccucagcugcagccacaaccccagccucagccacagccccaaccgcagccucagagccagccacaaccccagccucagcccaaaccacaaccucagcaguugcaucccuacccacacccgcauccucacccccacucucauccacacucccauccccacccucacccacauccccacccucaucagaucccgcacccacauccccaaccucacucacagccacacgggcauagacuacugaggagcacaaguaacucugcguga

SEQ ID NO: 60653 - RNA, 459 nt, Artificial Sequence
  derived and/or modified sequence opt3 from PHLDA2__Homo_sapiens__NP_003302
augaaaagccccgacgaggugcugagagaaggcgagcucgaaaagagguccgauucucuuuuccagcuguggaagaaaaagcggggugucuugaccucagaccgcuuaagucuguuuccugccagcccacgagcucguccgaaagagcuaagauuccacuccauccucaagguugauugcguggaaaggacaggaaaguacguauauuuuacuauugugacgaccgaccauaaagagauagauuuccggugugcaggggagucuugcuggaacgccgcgaucgcucuggcccuuauugacuuucaaaaucgcagagcacugcaggauuucaggucgcggcaggaacgcacagcccccgcugcacccgccgaggacgcugucgccgcggcagccgcugccccaucagaacccagcgagccuagucgaccauccccucagccuaagccaagaacuccguga

SEQ ID NO: 60654 - RNA, 384 nt, Artificial Sequence
  derived and/or modified sequence opt3 from PHLDA3__Homo_sapiens__NP_036528
augaccgccgcugcaacagccacugugcugaaggagggcguccucgagaaaagaagcgggggacuucugcaguuguggaagaggaaacggugcguuuuaacggaacgcggucugcaacuauucgaagcgaagggcaccgggggacgacccaaagagcucuccuuugcucguaucaaggccguggaauguguagagucuacaggcagacacauuuacuucacucuggugaccgagggugggggagaaauagacuuuaggugcccucuugaggauccaggcuggaacgcacagaucacacugggcuuggucaaguucaaaaaucagcaggccauucaaaccgugcgggcucgccagucacucgggacuggaacacugguuaguuga

SEQ ID NO: 60655 - RNA, 3960 nt, Artificial Sequence
  derived and/or modified sequence opt3 from PHLDB1__Homo_sapiens__NP_001138231
auggacgcccugaacagaaaucagaucggccccgggugccaaacccagacaauggugcagaagggaccucucgaucuuauugagacugguaaaggccugaagguccagacggacaaaccacacuugguuagcuuaggguccggaaggcugucuaccgcuauaacacuacucccgcuggaagagggccggacugugaucgguucagcagcccgcgauauuagucuucaagggcccggacuggcgccugaacauuguuacaucgagaacuugcgaggcacccucacacuguauccaugcggcaaugcuuguaccauugacgggcugcccguacgucagccuacuagacucacacagggaugcauguuaugucugggucagagcaccuuccuuagguuuaaccacccagccgaagcaaaguggaugaaauccaugauccccgccggcgggcgggcuccuggaccaccguacucucccgugccugcagagucggagucauuggucaauggcaaccauacgccacaaacugccacccgcggucccagcgcuugcgccagucacuccucucuggugagcuccauagaaaaggaucuacaggagaucauggacucacucguucuggaagaaccuggggcggcaggaaagaaaccagccgcuacaaguccccuuagcccgauggccaauggcggcagauaucuguugucuccucccacuuccccaggggcaaugucagugggaagcaguuacgagaacaccucuccugcuuucaguccccucagcucgccagccucuuccgguucaugugcgagucauagccccuccggccaggaaccugggccaucugucccgccccuggugccugccaggagcucaaguuaucacuuagcacugcagccaccccaaucccggccuagcggagcucgcucugagucaccacgacucaguagaaagggcggucacgaaaggcccccgagcccugggcuucggggccuguugacagauuccccagccgcuaccguacuagccgaggcacgucgcgccacggaaucucccagacugggaggccagcucccuguuguggcuauuucgcugagcgaguaccccgcguccggggcacuuucacagccaacuuccaucccuggaucucccaaauuucaaccaccggucccugcccccaggaauaagauugguacacugcaggaccggccacccagcccuuuccgagagccacccggcuccgaacgcguguugaccacuucaccuagcagacagcucguggggaggacauuuucugauggacuggcuacccggacguuacagccgccagagaguccccgccugggcagaaggggucuagacuccaugcgugaacucccuccacugagccccucucuuucccggcgagccuugucaccucugccgaccagaacaacucccgauccaaaacucaacagggaggucgcagaaaguccucgcccccggagaugggccgcucauggggccagcccagaggacuucucgcugacccuuggcgcaaggggacgccgaacacgguccccuucucccacucugggcgagagcuuggcgccacacaaggggucauuuaguggacgucucuccccggcuuauucucuggguagcuuaaccggcgccuccccuugccaaucacccuguguucagagaaagcugagcaguggggaucuaagggugccaguaacacgcgaacggaaaaauucuaucaccgagauauccgacaacgaagacgaucuccuggaguaccauagaaggcagcgacaggaacgccuucgggagcaagagauggaaagauuggagaggcagcgucuggaaacuauucucaaucugugcgcagaguacagccgcgccgacggaggccccgaggcuggugaauuaccuucgaucggggaggccacggcagcucuggcccuugcgggccggagaccaucaaggggauuggccggcgcuucugggcgaaguuccgaggagcccggaguggcaacacagcggcucugggaaagcauggagcgcucugaugaggaaaaccugaaggaggaauguagcuccaccgagucaacucagcaagaacacgaggacgccccuaguaccaaacuacagggcgagguccuggcucucgaagaggaaagagcccaggugcugggucacguugagcagcuuaaggugagggucaaagaauuggagcaacagcugcaggagagcgcacgggaagcggagauggaacgagccuuacuccaaggggagagagaggcugaacgcgcccugcuucagaaggagcagaaagcaguggaucagcugcaagaaaaguugguagcucucgagacagggauucagaaggaaagggacaaagaggccgaggcacuggaaaccgagacuaagcuauucgaagaucuggaguuucagcagcucgaacgugagucucggguugaggaagagagagaacuggccggccaaggucuuuugagguccaaagcugagcuguuacgcucaaucgcgaagcgaaaagaaagacucgccauccuggacagucaggcaggccagauucgggcucaggccgugcaagagagcgagaggcuugcccgcgauaagaaugcuucccugcagcuacuccagaaggaaaaagagaagcugacagucuuggaacguagauaucauucucugacgggaggacggccguucccaaaaaccacuucgacauuaaaggagguguacaggagcaaaauggacggcgaggcaaccucaccccucccucgcacacgauccgggccccugccaaguucuagcggauccucaucuagcaguucccaacuuagcgucgccacucugggcagaucuccuucacccaaguccgcguugcucacccagaacgguacggggagucugccacggaaccuagcugccacccugcaggauauagaaacaaagaggcagcuugcacuccaacagaaaggacaacaggugaucgaggaacagcgcagaaggcuggccgaguugaagcagaaagcugcagccgaagcgcagugccagugggacgcucugcacggcgccgcaccuuuuccggccggucccagcggcuucccaccuuuaaugcaucacucgauucuccaucaucugcccgcugggcgggagcguggagaggaaggcgagcacgccuaugacacucuuucucuggaauccagcgauucaauggagaccaguaucucuacagggggaaauuccgcaugcagcccagacaacaugucaagugcuagcggcuuggauauggguaagauagaagagauggagaaaaugcucaaggaagcccacgcggagaagaaucgccugauggaaucccgagagagagaaauggagcuaaggcggcaagcccuggaggaggaacgcagaaggcgggaacagguugagcgaagacuucagucugagagcgcacgcaggcagcaacucguggaaaaagagguaaagaugcgggaaaaacaguuuucccaggcucguccucugacuagauacuugcccauuaggaaggaggacuucgauuuaaaaacccacaucgaaucaucugggcauggagucgacacgugucugcacgugguucucaguucgaaggugugccgcggcuaucuggucaaaauggguggcaagaucaagagcuggaaaaagcggugguucguguuugaucgacuuaaaagaacacuguccuacuauguagacaagcacgagaccaaauugaagggggugauuuacuuccaagccaucgaggaaguuuacuaugaucaucuaaggucugcugcaaagucaccgaacccagcccugacuuuuugugucaaaacacacgaccgccucuacuauaugguggccccuagcgcugaggcgaugcggauuuggauggaugugauagucaccggagcagaaggcuacacucaguucaugaauuga

SEQ ID NO: 60656 - RNA, 5154 nt, Artificial Sequence
  derived and/or modified sequence opt3 from PHLPP1__Homo_sapiens__NP_919431
auggagcccgccgcugcagccaccgugcagagacugccugaacucggcagggaggaccgggcgagcgcuccagccgcagccgcugcagccgcugccgcggcagccgcugccgcagcugcccuugcggccgcagcugggggaggucgcuccccggaacccgcccugacaccugcugccccaucuggcgggaacggaucaggcaguggugcacgagaggaagcccccggggaggcuccuccaggacccuugccuggccgugcgggcggggcaggaagaaggcggcgcagaggugccccacaaccgaucgcuggcggggccgcacccgucccuggagccggcgguggggcuaauagcuuacugcuaaggcggggacgccucaagcgaaaccuguccgccgcagcggcugccgcaucuucgucaagcaguuccucugccgcugccgcaagccacuccccaggcgcugccggccuucccgcgucaugcagugccagcgcuucucuguguacuagauccuuggauaggaaaacgcuccugcugaagcaucggcagacccuccaguuacagccuucagaccgugauuggguucgccaccaacugcagagagggugcgugcauguauucgacaggcacauggcaagcacauaccuucggccaguguuguguacucuggauaccacagccggagaggucgcugcccgacuacuccagcugggucauaaaggcgggggagugguuaaggugcuuggccagggucccggggcagcggccgcucgcgaaccggccgagccucccccagaagcaggcccuagacuggcucccccagagcccagggacagugaggucccuccagcccggucugcaccgggagccuuuggcgggcccccucgcgcuccacccgcggauuugccucucccagugggaggucccggcgggugguccagaagggccagcccggcaccuucggacucuuccccaggagaacccuucguaggcgguccuguuucaaguccccgugcuccacggccuguggucagcgauaccgaguccuuuucucugagccccucagccgaaaguguguccgaccgauuagauccauauagcucugggggcggaucaaguagcuccucugaggaacuggaggccgacgcugcaucggccccgacuggcgugccugggcaacccagaaggccaggacaccccgcgcagccucucccacuuccccagacagcuagcuccccucagccgcaacagaaagccccacgcgcaauugauucacccgguggcgccguccgggaggggaguugcgaagagaaggcugcagccgcgguugcuccuggaggccugcagucuaccccagguagaagcggggugacggccgaaaaggcacccccuccgcccccaccucccacuuuguacguacaacuacacggcgagaccacaaggcgccuggaagccgaggagaaaccacuccagauacagaaugacuaucuguuccagcuuggauuuggcgaacuguggcgagugcaagaggaagggauggacuccgagaucggauguuugauucgguucuacgcuggcaagccucauucaacugguagcucugaacguauccagcucuccgggauguauaacgucagaaaaggaaagaugcagcugcccgugaauagguggacccgccggcagguuauuuuaugcggcacaugucugaucgugaguagcgucaaagauucucuaaccgguaagaugcacgugcucccacugauaggcgggaagguagaggagguuaaaaagcaucaacacugccuugccuuuuccucaaguggaccgcagagccagacguacuauaucuguuucgacacuuuuacagaauacuugagauggcugaggcaggugucgaaagucgcaucccaacgaauuucuagcguggaucucucaugcuguagucuggagcaccuuccugcuaaccuguucuacucccaggacuugacccaucucaaucugaagcagaacuuuuuacgccagaaucccucucugccagccgcgcggggccuaaacgaacuccaaagauucacuaaacugaagagccuuaauuuguccaacaaucaccugggggauuuuccccucgccgucugcucaaucccuacacuggcagaguuaaacgugagcugcaaugcucugaggaguguuccagccgcugugggaguaaugcauaaccuucagaccuucuugcucgacggcaacuuccugcagucucuacccgcagagcuggaaaauaugaaacaacucuccuaucugggucuuagcuuuaacgaguucacggauauuccugaagucuuggagaagcugaccgccguggacaaguuauguaugucggggaauugcguugaaacacuccgucugcaggcccuucgcaaaaugccgcacaucaagcauguggaucugcgguugaacgucauaagaaaacucauugcugacgagguggauuuucugcagcacguaacucagcuagaccugagggacaauaagcucggagaucuggacgcgaugaucuucaacaauauugaggugcuucacugugaacgaaaccaauugguuacccuggauaucugcggcuacuuuuuaaaagcacucuaugccucaucuaaugagcugguccagcuugacguguacccagugcccaacuaucugaguuacauggaugucucccggaaucgccuagaaaacguuccugagugggugugugaaagcagaaagcucgaggugcuggacaucggucauaaucagauuugcgaguugcccgcuaggcuguucuguaacucuagcuuacggaagcuccuggccggccacaaucagcuugcacgacugccagaaagauuggagcgcacauccguagaaguccucgaugugcaacauaaccagcugcuagagcugccucccaaccuucucaugaaagccgacucacugagguuuuugaaugcuagugcgaacaagcuggaaagcuuaccaccugccacucucucugaggagaccaauuccauacugcaggaacuuuaucugacaaacaauucauugaccgauaaaugcguuccgcuccugacugggcacccccaccuaaagauccugcauauggcauacaaccgucuucagaguuucccagcuagcaaaauggccaagcucgaggaacuggaggagauugacuuguccggaaauaaguuaaaagcaaucccuacgacaauaaugaacugucggagaaugcacaccgugauugcccauucuaauugcaucgaagucuuucccgaggugaugcaacugccagaaaucaaguguguugaucucucgugcaacgagcugagcgaagugacucuuccugagaaucugcccccgaaauugcaggagcuagaccugaccggcaacccaaggcucguacuggaucacaagacacuugaauuacugaauaacauucgcugcuucaaaaucgaccagccuucaaccggggacgcuuccggagcccccgcggucuggagucauggcuacacugaggcaucuggugugaagaauaagcucuguguggccgcuuugagcgucaacaacuuuugcgauaaucgagaagcccuguaugggguuuucgacggagauagaaacguggagguaccauaccuccugcaauguacaauguccgacauucuugcugaagagcugcagaaaacgaagaaugaggaagaguauauggugaacaccuuuauagucaugcagcggaaauugggcacugcaggucagaagcuaggcggggccgcugugcugugccacaucaaacacgaucccguugacccuggaggcucauucacacucaccucugccaauguggggaagugucaaacagucuuaugcaggaacggaaaaccgcugccccuuagccgcaguuacauuauguccugugaagaggaacugaagcguaucaagcagcauaaagcaaucauuacugaggauggcaaggugaaugguguuaccgagagcacgagaauacucggguauaccuucuugcacccaucuguggucccucggccccauguacagucagugcugcucacaccucaggacgaauuuuucauccugggauccaaaggccuuugggauagucuaagcguugaggaagcgguggaggccgucaggaacgugccagacgcucuggccgcagcuaagaaauugugcacuuuagcccaaucguacggcugucacgauucuauuuccgcaguagugguccagcugagcguuaccgaggacucauuuugcuguugcgaacucagugccgggggagcugugcccccuccaucucccgguaucuucccgccuuccgugaauauggucauuaaggaucgcccaagcgacggccugggggugcccucaaguagcuccggaauggcgucugagaucagcuccgaacuuucaacaucugagaugaguucggaaguuggcagcacugccuccgacgagccuccacccggugcacugucugagaacucaccggcuuauccuagcgaacagcgaugcaugcuccaucccauauguuuguccaauaguuuucagagacaacugucuagcgccaccuucucauccgccuuuagugauaacgggcuagacagcgaugacgaggaaccaaucgagggaguauucacgaauggcucucggguggaagucgagguggauauucacugcuccagggcaaaggagaaagaaaagcagcagcaccugcuccagguuccugcugaggccucagacgaaggcaucgugauuagcgcgaacgaggaugaacccgggcuuccacgcaaagcugacuuuucggccgucggaacaaucgguagaaggcgggcaaauggcucuguggccccccaagagcguagucauaacguaauagaggucgcuaccgaugcaccucugcgcaagccagggggauacuucgccgcgccggcucagcccgacccugaugaccaguuuauuaucccacccgaauuagaggaagaggugaaagagauuaugaagcaccaucaagaacagcagcagcaacagcagccuccacccccuccgcaguugcaaccacagcugccccgacacuaccagcucgaccagcugccugauuauuacgacacuccccuuuga

SEQ ID NO: 60657 - RNA, 3771 nt, Artificial Sequence
  derived and/or modified sequence opt3 from PHLPP2__Homo_sapiens__NP_001275932
augaagagaaacggcagcaggaauugccugaaccggcgcucccgauucgggucucgugagagagacuggcucagggaagaugugaaacggggaugugucuaccuuuauggugccgacaccacaacugcuacgaccacaacuaccacaucaaguagcuccucuucgucaagcaguuccucugaucugcacuugguuuuaugcaccguggagacucccgcaagcgaaaucugugccggcgaggggcgcgaaucccuguaccuacagcuccauggagaccugguaagaaggcuugagccuacagagcggccacugcaaauuguguaugauuacuugucacgccucggcuuugacgauccgguccgaauacaggaagaggcgaccaaucccgaccuggguugcaugaucagauucuauggggaaaagccuugucacauggauaggcuggaccggauucucuuaaguggaaucuacaacgugcguaaaggcaagacgcagcugcauaaaugggcugagcgccuuguuguguugugcggcacuugucugauugucagcucugugaaggauugccagaccgggaagaugcacauccuaccacucguaggagguaaaauagaggaaguuaagagaaggcaauauucccuggccuuuucaagcgcaggcgcccaggcucagacauaccaugugaguuucgagacucuugcagaauaccagcgguggcaacgacaggccucuaaagucgugucccagcgcaucagcaccguggaccugucguguuauucuuuggaggaaguccccgagcaccucuuuuacucccaggauauuacauaucugaauuuaagacacaacuucaugcaacuggagaggccugggggacucgacacccuuuacaaguuuucacagcugaaaggcuugaaucuaagucauaacaagcugggucucuucccaauccugcuuugcgaaauuagcacgcugacugaguugaaucucuccuguaacggguuucacgaccugcccucucagaucggaaauuuacugaaccuacaaacacucugccuggauggcaauuuccuuaccacuuugccugaagaacugggcaaccuccagcagcugagcucacuugggauaaguuuuaauaacuucucccagauuccagaaguuuaugagaagcugacaauguuggaccgggugguaauggcuggaaacugccucgaggugcugaauuuagguguccugaaccgcaugaaucauaucaaacacguggaucuaagaaugaaccaccucaagaccaugguuauugaaaaucuggagggcaacaaacauaucacgcacguggaccuuagggauaaucguuugaccgaccuggaucucagcucucuguguucauuagaacaacugcauugcgggcggaaccagcuucgagaguugacacucaguggauuuagccugagaacucuauacgccuccucuaauaggcugaccgcggucaacguguauccgguacccucgcuccugacauuccuugacuugagccgcaaucuguuagaauguguuccugauugggcaugcgaggccaagaaaaucgaggugcucgacgucuccuacaaccugcuuacugaagugccaguccggauucugucaaguuugucucucagaaagcugaugcuaggccacaaucaugugcagaaccugcccacccucguugagcacauaccucuggaagugcuugauuugcagcacaaugcucugacaagguuaccagacacccucuucagcaaagcccugaacaaacuuaacaagcuggagcaacuagaggaacucaaucuguccgguaacaaguugaagacuauccccacgacaauugcaaauuguaaacgccugcauaccuuaguagcucacucaaacaauaucagcauauuuccggagauucuccagcugccucagauccaguucgucgaccuuucuugcaacgaucugacugaaaucuugauucccgaggcccucccagcgacccugcaagaccuagaucugacagggaauaccaaccuugugcucgaacauaagacucuggacaucuuuucccacauuacaacguugaaaauagaucagaagccucugcccaccacugacaguacaguuaccagcacauucuggucucacggcuuagccgagauggcaggacagcgaaauaagcucuguguguccgcucuggccauggauucauuugcugagggcgucggggccguguacggaauguucgacggugaucggaacgaggagcuuccacgucuguugcagugcacuauggcagacguacuccuggaagaggugcaacagaguaccaaugauacgguuuuuauggccaacaccuuccuagucagccauagaaaacugggcauggcugggcagaaacuuggaucguccgcgcuccuguguuauaucaggcccgacacagcagauccugccucuagcuuuucauugacuguggcuaaugugggaaccugccaagccgucuuaugucgcggugggaagccaguuccgcugaguaagguguucucccucgaacaggaccccgaggaggcacagcgggugaaagaccagaaggccauuaucacagaagauaacaagguaaauggcgucacuugcugcaccagaaugcugggauguacguaccuuuauccuuggauccugccaaaaccccacauuucuagcacaccuuugaccauacaagacgagcuacugauccucggcaacaaggcucugugggaacaucuuuccuacacugaggccgugaacgcaguuaggcacgugcaggauccauuagcggcugccaaaaagcugugcacacucgcacagucauaugggugucaggacaaugucggagccauggugguuuacuugaacauuggugaagagggcugcaccugugagaugaaugggcugacucuccccggaccggugggcuuugcuagcaccacaacgaucaaagaugccccuaagccagcaacccccaguucuuccagcgguauugcuucggaguucucaucugaaaugaguacuuccgaaguaagcucugaggucgggagcacagccuccgacgagcauaacgcgggcggacuggauaccgcccuucugccucgacccgaacgccggugcucauugcacccaacaccuaccaguggccuauuucaaagacagcccagcucugcuacuuucuccucaaaucagagugacaacgggcuggauagcgacgaugaccagccaguggagggagugaucacgaauggcuccaaggucgaaguugagguggauauacacuguugcaggggucgugaccucgaaaacucuccgccuuuaaucgagucgagccccacacuguguucagaggaacaugcacgcggguccugcuucggcauucggagacaaaauaguguaaacucuggcaugcuucugccaaugagcaaagacaggauggagcuccagaagucccccucaaccucuuguuuguaugguaaaaagcugagcaauggcaguaucgugccucucgaagauucccugaaccuuauugaggucgccacugaagugccaaaacgaaagaccggguacuuugcugcccccacacagauggagccugaggaccaauucguugugccgcacgaucuagaagaggaagucaaagagcagaugaagcagcaucaggacagccggcuggaaccagagccccacgaggaagaucgcacugagccuccagaagaguuugacaccgcauuguga

SEQ ID NO: 60658 - RNA, 855 nt, Artificial Sequence
  derived and/or modified sequence opt3 from PHOX2A__Homo_sapiens__NP_005160
auggacuacagcuaucugaacuccuacgauucuugcguggccgcuauggaggcaucagccuauggcgacuucggggcguguagucagcccggagguuuucaauacagcccucucagaccagcuuucccggccgcaggucccccuugcccagcccuuggguccucuaauugugcucugggagcauugagggaucaccagcccgccccuuauucggcugucccauacaaguuuuuccccgaaccuucaggcuuacaugagaaacggaagcagcgccgaauccguaccacauuuacuagcgcccagcugaaagaacuagagagaguuuucgcggaaacgcacuauccagacauuuacaccagggaggagcucgcacugaagauagaucuuacagaagcccgggugcaaguaugguuucagaaccgcagagcuaaauucaggaagcaggagcgggccgcaagugcuaagggugccgcgggggccgcaggagcuaaaaagggcgaagcccgcugcuccucugaggacgaugacagcaaagaguccacuuguucaccgacccccgauaguacagcuagccugccuccacccccugccccaggcuuggcaucuccccgacucuccccgucaccucugcccguggcccuggggagcggaccagguccuggccccgggccacagccccucaagggagcuuuaugggcgggcgucgcaggcgggggaggcggcgggccuggagccggugcugccgaacugcuuaaagcauggcaaccagccgagaguggcccggggcccuuuucuggaguguuguccagcuuccauagaaagccuggcccagcucugaagaccaaucuauuuuga

SEQ ID NO: 60659 - RNA, 945 nt, Artificial Sequence
  derived and/or modified sequence opt3 from PHOX2B__Homo_sapiens__NP_003915
auguacaagauggaguauagcuaccugaacuccucugccuaugaaucaugcauggcuggcauggacaccaguagccucgcauccgccuacgcggauuucucuucguguucacaggcuagcggguuucaauauaaucccaucagaacaacuuucggagccacgagugguugcccuucccuuaccccaggcucuuguagccuggggacauugagggaccaccaguccucaccguacgcagccgugcccuauaaauuauuuacugaucauggaggccugaacgagaagcggaaacagcgccguauucgaaccacauucaccagugcucagcuaaaggaacucgagagagucuuugcagaaacucacuacccugacauauacacaagggaggagcuggcccuuaaaaucgaucugaccgaagcucggguucaagugugguuccagaaucgcagagccaaguuuaggaagcaggagcgggcggcagccgcugccgcagcugccgcgaaaaacgguagcucugggaagaaauccgacucaagccgcgaugacgaaaguaaggaggccaaaucuacggauccagacuccacuggaggccccggcccuaauccaaaccccaccccuagcugcggggcaaauggagguggcgggggaggcccaucgccggcuggugcccccggggcugccggaccuggcggcccagggggagagcccgguaagggcggggcagccgcugcggcagccgcugccgcagccgcugccgcagcggcugccgcagccgcugccggaggcuuggcagcugccggugggccuggccagggaugggcgccaggccccgggccgauuacaucuaucccugauucccucggaggucccuucgccucaguacugaguagccugcaacgaccaaacggcgcuaaggcagcccucgugaaauccucuauguuuuga

SEQ ID NO: 60660 - RNA, 375 nt, Artificial Sequence
  derived and/or modified sequence opt3 from PHPT1__Homo_sapiens__NP_001129333
auggccguggcugaccuggcacucauccccgaugucgacauugauagcgacggcguuuucaaguacgugcuuauaagaguacacuccgccccuaggucuggggcgccagcugccgagucaaaagaaaucgugcggggauauaagugggcagaguaccaugccgauauuuaugacaaagucaguggugauaugcagaagcaaggcugcgacugugaaugccugggagggggccgcaucagccaccagucccaggauaaaaagauucauguguacgguuauucuaugaugcgaccgaccuguguucccuugggggcuucgggaccucguauccaccaucagggcuuauggucaugcccagcaagacacuuuaacuga

SEQ ID NO: 60661 - RNA, 4950 nt, Artificial Sequence
  derived and/or modified sequence opt3 from PHRF1__Homo_sapiens__NP_001273510
auggacgaugacagccuggaugagcucguggccagaucccccggcccugacgggcacccacaggucggaccggcugaucccgccggugacuucgaagagucuucaguuggcaguagcggggauuccggagacgauucugacucggaacauggcgaugguaccgacggggaggaugaaggagccucagaggaggaagaccuugaggacaggagcggcagugaagauuccgaggacgauggcgagacacuguuggaaguggcggggacucaaggaaaguuagaggcugccgguucuuuuaacagcgacgaugacgcagaauccugcccuaucugucugaaugccuuccgggaucaggcuguaggcacgccagagaacugcgcacacuacuuuugucuagacugcauuguggaauggagcaaaaaugccaacaguugucccgucgaucgcacccucuucaagugcauauguauccgagcucaguuugggggaaaaauucugcguaagaucccuguggagaauacaaaagccagcgaggaagaggaagacccaacuuucugcgagguuuguggcagaucugauagggaagaccggcuucuguugugcgacgguugugaugcgggguaucauauggagugccucgacccaccucugcaggaggugccagucgaugaaugguuuugcccggagugugcagcccccggagugguacuggcugccgacgcaggcccuguuuccgaagaggaagugucacucuuacuggcugaugucgugccaaccacaagccgccuuagacccagggccggccggacccgcgcgauugcccgaacuagacaaagugagagggugcgggcaacagucaaccguaaucgcaucucuaccgcuagaaggguucagcacacgccugggcgguugggauccagccugcuagacgaggccauagaagcuguggccacuggucucucgaccgcaguauaccagcgaccacugacaccccgcacuccggccagaaggaagcggaagacccgcagaaggaaaaaggugccuggccguaaaaagacacccucugggccauccgcuaaaucaaagaguagcgcgacccgguccaagaaacgacagcauagagucaagaaaaggcgcggaaagaaagugaagucugaggcaacgacucggagcagaaucgccaggacacuuggccugcgccgaccuguucacucaaguugcauucccuccguguugaaaccagucgaacccagccucggucuguuacgggcugauaucggggccgcaucucugucacucuucggcgacccuuaugagcuugauccauuugacaguagcgaggaacuguccgccaacccguugucuccccuaucggcuaagcguagagcccugagcagguccgcacuccaaucacaccagccuguggcgcgcccaguaaguguuggacugucucggagaaggcuucccgcugccgugccugagccagaucuggaagaggaacccgucccggacuugcucggcagcauucuguccgggcagucauuacugaugcuaggaagcucugaugugaucauacaucgagacgguucccucagugcaaagcgcgccgcuccugucagcuuccagagaaauucuggcucccugucaagaggggaggagggauuuaaaggcugucuucaaccaagggccuugcccagugguagcccugcacaggggcccucgggcaaccguccacaguccaccggacugucuugccaaggccgcagccggacuccugcuagaacagccggggcgcccgugaggcucgaccugccagccgcuccgggagcaguucaggcccgaaaucuuucaaacgguagugugccuggcuuccggcagucccacucucccugguuuaaugggaccaacaagcauacgcugccauuggcuagcgccgcauccaaaauuucaagccgcgauaguaagcccccuuguagaucuguagucccaggacccccucucaaaccggcgccaaggcggaccgacaucuccgaacugccccgaaucccuaagauuagacgcgaugacggcggugggaggcgugaugccgcuccagcccacggccagagcaucgagauucccucggcaugcauaucacgguuaacaggaagagaaggcacugggcaaccuggaaggggcacccgcgcugagucugaagccaguucccgagugccgagagagcccgguguucacacagggagcucucggcccccugcacccagcucccauggaucacuggccccacuaggcccuaguagggguaagggcguggggagcacuuucgagucuuuccgcaucaauauucccggaaacauggcucacuccucacagcucaguagcccaggcuuuuguaacaccuuccguccggucgacgauaaagaacagagaaaggagaauccuucuccccuguuuuccaucaaaaagacaaaacagcuucggucggaaguguacgacccaagcgaucccaccgggucagacuccagugcgccuggaucuagcccagagagguccggccccgguuugcugccuucagaaauaacucgcacgauuucuaucaacagcccgaaggcccaaacaguacaggcagugcgaugcguuaccaguuauacugucgaguccaucuucgggaccgagccagaacccccucucggacccagcucugcuaugucaaagcugagaggcgccguggccgcugagggugcauccgauacagaacgggaggagccaaccgaaagucagggcuuagccgcgaggcugcgcagaccuucacccccagagccuugggacgaagaggauggggcuucguguucuacauuuuucggauccgaagagaggacugugacgugcgucaccguuguggagccggaagcacccccaagcccugacgugcuucaggcagccacucaucggguagucgaguugcgucccccaucacgcagucgaucuacauccagcucaagaaguaggaaaaaggcuaaacggaagcgcgugagcagagaacacggcaggacccgguccgggacacgaucugagagcagagaccgcuccucaaggucugcaaguccuucgguuggagaggaacggccccguagacaaaggagcaaagccaagucccgccggucuucaagcgaucgauccaguucuagagagagggcgaagcgcaaaaaggcuaaagacaagagccgggaacauagacguggcccguggggucacucaaggcggacuucccgcagucgaagcgggucuccaggauccucaagcuacgagcacuaugaaucgcggaaaaagaaaaagaggcggucugccagucgcccuagaggcagggaguguucccccaccagcucacucgaacgacugugccggcauaagcaccagcgugagagaucccaugagcgcccagauaggaaagaaucuguggcauggccccgggacagacgcaagaggcgaagccggaguccuuccagcgagcacagagccagggaacaccgccguccgcggucuagagagaaauggccccagacgaggucacauaguccagagcgcaagggugcuguccgagaagccuccccugcaccccuagcucagggcgagccugggcgggaagaucugccaaccagacuccccgcccugggagaggcgcacgugagcccugaaguugccacagcagacaaagcuccacuucaagcucccccgguguuggagguagcugcagagugcgaaccugaugaccuggauuuagacuacggcgauucugucgaggccgggcauguguuugacgacuucucgucagaugccguguuuauucagcucgacgauaugagcuccccacccaguccugaaucuacugacagcuccccagagagggauuucccccugaagccggcccuuccucccgcgucacuggcagucgccgcuauccagcgcgaaguuaguuugaugcacgacgaggauccaucucaaccucccccacuccccgagggaacccaggaaccucaucugcuaagaccagacgccgcagagaaggccgaagcuccgagcucccccgauguggcgccugccggcaaagaggacucaccaagcgcaucuggucggguacaggaagcugccaggcccgaggagguggucucccagacaccucugcuccguagucgagcacuggugaagcgcguuacuuggaaucuucaagaaagcgagucguccgccccagcugaagauagagcgccccgggccccuuugcacaggccgcagaaaccacgcgagggggcaugggacauggaggauguggcccccaccggagucagacagguguuuucugaacugccuuuccccucacacguuuuaccagagccuggcuuucccgacacggacccaagccagguguacaguccgggccucccucccgcuccagcccaacccuccucuauuccuccaugugcucuggucagccagcccacaguacaguucauacuucaggggucacugccucuagugggaugcggugcagcccaaacccucgcuccgguuccagccgcacugacucccgcguccgaaccugccagucaggcuacagccgcaagcaacucugaggaaaagaccccagcuccccgguuggccgcagagaaaacuaagaaggaggaauauaugaaaaagcugcauaugcaggagagggccguggaagaggucaaauuagcuaucaagccuuucuaccaaaaacgagaagugaccaaggaggaguauaaggauauucuccguaaagcgguacagaagaucugucacucaaaauccggcgaaaucaaucccgugaaggucgccaaccugguuaaagcauacguggacaaguauagacauaugcgccggcacaaaaagccagaggcuggggaggaaccgccuacacagggagccgaaggcuga

SEQ ID NO: 60662 - RNA, 2289 nt, Artificial Sequence
  derived and/or modified sequence opt3 from PHTF1__Homo_sapiens__XP_011538833
auggccagcaacgagagagacgcuaucuccugguaccagaagaaaauuggcgcauaugaucaacagauaugggaaaagucuaucgagcagacccagauuaaagggcugaagaauaaacccaagaagaugggacacaucaaaccugaccucauugauguggaccuuaucagggguucaacauucgccaaggcgaaaccagaaauaccguggacuucucugacgcggaagggcuugguccgcguuguguuuuuccccuuauuuagcaacugguggauccaaguaaccucccugcgaauuuucguguggcuacuccugcuuuacuuuaugcaggucaucgcuauugugcuguauuugaugaugccuaucguuaauauaucugaggugcucgggccacugugccugaugcucuuaaugggaacaguccauugucagauugugucgacucagaucacccgucccucaggcaacaaugguaacagaaggcggcgcaaacugagaaagacaguaaauggggauggaagcagggaaaacggcaauaacaguuccgacaagguucggggcauugagacccuugagucugugccuaucaucgggggauucugggaaacuauuuuugguaaucgcauaaaacgagucaaguugaucagcaacaaaggcacagagaccgauaaugacccauccugcgugcaccccauuaucaagagaaggcaaugucggccugaaauacguauguggcagacgcgcgagaaagccaaguucucagauggggagaaaugcagaagggaagcauuucggcgacugggaaacggcgugagugacgaucuaagcucugaggaagacggugaggcccgcacucagaugauucuccugagaagguccgucgaaggggcuucaagcgauaauggaugugagguuaagaaccggaagaguauccuuucucgccaucugaacucccaggugaaaaagaccacaacuagauggugccacaucguaagggacagcgacucguuggcagagucugaauuugaguccgccgcuuuuucacaaggcagucguagcggcguguccgggggaucucggagccucaauaugucacgaagagauagugaauccaccaggcaugacagcgagacagaagauaugcugugggacgauuuacugcacgguccagagugucgcaguucagucaccagugacagcgagggcgcccacgugaacacgcuccauuccgggacuaaacgggauccgaaggaagacguuuuccagcagaaucaccuuuucuggcugcaaaacucuucgcccagcuccgauagagugucagcgauuaucugggagggaaaugaaugcaaaaagauggacaugagugucuuggagauuucuggcauaaucaugagcagggugaacgcauaccagcaggguguaggguaucagaugcuaggcaauguugugacaauuggacuggccuucuucccuuuucuccaucgccuguuccgagaaaagucccuugaucaacugaaaucaaucagcgcugaggagaucuugacccucuuuuguggcgccccacccgucacuccuauuauagugcugucuaucauuaacuucuuugaacgguuaugccugacauggauguucuuuuucaugaugugugucgcagagcguaccuacaagcagagauuucuauucgcuaaacucuuuucccacaucacgagugccaggaaggcgcgcaaauaugaaauuccacacuuccggcugaagaagguggagaauaucaaaauauggcuuagcuugagaucuuaccugaagaggcgagggccccagcgcuccguugacgugguagucucaaguguguuucuccugacccuuagcaucgccuucauuugcugcgcacagguucugcaaggacauaaaacauucuugaacgacgcuuacaauugggaguuucucaucugggaaacugcccuguuacuguuccuacuccggcuggcuucgcuugguuccgagaccaacaagaaauauucuaaugugagcauuuugcugacagaacagaucaaccucuaccugaagauggagaagaaaccgaauaagaaagaacaguuaacucuggucaacaacgugcuuaaguugucaaccaaacuccugaaggagcuagauacaccuuuuagacuguauggccucaccaugaauccccugauauacaacauuacuaggguagugauccuuagugccguuuccggggucauuucugacuugcugggauucaauauccguuuauggaaaauaaagagcuga

SEQ ID NO: 60663 - RNA, 2244 nt, Artificial Sequence
  derived and/or modified sequence opt3 from PHTF2__Homo_sapiens__NP_001120830
auggccagcaaggugaccgacgcuaucgucugguaccagaaaaagauuggcgcauaugaucaacagauaugggagaaauccguugaacagagagagaucaaggggcugaggaacaaacccaagaagacagcccacgugaaaccugaccucauugauguagaccuugugcggggaucugcguucgcuaaggccaaaccagaaucaccguggacgagucugacgcgcaaggguaucguccgagugguguuuuuccccuuuuucuuucguuggugguuacaggugaccagcaaagucauuuucuuuugguugcuggugcuauaccuccugcaaguagcagccaucguucuuuucugcuccacaucuucgccucauucaauaccacugacugaggugaucggccccauuugguugaugcuccugcuggggaccguccacugucagaucgugagcacaagaaccccuaagccaccccucaguacuggaggcaagaggcggcgcaaauuaagaaaggcugcacaucuggaagugcacagggagggugauggguccucuacaaccgacaauacgcaggagggagccguccagaaccauggcacuagcaccucccacucaguuggcacaguguuucgggaucuuuggcacgcugccuucuuuuugagugggagcaaaaaggcgaaaaauucuauugacaaguccacugaaaccgauaacggauauguaucacuggacgguaaaaagacaguuaagagcggcgaggaugggauccaaaaucaugaaccucagugcgagaccauacgcccagaggaaacggcauggaacacuggaacacuacgaaauggcccgaguaaagacacccagagaacuauuacaaacgucucugaugagguguccagcgaagagggucccgaaaccggguacucgcucaggcggcacguugaccguacgucugagggagugcugcgcaauagaaagucccaucacuauaaaaagcacuacccuaacgaggacgccccaaaaucaggcaccaguuguagcuccaggugcucuagcucacggcaggauagugaauccgcucgacccgagagcgaaacagaggacguccuuugggaagaucuguugcauugugccgagugccacucuucauguaccagugagacugacguggaaaaucaucaaaucaacccuugcguaaagaaggaguaucgcgaugacccauuccaccagagccaucuccccuggcugcacuccucucacccgggcuuagagaaaauuucggcaaucguuugggaagggaaugauuguaagaaagcugacaugagcgugcuggaaaucuccggaaugauuaugaacagagucaauucacauauaccugguaucggcuaccagauuuuugggaacgccgugagucucauccuuggacugacacccuucgucuucagguugucucaagcgacugaucuagagcagcugaccgcccacagcgcauccgagcucuacgugauagcuuuuggcucaaacgaagacguuauugugcugagcaugguaaucaucucuuucgucgugcggguuucccuuguguggaucuuuuucuuucuguugugcgucgccgagcgcacauauaagcagagacuccuguucgcuaaauuauuuggucaucugaccagugccaggcgugcacgaaagagcgaagugccacacuuccggcuaaagaaaguacagaauauuaagauguggcucucucugagauccuaccuuaaaaggcgcgggccucaacggucaguggauguuauugucaguagcgccuuuuugcugacuauaucggugguguucaucuguugcgcucagcuccugcacguccaugagauuuuucuugacugccacuauaacugggagcugguuaucugguguaucuccuugacucucuuccuguuaagauuugugacacugggcucugaaaccagcaagaaauacucaaauaccaguauucuacucacugagcagauaaaccuguaucuuaagauggaaaagaaacccaauaagaaagaggaauugacacuggugaacaauguacucaagcuggcgaccaaauuacugaaggagcuugacuccccauucagguuguacggacucacuaugaacccccugcuauauaauaucacacaggucgugauucugucugcaguuagcggcgugaucuccgaucuccugggguucaaccuuaaauuguggaagauuaagucauga

SEQ ID NO: 60664 - RNA, 717 nt, Artificial Sequence
  derived and/or modified sequence opt3 from PHYH__Homo_sapiens__NP_001032626
augagagacgugaccaucagcaaguccgaguacgcccccucugagaaaaugauuacaaagguccaggauuuccaagaggacaaagaacuguuuagguauugcacucucccugagauacuuaaguacguugaauguuucacgggcccaaacaucauggcuaugcacaccaugcugauuaauaaaccgcccgauucagggaagaagacaagucggcauccuuugcaccaggacuuacauuauuuuccauuccgccccagcgaucugaucgugugcgcauggacugccauggagcacauuucccgaaacaauggaugucuaguagugcucccugguacccauaaaggcucucugaagccacacgacuaccccaaaugggaagggggagucaacaagauguuucacggcauccaggauuaugaagagaauaaagcgcgugugcaucuuguuauggaaaagggugacacaguguucuuucacccucuguugauacaugggucgggacagaacaagacccaaggcuucagaaaagcuaucucaugccacuuugccagcgcagauugucacuacauugacgucaagggcacaagucaggagaauaucgagaaagaagugguagggauugcccauaaguucuuuggagcugagaacuccguuaaucucaaagauaucuggauguucagggcacggcuggugaagggugaacgcacuaaccuguga

SEQ ID NO: 60665 - RNA, 993 nt, Artificial Sequence
  derived and/or modified sequence opt3 from PHYHIP__Homo_sapiens__NP_001092805
auggagcugcucagcacaccccacuccaucgaaauuaacaauauaaccugcgacucuuucagaaucucaugggccauggaggauagugaccuugaaagggugacucauuacuuuauugaucugaacaagaaagagaauaagaacagcaauaaauucaagcaccgggacgucccuacgaaauugguugcuaaggcagugccauuaccgaugaccguacgcggccauugguuucugucuccccgaacagaauauuccguggccguccagacugcggugaagcaaucggauggggaguaccuaguuucaggauggagcgagaccguggaguucuguacaggugacuaugcuaaagaacaccucgcccagcugcaggaaaaggcagagcagaucgccggccguaugcuuagauuuagugucuucuacaggaaccaucacaaagaguauuuucaacacgcucggacccauugcgggaauaugcugcagccuuacuugaaggauaacuccggaucucacggcagcccaacuuccgguaugcuccaugggguguucuuuucauguaauacagaguucaacaccggacagcccccucaggacaguccauauggccgcuggagauuucaaauucccgcacagaggcuguucaauccuagcacgaaccuguacuuugccgauuucuacugcauguauacugcuuaccacuaugccauccucguauuagcgccaaaaggcucucugggggaccgguucugucgcgaucgacuuccguugcuggacauagcaugcaauaaguuucuaaccuguuccguugaagauggagaacucguguucagacacgcccaggaccugauccuugagauuaucuacacagaacccgucgaccugucauuggguacucucggcgagauuagcgggcaucagcugaugaguuuaucuaccgcugaugccaagaaagacccuuccugcaagacauguaacaucagcgugggaagguga

SEQ ID NO: 60666 - RNA, 1353 nt, Artificial Sequence
  derived and/or modified sequence opt3 from PHYKPL__Homo_sapiens__NP_699204
auggccgcugaccagagacccaaggcagauacccuggcccucaggcaacggcuuaucagcuccucuugccgccuguucuuuccugaggacccagugaaaauuguccgagcgcagggccaguacauguaugaugaacagggggcugaguacauagacuguaucucaaacguugcccacgugggacauugccacccguugguagugcaagcagcccaugaacagaaucaggucuuaaacacaaauagucguuaucugcacgauaacauuguggacuacgcucagagacuaagcgagacucuccccgaacaacuguguguuuucuauuuucuuaauuccgguucugaggcaaacgaucuggccuugaggcucgcucggcauuacacgggccaccaggacguggucgugcuggaucacgccuaucaugggcaccugucgucacucaucgacauuagcccuuacaaguuccgcaauuuagauggacagaaagaguggguacauguugcgccacugcccgacaccuacagaggcccuuauagggaagaucacccaaaccccgcaauggccuacgcuaaugaggugaagcgggucgugaguuccgcccaggaaaaaggucgcaagaucgcagcuuucuucgccgagucucuuccuagcgucgggggacaaauaaucccaccggcgggcuauuuuucccagguggccgagcacauucgaaaggcaggcgggguuuucguggcugacgaaauccagguaggauuugguagagugggcaaacauuucugggccuuucaauugcaggggaaggacuucguccccgauauugugacaaugggaaaaucaaucggcaacggucacccuguugcuugcguggccgcaacucagccagucgccagggcuuuugaggcgaccgggguggaauacuucaauacauucggaggcagucccguaagcugugcaguuggccuggccgugcuaaacguccucgagaaggaacagcugcaagaccaugcuaccucugugggguccuuucuuaugcagcuguugggacagcagaaaauaaagcacccuauugucggugaugugcggggcguugggcucuuuaucggaguggaccugauuaaggaugaggccacucguacaccagcaaccgaggaagccgcuuauuuaguaucacgccugaaagagaauuacguccuccuuagcacggacggccccgguagaaacauccugaaguuuaaaccgccuaugugcuucaguuuggauaaugccaggcaagugguugcaaagcuagacgcgauccugacugauauggaagagaaagugcggucuugugaaacccuccgacugcagcccuga

SEQ ID NO: 60667 - RNA, 777 nt, Artificial Sequence
  derived and/or modified sequence opt3 from PI15__Homo_sapiens__NP_056970
augaucgccauuagcgcuguguccucugcacuccuguucucacuucugugcgaggccaguaccgucguuuuguuaaacagcacagacuccucucccccuacuaauaacuuuacggauauagaagcggcucugaaggcccagcuagacucggcagauaucccaaaagccagaaggaagcgguacauuucacaaaaugacaugaucgcuauucucgauuaucacaaccaggugcgcggcaaaguauucccgcccgcagccaauauggaguacauggugugggacgaaaaccuggcuaagagcgccgaggcgugggcagccaccuguaucugggaucaugggccuaguuaucuucugcgauuuuugggacagaaucucuccguccguacagguagauacaggucuauacugcagcuggugaaaccaugguaugacgaaguuaaggauuacgcuuuccccuauccucaagacugcaacccacggugucccaugcgcugcuuuggcccuauguguacucacuacacccagauggugugggccacaagcaauagaaucgggugcgcaauucauaccugucagaacaugaaugucuggggauccguguggaggcgggcuguauaccucguuugcaacuaugccccaaagggcaauuggaucggugaggcgccguacaaaguggggguccccuguucaaguugcccuccaagcuauggaggcucuuguacugauaacuuaugcuuccccggcgugacauccaauuaccuguauugguuuaaguga

SEQ ID NO: 60668 - RNA, 1392 nt, Artificial Sequence
  derived and/or modified sequence opt3 from PI16__Homo_sapiens__NP_001186088
augcacggcagcugcuccuuccugaugcuccuucugcccuuguuacugcuacucguggccaccacagggccugucggagcucugacugacgaggaaaagagacuuaugguugagcugcauaacuuguacagggcacaggugucuccaacggccucagauaugcuccacaugcggugggacgaagaacuggcggcuuuugccaaagcauaugcccgccaauguguauggggucauaauaaggaacgaggccguagaggggagaaccuguucgcuaucaccgaugagggaauggacgugccgcucgcaauggaagaguggcaccaugaaagggagcacuacaauuuaagugccgcuacaugcagccccggccagauguguggucacuauacucaggucgugugggccaaaaccgagcggauugggugcggaucccauuuuugugaaaagcugcagggcguugaggaaacaaacauagagcuuuuggugugcaauuacgaaccuccaggcaacgucaaagggaagcgccccuaucaagagggaaccccuuguucucagugcccaucggguuaccacuguaaaaauucacugugcgagcccaucggcagcccugaagaugcgcaggaccuaccauaucucgugacugaggcaccgaguuucagagccacagaagccuccgauucuaggaagauggggacccccagcucccuggccacgggcauuccugcauuucuuguaacugagguuucaggaagucuggcuaccaaggccuugccagcgguggaaacacaggcccccacuagccucgcaaccaaagacccuccaucuauggcuacagaggcucccccgugugucaccacggaggugccuuccauccuggcugcccauucauuacccagccuggaugaggagccagugacuuucccuaagaguacacacguccccauuccaaaaucugcagacaagguuaccgauaagacuaaagugcccucccggagcccugaaaacucgcucgacccaaagaugucucuuacaggugcccgcgagcuguugccgcacgcucaagaagaggcggaggcagaagccgagcuacccccuuccucagaaguacuggcuaguguguuuccagcccaggauaaacccggggagcuccaggcaacccuggaccauacgggacacaccagcuccaagucucuuccuaauuucccaaacacaagcgccacugcuaaugccaccggcggccgagcacuggcguugcagucaagucuccccggggcugagggaccggacaaaccuuccgucgugagcggucugaacucuggcccagggcauguuuggggacccuuacugggccuacuccugcuuccucccuuggugcuggccgguaucuuuuga

SEQ ID NO: 60669 - RNA, 354 nt, Artificial Sequence
  derived and/or modified sequence opt3 from PI3__Homo_sapiens__NP_002629
augagagccagcuccuuccugaucguggucguuuuucucauugcuggcacccuugugcuggaggcagccguaacaggggugcccgucaagggacaggacacugugaaagguaggguuccuuucaacggccaagauccagugaaggggcaggucucugugaaaggacaggacaagguaaaagcgcaggaaccgguuaagggccccgugucaacgaagccugguaguugcccaauaaucuugauucggugugcuauguuaaaucccccuaaccgcugccugaaagauaccgacuguccagggaucaagaaaugcugugagggaagcugcggcauggccuguuuugucccccaauga

SEQ ID NO: 60670 - RNA, 1440 nt, Artificial Sequence
  derived and/or modified sequence opt3 from PI4K2A__Homo_sapiens__NP_060895
auggacgagaccagcccccugguguccccugaaagagcccagccaccggauuacacauuccccucuggcucaggggcucacuuuccucaagucccaggaggugcaguuaggguggccgcggcugccggcagugggcccagcccuccaggaucccccggccaugaccgggagcgccagccucuccuugaucgagcacguggugccgcugcacaggggcagacucaaacgguagccgcucaggcccaggcgcuggcagcccaggcugccgcagcugcccacgcggcccaagcacauagagaaaggaacgaguucccagaagacccggaguuugaggcugugguccggcaggccgaauuggcuaucgagcgcugcauuuuccccgaaagaauauaucagggaucuucgggcucauacuuugugaaggauccucagggcaggaucauugccguuuucaaaccaaagaaugaggagcccuaugggcacuuaaacccuaaauggaccaaguggcugcaaaaacuauguugcccauguugcuuuggacgggacugucucgugcugaaucaggguuaccuuagcgaagcaggcgccagucuggucgaucagaaguuggagcucaacaucgugccccgcacaaagguaguuuaucuggcuuccgaaacuuucaauuacucugcgauugaccgagugaaaagcagagggaagaggcuggcacucgagaaagucccgaaggugggacaacgguuuaaccguaucggcuuaccucccaaaguggguuccuuccagcuguuugucgaaggguauaaggaugccgacuacuggcuucgcagauucgaggcugagccauugccugaaaauaccaacaggcagcugcuacuccaguuugagcggcugguugugcuugauuacauaauccgaaauacagaccgcggaaacgauaauuggcugauuaaguaugacugccccauggacucaaguagcucuagagauaccgacuggguaguggucaaagaaccagugaucaagguugccgcaauugauaacggcuuggccuucccccucaaacauccugacuccuggagggcuuacccauucuauugggccuggcugccgcaagcaaaggugcccuuuucacaggagaucaaagauuuaauacugccuaagauuagcgacccaaauuucgucaaagaucucgaagaggaccuuuacgagcuguuuaagaaggaucccggcuucgaccgggggcaguuucacaaacagaucgcggugaugcgcggacaaauuuugaaccuaacucaggcucugaaggauaauaaaaguccucuccaccugguacagaugccacccguuaucguggaaacagccagaucucaucagagguccagcucggagucuuauacccaauccuuccagucacguaagccguuuuucaguuggugguga

SEQ ID NO: 60671 - RNA, 1446 nt, Artificial Sequence
  derived and/or modified sequence opt3 from PI4K2B__Homo_sapiens__NP_060793
auggaggaccccagcgaaccugauagacuggccuccgcugacggcgggucuccagaggaagaggaagauggagagagggagccgcuccuuccccggaucgcaugggcccacccucgccgaggugcgccaggcucagcugugcgucuguuggacgccgcaggggaagagggagaagccggcgaugaggaguuaccccugccuccaggugacgucgggguuaguagaagcuccucugcugaacuagauaggucgcggcccgcagugucaguaaccauuggaacaagcgagaugaacgccuuccucgacgauccugaauuugcugacauaaugcugcgcgccgagcaggcgaucgaagugggcauuuucccagagagaaucagucaaggcuccucugggagcuacuuugucaaggauccgaaaaggaagauuaucggaguguucaaacccaaguccgaggaaccuuauggucagcuuaauccaaaauggacuaaguacguucauaaggugugcugucccugcuguuuuggccgggggugccugauaccuaaccagggauauuugucagaggcaggcgccuaccucgucgacaauaaacugcaccugaguaucgugccaaagacgaaaguaguuuggcucgugagcgaaaccuucaacuauaaugcuauugaucgcgccaagucucgagguaaaaaguacgcauuagagaagguccccaaaguggggagaaaguuucauaggaucggacugccgccuaaaauuggcuccuuccagcuuuuuguggaaggcuauaaggaggcugaguacugguugcggaaauucgaagccgacccccugccagagaacauccguaagcaauuucagucacaguucgaacgccuagucauacucgacuacauuaucagaaauacagauagggggaacgacaauuggcugguucgguaugagaaacagaagugugaaaaggagauugaucacaaagagagcaaguggaucgacgaugaagaguuucuuaucaaaauugcggccauagacaacggacuggcauucccuuucaagcaucccgaugaauggcgagcuuacccauuucacugggccugguugccccaagcuaaagugccuuucagugaggagauccgcaaucucauucugccauauaucucugacaugaacuuuguacaggauuuaugcgaagaccuguacgagcucuuuaagacugauaaggguuuugacaaagccaccuucgaaucccagaugagcgugaugagaggccagauacuuaaucugacacaagcauugagggacgggaagucgccguuucagcuaguccagauucccugugugaucguugagcggucucaaggaggcucccagggucgcaucgugcaccugucaaacaguuucacccagacugucaauugcagaaaaccuuucuucagcuccugguga

SEQ ID NO: 60672 - RNA, 6309 nt, Artificial Sequence
  derived and/or modified sequence opt3 from PI4KA__Homo_sapiens__NP_477352
auggccgcugcacccgccagaggcgggggagguggcgggggaggcggugggggaugcagcggcuccggaucuucagcgaguaggggguucuacuuuaacaccgugcugagccucgcucggucccuugccguccagcgcccugcaucucuggaaaagguucaaaaauuguuauguaugugcccaguggacuuccacggaaucuuucagcuggaugaacgacguagagacgccguaauugcucuagguauauuccucaucgaaucggaccugcagcauaaggacuguguggucccguaccuucugagguugcucaaaggccugcccaagguguacuggguugaagagucaacagcacggaaagggcgcggagcccugccuguggcugagagcuucaguuucugccucgucacuuuacuguccgauguggccuauagagacccaucucuuagggaugaaauuuuggagguacugcuacagguucuccacgugcugcuuggcaugugucaagcgcuggaaauccaggacaaggaguacuugugcaaguaugcaauucccugucucaucgguauaagccgggccuuugggcgcuacuccaauauggaagagucacuguuaaguaaacuguucccuaagaucccaccccauagccuccgaguccuugaggaacuggagggagugagaaggcggucuuuuaacgauuuccguuccauuuugccuucaaaucuacugacggugugccaggaaggcacccucaaacgcaagacaagcagugucucuuccaucagccagguuucgccagagagaggcaugccgcccccuucuuccccagggggaucagcuuuucacuauuucgaagccaguugucugcccgacgguacugcacuugagccugaguacuacuuuagcaccauuuccucuagcuucucagugaguccacuguucaacggcguaacauauaaagaauuuaauauccccuuggagaugcucagggaacuguuaaaccuggugaagaagauagucgaggaagcugugcuaaaaucccucgaugccauuguugcgagcgugauggaggccaauccgucugcagaccuguacuauaccucauucagugauccucuuuacuugacuauguuuaagaugcugcgggacacacucuauuacaugaaagaccugcccaccagcuucgucaaggagauccaugauuuugugcuugaacaauucaacacgucccagggggagcugcagaaaauuuugcacgacgcugaucgaauccacaaugaacucucuccacugaaguuacgcugccaggccaacgcugccuguguagaccugaugguuugggcagugaaagaugagcaaggagccgaaaaucuaugcaucaagcucucggagaagcugcagagcaaaacuuccucaaaggucauuauagcucaucuuccuuugcugaucugcugucuccagggccuggguagauuaugcgagagguuucccguggucgugcacaguguuaccccaucucugcgggacuuccuugugauucccagcccuguauuggucaaacucuauaaguaccauucccaauaccacacaguggcggggaacgauaucaaaauaucaguuacuaaugaacacagcgagucuacccugaacgugauguccggcaagaagagucagccaagcauguaugaacagcuacgcgacauugcaaucgauaauaucuguagaugccugaaagccggacucacagucgacccggugauuguagaggcuuuucuggccucucuuuccaacagguuguacaucucacaggagagugauaaggacgcacaucugauucccgaccacaccauacgugccuuaggccauaucgcuguggcccuccgggauacgccuaaaguuauggaaccaauucugcaaauccuucagcagaaguucugucagcccccuagcccacuggacgucuugaucauugaucaacucgggugccuggugauaacuggaaaccaguauaucuaccaggagguguggaaucuauuucagcaaauuucggucaaagcauccucuguuguguauagcgcgacaaaggacuacaaggaucacgguuaucgacauuguucacuggcugugaucaacgcccucgcaaauauugccgcuaacauccaggacgaacaccugguagaugagcuuuugaugaaucuguuagaacucuucguccagcugggccuugaggggaaaagagccagugagagggcauccgaaaagggacccgcucugaaagccucuagcuccgcgggcaaccuaggugugcucauaccgguuaucgccgugcugacccgccgguugccuccaauuaaggaggcuaaacccagacugcagaaguuauuuagggacuucuggcucuacucaguccugaugggguucgcaguggaaggcagcggacuuuggccugaggaaugguacgagggcguuugcgagaucgccacuaagaguccccuguugacauuuccaucuaaagaaccucuccgcuccgugcugcaauauaauagcgcuaugaagaacgauaccguaacgcccgccgagcuaucggaacugcgaucaaccauuaucaaucuucucgacccaccgccugaggucucugcacugauaaacaaauuggauuucgcgaugaguacauaccuguuauccguguaucggcucgaauacaugcgugugcugagaagcacugaccccgauagguuucaggucauguucuguuauuuugaggacaaggccauucagaaagacaagucugggaugaugcaaugcguuaucgcuguggccgauaaaguauucgacgcauuucuuaauaugauggcugauaaggccaagaccaaagagaacgaagaggaacuggagcgccacgcacaguucuugcucgugaauuuuaaccauauucacaagcggaucagaagggucgccgacaaauaccugagcggccuaguggauaaguucccacaucugcuuugguccgguacaguucucaaaacuaugcuggacauauugcagaccuuaucacugagucucagcgcugauauccacaaggaccagcccuauuacgauauuccugacgcgccauaccgaaucacagugcccgauaccuaugaggcccgcgaaucuauugucaaggacuuugcagcucgguguggcaugauccugcaagaggccaugaaaugggccccuacugugacgaagucccaccuucaggaauaccugaauaaacaucagaacuggguuucaggguugagucagcacacaggacuagcuauggcaaccgagagcauacugcauuucgccggcuauaacaagcaaaauacuacccucggugcgacacagcuguccgaaagaccggcuugcgugaaaaaggauuacucuaacuuuauggccucgcuuaauuuaaggaaccguuaugcaggggaggucuacggcaugauucgcuucagcggaaccacuggccagaugucagaccugaauaagaugaugguacaggaccuccacuccgccuuggaucggagucauccacaacacuauacacaggcuauguucaaacugacggcaaugcucaucucuagcaaggacugcgauccccagcugcuucaccaucuguguugggggccuuugagaauguuuaacgagcacggaauggaaaccgcccuagcgugcugggaguggcugcucgcuggcaaagacgguguggaaguuccauucaugagggagauggccggggcauggcauaugacuguggaacaaaaguuuggauuauucuccgccgagaucaaagaggcugauccccuggccgcaucagaggcuucucagccuaagccgugucccccagaggucacaccucacuacauuuggaucgacuuucuugugcagcgauucgaaauugccaaguacugcagcagugaucagguagagauauuuuccagccugcuccaacggucuaugucauugaauaucggcggugcgaaaggcuccaugaaccgccauguggccgcaauugggcccagauucaagcugcucacccugggacuuagucuacugcacgcugacgucguuccaaaugccacaaucaggaacguguugcgggagaaaauuuauagcacugcuuuugauuacuucucguguccucccaaguuuccaacccagggcgagaaacgauuaagagaggacaucucuauaaugaucaaguucuggacggcaauguucuccgauaaaaaguaucugaccgccagccagcucgugccgccugacaaucaggacacacgcucaaaccuggauauuacugucgggaguaggcaacaggccacccagggauggaucaauacauacccccuuucuuccggcaugagcacuauuucaaagaaaagugguaugagcaagaaaaccaaccgugggucccagcugcacaaguauuacaugaaacggagaacgcucuugcugucucuacuggcuacagaaaucgagaggcucauaaccugguauaauccacuuagcgcgcccgaacuggaguuagaccaagcaggagagaacuccguggccaacuggcgcucaaaguacauuucuuugagugaaaagcaguggaaagauaauguuaaccuggcuuggucgaucagcccuuaccucgccguacagcugccagcacgauuuaagaauacugaggccaucggcaacgaagugacaagacuuguccggcuggaccccggugcuguguccgauguuccugaggcgauuaaauuccucgugaccuggcauacuauagacgccgaugcaccggaauugucucacguccugugcugggcuccaaccgaucccccuacaggcuuaucauauuuuagcuccauguaucccccacauccucuaacggcccaguauggggugaagguacugaggaguuuucccccagaugcaauccucuuuuacauuccucaaaucguccaggcccuucgcuaugacaaaaugggauacgugcgugaguauauucugugggcugccucuaagagccaguugcuggcgcaccaauucaucuggaauaugaagaccaacauauaccucgaugaggaaggccaccagaaagacccggauaucggggaccugcuugaccagcucguugaggaaauuacuggaucacuguccggccccgcaaaggauuuuuaccagagagaguucgacuuuuucaauaaaaucacaaacgugagugccauuaucaagccauauccuaaaggugaugaacggaagaaggcuuguuugagcgcccugucugaggucaaagugcaacccgggugcuacuuaccauccaauccugaggcuauaguucuagacauugauuauaagucaggaacccccaugcagagcgcagccaaagcuccguaccuggccaaguuuaaagugaagagguguggcgucucggaacucgagaaggaaggucuucgcugccgaucugacagugaggaugaauguuccacacaggaggcagacggccagaaaaucagcuggcaagcggccaucuucaaggugggggaugacugcagacaggauaugcuggcuuugcagauuaucgaccuguuuaaaaacauauuccagcucguaggacuggaucuuuucguguuuccauaucggguugucgccacugcaccuggcugcggggugauugaguguauccccgacugcaccucaagggaccaauuaggacgccagacggauuucggcauguacgacuauuuuacaagacaguacggugaugaauccacccuggcuuuccaacaggccagguacaauuuuauucggucuauggcagccuauagccucuugcuguuccuacugcagaucaaggaccgucauaacgggaauauaaugcucgauaaaaagggacacauuauccauaucgacuuuggcuucauguuugagaguuccccaggcgggaaccuuggaugggaacccgauauuaaacugacugacgagauggugaugaucauggguggcaagauggaggcuaccccuuucaagugguuuauggaaauguguguccgcggguacuuggcgguacgaccguauauggaugccgugguuagccuggugacacucaugcuggacacuggauuacccugcuucagaggccagaccauuaaacuucugaagcacagguuuucuccaaauaugacagagcgggaagcagcuaacuucauaaugaaagucauccaaucauguuuccucaguaaccgcuccagaacguacgauaugauucaguauuaccagaaugacaucccuuauuga

SEQ ID NO: 60673 - RNA, 2406 nt, Artificial Sequence
  derived and/or modified sequence opt3 from PI4KB__Homo_sapiens__NP_001185703
augggcgacaccguggucgagcccgccccucugaagccaacaagcgaaccgacuuccgggcccccuggaaacaaugguggcucucuccuuucaguuaucacggagggggugggagaacugaguguaauugauccagagguggcucagaaagcaugccaagaagucuuggagaaggugaaauuacugcacggcgguguugccgugagcuccagagggacaccccuagagcucgucaacggagacggcguggauucugaaauaaggugucuggacgauccuccagcgcagauccgggaggaagaggacgagaugggcgcugccguagcaucggggaccgccaagggagcucgccgacguagacagaauaacucagcaaaacagagcuggcuucugagguuguucgaaaguaagcucuuugauauuuccauggccaucucuuaccuguauaauagcaaggagcccgguguucaggcuuacauuggcaaccggcuguucugcuuucgcaaugaagacguggauuucuaucucccucaguuacugaacauguacauccauauggacgaggaugucggggacgccauaaaaccauauaucgugcacagauguaggcaguccauuaauuuuucacuucagugcgcguugcugcuaggagcauacaguagcgauaugcauaucucuacucaacggcacucccgcggcaccaagcuccgaaaacugauucuuucagacgaacugaagccggcccauagaaaaagggaguugcccagccucaguccugcuccagacacaggucugucucccuccaagcggacccaccagcguagcaagucggaugccacugcaucuaucuccuuaucaaguaaccugaaacgcacagcuagcaauccuaagguggagaacgaagacgagccagucagacucgcccccgaaagggaguucauaaaaucccuuauggcgauugggaagcggcuggccaccuugccgacgaaagaacagaagacucagcgacuaaucucugagcugagccuccugaaucacaaacuuccugcacgcguuuggcugcccaccgcuggauuugaucaucacgugguaagagugccacauacacaagccgucguguugaacucaaaggacaaggcuccuuaucucauuuacguugaggugcuggaaugugagaauuucgauacuaccaguguccccgccaggaucccagaaaaccggauccgcuccacaagaagcguggagaacuuacccgaaugcggcauuacccacgagcagagggcaggcucuuuuucaacgguaccuaauuacgacaacgaugacgaggccuggaguguugaugacauaggggaacugcaaguggagcuaccagaaguccacacuaauagcugugauaacaucucccaauucucuguggacucgauuacaagccaggaguccaaagagccggucuuuaucgcugcgggagacauacgucggcgacucucagaacagcuggcacauacccccacugccuucaagagagauccugaggacccaagugcuguggcccuuaaagaacccuggcaggagaagguuaggcgcauucgggaagguucuccuuauggccacuugccaaauuggagacugcucagcgugaucguaaaaugcggggaugaccugaggcaagagcuucuggcauuucaggucuugaagcagcuccaguccaucugggagcaagaacgcgugccccuguggauuaagccguacaaaaucuuaguuauuucagccgauagcggaaugauagagccuguggucaacgcugugucuauccaucagguaaagaaacagucccagcugagucuacucgacuauuuccugcaagaacacggcagcuacacaaccgaggccuuccuuucugcacagcgaaauuuugugcaguccugugcggguuauugcuugguuuguuaccugcuccaggucaaggaucggcauaacgggaauauucuguuagacgcugaaggccacaucauccacauugauuucggauuuauacugucaaguagcccacguaaccuuggcuucgagacgucggccuuuaaauugaccacagaguucguggacgugaugggagggcucgauggugacauguuuaauuauuacaagaugcugaugcuacaaggccugaucgcagccagaaagcauauggauaaagucguucagauuguggaaaucaugcagcaagggucccagcuccccugcuuccacggaucuagcacuauuaggaaccugaaggagcgcuuucauaugucaaugaccgaggaacagcuucaguugcugguggaacaaaugguagacggcaguaugcgguccaucacaacuaaauuauacgacgguuuccaguaucucaccaaugggauaauguga

SEQ ID NO: 60674 - RNA, 1956 nt, Artificial Sequence
  derived and/or modified sequence opt3 from PIAS1__Homo_sapiens__NP_057250
auggccgacagcgcugagcugaagcagauggugaugucccucagagucucugaacuucaaguucuguugggcuacgcagggaggaacaaacacggacggaagcaugaguuacugaccaaagcccuacaccuccugaaggcggguugcucacccgcugugcagaugaaaaucaaggaacuuuaucgccgacguuucccucagaagauuaugacaccagccgaucugaguauaccgaauguacauagcucccccaugccugcaacuuugucuccaucgacgaucccccagcucaccuacgacggccacccugccucaagcccacugcugcccgugagucucuuagggccuaaacaugagcuggaacuuccacacuugacauccgcucugcacccgguccaucccgauauuaagcuacaaaaacucccuuuuuaugaccugcuugaugagcugaucaagccaacuucuuuggcaagcgacaacucccagagauucagggagaccuguuuugccuucgcucucacaccccaacaggugcagcagauuucaaguagcauggauaucucuggaaccaaaugcgacuuuacuguucaggugcagcugcgguucuguuuauccgaaacaucaugcccucaagaggaucacuuuccacccaaucugugugucaaggugaacaccaagccgugcagccucccuggcuaccuucccccaacgaaaaaugguguagaaccuaagcgccccaguagaccaauaaacaucacuucucugguuagguuguccaccacagugcccaauacuauugucgugagcuggaccgccgagaucgggcggaacuauucgauggcgguguaccuagucaaacagcugucuuccacaguucuccugcagcgccuucgagcaaagggaauuagaaauccugaccauucaagggcccugaucaaagagaaguugaccgcugauccagacagugaaauagccacgacuagccuccgggugucccuguuauguccgcugggcaaaaugcgucuaacaauucccugccgcgcacucaccuguucucaucugcaaugcuucgaugcuacucuuuauauccagaugaacgagaagaagccuacauggguauguccagugugcgacaaaaaggcccccuacgaacacuugauuaucgacggccuguuuauggagauccucaaauacugcaccgauugugacgaaauucaguucaaggaggaugggacgugggcgccuaugagaagcaaaaaggagguccaggaagugucagccaguuauaauggaguugacgguugccuguccagcacccuugagcaccaaguggcaucucaccaucagucaaguaacaagaauaaaaaggucgaagugauagaucugacaaucgacagcuccucugaugaggaagaggaggaaccaucggcuaaaaggacuugucccagcuuguccccgaccucaccucucaacaauaagggcauucugaguuuaccacaccaggccucucccguaagccggacaccuucccugcccgcuguugacacuucauacaucaacaccagccuaauacaggauuaucgacauccauuucacaugacaccuaugcccuacgaccuccaagggcuggauuucuuuccauuccuuucuggagacaaccagcacuauaauaccuccuugcuggccgcagccgcugcggcagugagugacgaucaggaccuccugcauagcucucgcuucuuuccguacacuuccucacagauguucuuagaucaacugagugccggcgguagcacgucgcuuccuacaaccaacggguccucuagcggaucaaauaguuccuuggucucuagcaacucccucagagagucacacagccauacugugaccaauaggaguucuacagacaccgcuuccauuuuuggcaucauccccgauauuaucagccuggacuga

SEQ ID NO: 60675 - RNA, 1866 nt, Artificial Sequence
  derived and/or modified sequence opt3 from PIAS2__Homo_sapiens__NP_004662
auggccgacuucgaggaacugagaaacauggugagcuccuuuagggucucugagcuccagguucuucugggcuucgcugggcggaauaagucaggacgcaaacacgauuuguuaaugcgagcacugcaucuacucaagagugguugcagccccgccgugcaaaucaaaauucgugaacuguacagaaggcgguauccucgcacccuugagggccuguccgacuugucuacaauaaagucgucaguauuuagccucgaugggggaaguuccccaguggaaccggaccuggcggucgcuggcauccacucucugcccagcacuuccgugacgccucauucaccaaguagccccguugguucugugcucuuacaggauaccaaaccuacauucgagaugcagcagccaucacccccuauuccaccgguccaccccgacgugcaacugaagaaccuuccuuuuuacgauguauuggacguucugaucaagccaacuucccuagugcagagcaguauucagagauuccaggagaaauuuuucaucuuugcccucacaccccaacaggucagggaaauauguaucucucgggauuuccugccugggggacgccgagacuauaccguccaggugcagcuuagacugugcuuggcagagaccuccuguccacaagaagauaauuaccccaacagccucugcauuaaggugaauggcaaacuguuuccguuaccuggcuaugcucccccaccuaagaacgggaucgagcagaaaaggcccggacggccacugaauauuacuucgcucguucgucuuucuuccgccgugcccaaccagaucucaauaaguugggcaagcgagauugguaagaauuacuccaugucuguauaucuggugcgccaauugacaagcgccaugcuacugcagagacucaagaugaaaggcaucaggaacccugaccauucacgggcucugauuaaggaaaaacuuaccgccgauccagacagugagaucgcgacgacuucccugcgagucagcuugauguguccgcucgggaagaugcgccugaccauccccugcagagcagugacauguacucacuuacagugcuucgacgccgcucuguaccuacagaugaaugagaaaaagccuaccuggauuuguccaguuugcgauaaaaaggccgcauacgaaucucucauacuggacggacuuuuuauggaaaucuugaacgauuguucagacguggaugagauuaaguuccaagaggacggcaguuggugccccaugaggccuaaaaaggaagcuaugaaagucagcucccagccaugcacaaagaucgagucuucgagcgugcuguccaaacccuguucaguaaccguugccagugaagcgucuaagaagaaaguggaugucauagaccucacgauugagagcuccucagaugaagaggaggacccgccugccaagcggaaaugcaucuucaugagcgaaacucagucuuccccaacaaagggugugcugauguaucagcccaguagcguccgcgugccuucuguuaccuccguggaucccgcagcuaucccaccuucacuuacugacuacaguguacccuuucaccauacaccaauuagcucgauguccucugaccugccgggguuggauuuccucagccugaucccugucgacccccaauauuguccacccauguuuuuagauucacugaccaguccucuaacggccuccucuaccagcgugacaacuaccuccucacacgagagcaguacacauguuucuuccagcucgucaagaucugaaacuggagugauuaccaguuccggcagcaauauaccagacaucauuucucucgauuga

SEQ ID NO: 60676 - RNA, 1533 nt, Artificial Sequence
  derived and/or modified sequence opt3 from PIAS4__Homo_sapiens__NP_056981
auggccgcugagcugguggaagcaaagaacauggucaugagcuucagaguuuccgaccuccagaugcuucugggcuuuguggggaggucuaaaucaggauugaagcacgaguuaguaacccgggcccugcaacuugugcaguucgauugcagucccgaacucuuuaaaaagaucaaagagcuguacgaaacacgcuaugcgaagaagaauagcgagccugcuccacagccgcaucgaccccuugacccucugacuaugcacuccacguacgaucgugccggugcagucccaagaacccccuuggccggcccuaacauugacuauccagugcucuacgggaaauaucugaauggacugggcaggcuccccgcuaagacauuaaaaccugagguucggcuggugaagcuaccauucuuuaacauguuggaugaacugcuaaaaccgacugagcucgucccccagaauaacgaaaagcugcaagagucuccuuguauauucgcacuuaccccacgccagguggagcugaucagaaauucgagggaauugcagcccgguguaaaggccguucaggugguccuccggauuugcuacucagacacaagcuguccucaagaggaucaguauccacccaacaucgcugugaaagugaaucauaguuacugcuccgucccgggguacuauccuucuaacaagcccggaguugaaccaaaacgcccuugucgacccauuaaucugacccacuuaauguaccugagcuccgccacuaacagaaucacagugaccuggggcaauuauggcaagucauacaguguagcgcucuaucuugugaggcagcugacgagcucugaguugcuacagcggcugaaaacuauaggggucaagcauccagaacucugcaaagcacuggugaaggagaaacuucgucuggaccccgauuccgagaucgccaccacaggaguucgcgugucauugauuuguccucucgucaagaugagacugagcgugccaugcagggcugaaacuugugcccacuuacaaugcuuugacgcaguauucuaccugcagaugaacgagaagaaaccgaccuggaugugucccguuugcgauaagccugcuccauaugaccagcuaaucauugauggucuccugaguaaaauccuuucugaaugcgaggacgccgacgaaauagaguacuugguggauggcuccuggugucccauucgggcggagaaggaacgaagcugcucgccucaaggggccauccugguccucggaccaucugacgcaaauggccugcuucccgcuccguccgugaacgguucaggggcccugggaaguacaggcggcgggggaccugucgguagcauggagaacggcaagccaggggcugaugugguugacuugacccucgauuccucuagcucaagugaagacgaggaagaggaggaagaggaagaggaggaugaagacgaggaaggaccccgcccuaaaagaaggugucccuuucagaagggccuggugccagccugcuga

SEQ ID NO: 60677 - RNA, 2274 nt, Artificial Sequence
  derived and/or modified sequence opt3 from PIBF1__Homo_sapiens__NP_006337
augagcagaaagaucuccaaagagucuaagaaagugaacauuucaaguagccuggaauccgaggacauaucucucgaaaccacaguccccacugaugacaucucgucaagcgaggaaagggagggcaagguucggauuacgcgccagcuuaucgagcgaaaagaacuguugcacaauauucaauuacugaagaucgagcuaagucagaagaccaugaugauagauaaccucaaaguggacuaccugacaaagaucgaagaacuugaggaaaaacugaaugaugccuugcaucagaagcagcuccugacucugcgucucgacaaccaauuagcuuuccagcagaaagaugcauccaaguaucaggagcugaugaagcaagaaauggagaccauucuuuugagacagaaacagcuggaagagacaaaucuacagcucagggagaaggccggggacguacggcgcaaccugagagauuuugaacuuaccgaggaacaauacaucaaacugaaggcguucccugaggaccaguugucuauuccagaauaugugagcgucagguuuuacgagcucgugaauccgcugcggaaagagaucugcgaauuacagguuaagaaaaacauacuggcugaggaacucuccacuaauaagaaccaacuuaagcagcugacagagaccuaugaagaggaucgcaaaaauuacucagaggugcagauucgaugucagagauuggcccuagaacuggcagacacgaagcaacucauccagcagggagauuauaggcaggagaacuacgacaaagucaagagugaacgggacgcccuggagcaagaggugauugaacuucgucgcaaacacgagauccuggaagcuagccauaugauccagacuaaggagagaucugaauuguccaaggagguaguuacccucgagcagacagugacucuguuacagaaagauaaggaauaccugaauaggcaaaacauggagcuaucaguccggugcgcacacgaagaggaccgacucgaacgccugcaggcccagcuugaggagagcaaaaaggcuagagaagagauguaugaaaaauacguggccaguagggaucauuauaagaccgaguacgaaaauaaguugcacgacgagcuggagcagauucggcucaaaacaaaccaagaaauagaucagcugcgcaacgcgucuagagagauguaugaaagggagaaucguaaccuucgggaggcacgagacaaugccguggcugaaaaggagagagccgucauggcagaaaaagaugcucuggagaagcacgaccaguugcucgauagguaccgcgaacugcaauuauccaccgagagcaaaguuacggaguuccugcaucagucgaagcuaaagucuuuugaauccgagcgggugcagcuccugcaggaagagacugccagaaaccuuacacaaugucaguuggaaugcgagaaauaucagaagaaacuggagguacucaccaaggaguucuacucacugcaggcgaguagcgagaaaaggaucacugaauuacaagcccaaaauuccgagcaccaggcacgccuggacauuuacgaaaaacuugagaaggaguuggaugaaaucauaaugcagacagcugagauugaaaacgaggacgaggccgaacgagugcucuuuucuuaugguuacggcgcuaauguccccaccacggccaagcggcgucugaagcagagcgugcaucuagcaagaaggguucugcagcucgagaaacagaacucacugauccuuaaggacuuggaacaccgcaaagaucaagugacccagcugagucaggaguuagaccgggccaauucccuccugaaccagacacaacagccuuauagauaccuuaucgaaagcgucaggcagcgagauucuaagauugacucacugacugagaguaucgcucaguuggagaaagaugugagcaaucucaacaaggaaaaguccgcgcugcuacaaaccaaaaaucagauggcacuggaccucgagcagcugcuuaaccaccgcgaagaguuggccgcuaugaagcagauucugguaaaaaugcauucuaagcacucggaaaauagcuuacuccugacaaaaacugagccaaagcauguuaccgagaaccaaaaguccaaaacacuuaacgugcccaaggaacacgaggauaauauauucaccccuaaaccaacucuguuuacgaagaaagaagcccccgaguggucaaagaagcagaaaaugaagacauga

SEQ ID NO: 60678 - RNA, 1833 nt, Artificial Sequence
  derived and/or modified sequence opt3 from PICALM__Homo_sapiens__NP_001008660
augagcggccagucccugaccgacagaaucacagccgcucaacacucugugacugggucagcagucaguaagacgguuugcaaagccaccacacaugagauuaugggacccaagaaaaagcaccucgauuaccuuauacaguguacuaacgaaaugaaugugaacaucccucagcuggcggacagcuuguucgagaggaccacaaauuccucuuggguaguggucuuuaaaucguuaauuaccacucaucaccugaugguguaugguaacgaacgguucauccaguaccuagcuucacgcaauacacucuuuaaccugagcaauuuccuugauaagaguggccugcaaggguaugacauguccaccuuuauucgacguuacucuagauauuugaacgagaaggccguuagcuacaggcaaguggcauucgauuuuacgaaagucaagcggggagccgacggcgugaugcgcacuaugaauaccgaaaaacuccugaagacaguaccaaucauacagaaccagauggaugcucugcucgacuucaauguuaacuccaaugaguuaacuaacggugugaucaaugcagccuuuaugcugcuuuucaaagaugcuauuagauuguuugccgcguauaacgaggggaucauuaaccugcuagaaaaguacuucgacaugaagaaaaaucagugcaaggagggacucgauaucuacaaaaaguuucugaccaggaugacacggauaucagaguuccuuaaagucgcagaacaggugggcauugaccgcggcgauaucccggaccugagucaggcccccagcucuuugcucgacgcucuggagcagcauuuagccucccuggaagggaagaaaauuaaggauucaaccgcagcuagccgagccacgacucucaguaacgcggugucuucccuugccagcacaggacugucguugaccaaggucgacgagagagaaaaacaagcagcucuagaggaggaacaggccaggcugaaggcucucaaagagcagcggcugaaggaacuugccaaaaagccucacacuucucugacaaccgcagccuccccaguuucaacgagugcugguggcaucaugaccgcgcccgcaaucgauauuuucagcacaccuuccucuagcaauucaacuucgaaguugccaaacgaccuccuggauuuacaacagcccaccuuucacccuuccgugcauccaaugagcacagccucucagguagcuucaacuuggggaggguucaccccgagucccguggcccagccucacccaagcgcaggccugaaugucgacuuugaguccguguucgguaacaaaucuacaaauguuauaguggauagugggggauuugacgaacuaggcggccuccugaagcccaccgucgccagccaaaaccagaaucuuccuguggcuaaauugccacccuccaagcugguaucagaugaccucgauaguucucuggccaaccuuguugggaaucugggaaucgguaacggcacuacgaaaaaugacgugaacuggagccagccgggggagaagaaguugacaggaggcuccaauuggcagccuaaagucgcacccaccacugcguggaacgcugccaccaugaacgguaugcauuucccacaauaugcaccucccgugauggccuacccagcuacaacccccacugggaugauuggcuauggaaucccuccacagaugggcucagucccggugaugacacagcccacgcucauauacagccagccuguuaugcguccacccaauccuuuugggccagugucuggagcccaaauucaguucauguga

SEQ ID NO: 60679 - RNA, 1248 nt, Artificial Sequence
  derived and/or modified sequence opt3 from PICK1__Homo_sapiens__NP_001034673
auguucgccgaccuggauuacgacaucgaggaagauaagcucggcauucccaccgugccugggaaagucacacuucagaaggacgcucaaaaccugauaggaaucagcauugguggcggggcacaguauugcccauguuuguacaucguucagguguuugauaauacuccggccgcguuagacggaacgguagcugccggcgaugagauuaccggugugaacgggagguccaucaaaggaaagacaaaagucgaaguggcaaagaugauacaggagguuaagggcgaagugacuauccacuauaauaaacugcaagccgaccccaagcagggcaugucucuagauauuguccucaaaaaggugaaacauaggcugguagagaacaugucaagugggaccgcugacgcacuuggacugagccgggccaucuugugcaaugauggucucguuaagcgccuggaggaacuggagcgaacagcugaacucuacaagggcaugaccgagcacacuaaaaacuuacugcgugccuucuaugagcuuucccagacacauagagcguuuggggacguguucucugucauuggagugagggaaccucagccagcagccucggaggcuuuugugaaguucgccgaugcacaccggucaaucgaaaaauuuggcauacgcuugcugaagaccauuaaacccaugcuaacggaccucaauacuuaccugaacaaggcuaucccugacaccagacuuacaauuaaaaaguaucuggaugucaaguucgaguacuugagcuacugucucaaaguuaaggaaauggacgaugaggaguauaguugcaucgcccugggugaaccauuauacaggguguccacugggaauuaugaguaccggcugauccuccgcugucgacaagaagcgagagccagguuuucucagaugcggaaagacguacuugagaagauggaacuguuggaucagaaacaugugcaggacauugucuuccaacuacagcgucuggugagcaccauguccaaguauuacaacgauugcuaugcaguucuccgcgacgcugauguguuucccauagaggucgaccuggcccacacaacccuugcuuacggacugaaucaggaggaguucacggauggcgaagaagaggaagaggaggaagacacugccgcaggcgagccuucaagagacacaagaggggccgcuggaccauuggauaaggguggcaguuggugugacagcuga

SEQ ID NO: 60680 - RNA, 654 nt, Artificial Sequence
  derived and/or modified sequence opt3 from PID1__Homo_sapiens__NP_001094288
auguggcagcccgccaccgagagacugcaacacuuccagacaaugcucaagagcaaacuuaacgugcugacuuugaagaaagaaccuuuaccagcugucaucuuucaugagccggaagcaauugagcugugcacgaccacaccccuaaugaagacuaggacccacuccggcuguaaaguuacauaccucgggaaggugucuaccacuggaaugcaguuccugucagguugcacagaaaagccuguaauagagcuuuggaaaaagcauacccuggcccgggaggacguguuuccagcgaaugcuuugcucgaaauccgccccuuccaggucuggcugcaccaucuggaucacaaaggcgaggccacggugcacauggacacuuuucaaguugcacgaauugccuauuguaccgcugaucauaacgugaguccuaauaucuucgcaugggucuaccgugaaauuaacgacgaucucagcuaucagauggacugccacgccguggagugugaguccaaguuagaagcuaaaaagcuggcccaugcgaugauggaggcauuuagaaagacauuccacucuaugaaaucggaugggaggauccacucaaauagcaguuccgaagagguaucucaggaacuugagagcgacgauggauga

SEQ ID NO: 60681 - RNA, 2763 nt, Artificial Sequence
  derived and/or modified sequence opt3 from PIDD1__Homo_sapiens__XP_011518511
augcagcugcccagagcccucccuggccaggcuugccuuagggcagggaccugucuggccagcaaggaccggcgcugggcgauggcugccacaguggagggaccagaauuggaggcagccgcugcagccggugaugcuuccgaagacucugaugccggcucacgagcguuaccguuccuggguggaaaccgucuaagucucgaccuguaccccggcgguugccagcagcuucugcacuuguguguccagcaaccucuccagcugcugcagguugaguuucucagauuaagcacucaugaagauccacagcugcuugaggcaacguuggcccaacugccccagucccuaucuugccucaggucgcuggugcuuaaagggggacagcggcgcgacacccugggcgcuuguuugagaggcgcccucacaaaucugccugcaggguuaucaggacuggcucaccucgcccaucuugaucugagcuucaacaguuuggagacucuaccagcgugcguacugcagaugaggggucucggcgcccugcuucugucccacaauuguuugucugaacuccccgaggcacugggggcuuuaccugcccugaccuuucuaacagugacccauaaccggcuccaaacucugccaccggcucuuggagccuugagcacacugcagcgccucgaccugucccagaaucuucuggauaccuugcccccugaaaucggcggucucgggucacuguuagagcugaaccuagcaaguaaucgacuccaaagccugccagccucucuugcuggauugagaucccugaggcuccuggucuuacacucaaaccugcuugcgagcgugcccgcagacuuggcccggcucccucugcuaacgcgucuggaucuccgcgacaaucagcugagagaucuuccacccgaguugcuggacgcuccguucguuagguuacagggcaacccucucggcgaagccagucccgacgcaccaucuuccccuguggccgcucugauucccgagaugccacggcuuuuucugacuagcgauuuggacucguuccccgucaccccucaggggugcucugugacacucgccuguggaguacgacugcaauuuccagcaggggcgacugcuaccccgauaacaauccgcuauagacuacugcuccccgaaccuggccugguuccacuugggccccacgaugccuugcugucccauguguuagagcuccagccucacggagucgcauuccagcaggacgugggccuguggcuucuguuuaccccaccccaagccaggcggugccgcgaaguggucguuagaacgaggaaugauaacucauggggugaccuagagacuuaccucgaggaagaggcuccgcagcgucugugggcccauugucaggugccucacuucaguugguuuuugguagugagccggccagucuccaaugcaugccuggugcccccugaagggacauuacucugcucuagcggccaccccggaguuaaggugauuuucccaccuggcgcuaccgaggaaccccgaagagucucaaugcaagugguaaggauggccgggcgcgagcugcaagcgcuucugggagagccagaagccgcuguuaguccguugcucugucugucccagagcgguccucccucuuuucuacagccagugacuguccagcugccccuuccuucaggcaucacagggcucagucuggaucggagcagauugcaucuguuauauugggcaccacccgccgcuaccugggacgauauuacggcccaagugguccucgagcugacccaccuuuacgcaagguuccaggugacacauuucuccugguauuggcugugguacacuaccaaaaacugcguuggaggcuuggcgcgcaaggccugggaacgacuccggcugcaccgugugaaucuaaucgcucugcagagaaggcgcgacccugagcaaguacuucuccagugucugccgcggaacaaagucgaugccacauugagaagguuacuggaacgauaucgcgguccagagcccucugacacuguggagauguuugaaggggaggaguucuuugcagcuuucgaacggggcauagacguugaugccgacagaccugauugcguggagggaaggaucuguuuugucuucuacucgcaucucaagaacgugaaggaagugagcuuuuaccguggcgcaguaccaguucgcguccccgaggaagccgaggcugcgcggcagagaaaaggggccgacgcacuguggauggcuacccuuccuauuaagcugccgagguugcgaggauccgaagguccccggcgcggcgccgggcuaucacuggccccacucaaucugggagaugcugagacaggcuuccuuacccagaguaacuuacugucuguggcagguagacucggguuggacuggccugccguggcgcugcaccucggcgucagcuauagggagguucaacggauccgacacgaauuuagagaugaccuggaugagcagauucgccauaugcuuuucuccugggcugaaaggcaggccggacagcccggcgcaguggggcuguuggugcaagcccuagagcagucagaccgucaggauguagcugaagagguccgggcagugcuggagcucggaagaaggaaauaccaggacagcauccgccgaaugggcuuagccccaaaggauccugcgcugcccgguucuuccgcuccacaaccgccugaacccgcccaggcauga

SEQ ID NO: 60682 - RNA, 7566 nt, Artificial Sequence
  derived and/or modified sequence opt3 from PIEZO1__Homo_sapiens__NP_001136336
auggagccccacgugcugggcgccguccucuacuggcuucuguugccuugcgcuuuacuggcagccugucuacucagauucagcgggcugucccuuguuuaucuguuguuucuccugcugcucccaugguucccgggacccaccagaugcgguuuacagggccauacagggcggcugcuucgcgcguugcugggacuaucucuccuguuucuuguggcucaccuggccuugcaaauaugucuccauauuguaccucgacuggaucaguuacugggcccaucaugcagucguugggaaacucucagcagacacauuggugugacgaggcuugaucugaaggacauccccaacgcaauucgguuggucgccccugaucuagggauccuggugguuuccucugugugucucggaauuugcggccgccuggcuagaaauaccaggcagucgccacauccccgggagcuugacgaugacgaacgcgaugucgacgcaucaccuacagccggccugcaggaggcugccacuuuggcgccaacccgaagaagcaggcucgcagcccgguuccgugugacagcucacuggcuguuaguagccgcagggcgcguucuggcugugacccuacucgcccuggcgggaaucgcccacccgagugcacuuuccucugucuacuugcugcucuuucuggcucuuuguacuuggugggccugccauuuccccauaagcacaagagguuuuuccaggcuguguguggcugugggcugcuucggggccggacacuugaucugucucuauugcuaccaaaugccucuggcacaggccuuacugccacccgcuggcauuugggcgcggguccuaggucucaaagauuuuguugggccuaccaacugcucaaguccacaugcacuggugcuuaauacgggauuggacuggcccguauaugccagcccgggcgugcugcuccuguuauguuacgcuacugccucucugcgaaaacuucgcgcauauagaccuuccggccagaggaaagaagccgcuaagggguacgaggcccgggaguuggaacucgcagagcuggaucaguggccccaagaacgcgagucagaccagcacgucgugccaaccgcgccugauacagaggcugacaacugcaucguucacgaacuaacuggacagagcagugugcugagaaggcccguccguccaaaacgggccgagccccgagaagcaucuccucuccauucccugggucaccuuauuauggaccagagcuacgugugugccuugaucgcuaugaugguauggucgauaaccuaucauucuuggcugacauucguuuuacuccugugggccugccuuauuuggaccgugagauccaggcaccaacuggcaauguuguguucaccaugcauccuccuguacggcaugacgcuauguugccugcgcuaugucugggcuauggaucuccggccggagcugcccacuacacuugggccugugaguuugagacagcugggauuagaacauaccagguacccaugucucgaccugggcgccaugcuucuguauacucuaacauuuuggcuccuguugcgccaguucgucaaggagaagcuguuaaaaugggcggagagccccgccgcucucaccgaagugacgguugcagauaccgagccuacacgaacucaaacccugcuucagucccugggugaauuggugaaggggguauacgccaaauauuggauuuacgucugcgcuggcauguuuaucgugguuucuuucgccggacggcucguggucuacaagaucguguauauguuccuguuucuacugugucuuacacucuuccagguauacuauagccuguggcguaaauugcugaaggcauuuuggugguuagugguugcguacacuaugcucguccugauugccguguauaccuuccaguuucaagacuucccagcuuacuggagaaaucuuacaggcuuuaccgaugagcagcugggggacuugggacucgaacaguucucagugagugagcuguuuuccagcauccuaguccccgguuucuuucugcuugccugcauccuccagcugcacuauuuccacaggccguuuaugcaauugacugauauggagcauguuucuuuaccuggcacgcgccugccacggugggcacacagacaggacgcugugucagggacaccccuccugagggaagaacagcaggaacaucaacagcagcagcaagaggaagaggaggaagaggaagauagucgagacgagggacuuggcguggccaccccucaccaggcaacucagguacccgagggugccgcuaagugggggcuggucgcggaacgcuugcuagagcuggccgcaggcuucagcgaugugcucucccggguucaaguguuccugagaaggcuuuuagaacugcacgucuuuaaacucguggcuuuguacaccguuuggguggcccugaaggagguaucugucaugaaccuccugcuuguggugcugugggccuucgcuuugccauacccucguuuucgccccauggcaucgugccuaagcacagucuggaccuguguuauuaucgugugcaaaaugcuguaucagcucaagguagugaauccacaggaauacuccucaaacuguacugagccguucccuaauaguacaaacuuacugcccacggagauaucucagagccuucuguaucggggaccagucgaccccgccaauugguuuggcgugagaaaaggguucccuaaccucggauacauucaaaaucauuugcagguucugcuccugcuuguguuugaagcgaucgucuauaggcgacaggagcacuaccggcgccagcaucaacuagcuccacugcccgcccaggcaguguucgccuccgguaccagacagcaguuggaccaagauuuacugggcugccucaaguauuuuaucaacuucuuuuucuacaaauuugggcuggaaauuuguuuccuuauggcuguuaaugugaucggacagaggaugaacuuccuggucacucuccacggcugcugguugguagcaauucugacacggcgacauagacaggccauagcgcgccuauggccuaacuacugucuguuucucgcucuuuuccuguuauaucaauacuugcugugccucgguaugccgccagcccuguguaucgacuaucccuggagguggucacgugcagugccuaugaauagcgcccuuauuaaguggcuguaccucccagacuuuuuccgggcucccaacucuaccaauuugaucuccgacuuucuguuacuacugugcgccagucagcaguggcagguuuucagcgcagagagaacagaagaguggcaaaggauggcuggggugaacacugaucgccucgagccucuucgaggcgaaccgaaucccgucccaaacuuuauccacuguagaucuuaucuggacauguugaagguggccguauuccgguaccuguuuuggcucgugcuggucguuguguucgugaccggagcgacgaggauuuccauauuuggccuuggguaucuccuggccugcuucuacuugcuguuauucggaaccgcacuacugcagcgcgauacacgugcuagacucguccuuugggacugccugaucuuguacaaugugacuguuauuaucagcaagaacaugcugagucuccuggccuguguauuuguggagcagaugcagaccggcuucugcugggucauucaacuuuuuagcuuaguguguacaguuaaggguuauuacgauccuaaagaaaugauggaccgggaucaggacugccugcuccccguggaggaagcugggaucauaugggauucggucuguuucuuuuucuugcugcuacagaggcgcguguuucugucccacuauuaccuccauguacgagcagaccuucaggccacugcccuguuggcuucuagaggauucgcgcuguauaaugcagccaaccucaagagcaucgacuuucaccggaggauugaggagaaaucacuggcucaauuaaagcgccagauggaaagaaucagggccaagcaggagaaacaucggcagggccgugucgaucgcagucgaccacaagacacccuugguccuaaggaucccggccuggaaccagggccggacuccccuggagggucuucacccccaagaaggcagugguggcggcccuggcucgaucacgcaacggugauucauuccggcgacuacuuccuauuugagucagauagcgaggaagaggaagaggccguuccugaagacccacgccccagugcucagucugcguuccaacuggccuaucaggcaugggugacaaaugcucaggccgucuugagaaggcggcagcaagagcaggagcaggcacgacaggaacaagccggacagcugccuaccggcggugggccgucccaggagguggaaccagcugagggacccgaagaggccgcggcaggcagaagccacguugugcagcgcguccucucgacugcccaauuucuuuggaugcugggucaggcuuugguggaugagcugacaagguggcuccaggaguucacccggcaccauggcacuaugucagacguauuacgugccgagagauaccugcuuacccaagaacugcuacaagggggagaggugcacaggggcguucucgaucagcuguacacaucucaggcugaagcaacguugccugggcccaccgaggccccaaacgcuccuaguacugucuccagcggacugggcgccgaggaaccccucucuagcaugacagacgauauggguuccccacuuucaaccggguaucauacacgcaguggaagcgaggaagcagugacugacccuggcgagcgggaggcgggugccucucuguaccaaggcuuaaugcgaaccgcuuccgaacuguugcucgacagaaggcugcgcaucccggagcuagaagaggccgaacuuuucgcagaggggcagggacgggcucugagacuccugcgugccguguaucagugcgucgcagcccacucagaguugcuguguuacuuuauaauuauccucaaucacaugguaacggcuagugcgggcagccuugugcugcccguuuuaguguuccugugggccauguuguccauuccaaggccuucuaaacgguuuuggaugacagcaaucgucuucaccgaaauagcugugguugugaaguaucucuuucaguucggguuuuuccccuggaacucgcaugucgugcugcgccgauacgagaauaaaccauauuuuccucccagaauccuaggacuugaaaagacugauggcuacauuaaguacgaccugguacaacucauggcccuguucuuucacaggagccaguuguuaugcuauggucugugggaucaugaggaagacucaccguccaaagagcacgauaagaguggggaggaggaacagggagccgaagagggcccaggcgugccugcagcuaccacagaagaccauauccagguugaggcccgggucgggcccacugauggaaccccagagccccaaguggaacuccgcccuagagacacaaggcgaauuucucuucgguuccguagacgcaaaaaggaggguccggcgaggaaaggcgcugccgcaaucgaagccgaggaucgggaggaagaggaaggggaggaagagaaggaggcucccacgggaagagaaaagcgcccaagcagguccggcggucgagugcgggcagccgggagaaggcugcagggauuuugucuaucacuggcgcagggcaccuaccgcccucuccgucgguucuuccacgacauauugcacacuaaauauagagcugccacagaugucuacgcacugauguuucuugccgacguuguggacuucauuaucaucauuuuuggcuucugggcuuuugggaagcauucugccgcaaccgauaucacuagcagucuguccgacgaucagguacccgaggcuuuccucgugauguuacugauucaauuuagcacaauggucguggacagggccuuguaucugcgcaaaaccguucucggaaaacuugcguuccagguggcccugguccuagcaauacaccuguggauguuuuucauccucccugcuguaacggaacgaauguuuaaccagaacgugguugcccaauugugguacuucgugaaaugcauuuauuuugcacugucugcuuaccagauccggugugguuacccaacuaggauucuuggcaauuuccugaccaagaaauauaaccauuuaaaucucuuccuguuucagggguucagguugguccccuuucugguggagcuccgcgccgucauggauuggguguggacagacaccacucuuucacuguccaguuggaugugcguugaagauaucuacgccaacauauucaucauuaagugcagcagagagacagagaagaaauauccucagccaaagggacagaagaagaaaaagaucgugaaguacggcaugggugggcuaauuauccuguuucucauagcgauuaucugguuccccuugcuguuuaugucguuaguacggucuguggucggaguugugaaucagccgaucgacgucaccgugacacuuaaacugggcggcuaugaaccucucuucacuauguccgcucagcagccaagcauuauacccuuuaccgcacaagccuacgaggaacugucaaggcaguucgauccucagccauuggcuaugcaguuuaucagucaauauucucccgaggacauuguaacggcccagaucgaaggguccagcggagcacuguggcguauuucaccgccuagucgagcccagaugaagcgcgagcucuacaacgguacagcugauaucacccuuagauucacuuggaauuuucaacgggaccuggcgaaaggcgggaccguggaguacgccaacgaaaagcacaugcuagcacuggcucccaauagcacagccaggcgccaguuagcaucccuccuggagggaacuucugaucagagcguugugauaccaaacuuguucccuaaauauaucagagcccccaauggcccagaagcuaaccccgucaagcagcuucaaccuaaugaggaggccgacuaccugggugugcggauucagcucaggcgagaacagggggcgggagcaaccggcuuccuggaguggugggucaucgaauugcaggagugucguacggacugcaaccugcuaccaauggugauauuuuccgauaagguuucaccgcccucucucggcuuccuugccggguauggaaucaugggucuguacguaaguauaguguuagucauuggcaaauuugugagaggguucuuuucggaaaucagccacuccaucauguucgaggagcugccuuguguugaccgcauucucaagcugugccaagauaucuuuuuggugcgggaaacaagggagcuugaacuggaggaggaacucuaugcuaaacugauauuccuauacagaucuccagagaccaugauuaaguggacucgcgaaaaagaguga

SEQ ID NO: 60683 - RNA, 8259 nt, Artificial Sequence
  derived and/or modified sequence opt3 from PIEZO2__Homo_sapiens__NP_071351
auggccagcgaaguggucugcggccugaucuuccggcuccuucugcccauuuguuuggcuguugcaugcgccuuuagauauaacggguuauccuucguguaucugaucuaucuucuccugaucccucuauuuucugaaccaaccaagacuacuaugcagggacacacgggucggcuguugaaaucacucuguuucauuagucugagcuuucugcucuuacauaucauuuuccacaucacccugguaucccuugaagcgcaacaucgcauugcuccgggcuauaauugcucuacaugggaaaagacuuuucgacagaucggguucgagucguugaaaggagccgacgcaggcaacgguauucguguguuuguccccgauaucgggauguucauugccucacugaccaucuggcuacucuguagaaauauagugcagaagccuguuacagacgaagcugcacagagcaacccagaguuugagaaugaagaacuggccgaaggagagaaaauugauagugaggaagcucuuaucuaugaggaagacuucaacggcggcgaugggguggagggagaacuggaggaguccaccaaguugaagauguuuaggcggcucgccucugucgcgagcaaacugaaggaguucauugguaauaugaucacuacagcaggcaaagugguaguuaccaucuuacugggguccucaggaaugaugcuccccagucuuacgagcucuguguauuucuuugucuuccugggcuugugcacuuggugguccuggugucgcaccuuugacccucuacuguucucaugccucugugugcugcuugccauuuuuacagcuggucaccugauaggguuguaccucuaucaauuccaguuuuuccaggaggccgugccacccaacgauuacuacgcaagacuguuuggaaucaagagcgucauucagacugacugcaguucuaccuggaaaaucauaguuaauccugauuuauccugguaucaucacgcuaacccaauucugcuacucgugauguacuauacacuggccacccuuaucaggaucugguugcaagaaccgcugguacaggacgagggcacgaaggaagaggauaaggcgcucgccuguagccccauucagaucacugcaggccggcgccgaucgcugugguacgcuacacacuauccuaccgacgagagaaaacuucugucuaugacucaggaugacuacaagccauccgacggguugcucgugacagucaauggaaaccccguggauuaucauaccauucacccuucacugccaauggaaaauggucccggcaaagccgacuuauacaguacgccgcaauacaggugggagccuagcgaugaauccucugagaagcgggaagaggaggaagaggaaaaagaggaguucgaagaggaacguagccgcgaggaaaagagaucaauaaaaguucaugcuauggugagugucuuucaguucaucaugaagcaguccuauauuugcgcccugaucgcaaugauggccuggagcaucaccuaccacucuuggcuaacauuugugcuccugauuuggucaugcacucuuuggaugauaaggaaccggcgaaaguaugcuaugaucaguagccccuucaugguaguuuacgggaauuugcugcucauucugcaauauaucugguccuucgaguuaccagagauuaaaaaggugccuggauuucuggagaaaaaggagcccggcgaacuugcgucuaaaaucuuguucaccauaacauuuuggcuccugcuacgccagcaccugacugagcagaaggcacuccaggaaaaggaggcccugcuuucggaggucaaaaucgguagccaagaaaacgaggaaaaggacgaggaauugcaggauauucagguggagggggagccaaaagaagaggaagaggaggaagcuaaggaggaaaaacaggagagaaagaaggucgaacaagaggaggccgaagaggaagacgagcaggauaucaugaaagugcugggcaacuuaguuguggcaauguucauuaaguacuggaucuauguauguggaggcauguuuuucuuugucuccuucgaagggaaaauagugauguacaagauuaucuacaugguucucuuucuguucugcguggcccuuuaucagguccauuacgagugguggaggaaaauucugaaguauuuuuggaugucagugguaaucuacaccauguuggugcucauauucaucuauacauaccaguuugagaauuuccccggacuguggcaaaacaugaccggucuaaagaaagaaaagcuggaggaccucggccugaaacaguucacuguugcugaacuuuuuacgcggauuuucaucccuaccagcuuuuugcuggucuguauuuuacaccuccauuauuuccacgaucgcuuucuggagcuuacagaccugaagucuaucccaagcaaagaagauaauacuauauacagacuagcccauccggaggggucccuccccgaccugaccaugaugcacuugacagcaucacuggagaagccugaagugaggaaauuagcggagccaggagaagagaagcucgagggcuacagcgaaaaggcucagaaaggugaccuggggaaggauucugaggaauccgaggaagacggcgaggaggaagaggaaagugaggaagaggaggaaaccagcgaucuucguaacaaauggcaccuggugauugaccgguugacuguccucuuccugaaguuucuagaguauuuccauaaacugcagguuuuuaugugguggauccuugaacuccacaucauuaagaucgugucuuccuacauuauaugggugucaguaaaggaggucagucuguucaauuauguguuuuugaucagcugggccuucgcacugcccuacgccaaauuacgaagacucgcuucguccguuugcacaguguggacgugugucauuaucgugugcaagaugcuguaucaacuucagaccauuaaaccugaaaacuucucuguuaauuguagccugccaaacgagaaucagacuaacauccccuuuaaugaguugaacaagucacuccuguacagugccccgauagauccuacagaaugggugggacuaaggaaauccucuccacugcuuguauaucuccgcaauaaccuguugauguuagcaauccuggcuuucgaggucaccauuuaccggcaucaagaauacuauagaggcaggaauaaccucacagcccccgugagccgcacuaucuuucacgacauuacccgacugcaccuugaugacgggcugaucaacugcgcgaaguacuucauaaauuacuuuuucuacaaguuuggauuggagacguguuuccuaauguccgugaacgucauuggucagcggauggauuuuuaugccaugauccaugcuugcuggcugaucgcaguucucuaccguagaaggcgcaaagccauugcugagauauggccuaaguauuguugcuuccuggccugcaucauuaccuuucaguacuucaucuguauuggcauacccccagcaccuugccgggacuaccccuggagauuuaaaggggcgucauucaaugauaacauaaucaaguggcuuuauuucccagacuuuauugugaggccgaauccuguauucuuaguguacgauuuuaugcugcucuugugugccagccugcagcgacaaaucuucgaagacgagaacaaagcugccguccgcauuauggcaggagacaauguggaaaucugcaugaaccucgaugcugccaguuuuucucagcacaaucccguuccagacuucauacauugucgguccuaucuggauaugagcaaggugauuaucuuuucguaccuuuucugguuuguccugacaaucauuuucaucacuggcaccacaagaauaucaauauuuugcauggguuauuugguggcauguuucuacuuucuacuguucgggggcgaccucuuacugaagcccaucaaaucuauucuuagguauugggauuggcugaucgccuacaacguuuucgugauaacuaugaagaauauucucaguaucggagcuugcggcuacaucgggaccuugguccacaacuccuguuggcugauucaggcguuuagccucgccugcacgguaaaaggauaucagaugccugcagcuaauucuccauguacacugcccagcggcgaggccgguaucauuugggacuccauaugcuucgccuuucuucuacugcaacgucgcguguucaugucauacuacuuuuugcauguuguggcugauaucaaggcaagucagauuuuagccagcagaggggcggaacuguuccaggcuaccaucgucaaagccgugaaggcaagaaucgaggaggagaagaaaucuauggaccagcucaaaaggcaaauggaucgaauuaaagcccggcagcagaaguacaaaaagggaaaagagcgcaugcugucccuuacucaagaaccuggcgagggucaggacaugcagaagcugucagaagaggaugacgagagagaagcugauaagcagaaagcaaagggcaaaaagaaacaaugguggaggccguggguagaccacgccaguauggugcggagcggggacuauuaccucuuugagacagauuccgaagaggaagaggaggaagaguugaagaaggaagacgaggagccaccccgaagaucugcguuccaguuugucuaucaggcuuggauaaccgauccuaaaacugcccugcgccagaggcacaaggagaaaaagcguucggcacgggaggaaagaaaaaggcgccgaaagggaagcaaggagggcccaguugaaugggaggacagagaggaugaacccaucaaaaagaaaucagacgggccugauaacauuaucaagcggauuuucaauauccuaaaauuuaccugggugcuguuccucgccacaguggacuccuuuacgaccuggcuuaacaguauaucuagggagcauaucgauauuagcacuguccugcgcaucgaacguugcauguuaacaagagagauuaagaagggaaacgugccgacccgggaauccauccacauguacuaccaaaaucauauaaugaacuugucaagggagucuggccuggacacaauugaugagcaccccggugcugccagcggggcacagacugcucaucgcauggacagucucgacucccacgauagcaucucuucagaaccaacccaguguacgaugcuguauucccgacagggaacaaccgagacuauugaagagguugaagccgagcaagaggaagaggcgggcaguaccgccccugaacccagagaggcaaaagaguacgaagcuacagguuaugacguaggcgccaugggggcugaggaagcaagccuuacuccagaggaagaacugacccaguucucgacacucgauggagacguggaggccccucccucuuacuccaaggccgucagcuucgaacacuugucauuuggcagucaggaugacucugcugggaaaaaucggauggcgguguccccagaugacagcaggacggauaagcugggaucaaguaucuuaccgccucuaacccaugagcugacugcaagcgaacuccuucugaaaaagauguuccacgacgaugaguuggaagaguccgagaaauuuuauguuggccagccccgcuuccugcuccuguuuuacgccauguauaacacacuuguggcuagaucugaaauggucugcuacuucgugauaauccucaaucauaugguaagcgccuccaugauuacccuguugcugccaaucuuaauuuuucuaugggcaaugcugucaguccccaggccuucucggcguuucuggaugauggccaucguguacacugagguugcuauaguggucaaguacuuuuuccaauuugguuucuuuccauggaacaagaauguggaaguuaacaaagacaagcccuaccacccuccgaauauuaucgggguggagaaaaaggaaggauauguccucuacgaucuuauccagcuguuggcgcuguucuuccaccgcaguauucucaaaugucauggccugugggacgaggacgauaugacagagucggguauggcccgagaagagagcgacgaugaacuuuccuuaggccacgggagaagggacucuucagauagccugaaguccaucaaccucgcagcuaguguggagucuguacaugugaccuuuccagagcagcaaacggccguucggcgcaagagaagcggaucauccagugaacccagccagaggucuuccuucucaagcaaucggucgcagcgaggcucuacaaguaccagaaacuccagccagaaagggucauccgucuugucuauaaagcaaaaaggaaagcgcgagcuguauauggaaaaacuacaggagcaccugauuaaggcaaaggccuuuacaaucaaaaagacccucgaaauuuacgugccuaucaaacaguucuuuuauaaucuuauacaucccgaguacagcgcugugacugacgucuacguacugauguucuuggccgauacaguggacuuuaucauuaucguuuucggcuuuugggcguucgguaagcacagugcagccgcugauauuaccuccagccugucugaggaccaggugccagggccuuuucucgucauggugcugauccaauucggaacaaugguuguggauagggccuuauaucuucggaaaacuguccugggcaaggugauuuuucagguaauccucguguucggcauacacuucuggauguuuuucauucuacccgggguuaccgaacguaaguuuucacagaaccuggucgcucaguugugguacuucgugaaaugcguguauuuuggacugagugcauaccaaaucagaugugguuauccaacgaggguccucggcaauuuccuuacaaaguccuacaacuauguuaaccuguuuuuguuccagggguuucgccuggugccuuuccucaccgaguuacgggccguaauggacuggguguggacugauaccacacugagccuuucuucguggaucugcgucgaagacauuuacgcucauauauuuauccugaaauguuggcgagagucagaaaagagauacccgcagcccaggggacaaaagaagaaaaaggugguuaaguauggcaugggugggaugauuaucgugcuacucauuugcaucgucugguucccacuguuguuuaugagccugauaaaauccguagccggagugaucaaucagccucucgacguuagugugacuauuacccuuggcggcuaccagcccaucuucacgaugucugcacagcaaagccagcugaaggucauggaucagcaguccuucaacaaauuuauucaagcguucucacgcgacacaggggccaugcaguuuuuagagaauuaugagaaggaagauaucaccguggcugagcuggaaggaaacaguaauucuuuguggacuauaagcccaccuuccaaacagaagaugauucacgagcuccuggaccccaacucaaguuucucugucguguuuuccuggaguauccagcggaaucuaagccuuggugccaagucggaaaucgcaacagauaaacuguccuucccgcucaagaacauuaccaggaaaaauauagcuaagaugaucgccggcaacucuacugagucaagcaaaacaccaguuaccauugagaagaucuacccuuauuacgugaaggcacccagugacuccaauucuaaaccaauuaagcaacuguugagcgaaaacaauuuuauggauaucacgauaauccugucacgugacaacacuaccaaauauaauuccgagugguggguacucaaccuuacagggaauaggauuuacaaccccaacagucaggcccuggaauuaguggucuucaaugauaagguuagcccuccgucucugggauuuuuggcuggcuacgguaucauggggcucuaugcgucagugguccuggugauuggaaaauucguacgggaguuuuucuccggcaucagccauucuauuauguucgaggaacuacccaacguggaccgcauacuuaagcuguguaccgauaucuuucucguucgagagacaggcgaacuggaguuggaagaggacuuauacgccaagcugauuuuccucuauagaaguccagagacuaugaucaaauggaccagggaaaagacgaauuga

SEQ ID NO: 60684 - RNA, 2124 nt, Artificial Sequence
  derived and/or modified sequence opt3 from PIF1__Homo_sapiens__NP_001273426
augcugagcggcaucgaggccgcugcaggggaauacgaggacuccgaacucagaugcaggguggccgucgaggaacuuucucccggaggucagccucggcgccgacaagcgcugcguaccgcugaguugucauuaggcagaaacgagaggcgggaacugaugcuacgccuccaggccccagggccggcaggaagacccagguguuucccucugcgggccgcucgccuuuuuacacgauucgcagaggccggcagaaguacucugagguugccagcucacgauacgcccggugccggggcgguucagcuccugcugagcgacugcccuccagaucggcuccgucgcuuuuuaagaacccugaggcuuaaguuggcagccgcucccggaccuggcccagccuccgcacgggcucagcugcuaggcccgcgaccccgcgacuucgugacaauuucuccuguacaaccagaagagagaaggcuccgggccgcgacucgcgugcccgauaccacacuggucaaaagaccuguggagccacaggccggggcagaacccucgaccgaggcuccgagguggccucuucccguuaagcgucugucauugccaagcacuaaaccucagcucagugaggaacaggccgcugugcugcgggccgucuuaaagggacaauccauauuuuucacagguucugcaggcaccgggaaaagcuaucugcucaagcgaauccuuggaucccugcccccaacgggcacuguggccaccgcuucaacagguguagcggcaugucauauugggggaacuaccuugcacgccuuugcuggcaucggcagugggcaggcaccccuagcccagugcguugcccuggcucagagaccuggagugaggcaagguuggcucaauugucagcgccuggucauugacgaaaucagcaugguggaggccgaucuuuucgacaagcuggaggcaguggcgcgggcugucagacagcaaaacaaaccauuuggcgggauacaguugaucauuugcggagauuuccuccagcugccgcccguuacaaagggcucucagccuccaagguuuuguuuccaauccaaaucauggaagcgcugcgugcccguaaccuuagaacugacgaaaguguggcgacaggccgaccagacuuuuaucagccuacuccaggcaguccggcugggucguuguagugaugaggugacaagacaacuucaggccaccgcuucucauaagguugggagggacggcauuguggccacucgcuugugcacacaccaggaugacgucgcacugaccaaugaacggagacuccaggagcugccuggaaaggugcauagguucgaagcuauggacuccaacccagagcuugccagcacgcuggaugcgcaaugucccguaucgcaguugcuccagcugaaauuaggcgcccagguuaugcuggugaagaaucuaucugucucccgagggcucgugaacggagcucgcggugucgugguuggcuucgaggcagaagggcggggacugccgcaagugagauuucuuugcggcguaaccgaggucauccacgccgacagguggacagugcaggcuacuggugggcaguugcugucacgucaacagcucccucugcaguuagccugggcaaugaguauacacaaaagccagggcaugacccuggauugcguugaaauuucccuuggacgcguguucgcgucuggccaagccuacgucgcuuugagccgggccagaucacuccaggggcugagggugcuagacuuugauccaauggcaguacgaugugacccccgggugcugcauuucuaugcuacacuccgcagaggaaggagucugucccuugccgcagagggucggggcaaugaagaucgaugcagcgggucuucaaucagagccuugggaggcgacugguggggucugcgcuuaggggcugcgaguaagcagaggacugagcuccguuguguuagcaccgcccggccuucccuggcacagcccagaacaaacacccuucaaucucugacuaaagagcacaaguugcagaauguccauccauacuuuaaacuccuguuccagggcauuaacucgguguggggacacuga

SEQ ID NO: 60685 - RNA, 477 nt, Artificial Sequence
  derived and/or modified sequence opt3 from PIFO__Homo_sapiens__NP_001287760
augugcuucagcagagccgacgcugcagauaacuaccccuuuggcaccugucagcaaaggaagcuguucccucacuuucauccaccgaaucucaucgggaacaaauucgugccccuucggggauccccucaccgcgguccaggcugcuauuuuucugacgagaugacaccccaugccgggcgauaccagaaggucucaccucagcaggaaaaacacaagcaaaauuucgcgccauuuaacguucuggugccccguuucaaaaauuauccuaaggauacuuacuauccaaguccgggagcuuacaaccccgagaagaaaccuccacccaagauugccuggccuaugaaauuuggcagcccagacugggcacagguacccuguuugcagaagagaacguuaaaagccgaacuguccaccgauaaggacuucaggaagcaucggaaucgcguggcuuaucuaucucucuacuacaacuga

SEQ ID NO: 60686 - RNA, 1455 nt, Artificial Sequence
  derived and/or modified sequence opt3 from PIGA__Homo_sapiens__NP_002632
auggccugcagaggcggggcuggaaacggucacagggcaagcgccacccugucccgggugucucccggcucacucuacacaugucgcacucgaacgcauaauaucugcauggucagugacuucuuuuauccuaacaugggagggguugagagccacauuuaccagcuuucccagugucugauagaacguggccauaaggugaucauuguaacccacgcguaugguaauagaaaagggaucagguacuugacaucuggauuaaagguguauuaccugccacuaaaagucauguauaaccagucgacugcuaccacacucuuccauucacugccgcuucugcgguacauuuuugugcgcgagagaguuaccaucauacacagccacaguuccuucucugccauggcacaugaugccuuguuucacgcuaagacuaugggccuccagacaguguucaccgaccauagccuguuuggcuucgcagaugucuccucagugcugacgaauaaacucuuaacuguaagucugugcgacaccaaccacaucauuuguguuagcuacacaucuaaggaaaauacugugcuuagggccgcuuugaaccccgagaucgucuccgugauuccuaaugccguggauccaaccgacuuuacacccgauccuuuccggcgccacgacucaaucaccauagucguugugagccgacugguauauagaaaggggauugaucuacucaguggaaucauuccagaacugugccagaaauaccccgaccuuaacuuuaucaucgguggcgaggggccuaagaggauuauacuggaggaagugcgggagcguuaucaauugcaugaucgcgucagacuccugggagcguuagaacacaaagacgugaggaauguucuggugcagggccauaucuuccucaacacgucucuuacugaggcauuuuguauggccauugucgaggcugccuccugcggucugcaagugguaagcacacggguugggggaaucccagaaguguugccggagaaucuaauaauucugugugaacccucggucaagucucucugcgagggccuggaaaaagcaaucuuccagcuuaaguccggcacccugccugcuccagagaacauccacaauauugugaagacuuucuacacauggcgaaacgucgccgagcgcaccgaaaaaguguaugauagaguuucaguggaggcgguauugcccauggacaagaggcucgaccggcugaucagucauugugggccugucacgggauacauuuuugccuuacuggcaguguucaacuuucuauuccucauauuucugcgcuggaugaccccagauagcaucauugacguugcuaucgaugccacaggucccagaggcgcuuggacuaauaacuauucccacucuaaacgugggggagaaaauaacgagaucagcgaaaccagguga

SEQ ID NO: 60687 - RNA, 660 nt, Artificial Sequence
  derived and/or modified sequence opt3 from PIGF__Homo_sapiens__NP_002634
augaaggacaacgauaucaaaagacugcucuacacccaccuucugugcauuuucagcauaaucuuguccguguuuauucccucuuuauuccuggagaauuuuucaauccuagaaacacaucucacuuggcuguguauuugcaguggcuucgucacggccguuaaccuugugcuguauuugguagugaagccuaauaccagcuccaaaaggucuucgcucucacacaaggucacaggguuucugaaauguugcaucuacuuccugaugagcuguuuuaguuuccaugugauauuuguucucuauggagcuccauuaaucgagcuggcacuugaaacuuucuuguuugccgugauucuguccaccuucacaaccgucccgugccuaugucuccugggucccaaccuuaaggcguggcugcggguguuuucucgcaauggcguaacuagcaucugggagaacuccuugcagauuacaaccaucucaaguuucguuggggcuuggcucggagcccugccuauaccauuagacugggaacgacccuggcaaguguggccuauuagcugcacgcugggcgcaacuuucgguuacgucgccgggcucgugaucucuccacuuuggauuuauuggaaucguaagcagcugaccuacaaaaacaauuga

SEQ ID NO: 60688 - RNA, 2952 nt, Artificial Sequence
  derived and/or modified sequence opt3 from PIGG__Homo_sapiens__NP_001120650
augagacugggcagcgggaccuucgccacaugcuguguggcuaucgagguccucggaauugcaguuuuucuuagggguuucuuucccgccccugugcgguccucugcgcgcgcugaacacggcgccgagccaccggcacccgaaccuucagccggggcuaguagcaacuggacuacgcugccacccccuuuguucuccaagguagugauagucuuaaucgacgcacugcgagaugacuuuguguucggaucuaaaggcguuaaguuuaugccauacaccacauaucuaguggagaaaggugccucgcauucauucgucgcugaagccaagcccccuacugugaccaugccacguauuaaagcgcucaugacagggagccugccgggauuuguagauguuaucagaaaucuuaacagucccgcacuguuggaggacuccgugauuaggcaggccaaggcugccggcaagcggaucgucuucuacggcgaugagaccugggugaaacucuuuccuaagcacuucguggaauaugacgggacuacaucuuucuuugucagcgauuacaccgagguugacaauaacgugacgcgccaucuggauaaaguacugaagagaggagacugggauauacucaucuuacacuaucugggucuugaccauauuggccacaucuccgggccaaauucacccuugauuggacaaaaacugagugaaauggauagcgugcuaaugaagauccacacuucucuccaguccaaggagagggagaccccucugccaaaccuucuggucuugugcggcgaccaugguaugucagaaacagggagccacggagcaaguucuacugaggaagugaauacaccccucauacugauuuccagcgcuuucgagcggaaaccgggcgacauccgccauccuaagcacguucagcagaccgauguggccgcgaccuuagccauugcacugggccuccccaucccaaaagacucggucgggucucuucuguuuccugugguagaaggacgacccaugagagagcaauugagguuccuacaccugaacacgguucagcucuccaagcugcuucaggagaaugugccaucauacgaaaaagaucccgguuuugagcaguucaagaugagugaacggcugcauggcaacuggauccguuuguaucucgaggaaaaacacagcgagguccuguuuaauuuaggguccaaggugcugcgccaauaccuagacgcucucaagacucugucucuuagcuugucagcccaggucgcucaguacgauauuuauaguaugauggugggaacaguugugguacuggagguccucacccugcuucuguuguccgugccucaggcccucagaaggaaagcagaacuggagguuccauuaagcucuccgggcuucucacugcuauuuuaccucgugauacugguccuuagugccgugcauguaaucguguguacuagcgcugaauccucuugcuauuucugugguuugucguggcuggcggcagggggcguuaugguccucgccagcgcucuguuaugcgugauuguguccguccugacaaacguucuugugggaggcaauacgccccggaagaacccuaugcacccaucaagucgauggucugaguuggaccuccugauccuacuggggaccgccggacaugugcucagccugggugcauccucauuuguagaagaggagcaccaaaccugguacuuccuugucaauacauugugucuggccuuaagccaggaaacuuaucgcaacuacuuucucggcgaugacggggagcccccuugcggacuguguguggaacagggccacgauggugcuaccgccgcauggcaagacgggccaggcugcgauguucuugagagagacaaaggacauggcucucccuccacaagugaggugcugagggggcgggaaaaguggauggucuuggcgagcccguggcucauacuggcuuguugccgccuacugagaucucucaaccagacuggagugcagugggcccacaggccugaccugggucauuggcuuaccuccucagaucacaaagcagaguugaguguucuggccgcuuuaagccuccuggugguauucguccuugugcagcguggcugcucgccaguguccaaggccgcacuggcucuagggcuccugggagucuauuguuaccgggccgcgauuggcucuguucgauuucccuggagaccugacagcaaggauaucucaaaagguaucauugaagccagguucguguacguauucguguuggggauccuguuuacaggcaccaaggacuuacucaaaagucaagucauugcugcagauuucaagcugaaaacugugggacuuugggagauauauuccggccugguuuugcucgccgcucugcuauuucgcccccacaaucugccagugcuugccuucucucuccugauccagacguugaugacaaaguuuauuuggaagccucugcggcaugacgcagcggaaaucaccgucaugcacuacugguucgggcaggccuuuuucuauuuucagggaaacagcaauaacaucgcuacuguggauauuuccgccggcuucguugguuuagacaccuacguggagauacccgcaguccuccugacagcuuuugggaccuaugccggaccaguacuuugggcaucacaucuggugcacuucuugagcagugagacuagaucuggcuccgcccucagccaugcuugcuuuuguuacgcgcugaucugcucgauuccgguuuucacauauaucgugcuagucacgucacugagguaccaccuuuucauuuggucuguguuuaguccuaaacuccuguacgaagguaugcacuuguuaaucaccgccgcaguauguguguucuuuacugcuauggaucaaacacgccugacccaguccuga

SEQ ID NO: 60689 - RNA, 759 nt, Artificial Sequence
  derived and/or modified sequence opt3 from PIGL__Homo_sapiens__NP_004269
auggaggccauguggcugcucugcguggcucuugcaguccuggccuggggcuucuuguggguuugggacagcuccgaaagaaugaagucuagggagcaagggggacgguuaggugcggaaucacgcacccugcuagugaucgcucaccccgaugacgaggccauguuuuucgcaccuacaguacucggccuggcccgacuucgucauuggguguaccuguuguguuuuagugcugggaacuauuacaaucagggagaaacuaggaaaaaggagcuccugcagagcugcgauguccugggcauuccacucuccucugugaugauaaucgacaacagagauuucccggacgaucccgguaugcagugggacacggagcacguugcacggguguuacugcagcauauugaagucaaugggaucaaccuugugguaaccuuugaugccggaggcguuucgggccacucaaaucauauugcuuuguaugccgcggugcgcgcacugcacagcgaggggaaacuaccuaagggauguaguguccucacacugcaauccgugaacgugcuuagaaaauacaucucucuguuggaccucccacugagcuuacugcacacucaggauguccucuucguucuuaauuccaaggaaguggcccaggcuaagaaagccaugucaugccauaggagucagcuguugugguuucggcgccuauauauaaucuucagccgauacaugagaauuaacucucuguccuuucucuga

SEQ ID NO: 60690 - RNA, 1272 nt, Artificial Sequence
  derived and/or modified sequence opt3 from PIGM__Homo_sapiens__NP_660150
augggcagcaccaagcacuggggagaguggcugcucaaccuuaaaguggcccccgcuggagucuucgguguugcauuucuggccagaguggcguugguauucuacggcguguuucaggacaggacauuacauguccgguauacugauaucgacuaccaaguguucacggaugcugcccgcuuuguuaccgaagggcgauccccuuaucugcgugcaacauacagauauacuccacuacucggauggcugcuuaccccgaauauuuaccugucugaguuguucggcaaguuucucuucauaucaugcgaccugcugacagccuuucucuuauauaggcugcuuuugcugaaaggucuagggcggcgccaggcuuguggauacugcguguucuggcuccugaacccccuuccuauggcagucaguagcagaggcaaugccgauuccaucguggcuucucugguauugaugguucucuaccugauuaagaaaagguuaguggccugugcggcagucuuuuauggcuucgccgugcacaugaagaucuacccagugaccuauauucugcccaucacucuccaucuucugccugaccgggauaacgacaagucguugcgccaguuucgauacacauuccaggcuugccuauaugaacugcucaaaagacuguguaauagggccguccuucuguucguugcaguggcuggguugaccuuuuucgcccucucauuuggauucuacuaugaguacgguugggaauuucuggagcacacguacuucuaucauuuaacucggcgugauauacgccacaacuuuagcccauacuucuauaugcuguaccuaaccgcggagaguaagugguccuuuucucucggcaucgccgcauuccugccccaacuuauuuugcugagcgcuguauccuuugccuauuacagagaccucguguucugcuguuuucugcacacaucaaucuucgucacuuucaauaaagugugcaccagucaguauuuucuuugguaccuguguuugcucccucugguuaugccauuagugaggaugccguggaagcgggcugucgugcugcuaaugcucugguucauugggcaggccauguggcuggcacccgccuacguacuugaauuucaggggaaaaacacauucuuguuuaucuggcuggcuggccucuucuuucuguuaauaaauugcagcauucugauccaaauuaucucucauuauaaggaggaaccucuuaccgagcgaaucaaguacgauuga

SEQ ID NO: 60691 - RNA, 2796 nt, Artificial Sequence
  derived and/or modified sequence opt3 from PIGN__Homo_sapiens__NP_789744
augcuacucuucuuuacccuuggccuguugauccacuucguguuuuucgccagcauuuuugacauauacuucacaucccccuuaguccaugggaugacuccucaguuuacgccacugccgcccccugcuagaaggcuaguucucuucguggcagauggacugcgggccgacgcgcuuuaugagcuggaugaaaacgguaauucucgcgcuccauuuauccgaaacauuaucaugcacgagggcucaugggggauuagucauacccguguacccacagaaagcagaccuggacacguggccuugaucgcaggcuucuacgaggacgucuccgccguggcuaaggguuggaaagaaaauccaguugaguuugauucucucuucaacgagucgaaguauacuuggucaugggggagccccgacauacugccuauguuugcaaaaggagccaguggcgaucauguguacaccuauuccuacgacgcuaagagggaagauuucggcgcccaagacgcgacaaaacuggauaccugggucuucgacaaugugaaggacuuuuuccaccacgcacggaacaaucagucucucuuuagcaagaucaacgaggagaaaauuguauucuuuuuacaucugcuugggaucgauacuaauggacacgcccaucgcccauccucaagagacuauaagcacaacauuaaaaagguugaugacggugugaaagaaaucgucaguauguucaaucacuuuuacggcaacgaugggaagacaaccuucauauuuacgagcgaccauggaaugacugauuggggcucucacggugcugggcauccguccgagaccuugacaccccuggugacuuggggagccggcauuaaguacccucagagggugucagcacagcaauucgacgaugcuuuucuaaaagaauggcggcucgagaauuggaagcgccuggacgucaaccaggccgauaucgcgccacuuaugaccagccugauuggcguucccuucccuuugaauaguguggggauccucccaguagacuaucugaacaacacagauuuauuuaaagccgaaucuauguucaccaaugcagugcagauccuggagcaguucaaggucaaaaugacgcaaaagaaagaagugacucuccccuuucuuuucacaccguuuaagcuguuguccgacagcaagcaguucaacauucuacgaaaagcuagaucguacauaaagcacaggaaauuugacgagguugugucucugugcaaggagcucauccaucuggcccuuaaaggacuguccuauuaccacaccuaugaucgguucuuuuugggugucaaugugguaauuggcuucguuggguggaucucauacgcuagucuccugauaauuaagagccacuccaacuuaaucaagggagugucuaaagaagucaagaaaccuagccaucugcuacccuguucauuuguggccaucggcauucucgucgcauucuuucugcuuauccaggccugcccauggacuuauuacguguacgguuugcugccucuccccauuugguaugcuguucugcgugaguuccaggugauacaagaccuuguagucagugugcugacauacccauugucccacuuuguuggguaucuccuggcguucaccuuaggcaucgaagugcugguccugagcuucuuuuaccgcuauaugcucacggcaggacugaccgccuucgcugccuggcccuuucuuacaagauuguggacuagggcaaagaugaccucucugucauggacauucuuuagucuccuguuagccguguucccucugaugccaguagugggccggaaaccggauauuagccuuguuaugggggcuggauugcucguccugcuacugucccucuguguggugacuucucugaugaagcgaaaggacucguuuaucaaagaggaacuuuugguccaucuguuacagguucucagcaccgugcuguccauguacgugguauauucaacacagaguucucuucugcgcaagcaagguuugccccucaugaaucagaucauuagcugggccacccuggcauccucacuugucgugccucugcucagcucuccaguucuguuccagagacuauuuuccauauugcugaguuuaaugagcacuuaccuccugcuuucuacgggcuacgaggcgcuguucccccuagugcucuccugccugauguuugucuggaucaacauugagcaggaaacauugcaacagucagggguguguugcaaacagaagcugaccaguauccaguucagcuauaauacugauauuacccaauucaggcaguuauaccucgacgauauccggcgcgcuuucuuucugguguuuuuccuuguuacagccuuuuucggaaccggcaacauagcaucgaucaauuccuuugaccuggccucuguauauuguuucuugacugucuuuagcccuuucaugaugggugcucucaugauguggaaaauucugaucccauuugugcuagugaugugcgccuucgaggcaguccagcugacaacgcagcuuucaaguaagucccucuuucugauuguuuuggugaucucugauauaauggcucugcacuucuucuuuuuaguaaaggacuacgggagcuggcucgauauuggcaccuccaucucacacuaugugauugucaugagcaugacuaucuuccugguguuucuuaacggacuggcccaauugcucacaaccaaaaagcugagacuauguggcaaacccaagagucauuucauguga

SEQ ID NO: 60692 - RNA, 2019 nt, Artificial Sequence
  derived and/or modified sequence opt3 from PIGO__Homo_sapiens__NP_001188413
augcagaaggccagcgugcuacucuuccuugcuugggucugcuuucuguucuacgcaggcaucgccuuguuuaccuccggguucuuacugacaagacuagagcucacuaaccacucuucaugucaagaacccccuggaccagguagucugccguggggcagccaggggaaacccggagcgugcuggauggcuuccagguuuucucggguugugcuuguacugauugacgccuugcgcuucgauuuugcacagccucagcauucgcacgugccacgagagcccccugucucacucccauuccugggcaagcugagcagucuccaacguauauuagaaauccagccccaucacgccagacuguauaggucccagguggacccuccaacgaccacaaugcagcggcuuaaggcuuugacuaccgguucucugccgacauuuauugaugcagggagcaauuucgccucccaugcuaucguugaggacaaccuaauuaaacaacucaccucagccggacgcagaguggucuuuaugggcgaugacacuuggaaagaucuguuccccggcgcguuuaguaaggcauucuucuuuccuagcuucaaugugagggaccuugauacaguagacaacgggauccuggaacacuuguacccaaccauggauucuggagagugggacguucucauagcccacuuucuggguguggaucauuguggccacaagcaugggccccaccacccugagauggcuaaaaaguuaucccagauggaccaggucauccagggacugguggaacggcucgagaaugacacgcuucugguggucgccggcgaucaugguaugacuaccaacggggaccacggaggcgauucagaauuggagguuagcgcagcucuauuccuguauaguccaacagccguguuucccucuacuccgccugaggaacccgagguaauuccacaagugucccucgucccuacccuggcgcuucuguugggccuccccaucccauucgggaauauuggagaagugauggccgagcuguuuagcgguggcgaagacucgcagccccauucuuccgcauuagcucaggccucagcucugcaccuaaacgcccaacagguuagucgcuuccuccauacauacagcgcagccacccaggaucugcaggcuaaagagcuucaccaauugcagaaucuguuuuccaaggcgucugcagacuaucaguggcuccugcagagcccuaaaggggccgaggcuacgcuuccaacugugaucgccgaacugcaacaguucuugcgaggagcaagagccaugugcauagagucaugggcuagguuuagucucuccuuccuguuacugcaccuacucgccgcaggcauuccggucacaacccccgguccuuuuacugugccauggcaggcgguaagcgcuugggcccugauggcaacacagaccuucuacucuacggggcaucaacccguuuucccugccauccacuggcaugcugccuuugugggcuucccagaaggacacggcucauguaccuggcuucccgcauugcuggucggggcuaacacauuugccagucaccuccuguucgcggugggaugcccguuacugcuuuuguggccuuuucucugugagagccagggucugcggaagcgucagcagccacccggcaaugaagccgaugcucgcgucagaccugaggaggaagaggaaccccuaauggagaugaggcugcgggacgcaccacaacauuucuaugccgcucuccugcagcuuggguugaaguaccuguuuauuuuaggaauccagauccucgccugcgcacuggcggccuccauucuucgacgccaccugaugguguggaaaguuuucgcuccuaaguuuauauucgaagccgugggcuuuaucguaucuucggucgguuugcuccuggggauugcacuggugaugagaguugauggcgcugugagcuccugguucaggcaacuguuucucgcccagcagcgguga

SEQ ID NO: 60693 - RNA, 477 nt, Artificial Sequence
  derived and/or modified sequence opt3 from PIGP__Homo_sapiens__NP_710148
auggugcccagaagcaccucccugacacucaucgucuuccuuuuucacaggcugucuaaggccccuggcaaaaugguugagaacucaccaaguccguugcccgaacgggcuauuuacggguucguguuauuucugagcucccaguucggauuuauacuauaucucguaugggcauucaucccugagucuuggcuuaauucgcugggucugacuuacuggccacaaaaguauugggccguggcguugcccgucuaccuccugauugcuaucgugauuggcuauguucugcucuuugggaucaacaugaugucaacgagcccuuuagacaguauacauaccaucacagauaauuacgccaaaaaccagcagcagaagaaauaucaagaagaggcaauuccagcccugcgcgacaucuccauuucugaagugaaucagauguucuuucuugcugcaaaggaguuguacacuaagaacuga

SEQ ID NO: 60694 - RNA, 1746 nt, Artificial Sequence
  derived and/or modified sequence opt3 from PIGQ__Homo_sapiens__NP_004195
auggugcugaaggccuucuuuccuaccugcugugucagcacagacuccggccuccuuguugggagaugggugcccgagcagucuucagcuguagugcuggcagucuugcacuucccauuuaucccgauucaagugaaacaguuacuggcccagguuaggcaggcgagucaagugggagucgcugugcuagguacuuggugccauugucggcaggaacccgaggaaagccucggccgcuuccuggagucccuuggggccguauuuccucacgaaccauggcugcgauugugccgugagagaggaggcacguucuggucuugugaggcaacccauaggcaggcccccacagcuccuggugcaccaggggaagaucagguuaugcucauauuuuacgaccaacgacaggugcugcugucgcagcuccacuuacccacuguccugccugaucgccaggccggagcuaccacagccucaaccggcggccuugcggcaguguucgacacuguggccagaagcgaggucuuguuuaggagugaucgguucgacgaagggccaguucgccugucccauuggcaaucugagggaguggaggcuagcauccuagccgaacucgcacggagagcuuccgguccgauuugccugcuucuggccucauugcucagucugguaagcgcggugucugccuguagggucuuuaaguuauggccccuguccuuccucggcucaaaacuuagcacaugcgagcagcugcggcaccguuuggaacaccuaacccugaucuuuaguacgcgcaaggcagagaacccugcucagcucaugagaaaagccaauacuguggcuucuguucugcuugauguggcccugggguugaugcuccuguccugguuacauggaaggagccggauuggccaccuggcagacgcccuagucccaguggcugaucauguagcggaggaacuccaacaucugcuucagugguugaugggugcacccgccgggcugaagaugaaccgagcucucgaccagguucugggacgcuucuuccuuuaucacauccaccuguggauaucguacauccacuugaugucuccuuuuguggagcauauucucuggcacgucggccuguccgccuguuuaggccugaccguggcacuaucacuccugagugauaucauugcccuuuugacauuccauaucuauugcuuuuacgucuauggggcuagacuguacugucucaagauacacggacugagcuccuuauggaggcuguuccgggguaaaaaguggaaugugcuucgccagagaguugacucuugcagcuaugauuuggaccaacucuuuauuggcacucugcuauucaccauccugcucuuucugcuuccaacaaccgccuuguacuaccugguguucacguuacucaggcugcuuguagucgcagugcaggggcugauucacuugcucguugaccugaucaacucacuaccccuguauagucucggacugcgucuuugccggccguaccgauuggcggcuggcgugaaauuuagaguccugaggcaugaagccggucgcccuuuacggcuccugaugcagaucaauccccuuccauauuccagagugguacacacuuacaggcugccuagcugugggugccaucccaagcacucuuggggcgcacuaugucgcaaacucuuccugggagaguugauuuauccauggcgacagcggggcgauaagcaagacuga

SEQ ID NO: 60695 - RNA, 2295 nt, Artificial Sequence
  derived and/or modified sequence opt3 from PIGR__Homo_sapiens__XP_011507931
augcuucucuucgugcuuaccugccuguuggccgucuuucccgcuaucagcacaaaguccccuauuuucggcccagaagaaguuaacucuguggaggggaauaguguaaguauaacuuguuacuauccgcccacgagcgugaacagacacaccaggaaauacuggugccggcagggagcacgcgguggcuguaucacauuaauuuccucugaaggguaugucucgucaaaguacgccggacgagcgaaucugacuaacuuuccugagaauggcaccuucgugguuaacaucgcucaacuaagccaggacgauaguggucguuauaaaugcgggcucggaauuaauuccagaggccugucuuuugacgugagccuugaagucucccagggcccagggcuguugaacgauacaaagguguacaccguagaccucggaaggacuguuacaaucaauugucccuucaaaaccgagaacgcccagaagcggaagucacuguauaaacaaauaggucuguacccugugcucgucaucgauaguagcggcuacgugaauccaaacuauacggggcgcauuagauuagacauccagggaacuggccagcugcuguuuucuguggucauuaaucaguugaggcuguccgaugcaggucaauaccuaugccaggccggggacgauucaaacagcaauaagaaaaacgcugaccuccagguucugaagcccgagccugaacuuguguaugaggaucugcggggaaguguaaccuuccauugugcauugggcccagaaguggccaacgucgcuaaauuucucugccgccagucuuccggcgagaauugugacgugguugugaacacacuggggaagcgagccccggcguucgagggaagaaucuuacugaauccccaagauaaggacgguagcuuuucggucgugauaacuggccucaggaaagaagacgcagggcgguaccuuugcggagcccacucugauggccagcugcaggaggguuccccuauucaggcuuggcaguuguucguaaacgaagagucaaccaucccacguagucccacaguugugaagggggucgccggcggaagcguggcaguccuauguccuuauaaucgcaaagaauccaagucuauuaaauacuggugccugugggagggcgcucagaacgggagaugcccacuccugguggacagcgagggauggguuaaggcccaguaugaagguaggcuuucacuguuggaggaacccggcaaugggaccuuuacggugauccucaaccaacugacuucacgggaugcgggauucuacugguguuuaacaaauggcgacacccuguggcgaacuacaguagagaucaaaauuauagaaggugagccgaaccuaaaggucccugggaaugugaccgccguucucggcgagacgcugaaggugcccugccauuucccauguaaauuuuccagcuacgaaaaguauuggugcaaauggaacaauaccggaugucaggcacuuccuucucaggaugagggccccucaaaggcuuucgucaacugcgacgaaaauagucgcuuggugagccugacacucaaccugguaacuagagccgaugaggggugguacugguguggagugaaacagggucacuuuuauggcgaaaccgcugccguuuacgucgcaguggaggagaggaaggccgcugggucccgggacgugucucuugcgaaggcagaugccgcuccagacgaaaaaguccuggauucgggauuccgcgagaucgaaaacaaggccauucaagaccccagauuguuugcagaggagaaagccguugcugacacaagggaucaggccgacggcagccgugcauccguggauucagguaguucugaggaacaagggggcagcucccgggcgcucgugucaacucugguaccuuuaggacugguccuagcugugggcgccguugcagugggggucgcccgagcuagacauaggaagaauguggaccgcguuagcauccggucuuauagaaccgauauauccaugagugacuucgaaaacagcagggaguuuggagccaaugauaacaugggcgcaucuuccauuacacaggaaaccucacucggugggaaagaggaguucguggcuacuacggaaaguacaaccgagacuaaggaaccaaagaaagccaagcgcagcucgaaagaggaagcggagauggccuacaaggacuuucugcuucaauccucuaccguagcugcagaggcccaggauggaccgcaggaggcuuga

SEQ ID NO: 60696 - RNA, 1569 nt, Artificial Sequence
  derived and/or modified sequence opt3 from PIGT__Homo_sapiens__NP_001171657
auggccgcugcaaugccccuggcccuccuugugcuguuguuacugggcccugggggauggugccuagcggagccaccgagagacagccucagggaggaacuggucaucacaccccuuccuuccggugauguugcugccaccuuccaguuucggacucgcugggacucugaacugcaacgagagggcgugucacacuaccguuuguucccaaaggcacucgggcagcugauuaguaaauauagccugagagaacuccauuuauccuuuacgcagggauucuggaggacccgguacuggggucccccuuuucugcaggccccaucugauacagaccacuauuuccuucgcuacgcuguauugcccagagagguggucuguacugagaaccugaccccuuggaagaaacuacucccaugcucgucaaaggcaggccugagcgugcuucugaaagccgauagguuguuucauacaaguuaucacucccaagcuguucauauacggccggugugucgcaaugcccgaugcaccucuaucagcugggaacucagacagacucuguccgucguguucgacgcguuuauuacagggcagggaaagaaggauuggucauuauucaggauguuuagucggacccugacggagcccuguccucucgcaagcgaaucucguguauacguugacaucacuaccuauaaccaggauaaugagacacuugaggugcacccacccccuacuaccacauaccaagacgucauucugggcacccgcaaaacguacgccaucuaugauuugcuagacacugcuaugauaaacaauuccagaaaccugaauauccagcucaaguggaaaaggccacccgaaaacgaggccccgccugugcccuuccugcacgcacagcgguacgugucaggcuaugggcuucagaagggagaacugagcacauugcucuacaauacccauccauaucgagcuuuuccuguccuguuacuggauacuguucccugguaccuacgccucuaugugcacacacugaccauuacgaguaaagguaaggagaacaagccaucuuacauccauuaccaacccgcccaggacagacuucagccucacuugcuggaaaugcucauucaacugccagccaauuccguaaccaaagugagcauccaguucgagagggcgcuucugaaguggacagaguauacuccggaccccaaccacggcuucuacgucucgccuucuguguuguccgcacucguuccaucaaugguggcugccaaacccgucgauugggaagagaguccucuguuuaauagcuuauucccaguguccgacgggucuaacuauuuuguacggcuguacaccgaaccccuacucguuaaucugccgacaccugauuucagcaugccauauaacgugauaugccuuacuuguaccgucguggcugucugcuacggaucauuuuauaacuugcugacacgcaccuuccauauugaggaacccagaacuggcggucucgccaagaggcuggcaaauuuaauccgucgggcccgaggggugccuccccuguga

SEQ ID NO: 60697 - RNA, 1308 nt, Artificial Sequence
  derived and/or modified sequence opt3 from PIGU__Homo_sapiens__NP_536724
auggccgcuccccuggugcucguccuuguuguggcaguaaccgugagagccgcgcuguucaggagcuccuuggcugaguuuaucucugaacgggucgaggugguuucaccuuuaaguagcuggaagcgcguggucgaaggccugucccuacucgaccugggggugucuccauacucgggagccguauuccacgagacaccgcuuauuauauaucuguuucauuucuugaucgauuacgcagaacucguuuuuaugauuacugacgcccugacggcuaucgcacuguauuucgccauucaggauuuuaacaaaguggucuucaagaaacaaaagcucuuacuggagcuugaccaguacgcucccgauguggccgaguugauccgaaccccuauggaaaugcguuauauaccacugaaaguggcgcuauuuuaccuccugaaucccuauacaauccuuucaugcgucgcaaagagcacuugugccauuaacaauacccugaucgcuuucuuuauuuugacaaccaucaaggguagugccuuccucuccgcaauauuucuggcuuuagccacuuaccagucucuguacccucucacacuuuucguuccaggccuguuguaucuacugcagagacaauacauucccgugaaaaugaaaagcaaggcguucuggaucuuuuccugggaguaugccaugauguacguagggucacucguggucauuaucugccugaguuucuuucuucugagcucuugggacuucaucccugcaguguauggauuuauuuuguccguuccagaucucaccccgaacauaggccuguucugguacuuuuucgcugaaauguuugagcacuucucauuauuuuucgugugugucuuucagaucaauguguucuucuauacgauuccccuggccaucaagcuaaaagagcauccuauauuuuucauguuuauucagaucgcuguaaucgccauuuucaagagcuacccaacuguuggugacguggcacucuacauggccuuuuuccccgucuggaaccaccuguauagguuucuucggaauaucuucguguugaccugcauuauaaucgucuguagucugcucuuuccugugcuguggcaucuuuggauuuacgcugggucugcgaacuccaauuucuuuuaugcaaucacacugacuuucaacguuggacagaucuugcucauuagcgauuacuuuuaugccuuccugcgcagagaauacuauuuaacccacggccuguaccuaacagcuaaggacggcaccgaggccaugcucgugcugaaauga

SEQ ID NO: 60698 - RNA, 1515 nt, Artificial Sequence
  derived and/or modified sequence opt3 from PIGW__Homo_sapiens__NP_848612
augagcgagaagcagaugaaagaagccuucguguccaaccugaauggcaccacaguccucgagaucacucaagggcuuugcuuucccgcuuucuguauucugugcagaggauuuuugauaaucuucucucaguacuuauguucauuuaguccuacguggaagaccagguuccugacagacuuuguugugcuaauuguaccaaugguggcaacucucaccaucugggccagcuucauucugcuugaacuguugggugucaucauauuuggcgcggggcuccuguaucagaucuaccggcgccgaacaugcuaugcucgucugccguuccucaaaauuuuagagaaguuucugaacaucucccuugaaucugaguacaaucccgccauuucguguuucagagugaucaccucagcauuuacugccauagcuauuuuggcaguugauuucccucuguucccaaggcgguuugccaaaacagagcuauauggaaccggcgcuauggacuucggugucgggggauuuguguucggcagcgccauggugugccucgaaguacgcagaaggaaguacauggagggcaguaagcugcacuauuuuacgaacucccuuuacucuguuuggccccugguguucuuggggaucggacggcucgcgauuaucaaaagcaucgguuaccaggaacaucugacugaguauggcguccacuggaacuuuuucuuuaccauuauaguggugaaguuaaucacaccucugcuccuuauuaucuucccacugaauaaauccuggauaauugcauuggggaucacuguccuauaccaacuggcccucgauuuuaccucacugaagcgccuuauccuguauggaacagacggcagugguacccgaguuggguugcucaaugcuaacagagagggaauuaucagcacgcugggcuacguggccauucauauggcaggcguacagacuggguuauauaugcacaaaaauaggucucauauaaaggaucugaucaagguggcuuguuuccuacuccuggccgcgauuucccuuuuuaucucauuguacgucgugcagguuaacguggaagccgucagccggcguauggcaaaucuggcuuucugcaucuggauuguggccaguucucucauacugcuuuccagccuguugcucggagacaucauucugucguucgcuaaauuuuuaaucaagggugcccugguacccuguucuuggaaacuaauucaguccccuguuacaaacaagaaacacucagagagucucgugccagaagcagagcgcauggaaccgagccugugccuuaucaccgccuugaauagaaagcaacugauauucuuucuccuguccaacaucacuacaggcuuaauuaaucugauggucgauacccuucacucuagcacguugugggcucucuucguggucaaccuguauauguuuucaaacugucuaaucguguacguucuguaccuccaggacaaaaccgugcaguucugguga

SEQ ID NO: 60699 - RNA, 216 nt, Artificial Sequence
  derived and/or modified sequence opt3 from PIGY__Homo_sapiens__NP_001036081
auguuccugagccuccccacccuuacagugcugaucccuuuggucuccuuagccggccuguuuuacucugcuucaguugaggaaaacuucccacaggggugcacgaguacugcaagccuauguuuuuauucccuccugcuuccgauuaccauacccguguacguauucuuucaccuguggacauggaugggaaucaaguuguucagacauaauuga

SEQ ID NO: 60700 - RNA, 873 nt, Artificial Sequence
  derived and/or modified sequence opt3 from PIH1D1__Homo_sapiens__NP_060386
auggccaaccccaagcugcucggcauggggcuuagcgaggcugaagcaaucggagccgacuccgcgagauucgaggaacuguuguuacaggcuucuaaagagcugcaacaggcccagaccacaaggccugaaucaacucagauucaaccacagccggguuuuugcauaaagacgaauaguagcgagggcaaaguguucaucaacauuugucacucccccucuaucccuccacccgcagaugucaccgaggaggaacuacuccagaugcuggaagaggaccaggccggguuucggauuccuaugucgcuuggagagccacaugcugaacuggaugcaaagggccaagguugcacagccuacgacguugcuguaaauucagauuucuaucgccgaaugcagaacagcgacuuuuugcgugagcucgugaucacuauagccagagaagggcuggaggauaaauacaaucugcagcucaaccccgaauggaggaugaugaagaaucggccuuucaugggaaguaucucccagcaaaacauucgcucugagcagagaccaaggauccaggaguuaggcgaccuguauaccccggcgcccggccgggcagaaagcgggccugagaagccacaccuuaauuuguggcuggaagcccccgaucuacuccuggcugagguggaccuuccuaaacuggauggagccuugggucucucccuggaaauuggcgagaaccgcuuagucaugggagggccacaacagcuguaccaucucgacgcauauaucccccuucagauaaauucacacgagaguaaggcugccuuucaucgaaaaagaaagcagcugaugguggcgaugccguugcuaccuguucccagcuga

SEQ ID NO: 60701 - RNA, 2418 nt, Artificial Sequence
  derived and/or modified sequence opt3 from PIK3AP1__Homo_sapiens__NP_689522
auggccgcuagcggcgugcccagagggugcgacauccugauugucuacuccccugaugcagaggaauggugucaguaucuccaaacccuuuuccugucuucaaggcagguucggagucagaagauauugacacaccgcuuaggaccagaggccagcuuuuccgcggaagaccugucucuauuccucucgacucgaugcgugguagugcugcuuucagcugagcugguccagcauuuucacaaaccggccuugcucccccugcugcaacgugcauuccauccuccacacagagugguuaggcucuuauguggugugcgggauagcgaagaguuucuggacuucuuucccgauugggcccauuggcaggagcuuacgugcgacgaugaaccugagaccuacgucgcugcagugaagaaagccaucagugaagacuccggcugugauucuguaacagacacugagccagaggaugaaaagguugugagcuauuccaaacagcagaacuugcccaccgucacaucaccugggaaucugaugguggugcaaccagaccgcauuagaugcggagcugagaccacugucuacguuaucgugagguguaagcuagaugaccggguagccacagaagcggaguucaguccggaagacagccccucugugcgcauggaggcaaaggucgagaacgaauauaccauuuccgugaaagccccuaaucucucaagcggcaacguuagucugaagaucuacucuggugaucuuguggucugcgagacggugauauccuauuacacugacauggaagagaucgggaaucuguugagcaacgcugccaauccaguagaauuuaugugucaggcauucaaaauuguucccuacaacaccgagacacucgauaagcuguuaacugagucgcugaaaaauaacaucccugcuucuggacuccaccuuuuuggcauuaaucagcuggaagaggaagacaugaugaccaaccagcgagaugaggaauugccaacacuacugcacuucgccgcgaaguauggccucaagaaucugaccgcccuucuguugacgugccccggggcacuccaggcuuacuccguggccaacaaacauggacacuauccgaauacuaucgcugagaagcaugguuuuagagaccugaggcaauucauagaugaguacgucgaaacaguggacauguuaaaaucacacauuaaggaggaacugaugcacggcgaggaggccgaugcagucuaugaaaguauggcccaucuaagcaccgaccuccugaugaaauguucccuuaacccugggugcgaugaggacuuguacgaaucuauggcugcguucgugcccgcagccacugaggaccuguauguugaaaugcuccaggcuagcacaucaaacccaaucccuggagauggcuuuagucgggccaccaaggacuccaugauucguaaauuccuggaggguaauagcauggggaugacgaaccuugagcgcgaucaaugccaccugggacaggaagaggacguguaccauaccguagaugacgaugaagcauuuucugucgacuuggccucaagacccccagugcccguuccuaggccagagacaacugcuccgggcgcccaccagcuccccgauaaugaaccuuacaucuucaagguguuugcagagaagagucaggagcggccaggcaacuucuaugucagcuccgaaucuauccgaaaagggcccccugugcgcccauggagagacaggccccaaucgagcauuuacgauccguuugcgggaaugaagaccccuggucagcggcagcugauaacauuacaggagcaaguaaaacugggcaucgugaauguugacgaagcuguccuacauuucaaggaguggcagcucaaccagaaaaagcgcuccgaaucauuuagauuccagcaagagaaucugaagaggcuucgugauaguauuacucggcgacagagagagaaacagaagucugggaaacagaccgacuuggaaaucacagugccaauaaggcacagccaacaucugcccgccaagguggaguuuggagucuaugaauccggcccucgcaaaucaguuauucccccacggaccgagcucagaaggggugacuggaagacugauagcacgucuuccacagcaaguagcaccucuaaccgcuccucaacucgaagucuguuaagcgugucguccgggauggagggcgacaaugaagauaacgaggugccugaaguaacccggucucguagccccggaccaccgcaggucgacggcacaccuaccaugucacuggagagacccccaagggugcccccucgcgccgcuagucagcggccacccacuagagaaacauuccacccuccgccacccguuccuccaagggggcgauga

SEQ ID NO: 60702 - RNA, 5061 nt, Artificial Sequence
  derived and/or modified sequence opt3 from PIK3C2A__Homo_sapiens__NP_002636
auggcccagaucagcuccaacucuggcuucaaggagugccccucaagucacccugaaccaaccagagcuaaagacguggauaaggaggaagcacugcaaauggaggccgaagcgcucgcuaaacuucagaaggacaggcaggucacagauaaucagcggggguuugagcugagcuccucuacucgcaaaaaggcccaaguuuacaacaagcaggacuaugauuugaugguguucccggagucggacucacagaaacgagcauuagauauugacguagaaaagcugacgcaggccgagcuagaaaaacuccugcuugaugacagcuuugagaccaagaaaacacccgugcugccugucacuccaauauugagucccuccuucucugcucaacucuacuuucguccuaccauccagagaggacaguggccacccggucugccuggcccaagcacauaugcacugccguccauuuaccccucaaccuauaguaagcaggccgcuuuccaaaauggguuuaacccuaggaugccaacuuuccccagcacagagccuaucuaccucucuuuaccaggacagucccccuauuuuucauacccgcugaccccugccacgcccuuccauccacagggcagccuuccuauuuaccggcccgugguuaguacugauauggcgaaguuguuugacaaaaucgcaucuaccuccgaauuccugaagaaugguaaagcccgcacagaucuagagauaacugacagcaaggugucgaaccuccaagucucuccaaaauccgaagacaucucaaaguuugauuggcuggaccuugauccccugaguaaaccuaagguggacaauguagagguuuuggaucacgaagaggagaagaacgugagcucccuccuggcuaaagacccaugggaugccgucuuacuggaagagagaucuaccgcaaauugucaucucgaaaggaaggugaacgggaaaagccuuucaguggcuacagucacccggagucagucccugaauauucgcacgacucaguuggccaaggcgcagggacacaucagccaaaaagacccgaacggcacaucuucacuacccaccggcaguagccugcuccaggagguugaagugcagaaugaggagauggccgcauucugccgauccauuacuaagcugaagacaaaauucccuuauaccaaccauagaacgaauccaggguaccuucugucucccguaaccgcucagaggaacaucuguggagaaaacgccucggugaaggucagcauagauauugaggguuuucaauugccugugacauucacuugcgacguuuccucaaccguggaaaucauuaucaugcaggcucucuguuggguccacgaugaccugaaucagguggacguaggcaguuauguuuuaaaagugugcgggcaggaggaaguccugcaaaacaaucacugucuaggaucucaugagcacauccagaacugccggaagugggauacagagauucgucuccagcugcuuacuuuuagcgccaugugucagaauuuggcacgcaccgccgaagacgaugagacaccaguggaccugaacaaacaucucuaccaaauagaaaagcccugcaaggaggcuaugaccagacacccggucgaggaacugcuugauuccuaucacaaucagguggagcuggcguugcagaucgaaaaccaacauagggcaguugaccaggugauuaaagccguacggaagaucuguucagcucucgauggcgucgagacucuggccauaacggaaagcgugaaaaaguuaaaacgagcaguuaaucugccucgcucuaagacagccgacgugaccucccuauucgguggggaggauacuaguagaagcucuaccaggggaucccucaacccagagaaucccguccaggugucaauuaaccagcugacagcugccaucuacgaccuuuugcggcugcacgcaaauaguggccgcagcccuaccgauugcgcgcaaucguccaagucuguaaaagaagcuuggacuacaacggagcagcuccaguuuaccaucuucgccgcacauggcauuagcucaaacugggugaguaauuaugaaaaguacuaccugaucugcuccuuaucucacaacgggaaagaccuguuuaagcccauucagagcaaaaagguuggaacuuauaaaaacuucuuuuaccuuauaaagugggaugaguugaucauuuucccaauccaaaucucccagcucccucuggaaucaguccuacaucugacacucuuugguauucugaaucagagcaguggcucuucccccgacagcaacaagcagagaaaagggccagaggcccuuggaaaggugucguugccgcuguucgacuuuaaaagguucuuaaccuguggcacaaagcuccuguaucuuuggacuucaucucacaccaauagugugccugguacggucaccaaaaagggguacguuauggagcguauagugcugcaaguggauuuccccuccccagcuuuugacaucauuuauacaacuccccagguagaucggagcaucauucagcaacacaacuuggaaacccucgagaaugacaucaagggcaaacugcuagauauacugcauaaggacucuagccucggacuguccaaagaagauaaggccuuccuuugggagaaacgauacuauugcuuuaagcacccuaacuguuugccaaagauccuggcaucagcucccaauuggaaaugggucaacuuagccaagacauacagucuccugcaucaguggccugcgcuuuacccgcugauugcccuagaacuccuggacagcaaauucgcugaucaggaggugagaucuuuggcaguuacuuggaucgaggccauuuccgacgaugaacugaccgacuuacucccacaguuugugcaagcucugaaguaugagaucuaccuuaauucaagucugguccaguucuugcucagcagggcccugggcaacauacagauugcacacaaucuauauuggcugcuuaaagaugcgcuccacgacgugcaguuuuccacgcgcuacgaacauguucugggggccuugcugucugugggagguaagcgguuaagagaggagcuccugaagcaaacaaaacuuguacagcuguugggcggggucgcugaaaaggugaggcaggccucgggaagcgcacgccaggugguccuccaacgaucaauggagcggguucaguccuucuuucagaaaaacaagugccgucugccccuaaaaccuagucugguggcuaaggaacuuaauaucaaaucuuguagcuucuuuuccucaaacgccguaccacucaaggugaccauggucaaugcagaccccaugggcgaggaaauuaacgugauguucaagguuggugaggaucugagacaggacauguuggccuuacaaaugaucaaaauaauggauaagaucuggcugaaagaggggcucgaccugaggauggugauuuuuaagugccuuucuacuggccgcgaucggggaauggucgaacuggugccugcuagcgacacauugagaaaaauccagguugaguauggcgugaccgggaguuucaaggauaagccgcuagcggaauggcugaggaaauacaaccccuccgaggaagaguaugagaaggccagcgaaaauuucauuuacucuugugcaggaugcugugucgcuacuuacguacucgguaucugcgaccgacacaacgauaauauaaugcugcgcucaaccggccauauguuucacauugacuucgggaaauuucuuggacaugcccagauguucggcuccuuuaagcgggauagagccccauucguguuaacaagugacauggcuuauguuaucaacgguggggagaaaccuacgaucagguuucaacuguucguggaccucuguugccaggcauacaauuugauucguaagcagaccaaccuguuucucaaucugcuuagccugaugauccccucgggcuugccagaacuaacuucuauucaggaucugaaguauguccgcgacgcccuccaaccucagacaaccgaugcggaggcuacaauauucuuuacucgguuaaucgaauccagccugggaucaauugccaccaaauucaacuucuuuauccacaaucuugcacagcugagauucaguggccuccccucuaacgacgagccaauuuuguccuuuagcccgaagacguacucauucaggcaggaugggcgaaucaaagaggugaguguauuuacauaucacaagaaauacaauccugacaagcauuauauauacgugguccggauccugcgcgaaggacaaauugagcccagcuucguuuuuagaaccuucgaugaauuucaggagcuccacaacaagcuguccaucauuuucccacuuuggaaacuacccggcuuuccuaauaggauggugcugggucggacucauaucaaggacguggccgcuaaacgaaagauagaguugaacucuuacuuacagagccugaugaaugcauccaccgaugucgccgaaugcgaccucguguguacauucuuucacccacugcuuagagaugagaaagcggaagggauugcucgcucagccgacgcaggaucuuucagucccacuccuggccagaucgguggcgccguuaagcugucgaucagcuauaggaacgggacccucuucauuaugguaaugcauauaaaggauuuggugacagaggacggagcugacccgaacccauacgucaaaacguaucugcuacccgauaaucacaagaccuccaaacguaagacuaaaaucucucggaagacaagaaacccuaccuuuaaugaaaugcugguguacucaggcuauagcaaagagacucucaggcaacgcgagcuucagcuguccguuuuaagugccgaaucuuugcgagagaacuucuuucuggggggagugacacucccccugaaggacuucaaucuuagcaaggaaaccgucaaaugguaccagcugacggcagcuacuuaucucuga

SEQ ID NO: 60703 - RNA, 4905 nt, Artificial Sequence
  derived and/or modified sequence opt3 from PIK3C2B__Homo_sapiens__NP_002637
augagcuccacccagggcaacggggagcacuggaagucucuggaaucagugggaaucaguagaaaagagcucgccauggcugaagcacuucaaauggaguacgacgcccugagcagguugcggcaugauaaggaagagaaucgcgcgaaacagaacgcugaccccuccuuaauuucuugggaugagccuggugucgacuucuauucgaagccagccggccgacguacagaucugaaacuacucagagggcugucaggaagcgacccgacucuuaauuacaacagucugaguccccaggaaggcccuccaaaucacucuacgagccaggguccccaaccuggguccgauccauggcccaagggaucauugaguggcgacuaucucuacauauuugauggcagcgacgggggaguuucuuccucaccugguccaggcgauaucgaggggagcugcaagaaacugaguccgcccccucugccacccagggcaucuauuugggacaccccuccacuucccccgcggaagggauccccuagcucgucuaaaaucucccagcccucagauauuaacacauucaguuuaguggaacagcugccaggcaagcucuuggagcaucgcauccuggaggaagaggaaguacuaggugggggaggccagggcagacuccuggggagcguggacuaugacggaauaaaugaugccaucacuaggcuuaaccugaaauccaccuacgacgcugagauguugcgggaugcaacacgcgguuggaaggaaggccgagggccucucgacuuuucuaaggauaccagcggaaaacccgucgccagaucaaagacuaugccaccccaagugccuccaaggacauaugcuagucgguacggcaaucguaaaaacgccaccccggguaagaaucgcagaauuuccgcggcacccguugggagcaggccucacacgguggccaacggccaugagcuguucgaggucucugaggaacgggacgaagagguggcugccuuuugucacauguuagauauccugcgaucaggaagugacauucaggauuacuuccucacuggcuauguauggagcgcaguuaccccaucccccgaacaccuuggggacgaggugaaucugaaagucacaguguugugcgaucgccuacaggaggcucugacuuuuaccuguaacuguucuucgacaguggaccuccugaucuaccagacccuuugcuauacgcaugacgaucugagaaaugucgacguuggagauuucguguugaagccuugcggucucgaagaguuucugcaaaacaaacacgccuuaggcagccaugaauacauacaguauuguaggaaguucgacauugauauccggcugcagcuaauggagcaaaagguagugcgcuccgaccucgcgagaacugucaacgaugaccagucaccaaguacacugaauuaccuugugcacuugcaggaaaggcccguuaaacagaccauuucucgucaagcccugagccuccuguuugauacuuaucacaacgagguggacgcauuccuucuggcugauggggacuuuccguugaaggccgaucgggucgugcaguccguaaaagcuaucugcaaugcccucgcagccguugagacaccugaaaucaccucagcucugaaccaguuaccacccuguccuagccgaaugcagcccaagauucaaaaagacccaucugugcuggcggucagagagaauagggaaaagguggucgaggcacuaacggccgcuauacucgaccugguggagcuuuacugcaacaccuucaaugccgauuuccagacagcaguuccuggaucccgcaagcaugacuuggugcaggaagccugucacuuugcucggagucuggccuucacuguauacgcaacccauagaauccccauuaucugggcgacaagcuaugaggauuuuuaccucucuugcucccugucacacggcgguaaagaauuaugcaguccacugcagacuaggcgcgcucauuucagcaaguaucuuuuucacuugauagucugggaccaacagauuuguuucccggugcagguuaaccgacucccucgggagacccugcuaugcgccacacuguacgcacuccccaucccacccccugggucguccucugaagccaauaaacagcguagagugccagaggcucugggcugggucaccacuccccuuuuuaacuucaggcaaguguugacguguggacgcaagcuguuaggccucuggccugccacacaggagaauccgagcgcacgguggucagcuccaaacuuucaccagcccgauaguguaauccugcaaauugacuucccuaccuccgccuuugauaucaaauucacuucuccacccggggacaaguuuagcccuagauaugaguucggaucccuuagggaagaagaucagcgaaagcugaaagacauuaugcagaaggagucauuguacuggcucaccgaugcggacaaaaagcgccugugggaaaaacgguauuacugccauagcgaggugaguucucuaccgcugguucucgccuccgcucccagcugggagugggcaugucugccagauauauacguccuuuugaagcaguggacacacaugaaucaucaagacgcccuggguuuacuccacgcuaccuucccugaccaggaagugagaaggauggccgugcaguggaucggcucgcugucagaugcagagcuucuggacuaucuaccccagcucguccaagcgcugaaguacgaaugcuauuuggauucuccacugguucguuuucuucucaaacgcgccgugagugaccugcgggugacucacuacuucuuuuggcuucugaaggauggguugaaagacucccaguucagcauuagauaucaguaccuccuggcugcccuacuguguugcuguggaaagggccuuagggaggaauuuaaccgacagugcuggcucguaaaugcacuggcuaaauuggcccaacagguccgggaggcagccccuucugcucgccaggguauccugagaacaggguuagaggaagugaagcaauucuuugcgcucaacggcagcuguaggcugccccuuuccccaucacuguugguuaaaggaaucgugccgcgggauugcaguuauuucaacagcaaugccgucccucucaagcugucuuuucagaacguggacccccuaggcgagaauauucgaguuauauucaagugcggggaugaccugagacaggauaugcuuacgcuccagaugauccgcauuauguccaaaaucugggugcaagaaggacuggacaugaggaugguaauuuuucguuguuucucaaccggccgggguagagggauggucgagaugaucccaaacgcagagacuuugaggaagauacagguggaacauggagugacaggcaguuuuaaagaccgccccuuagcugauuggcugcagaagcacaauccuggugaggacgaauacgagaaagccgucgaaaacuucaucuacagcugcgccggcuguugcguugcuaccuaugugcucgggauuugugaucgacauaaugacaacaucaugcugaagacaacuggacacauguuccauauugauuuuggcagauuccuugggcacgcacagauguuuggaaauaucaagcgggacagggccccauucguauuuaccuccgauauggcguacgugauaaacggcggugacaaacccucuucgcgcuuccacgauuuugucgaccugugcugucaggcuuauaauuugauucguaagcauacgcaccuauuccugaaccuccuggggcuuauguuaagcugcggaaucccugagcugucagaucucgaggacuugaaauacguguaugaugcccugagaccgcaagacaccgaagcaaaugccacaacuuacuuuacccggcucauugaguccagucugggcucuguugcuacaaaguuaaacuucuuuauccauaaucuggcacagaugaaauucacugguagcgacgauagguugacccuauccuucgccucacgcacgcacacacugaagucuagcggccgaauaagugacguguuucucuguagacaugaaaagaucuuccacccaaacaaaggguauauuuacgucgugaagguuaugcgggagaacacccacgaagcgacuuacauccagaggacauuugaggaguuccaagaauuacauaauaaacugcgccuucuguuucccuccagccaccucccuucuuuccccucaagauuugugauuggaaggucccggggcgaggcugucgccgaacgucgccgagaggaauugaacggguauaucuggcaucugauacacgcaccaccugagguagccgagugcgaucucguguacaccuucuuucacccccugccaagagacgaaaaggcuaugggaacuuccccugccccgaaaagcucggauggcaccugggcaaggcccguugguaaggucgggggagaggugaaacuuucuauuuccuauaagaauaacaagcuauucaucauggugaugcauauccggggccugcaguuguuacaggacgguaaugauccagacccuuacguaaaaauuuaucugcuccccgauccacagaagacaacgaaacgcaagaccaaaguggcuagaaagacuuguaacccuacauacaaugaaaugcuggucuaugacggcauccccaagggggaucuucaacagagggagcugcagcucagcguuuugucagagcaaggauuuugggaaaacgugcugcuaggcgaggugaauauucggcugcgagaacucgaccuugcccaggagaaaaccgggugguucgcgcugggaaguagaucucacggcacauuauga

SEQ ID NO: 60704 - RNA, 4461 nt, Artificial Sequence
  derived and/or modified sequence opt3 from PIK3C2G__Homo_sapiens__NP_001275701
auggccuacagcuggcagaccgaccccaacccuaaugagucccacgaaaagcaauaugagcaucaggaguuccuguuugugaaccagccacacucuucaagucaggucagccucggcuucgaucaaaucguugacgaaauuuccgggaaaauaccgcauuacgaaucugagaucgaugagaauacauuuuucgugcccacugcuccuaagugggacucgacgggacacucacuuaacgaagcacaucagauuagccugaaugaguuuaccaguaaauccagagaauugucuuggcaccagguaagcaaggccccagcgaucgguuucucccccucaguguuaccuaaaccacagaacacaaauaaggagugcaguuggggcagccccauugggaagcaccauggagcugaugacucuagguuuuccauccuggccccuucauucacuagccuagauaaaauaaaccucgagaaggaacuggagaaugaaaaccacaauuaucauaucggcuuugagaguucuauuccaccgaccaacuccagcuucucgucugacuuuaugcccaaagaagagaauaagcgguccggucacgucaacaucguggagccuucacuuaugcuguugaaagggagucuccaaccaggaaugugggaaagcacauggcagaagaauauugaguccaucggcuguucuauacagcugguugaagugccccagagcucaaacaccagucuggcauccuucugcaacaaggucaaaaagauucgcgagcgauaccacgccgcugaugugaauuuuaacagcggcaaaaucuggucuacuacaaccgcauucccuuaucaacucuucucaaagacgaaauuuaauauucauaucuucaucgacaacaguacucagccauuacacuuuaugcccugugccaauuaccugguaaaggaucuuauugcugaaauauugcauuucugcaccaacgaccagcugcuaccgaaagaucacauccucagcguuuguggguccgaggaguuucugcaaaaugaccauugccuuggaucucacaagauguuccagaaggacaaaucggugauucagcugcacuugcaaaagagccgugaagccccugguaaacucuccagaaagcaugaggaagaucacucacaguuuuaucugaaccaguuacuggaguucaugcauaucuggaaagucaguaggcagugucuccuuacacugauacggaaguacgacuuucacuugaaguaccuacugaaaacucaggaaaauguguauaacauuaucgaggaggugaagaaaaucugcucuguccucggcuguguugaaaccaagcaaauuacagaugcggugaaugagcugagccuuauccugcagcgcaaaggggaaaacuucuaccaguccucagagaccagcgcaaagggauugauugagaagguaacgacugaacucucuacauccauauaucagcugaucaauguguacugcaacaguuuuuaugccgacuuccaacccgucaaugugccaagauguaccagcuacuuaaacccuggccugcccucucaccuauccuuuacuguuuaugcugcccauaacauuccagagacaugggugcacucauacaaagcauucaguuuuaccugcuggcucacguacgcugguaagaaacugugccaggucaggaauuaucggaacauccccgauaagaaacuuuucuucuuuuuggugaauuggaacgaaaccaucaauuucccucuggagauuaagagccucccacgcgaaucgaugcugacaguaaaguuguuugggauagccugugcgacuaacaaugccaaccuguuggcauggaccugccucccgcuguuccccaaagagaaguccaucuuaggaucuaugcuguuuagcaugacacuacagucagagccuccaguugaaaugauuacucccggcgugugggacgucagucagccuuccccagugacccuccaaaucgauuuccccgcuacaggcugggaguacaugaaaccggacucugaagagaaucgaagcaaccuggaggaaccucuuaaggaguguauuaaacauaucgccagauugucccagaagcagaccccacugcuccugucagaagagaaaaagagguauuuaugguuuuaccgguucuauugcaauaacgaaaauuguagccugccccuugucuuggggagugcuccuggaugggaugagcguacugugucugaaaugcacacgauacuccgcagauggacauuuucccaaccccuggaggcccuaggucugcucaccagcucguucccagaccaggagaucaggaagguugcagugcagcagcuggauaaccuuuugaaugacgaacuguuagaguaccucccucaacugguacaggccgucaaauuugaauggaaccuugagucaccccuggugcaguugcuccugcaucggucucuacagaguauucaaguugcucaccgacuguauuggcuccugaagaacgcggagaaugaagcauacuucaaauccugguaccagaaacuuuuggccgcucugcaguucugcgccggcaaggcauuaaacgacgaguuuagcaaggaacagaagcucaucaaaauucugggggauaucggagagcgcgugaagucugccagcgaccaccaaagacaggaaguccuuaaaaaggagauaggcaggcuggaggaguucuuucaggaugugaauacuugucaucuaccacucaacccggcucugugcauuaaagguaucgaccacgaugccuguuccuauuucaccucaaaugcauugccucugaagauuacauuuaucaacgcgaaucccauggggaagaacauaaguaucauuuucaaagcuggcgacgauuuacggcaagacaugcucguacugcagcuuauccaggugauggauaauauuuggcugcaggaaggauuggacaugcaaaugaucauauaccgcugccucagcaccggcaaggaucaggggcugguucagauggucccagacgccgugacucuagcaaaaauucauagacacucuggacugaucgguccccuuaaggaaaacacaaucaaaaagugguuuucccagcauaaucaccucaaggccgauuaugagaaagcucugaggaacuucuuuuacucaugugccggcuggugcguggucacguucauuuuggggguuugcgaccgucacaaugacaacaucaugcugaccaagaguggacauauguuucacauugauuucggcaaauucuuaggucaugcacaaacuuuugggggcauaaagcgggaccgagcuccuuucaucuuuacaagcgaaauggaguauuucauuaccgagggaggcaaaaauccacagcacuuucaggauuucguggaacucuguugcagagccuacaacaucauuaggaagcacucccagcugcuucugaacuugcucgagaugaugcuguaugcggggcuacccgaacugucuggaauccaagaccuuaaauacguguacaauaaccuccgcccucaggauacagaccuggaggccacuucgcauuuuaccaagaagauaaaagaaagccuugaguguuucccgguaaaguuaaauaaccugauccacacgcucgcucagaugucagcaauuuccccagccaaaaguaccucucagacauuuccccaagagagcugccugcuuuccacuacccggucaaucgaaagagcuacaauucuggguuucucuaagaaaagcaguaauuuguaucuaauccaggucacucauuccaacaaugagaccagccugacggaaaagucuuuugagcaguucucaaagcuccacucccaacugcagaaacaguuugccagucuuacauuaccugaguucccacauugguggcaucugcccuucaccaacagcgaucacaggcgcuuucgagaccucaaucacuacauggaacagauauugaacgugucgcacgagguuacuaauucugauugugugcuguccuucuuucucagcgaagcaguccaacagacaguggaggaaucaaguccuguuuaucugggcgagaaguucccggacaaaaagcccaaagugcagcuuguaauuucuuacgaggaugucaagcugaccaucuuggugaagcauaugaaaaacauccaccuaccagacggguccgcgccuagcgcccacguggaauuuuaucugcuccccuacccaucagagguccggcguagaaagacuaaaaguguuccuaagugcaccgaucccacauauaaugaaauugugguauacgacgaggugacggaauuacagggacauguccugaugcuuauagugaaaagcaagaccguuuucgugggcgcuaucaacauuaggcuguguuccgucccacucgacaaggagaaaugguacccguuggguaauucuaucauuuga

SEQ ID NO: 60705 - RNA, 2664 nt, Artificial Sequence
  derived and/or modified sequence opt3 from PIK3C3__Homo_sapiens__NP_002638
augggcgaggccgaaaaguuccacuacaucuauagcugcgaccuggauauuaacgugcagcucaaaauagggucccuugagggaaagagagaacaaaaaucuuacaaggcuguccuggaggaccccauguugaaauuuucagguuuauaucaggaaaccuguagugaucuguacguuacaugccagguguucgcagagggcaagccucuagcccucccaguaaggacuagcuauaaggcguuuuccacgcgguggaauuggaacgaguggcugaaacuuccggugaaguaccccgaccugccucgcaaugcucaggucgccuugaccaucugggauguguaugggccaggaaaagcaguucccgugggcgguacaacugucucucucuucgggaaguacggaauguuucgacaaggcaugcaugaccugaaaguguggccuaacguagaagccgauggcucggagccaaccaagacacccgggcguaccucaagcacucugagugaagaccagauguccagacucgcuaaguuaacaaaagcacacaggcagggacauaugguuaagguggauuggcuggaccggcuuaccuuccgcgagauugagaugaucaaugaaucugagaaaagaagcuccaacuuuauguacuugauggucgaguucaggugugugaagugcgaugacaaagaguaugguauuguguacuaugaaaaggauggcgacgagucaaguccuauccugacgagcuuugagcuagucaaaguuccagacccgcagaugucuauggaaaaucucguggaguccaagcaccauaagcuggcccggucacuucgcagcgggcccagugaucacgaccugaaaccuaacgcugccacucgagaucaauugaauauaaucguaucuuacccacccaccaagcagcucacauaugaagaacaggaccugguguggaaauucagauacuauuuaacuaaccaggaaaaggcgcugaccaaauuucucaagugugucaauugggaucuuccucaagaggcaaagcaggcccuggaguugcuaggaaaauggaagccaauggacguggaagauucccuggagcuccugagcucgcacuacacaaaccccaccguuaggcgguacgcuguggcccgucuucgccaggcagacgaugaagaccuguugauguaucuccugcaauuaguccaggcucugaaauacgagaauuucgaugacauuaagaacggccuagaaccgacgaaaaaggacucucaguccucagugagugagaauguaagcaacuccgguaucaacucugccgagauugauagcucacagaucauaacaaguccucuccccuccguuagcucuccaccucccgcgucaaagacuaaagaagugccagacggggagaaucuggaacaagaucuuugcaccuuuuugauuaguagagccuguaagaacagcacucuggcaaauuaucucuacugguaugucaucguggagugcgaggaccaggauacacagcagagggaccccaaaacccaugaaauguaccugaacgucaugcggcgauucucccaagcucugcugaagggagauaaaucugugcgcguuaugagaucguugcucgccgcucagcagacguucguggacaggcugguacacuuaaugaaggccguccagcgggagagcggcaaucgcaagaaaaagaacgaaagacugcaagcacuacucggcgauaaugagaaaaugaaccuguccgacguggaacuuauuccuuugccacuggagccgcagguuaagaucagggggaucauucccgagaccgccacacucuuuaaaucagcucugaugccugcgcaguuauucuuuaagacugaagauggagguaaauauccagugauauucaagcauggcgacgaucugcgucaggaccaacuuaucuugcagauuaucagucucauggacaagcugcuacggaaagagaaucuggaucucaagcugacccccuacaaaguccuugcaacaucuacuaagcacggguuuaugcaguucauacaaagcgugccuguagccgaaguguuggacaccgagggauccauucagaacuuuuuccgaaaauacgcuccaucagaaaauggccccaacgguaucagcgccgagguuauggauacauaugucaagucuugugcaggguacugcgugaucaccuauauucugggcgugggagacagacacuuagauaaucuccugcuuacuaagacgggcaaacuguuucauaucgacuucggguacauuuugggaagggauccgaagccucucccacccccuaugaaacugaacaaggagauggucgaagguaugggcgggacacaguccgagcaguaucaagaauuucgcaaacaguguuacaccgccuuccuacaccuucggagauauaguaaucucauacugaaccuuuuuagcuugaugguugacgcuaacauccccgauauugcccuggagccagacaagacugugaagaaagugcaggauaaguucagguuagaccucucugaugaagaggcaguacauuacaugcagucccugaucgacgagucaguccacgcgcuuuucgcugccgugguugaacaaauccauaaauuugcacaguacuggcgcaaguga

SEQ ID NO: 60706 - RNA, 3207 nt, Artificial Sequence
  derived and/or modified sequence opt3 from PIK3CA__Homo_sapiens__NP_006209
augcccccuagaccaagcuccggcgagcugugggggauccaccucaugccgcccaggauucuuguggaaugccuguugccuaacggaaugauagucaccuuagagugucugcgggaagccacacuaaucacuauuaagcaugaacucuucaaagaagcucgcaaguacccacugcaccagcuucugcaagacgagucuucauauaucuuuguuagugugacgcaggaggcagaacgagaggaguucuuugaugagacccguagauugugcgaccucaggcuguuccagcccuuucugaaaguaauugagccuguggguaaucgggaagagaagauccucaaccgcgaaauaggcuucgccaucgggaugccagucugugaguuugauauggugaaagaccccgaaguucaggauuucagaaggaauauuuuaaacgugugcaaggaggcggucgaccugcgggaucuuaauagcccucauucccgcgcuauguacguguauccaccgaacguagagucuucgcccgaauugccuaagcacaucuacaauaaacuggacaagggacaaauuaucguugugauaugggucauugugucaccaaacaaugauaaacagaaguauacacuaaaaaucaaccaugacugugugcccgagcaggucauugccgaagcaauccgaaagaagacuagaagcaugcuccugaguuccgagcagcuuaaacugugcguuuuggaauaccaaggcaaguauauccucaaagugugugguugcgaugaguacuuucuggagaaguacccuuuaucucaguauaaauacauuaggagcuguauaaugcuggggcggaugccaaaucucaugcuuauggccaaggaaucccuguauucacaguugcccauggacugcuucaccaugccgaguuacagccgucgcaucucuacagcuaccccuuauaugaacggagagacuuccacaaaaucacuauggguaauuaauagcgcacugagaaucaagauacucugugccaccuacgugaacgucaauauuagggauaucgacaagaucuaugugcggacgggcauuuaccacggcggggaaccccugugcgacaacguuaacacucagcgagugccaugcaguaauccucgcuggaacgaguggcuuaauuacgauaucuauauucccgaccugccaagagcugccagguugugucucucuauaugcuccgucaaaggacggaagggugcgaaagaagaacacuguccccuggcauggggcaacaucaauuuauuugauuacaccgacacacuggugagcgggaagauggcccuaaaccucuggccuguaccacauggacuggaggaucuuuugaauccgauuggcguuacugguucgaaccccaauaaagaaaccccuugccuggagcucgaguucgacugguuuucuuccguggucaaguucccagauaugucagugaucgaggagcacgcuaacuggagugucagccgcgaagccggguucuccuauucucaugcaggacugagcaauagacuugcuagggacaacgagcugcgugaaaaugauaaggagcaauugaaagccaucucaacacgggacccccucagugaaauuaccgagcaggagaaggauuuucuguggucccaccgacacuacugugugacgauaccugaaaucuuaccaaaacugcuacucagcguuaaguggaacucuagagacgagguggcgcagauguauugccugguaaaagacuggcccccgauuaagccugaacaagccauggagcuuuuggauuguaauuacccagaccccauggucaggggcuucgcagugcgcugccuggaaaaguaucucacugaugacaaacugucacaguacuuaauccagcugguucaggugcuuaaguacgagcaauauuuggauaaccuccugguccgguuucuacugaaaaaggcucucacaaaccagagaauuggccauuucuuuuucuggcaccugaaaagugagaugcauaauaagaccgugagccagagguuugggcuuuugcuggaauccuacugucgcgccugcggaauguauuuaaagcaccucaaccgacagguagaggcuauggaaaaacugaucaaucuuacugacauacugaagcaagagaaaaaggaugaaacacagaaagugcagaugaaguucuugguugagcagaugcggcguccugacuuuauggaugcccuccaagguuuccugucuccccuaaacccagcacaucagcugggcaaucucagacuggaggaauguaggaucaugucgagcgccaaacgcccucuuugguugaacugggagaaucccgacauuauguccgaacuguuauuucagaacaaugagaucauuuucaagaacggggaugaccuccggcaggauaugcugacccuucaaaucauaagaauuauggagaauaucuggcagaaccagggacuggaccuaaggaugcucccauacggcugccugucaauuggugacugcgucggguugaucgaaguggugcgaaauagucacacgauaaugcaaauccaguguaagggcggacugaaaggcgcuuuacaguuuaacucucacacccuccaucaguggcugaaggauaaaaauaagggggagauuuaugacgcggcaaucgaucuuuucacacgcagcugcgccggauacugugucgcuacuuucauucuggguaucggcgaccggcacaacuccaacauaaugguuaaagaugacgggcaauuguuucauauugauuucggacacuuucucgaccacaagaagaaaaaguucggcuauaaaagagaaagggugccguuugugcugacccaggauuuccuaaucguaaucucaaagggugcccaggagugcacaaaaacucgugaauuugagcgcuuccaggagauguguuacaaggcauaccuggccauucggcaacaugcuaaucuuuuuaucaaccucuucagcaugaugcuggggucuggcaugccugaauugcaguccuuugacgauauugccuauauaagaaagacccuggcauuagacaaaacagagcaggaagcgcucgaguacuucaugaagcagaugaaugaugcucaccauggaggcuggaccacuaaaauggacuggaucuuucacacgauuaagcaacaugcccugaacuga

SEQ ID NO: 60707 - RNA, 3213 nt, Artificial Sequence
  derived and/or modified sequence opt3 from PIK3CB__Homo_sapiens__NP_006210
augugcuucagcuuuaucaugcccccugccauggcugacauucuggauauaugggcaguggacucccagaucgccucugauggcucaauuccagucgacuuccuccuuccgaccgggaucuacauucaacuggagguucccagagaagcgacaaucaguuauauaaagcagauguuguggaaacaggugcacaacuacccuauguuuaauuuacugauggauaucgacagcuauauguucgcuuguguaaaccagacugccguguacgaggaacuagaggaugaaacgaggcggcucugcgacguccgcccauuucugcccgugcuuaagcugguuacccgauccugugauccuggagagaaauuggacucuaagauuggugugcucaucggcaaagggcugcaugaguucgauucgcugaaggacccagaagucaaugaguuucguagaaagaugaggaaauucucagaagagaagauucucagcuuagugggacugaguuggauggauuggcuuaaacaaacauaucccccugagcacgaaccauccaucccggagaacuuggaagacaagcuguacggcgguaaacuaauaguagcaguucauuuugagaauugccaggacguguucucuuuucaggucagccccaacaugaauccuauuaaggugaacgaacucgccauccagaagcggcugacuauucacgggaaagaggaugagguguccccauaugacuacguccuucaaguuucaggacgcguggaauacguauucggcgaucauccccugauccaguuucaguauaucagaaauugugugaugaacagggcuuugccucacuucauucucgucgagugcuguaagaucaaaaagauguacgaacaggagaugauagcaauugaagccgcuaucaaucggaacaguagcaaucugccauuaccccugccgccuaaaaagacccgcauaauuucucacgugugggagaacaauaaccccuuccaaaucguucucgugaaaggcaacaaguugaauacagaggaaaccgucaaggugcauguacgagccgggcuguuucacggaacugaguugcuaugcaaaacaaucguuuccucagaagugagcgguaagaacgaccauauuuggaaugagccacuggaguucgauaucaacauuugugaccucccuagaauggcgaggcugugcuuugcagucuaugccgugcuugauaaagucaagaccaaaaagaguacgaagacuauaaaucccucuaaauaccagaccauccggaaggcuggcaaagugcacuauccaguugccugggugaacacaaugguauucgacuuuaaggggcagcugcguacuggagauauuaucuugcacuccuggagcucguuccccgacgaacucgaggaaaugcugaauccuaugggcaccguccaaacaaacccauacaccgagaaugcaacggcuuuacaugugaaauuuccggaaaacaagaagcagcccuauuacuacccuccauucgauaaaaucauugagaaggccgcggagauagccucuuccgacucagcaaauguuaguagccgcggugggaaaaaguuucugcccgugcuaaaagaaauccucgacagagauccucugucccagcuuugugagaacgaaauggacuugauuuggacucugaggcaggauugccgggagaucuucccacaaucucuccccaagcugcuucugagcauuaaguggaauaaauuggaagacgucgcucagcuccaggcccuguuacagaucuggccgaagcugccuccacgagaggcucuagagcuccuggauuuuaacuaucccgaccaauacgugcgcgaauaugccguaggaugccuuagacagaugucagaugaggaauugagucaguaccugcuccagcuggugcaaguuuuaaaauaugagccuuuccuggacugugcacuuuccagguuuuugcucgaacgggcccugggcaaucgcagaauaggccaguuccuauucuggcaccugaggagcgagguccauauccccgcugugucugugcaguuuggggucauucucgaggcguacugccguggaucaguuggucacaugaaggugcugaguaaacagguggaagcacuuaacaaguugaaaacacugaacagcuuaaucaagcucaaugccguaaagcugaaccgggcuaaaggcaaggaggccaugcauaccugucuuaaacaauccgcauaucgagaagcccugucugauuugcagucgccacucaauccuugcgucauucugagcgagcuauacguggaaaaguguaaauacauggacuccaagaugaagccccuguggcucguuuauaacaauaaaguguucggggaggauucagucggagugaucuuuaagaacggcgacgaucugagacaggacaugcuuacuuugcaaaugcugagguuaauggaccuccuguggaaagaggcuggucuugaucugcgcaugcuaccauacgggugccucgccacaggcgaccggaguggacugauagaaguugugucuaccagcgagacgauugcagauauccagcuuaauuccucaaacguagcggcugccgcagccuucaauaaggacgcucuguuaaacuggcucaaagaauauaauagcggcgaugaccuggauagagccauugaggaguuuacccuuucuugugcaggguacugcgucgcuuccuaugugcugggaaucggugacaggcacagugauaacauaauggugaagaagacaggccaguuguuccacaucgacuuugggcauauucucggaaauuucaaaagcaaguuuggcaucaaacgcgaacgagucccguucauucugacuuacgauuuuauccacguuauacagcaagguaagaccgggaacacagagaaauucggccgguuucgucaguguugcgaagacgccuaucuaauucugagaaggcauggaaaucuuuucaucacucucuucgcgcugauguugaccgccggccugccugaguuaacaucugugaaggauauccaguaccucaaggacucccuggcucuugggaaaucagaagaggaggcacugaagcaguuuaaacaaaaguucgacgaagccuugcgcgagaguuggaccacuaaaguaaacuggauggcucacacggugcggaaggauuacagaagcuga

SEQ ID NO: 60708 - RNA, 2487 nt, Artificial Sequence
  derived and/or modified sequence opt3 from PIK3CD__Homo_sapiens__XP_011539885
auggccugcgcucugagaaagaaagcaaccguguucaggcagccccucgucgagcaaccugaagacuacacacuucagguuaacggccggcacgaguaucuguacgggagcuauccauugugucaguuucaguacaucugcuccuguuuacauucuggacugacuccgcaccuaacgauggugcauucaaguagcauucucgccaugcgcgaugaacaauccaaucccgcgccucagguacagaagccacgagcuaaacccccuccaauacccgccaagaaaccuucuucggugucacuguggagccuugagcagccauuccguaucgaacugauucaagguaguaaggucaacgcagacgagagaaugaaguuggugguucaggccggccucuuucacgggaaugagaugcugugcaaaaccguguccucuagcgaagucuccguguguucagagccgguauggaagcagaggcuggaguucgauaucaacauuugcgaccucccccggauggcucgcuuauguuuugcacuguaugccguuaucgagaaagcuaagaaagccagaaguacaaagaagaaaagcaagaaagcggauugcccuauagcaugggccaaucuuauguuguucgacuacaaggaucagcugaaaacuggagagaggugucuauauauguggccaucugugcccgacgaaaagggcgagcuccugaacccuaccgguacaguccgguccaauccaaacaccgauucagcugccgcacuucugaucugcuugcccgaaguggcuccgcauccuguguacuaccccgcccucgagaaaauucuggaauuagggcgccacagcgaguguguccacguuacugaggaagaacaacugcagcuccgagaaauccuugagagaaggggaaguggcgaacuguaugagcaugagaaggacuugguguggaagcuacggcacgaaguacaggagcauuuuccagaagcgcuggcccgucuccugcuugugacaaaauggaauaagcacgaggaugucgcacaaaugcuguacuugcucugcucuuggccugaacugcccguguuauccgcucuggagcuacucgacuucagcuuuccagauugccacguuggcucguucgccauuaaaucucugcgcaagcugaccgacgacgaguuguuucaguaucugcuccagcuggugcagguccuuaaauacgaauccuaucuggauugugaguugacgaaguuccuccuggacagagcuuuagccaacaggaagaucgggcauuuucuguucuggcaccuacggucagaaaugcaugugcccaguguagcacuccgauucggacugauacuugaggccuacugccgcgguagcacucaccauaugaaaguuuugaugaagcaaggcgaggcucuguccaaacucaaggcgcugaaugauuuugugaaauuaucuagccagaagaccccuaagccacagacaaaagaacugaugcaccuuuguaugagacaggaggcauauuuggaagcccucucacaccuucaaaguccgcuagaccccuccacucugcucgcugaggucugcguggaacaguguaccuucauggauagcaagaugaaaccucuguggauuauguacucuaacgaggaggccgggucaggaggcagugucgguaucauuuuuaagaauggggacgaucuuaggcaggacauguugacacugcagaugauccaauuaauggaugugcucuggaaacaggaaggacuggaccuucggaugaccccauacggcugccugcccacgggcgaucgcacuggguugaucgagguugugcucagaagcgacacaauugcaaacauacagcugaauaaguccaacauggccgcuaccgccgcauucaacaaggacgcgcuacugaauuggcucaaaucuaagaacccuggagaagcucuggauagggccaucgaggaauuuacucuuucgugugcagguuauugcguagccacauacgucuugggcauuggggaccgucauagcgauaauaucaugauacgggaguccggacagcuguuccacauugacuuuggccauuucuuagguaacuuuaaaaccaaguucgggaucaaucgagagagagugccauuuauccucacguaugauuucguucacgugauucaacagggcaaaaccaacaauucagaaaaguuugagagguuccgcggauacugugaacgggcuuauacaauccugagaaggcacggccuucuguuccuacaucucuuugcccugaugcgcgcagcuggguugcccgagcugaguugcucuaaagacauucaguacuuaaaggauagccucgcccugggaaagacugaagaggaggcgcuuaaacacuuccgagucaaguuuaacgaagcccugcgggaguccuggaaaaccaaggugaauugguuggcucauaacguaucaaaagacaaucgucaauga

SEQ ID NO: 60709 - RNA, 3309 nt, Artificial Sequence
  derived and/or modified sequence opt3 from PIK3CG__Homo_sapiens__NP_001269355
auggagcuggaaaacuacaagcagcccgugguccucagagaggacaauugcaggcggcgccgacguaugaaaccuagaagcgccgcugcaucccuuucuucaauggaacugaucccaauugaguucguuuugccgaccagucaaaggaaguguaaaagccccgaaacagccuuacugcacguggcgggccaugggaacguagagcagaugaaggcucagguguggcuacgggcccucgagacuuccgucgcagccgauuuuuaucaccgccugggaccucaucacuuccuucuguuguaccagaaaaagggucaaugguaugaaauauacgacaaguaucaggugguucagacgcucgauugccugagauacuggaaagcuacccauaggucuccaggccagauccaccuggugcaacggcaucccccuucggaggaaucacaggcauuucagcgccagcucacagccuuaauuggguaugacgucacugaugugagcaauguacacgacgaugagcuggaguucacccgaagaggacuuguuacaccaaggauggcugaaguggccagucgggaccccaaguuguacgcgaugcacccuugggucaccuccaaaccacugccggaguaccuauggaagaaaaucgcaaacaauuguauuuuuaucgugauacaucguucuacuacaagccaaaccaucaaggugucccccgaugacacgccuggcgccauucuccagucauucuuuacuaagauggcuaaaaagaaaagucugauggauaucccagaaagccagucugagcaagacuucguccuucgcguuugcgguagagaugaauaucuggugggggagacccccauuaagaacuuucaguggguaaggcacuguuugaaaaauggagaggaaauccacgugguccucgacacaccuccagaccccgcccuggaugaggugcggaaggaagaguggccguuaguugacgauugcacuggcgugaccggcuaccaugaacagcugacaauacacgggaaagaccaugaguccgucuucaccgugucacucugggauugugaccgaaaguuucgcguaaagauuagaggaaucgauauuccuguucuucccaggaacacggaccugacuguguucgucgaggcaaauauccagcacggucaacagguguugugccagcggcgcacaagcccaaaaccuuuuaccgaagagguccuauggaacguguggcuggaguucaguaucaagauuaaagaucuccccaagggcgcucugcuuaaucugcagauauauugugggaaagccccagcguugucuuccaaggccagcgcagaaucgcccucuuccgaaucaaagggaaaaguucaacuccuguacuaugugaacuuacugcuaaucgaccauagauuccuccugaggcguggcgaguacguacuucacauguggcagauuagugguaagggggaggaucagggcagcuuuaaugcugacaaauugacuuccgccacaaacccugacaaggaaaauucuaugagcaucucaauacugcucgauaacuauugccacccaauugcucugccgaaacaucagcccaccccugacccagagggagaucggguccgagccgaaaugcccaaccaacuuagaaagcagcuggaggcaaucaucgccacggacccuuugaauccacucaccgcugaggauaaggaacuguuauggcacuucagguacgagagucugaaacaucccaaggcguacccgaaacuauuuuccagcgugaaguggggccagcaggaaauuguugcaaaaacauaucaacuccuggcccgccgggaggugugggaccagucugcucuugaugucggguugacuaugcagcugcucgacuguaacuucucagaugaaaaugugagagccaucgcaguacaaaagcuggagaguuuagaggacgaugacgugcugcacuaccuuuugcagcucguucaggccgucaaguuugaaccuuaucacgauagcgcucuggccagguuccuacugaaacgcggacuccgaaacaagcggauuggucauuuucuguucugguuucuucguuccgagauagcacagucuagacacuaccaacagagguucgcggugaucuuggaggcuuaucugcgcggcugcgggaccgccauguuacaugacuuuacacaacaggugcaggucauugaaaugcuccagaaaguuacucuggacaucaagucgcuuagcgcagaaaaauacgauguguccucacaggugaucagucagcugaagcaaaaauuggagaaucuccagaacucucagcugccagagagcuuccggguacccuaugacccuggacuaaaggccggcgcucuggccauugaaaagugcaaagucauggcauccaagaaaaagccccucuggcuggaguuuaaaugugcugauccaaccgcccuuucaaaugaaacaauagguaucauuuucaagcacggggacgauuugagacaagacaugcugaucuuacagauucucaggaucauggagagcauaugggaaaccgagucucuggaucuuugccugcuaccuuacggcuguaucuccacuggagacaagauuggcaugaucgagauugugaaagaugcgacgacaaucgccaagauacagcagaguaccguugggaacacuggagcuuucaaagacgaagugcucaaucauuggcugaaggagaaaagccccaccgaagagaaguuucaagcagccgucgagcgauucguguacucuugcgcugguuauuguguugccacauuuguguugggcauuggggaucgccacaacgacaauaucaugauuaccgaaacuggaaaccuguuccacaucgauuuuggccauauauuagguaauuacaaguccuuccucgggaucaacaaagagcggguaccauuuguccugacaccggacuuccuuuuugugaugggcacgucaggaaagaaaaccaguccucacuuccagaaguuucaggacauuugcgugaaagcauaucuggcguugagacaucacacuaaucuccugaucauucuauucagcaugaugcugaugacaggcaugccccagcuuaccucgaaggaagauaucgaguacauaagggacgcccucacagucgggaagaacgaagaggaugcuaaaaaguauuuucuggaccaaauugagguuugucgugauaaaggauggacugugcaguucaacugguucuugcaucugguauuagguaucaagcagggcgaaaaacacuccgccuga

SEQ ID NO: 60710 - RNA, 522 nt, Artificial Sequence
  derived and/or modified sequence opt3 from PIK3IP1__Homo_sapiens__NP_001129383
augcugcucgccugggugcaggcuuuccuugucagcaacaugcuguuggcagaggccuacggcuccgggggaugcuuuugggacaauggucacuuauauagagaagaucaaaccucucccgcgccuggccugaggugucuaaacuggcucgacgcucagucagggcuggccagugcaccaguuagcggagccggcaaucauuccuacugccggaacccggaugaggacccccgcgguccuugguguuaugugucuggggaagcuggaguaccagagaagcgacccugcgaagaucuucguuguccugagacaacuucgcaggcacugccagccuucacgaccgagauccaggaggcuucagaaggccccggcgccgacgaagugcaagucuuugcgccugcaaaugccuugccagcuagaagcgaggccgcagcugugcagccgguuauugggauaagucagagggugcggaugaacuccaaagagaagaaagaucucggaacacuggguggccgcaucuga

SEQ ID NO: 60711 - RNA, 1086 nt, Artificial Sequence
  derived and/or modified sequence opt3 from PIK3R1__Homo_sapiens__NP_001229395
augcacggcgacuacacccugacacucagaaaagggggaaacaauaaacuuaucaagauuuuccauagggaugguaaauauggcuuuagcgacccccugacuuucuccucuguggucgaguugauaaaccacuaccggaaugaaucauuagcccaguauaacccuaagcuggauguuaaacuacucuacccagugaguaaguaucaacaggaccagguagugaaggaggauaauaucgaagcugucgggaaaaagcugcaugaguacaacacgcaguuucaagaaaagagccgcgaguaugaccgacuuuacgaggaauacacccguacaucccaggagauucagaugaagagaacugcaaucgaagccuucaaugagaccauuaaaaucuuugaggaacagugccaaacacaggagagguauucuaaggaauacauagagaaguucaaacgggaaggaaacgagaaggagauccagcgcauuaugcacaauuaugauaaacugaagucgagaaucucagaaauuaucgacagcaggcggcgcuuggaggaagaucucaaaaagcaggcggcugaguaccgagaaauagacaaaagaaugaacaguauuaagccggaucugauccaacugaggaagacccgggaccaguaucucaugugguuaacucagaaaggcgugcgucaaaagaaacugaaugaguggcuugguaacgagaauacagaagaucaguacuccuugguugaggacgacgaagaucugccccaucacgacgagaagaccuggaacguggggucuagcaaucgcaacaaagccgaaaaccuacucagaggaaagagggauggcacguuucugguccgggaguccucaaagcagggcuguuaugcaugcagugugguaguugacggggaggugaaacacugugucauuaauaagacugccaccggauacgguuucgcugaaccuuacaaccuuuauagcucucugaaagaguuggugcuccauuaccagcacacaucccuggugcaacauaaugauucauuaaacgucacucuggcauauccaguuuacgcccagcagcgacgcuga

SEQ ID NO: 60712 - RNA, 2187 nt, Artificial Sequence
  derived and/or modified sequence opt3 from PIK3R2__Homo_sapiens__NP_005018
auggccggccccgagggguuccaguacagagcucuguauccuuuuaggcgggaacgcccagaggaccucgaacuucugccgggagauguguuggucguuagccgagcagccuuacaagcgcuggguguggcugagggcggggaacguugcccccaguccguaggauggaugccuggccuaaacgagagaaccaggcagcggggugacuucccagggacauacguggaguuucucggacccgucgcccuggcacgcccuggcccaagacccaggggcccucggccacuuccggcccgcccccgagauggggcuccugaaccaggacugacuuugcccgaccucccugagcaguucucuccacccgauguggcaccgccucugcugguuaagcucguggaagccaucgagagaacggguuuagacucagagagucacuauaggcccgaacugccagcuccucggaccgauuggagccuuuccgacgucgaucaaugggacacagccgcguuggcagauggcauuaaaucuuuucugcuagcccuccccgcuccacuggugacucccgaggccucggcagaagcucgucgcgcccuuagagaggcggccgggccuguaggaccagcacuggaaccgcccaccuugccucuccauagggcucugacauuacgguuccugcuccagcaccuuggccgaguugcccgcagagcuccagcccugggucccgcagugagggccuugggggcuaccuuuggaccucuacugcuccgggcgccacccccgccuucaagcccacccccuggcggcgcacccgacgggagugagccauccccugauuuccccgcccugcuugucgagaagcuguugcaggaacaucucgaggaacaggagguggcuccaccggcccugccucccaaaccacccaaggcaaaaccugccccaacuguguuagcuaauggagguucucccccuagccugcaagacgccgaaugguacuggggcgacauaucccgcgaggaggucaacgaaaagcuaagagauacaccggacgggaccuuucucguuagggaugcaucaaguaagauccagggagaguauacgcugacucuucguaaaggcgguaauaacaaguugauuaaaguguuccaccgggacgggcauuacggcuuuagcgaaccacugaccuucuguucuguaguggaucucaucaaucacuaucgacacgagucccuggcgcaguacaacgcuaaacuugacacaagacuguuguaccccgucucaaaguaucagcaagaucagauugugaaggaagacagcguugaggccgugggagcacagcucaaggucuaccaucaacaguaucaggauaaaaguagggaguacgaccagcuguaugaagaguacacucgcaccucucaagaauuacagaugaagcggacagccaucgaggcuuuuaaugagaccauaaaaaucuucgaagaacagggccagacgcaagaaaagugcuccaaagaguaucuggaaagauucaggcgcgaggggaacgagaaggaaaugcagcggauucuacucaauagcgagcgacugaaaucgcguaucgccgaaauucacgagucuagaacuaaacuugaacagcaguugagggcacaggcuuccgauaaccgcgagaucgacaagcggaugaacucacugaagccugaccucaugcaacugagaaagauaagggaucaguacuuaguguggcugacacagaaaggagcccgacaaaagaaaauuaaugaguggcuugguaucaagaaugaaaccgaggaccaguacgcguugauggaagaugaggacgaucucccacaucacgaggagcgcacuugguauguaggcaagauuaaccggacacaggccgaggaaaugcugagugggaaaagagacggaaccuuucuaaucagggagagcucccaacguggcuguuacgcuugcucuguuguggucgauggugacacgaagcacugugugaucuaucgcaccgcaacaggguucggcuuugccgaacccuacaaucuguauggaagccucaaagagcugguccuucauuaccagcacgcuucauuggugcagcauaacgaugcccugacuguuaccuuagcacacccugugcgggcgccgggccccgggccaccucccgccgcuagauga

SEQ ID NO: 60713 - RNA, 1524 nt, Artificial Sequence
  derived and/or modified sequence opt3 from PIK3R3__Homo_sapiens__NP_001290356
augggccccagcagacuggugagggggccucggccacagggaaugcgcuccccguaccgacgucccgguaugggcuggccuagaccaagguucccccggauguuuaagugcucucgcagaagguaucaacaggggcuccggggacgcaccgccucaagugcugcaaucaacccugccacacgagcgaugggcauuaauaacacucacacggacaccacaauagucuggaucuucccaccccaggcccuuccuccaaaaccgcccaagccuaugacuagcgcuguuccaaaugguaugaaagauuccucugugucgcugcaggacgcagagugguacuggggagauauuucaagagaagagguaaacgacaaguugagggauaugcccgacgggaccuuuuuagugcgggaugccagcacaaaaaugcaaggcgacuauacccugacucuacguaagggcgggaauaacaagcucaucaaaauuuaccaucgcgauggaaaguaugguuucagugacccucugacauuuaauuccgucguggaacuuaucaaccacuaccaucacgagucucuggcucaguauaauccaaaauuggauguuaagcucauguaccccgugagcagauaccagcaggaccaacuggucaaagaagauaacauagacgcagugggcaagaagcugcaggaguaucauucccaguaccaggagaaaucaaaggaauaugacaggcucuacgaggaauauacccggacgagucaagagauccagaugaaacgaacugccauugaggcuuucaaugaaaccaucaagauuuuugaggaacagugucacacacaagagcagcacagcaaagaauacaucgagcgcuucagaagggaggggaacgaaaaggagauagaacggauuaugaugaauuaugauaaauuaaagucucgccugggagagauccaugacuccaagaugagacuugaacaggauuugaaaaaccaggcccuggacaauagggagauugauaagaaaaugaacucaaucaagccggaccuaauccaacuccguaaaauucgggaucagcaccugguauggcuuaaccauaagggcguucgacagaagagacugaaugugugguuggguaucaaaaacgaggacgcggaugaaaauuacuuuauaaacgaggaagacgagaaucucccucacuacgaugaaaagacuugguucgucgaggacauuaacagggugcaggcagaggaccuguuauaugggaaacccgauggagccuuucugauccgcgaaagcaguaagaaaggcugcuacgcuuguucuguggucgccgacggcgagguuaagcacugcgugauauauuccaccgcacggggguacggauucgcugaaccauauaaucucuacagcucgcuuaaggagcugguauugcauuaucaacagacaucucuagugcagcacaacgauucccugaaugucagacucgccuacccugugcaugcgcagaugcccucacuguguagguga

SEQ ID NO: 60714 - RNA, 4077 nt, Artificial Sequence
  derived and/or modified sequence opt3 from PIK3R4__Homo_sapiens__NP_055417
augggcaaccagcuggccgggaucgcucccagccaaauucucuccguggagucuuacuucucagacauacacgauuuugaauaugacaagagucuuggaagcaccagauucuuuaaagucgcaagggccaagcaucgggagggucugguugugguaaaaguguucgcgauccaggauccuacauugccauuaacuuccuacaagcaggaacuggaggaacuaaaaauucgccucaauucugcucagaacugccugccguuucaaaaggccucggagaaggcaucagagaaagccgcuaugcuuuuccgacaguauguccgugacaaucuguacgauagaaucagcacgaggcccuuuuugaacaauauugaaaagcgguggaucgcauuccagauacucaccgccguggaccaggcucacaaaaguggcguucgccauggggauaucaagacagagaacgugauggucacuuccuggaauugggugcugcugaccgacuuugccucuuucaaaccuacauaucucccagaagauaaccccgcggacuuuaauuacuucuuugauaccagcagaaggcggacuuguuauauugcaccugagcgcuucguagacggaggcauguucgccacagaguuagaauacaugcgagauccauccaccccucugguugaccuuaacucaaaucaaagaacgaggggugaguugaagcgggcuauggacaucuuuagugccgggugcgugauugcagaacuguucacugagggagucccucuauuugaucucagccagcugcuugcuuaccguaacggccacuucuuuccagaacaggugcugaauaagaucgaggaccauucuauacgcgaguuggugacccagaugauucacagagaaccggauaaaaggcucgaggccgaagacuaucugaagcaacagcggggcaacgcguuccccgagaucuuuuacacauucuuacagccuuauauggcccaauuugcaaaagaaacuuuccuguccgcugaugagaggauucucgucauccgcaaggaccuugggaauaucauucacaaccuguguggacaugauuugccagagaaagccgaaggugagcccaaggaaaacggccuaguuauacuggugucaguaaucaccagcugccuccagacacugaaauacugugacaguaaacuugcugcccuggaguugauucuccaccuggcaccuagauuaucuguggaaauccugcuagauaggauaaccccauaucuccugcauuuuuccaaugacagcgucccccgggugcgcgccgaggcucuuagaacguugacuaagguucuggcgcucgugaaagaggucccgaggaacgauauuaauaucuacccugaauauauccugcccgggauugcacaccuugcccaggacgacgcuacaaucgugcgucuggccuacgcagagaacauugccuugcucgcugaaaccgcccugcgguucuuagagcugguacagcuaaagaaucucaacauggagaaugauccaaacaaugaagagauagacgaaguuacucacccuaacggaaauuacgauacagagcugcaagcacuucaugaaauggugcagcagaaagucgugaccuugcugucggaccccgagaacaucgucaagcagacgcucauggagaauggcauuacccgacugugcguguuuuucgguagacaaaaagcgaacgauguuuuacugucucacaugaucacauuccuuaaugacaagaacgauuggcauuugcgaggggccuuuuucgacuccaucgugggaguagcugcauaugucggcuggcagucaaguagcauucucaagccacugcuacagcagggccuguccgaugccgaagaguuugugauaguuaaagcucucuacgcccugacuuguaugugccaacuuggguugcugcagaagccccacguguaugaguucgcaucugacaucgcucccuuuuuaugucauccaaaccucuggauucgcuacggagccgucgguuucaucaccgugguagcgcggcagauuagcacagccgauguguauugcaaacugaugccguaccuugaccccuauaucacucagccuauaauccaaauugaaagaaagcugguuuugcucucaguccugaaagaaccagugaguagguccaucuuugauuacgcucuacgcagcaaggacauuaccucucuguuccgacaccuccacaugcggcagaagaaacguaauggcucacugcccgacuguccuccacccgaggauccggcaaucgcccagcuuuugaagaaacuguuaagucaagggaugacagaggaagaggaagacaagcuccuggcucuuaaagauuuuaugaugaaaagcaacaaggccaaggcaaauauaguggaccagucccaucugcacgauucuucgcagaagggagucauugaccuagcggcccucggcaucaccgguagacagguugaucuggugaaaacuaagcaagagccugacgauaaaagggcucgcaagcaugugaaacaggacagcaacguaaaugaagaguggaaguccauguucgggucauuggauccacccaacaugccucaggcccugcccaagggcagugaccaggaggucauucaaacgggaaaaccaccucggucugaaagcuccgcaggcaucugcgugcccuuaucaacaagcucucagguuccagaggugaccacuguccagaauaagaaaccggugauaccuguucucuccaguaccauccugcccagcacauaccagauuagaaucaccacuugcaagacagaacuucaacagcugauucagcaaaagagggagcaguguaacgcugagcgaaucgccaagcagaugauggaaaaugcagagugggaaucuaagccacccccuccaggguggcgccccaaaggauugcucguggcccaucugcacgagcacaaguccgcuguaaaccggauaagagucucagaugaacacagucuauuugcgacgugcagcaaugacgguaccgugaaaauuuggaacucgcagaagauggagggcaaaacuacaaccacaagguccauccugacuuauucucguaucgggggacgcgugaagacccuuacguucugucaaggcagccauuaccucgccauugcaucagacaauggugcuguccagcuguuggggaucgaggccaguaagcugccuaaauccccgaagauucacccauuacagucucggauacucgaucagaaagaagacggcugcguuguggauaugcaucacuuuaacagcggagcccaauccguacuggcuuaugcaaccgugaauggcucacuugucgggugggaccugagaagcaguucuaacgccuggacauugaagcacgaucucaaauccggacugaucacuagcuucgcgguggacauucaucaguguuggcuaugcaucgguaccucgucaggcacaauggcuuguugggauaugagguuccagcugcccauuucuagucacugccauccuucccgagcccggauccgcagacuuagcaugcacccacucuaccagucuuggguuauagcagccgugcaagggaacaaugaggucagcaugugggacauggaaacuggagauaggcgguuuacccugugggcuuccucagcacccccuuugagugaguuacagccgagcccccauucugugcacggcaucuauuguuccccagccgacgguaacccuauucugcucacggcggggucagauaugaagauccgauucugggaccuggcuuaccccgaaagaaguuauguuguggccggcagcacauccucuccaucggucagcuacuaccgcaagauuaucgagggaaccgagguagugcaggaaauacagaauaaacaaaagguuggcccuucagacgauacucccaggcgugggccagagucccuuccggugggacaccaugacauuaucacagaugucgcaaccuuucagacuacccagggcuucaucgugacagccagucgggacgguauuguaaaaguguggaaguga

SEQ ID NO: 60715 - RNA, 2643 nt, Artificial Sequence
  derived and/or modified sequence opt3 from PIK3R5__Homo_sapiens__NP_055123
augcagcccggcgccaccacaugcacugaggacagaauccaacacgcucuggaaaggugucuccaugggcuuagccugucccggcgcucuacgucauggagugcaggauugugcuuaaacuguuggagccugcaggagcuagugucccgagauccuggucacuuccucauucugcuugaacagauacugcagaagacccgugagguccaagaaaaaggcacauacgacuugcucacuccacuggcccugcucuuuuauucuaccguuuuaugcacaccgcauuuucccccugauucggaccugcuuuugaaggcggcuucaaccuaccacagauuucugacuuggccagugcccuauuguagcaucugccaggagcuacucacauucauugaugccgagcugaaagcaccugggaucaguuaccagaggcuuguacgggccgaacagggacugccaauucgcucccauagaucuagcaccgugacggucuugcuccugaaucccguggagguucaagcugaauuuuuagcaguggccaacaagcuguccacuccuggccacucaccacacagugcuuauaccacacuccuucugcaugccuuccaggcgacuuuuggugcacacugugacgucccgggguugcauugcaggcuacaggccaaaacccuggcugagcucgaggauaucuucacagaaaccgccgaggcacaggaacuggcuagcggaauaggcgacgccgcggaggcccggcgcuggcuucgaacgaagcugcaagcagugggcgaaaaggcuggguuucccggaguauuggauacugccaaaccugguaagcuccacacaaucccaauucccguugcuagauguuacaccuauucuuggucccaggacucauucgauauccugcaggagauuuuacugaaagagcaagaacuacuccagccuggcauccugggggacgaugaggaagaggaagaggaggaagaggaaguggaggaagaccuugagacugacggacacugcgccgagagggauagcuugcugaguacaucuucccucgcaagccaugacucgacccugucucuugccuccucacaggcuaguggcccagcgcugagccggcacuugcucacguccuuugucucuggucugagcgaugggauggacucaggauacguggaagauagugaggaauccagcucugaguggcccuggcgucgcggcucacaggagagaaggggccaucggcgaccggggcaaaaguucauacgcauuuacaaauuauuuaagaguaccagccagcuggugcuaagaagggacucccggucucucgaaggaucgagcgauacagcacugccucuucgcagagccgguuccuuguguucaccccuggacgagccagucaguccucccucuagggcucagcguagccggucccucccacagcccaagcugggcacucaauuaccuucauggcugcuugccccagcaagccgaccgcagagaaggcgccccuucuugucuggggaugaagacccuaaagccuccacccuccggguugugguauucggaagugauagaaucagcggcaagguggcuagggccuauucuaaucugcgccgacuagagaacaaucggccacugcucacacguuucuucaaacugcaguuuuucuacguccccgugaagagaucccacgguacuucaccuggggcaugcccacccccgaggagucagaccccuagcccacccacagacucgccucgccaugcgucccccggcgaacuuggaaccacuccaugggaggagucuacgaacgacauuagccacuauuugggcaugcuggauccuugguacgaacggaauguuuuagggcucaugcaucugcccccagaggugcuuugccaacagucacugaaagcugaagcccaggcauuggagggaaguccgacacagcucccuauccuggccgacaugcuacuguauuacuguagauuugcugccaggcccguccuccugcaaguguaucagaccgaacuuacuuucaucaccggugagaagacaaccgagauuuuuauacacuccuuggaacugggccacucugcagcuacucgagccaucaaagcgagcgggccaggauccaagcgcuuaggcauugauggugaccgggaggccguaccccucacacugcagaucauauacucaaagggggcuauuagcggcagaaguagguggucuaaccuugaaaaaguuugcacguccgugaaucugaacaaggcaugucguaaacaagaggaacuagauagcucgauggaggcccucacccugaauuugacugaggucgugaagcgccagaacucaaaaucuaagaagggauucaaucagaucaguacaucccagaucaaagucgacaaggugcaaauuaucggcagcaacucuugcccuuuugcuguuugucuggaucaggacgaacggaaaauuuuacagagcgugguaagaugcgaggucuccccauguuacaagcccgaaaaaucagaucucaguagcccuccgcagaccccacccgaccugccugcccaagcagcgccagaucuuugcucucuguugugucuccccauaaugacauucuccggggcccugccuuga

SEQ ID NO: 60716 - RNA, 1647 nt, Artificial Sequence
  derived and/or modified sequence opt3 from PIKFYVE__Homo_sapiens__NP_001171471
auggccaccgacgauaagacaagccccacucuggacuccgcuaacgaucucccuagaucuccaacgucaccgagucaccuuacccauuucaaaccccugacaccugaccaggaugagccacccuuuaagagcgcauacuccucuuucgugaauuuguuuagguucaacaaagaacgggccgagggcgggcaaggagaacagcagccuuuaucggguucauggacuagcccacagcugcccagucgcacccaauccguccgaucuccuacaccauauaagaaacagcuaaaugaggaacuccagcguagaagcuccgcgcuggacaccaggcggaaggcugagccgacuuuuggcgggcacgauccccgcacagccguucagcuuagaucacugaguaccguguugaagaggcucaaagagaucauggaaggaaagagccaagacucugaucugaaacaguacuggaugccugacucccagugcaaggaguguuaugauugcucagaaaaauucacgacuuuucggcgccgacaucacuguagacugugcggccagauuuucuguuccaggugcuguaaccaagagauaccagguaaguuuaugggguacaccggagaccuccgggcaugcacauauugucguaagaucgccuuaaguuacgcucauucuacugauuccaauagcauuggcgaggaccugaacgcacuuucggacucugccugcuccguaucaguguuggaucccagugaaccucgcaccccagucggcagcagaaaggcuuccaggaauaucuuccuggaggacgaucuagccuggcagucucucauucaccccgacagcucaaacacaccgcugaguacccggcuuguguccguucaggaagaugcggggaaaagcccugcacgaaaucgcucugccucaaucacgaaccugaguuuggacagaagcggaucccccauggugccaucuuaugagacuucggucagcccucaagcuaauaggacauacgugcggaccgaaacuacagaggaugagcgcaaaauacuccuggacuccguacaguuaaaggaucuguggaaaaagaucugucaccauucaagugguauggaauuucaggaccacagauacuggcucaggacccaucccaacugcauuguuggcaaagagcuugugaauuggcugauccguaacgggcacauugccacgcgggcacaggcuaucgccauaggacaagcgauggucgauggccgaugguuggacugcgugucucaccaugaccagcuauucagagaugaauaugcccuguacaggccacuccagagcaccgaguuuuccgaaacacccucaccugacagcgauucugugaauagcgucgagggucacagugagccaagcugguucaaggacauuaaguucgaugacucugauacugaacagaucgcagaggaaggggacgauaaccuggcuaacuccgccucaccgaguaaacgcaccagcguuucguccuuucaaucuacaguggacagcgauucagcugccaguauuucccuuaauguagagcuggacaacgugaauuuccauaucaagaaacccucuaaguauccucacgucccaccccauccugcagaucagaaaggacggagauga

SEQ ID NO: 60717 - RNA, 912 nt, Artificial Sequence
  derived and/or modified sequence opt3 from PILRA__Homo_sapiens__NP_038467
augggcagaccccugcuccuuccucuguugccauuacugcuaccgcccgccuuccuccagccuagcggguccaccggaucugguccaucauaccuguauggcgugacacaacccaagcaccuuagugcuagcaugggaggguccgucgagaucccuuuuucuuucuacuauccaugggaacuggcaacugcccccgacguuaggauuucguggcggcgcggccauuuucaccgacagucauucuacagcacgcguccuccaaguauacauaaagauuaugugaacagauuguuucucaauuggaccgagggucagaaguccggguuccugaggaucucuaaccugcagaaacaagaccagagcguauacuuuugccggguggaacucgauacacgcuccucaggaagacagcaguggcaaaguauugagggcacuaaguuaagcaucacccaggcggucacaaccacuacacagaggccgucuuccaugaccacgacuuggcggcugucaagcaccacaacuaccacaggccuucgcgugacccaggggaaacgaagaagugacucuuggcacauuuccuuggaaacggcuguuggaguggccgucgcagugacuguacuggguaucaugauacuaggccucaucugucugcuuagguggcggcgucgcaaggggcaacagagaacaaaggccaccacucccgcuagggagccuuuccagaauacagaggaaccauaugagaacauucggaaugaaggacaaaacaccgaucccaaacugaauccuaaggacgauggcaucguuuacgccagcuuggcacucucgucuuccacgucaccacgagcucccccgagucaucgcccucugaaaagcccccagaacgagaccuuauacuccgugcugaaggccuga

SEQ ID NO: 60718 - RNA, 1215 nt, Artificial Sequence
  derived and/or modified sequence opt3 from PIM1__Homo_sapiens__NP_001230115
augccccacgagccucaugaaccacugaccccgcccuucagcgcccucccugacccagcuggcgcacccuccagaaggcagucucggcaacgcccucagcuuucaagugauagcccauccgccuuucgagcgucucguucgcacucaagaaacgcuacaaggagccauagucacucccauucuccccggcacagccugcgccacuccccugggucaggaaguugcgguagcagcuccggccauagaccaugugccgacaucuuggagguggggauguuacugucaaagauuaauagccuagcacaccucagggccgcuccgugcaacgaucugcaugcaacuaaacuugcccccggaaaggaaaaagagccucuggaaagucaguaccaggucggcccauugcucgguucugggggauucggcuccguuuauagcggcauacgggugucggacaaucugcccguagcuaucaagcacguggagaaagaucgcauuucugacuggggagagcugccuaacgggacgcgagucccaauggaagugguucucuuaaagaagguguccucagguuuuaguggcgucaucagacugcuugauugguucgagaggcccgacagcuuuguguugauucuggaacggccggagccuguacaagaucuauucgacuuuaucaccgagcguggggcccuccaggaggaacuggcgcgcuccuucuuuuggcagguucuugaagcagugagacacugucauaauugcggaguccugcacagggauauaaaagacgagaacaucuugauugaucucaaucggggcgaacugaaguuaaucgacuucgguucuggggcccugcucaaagacacaguguacacugauuuugacggaacccgaguguauucucccccagaguggauucgcuaccauagauaucacggcaggucagcugccgucuggagucuuggcauccuguuguacgauaugguuuguggggacauaccuuucgagcaugaugaagagauuauccggggacagguguuuuuccgccaaagaguauccagcgaaugccagcaccuaauuagguggugucuggcacuccgucccucugaccggccaacauucgaggaaauccagaaccaccccuggaugcaggaugugcugcuuccucaagagaccgcugagauccaucugcacucauugaguccagguccgagcaaguga

SEQ ID NO: 60719 - RNA, 936 nt, Artificial Sequence
  derived and/or modified sequence opt3 from PIM2__Homo_sapiens__NP_006866
augcugacaaagccccuccagggcccuccagccccgcccgggacaccuacuccacccccuggagguaaagacagagaggcuuucgaagcagaguacaggcuuggcccacuguuggggaagggaggcuuugguacgguguucgccgggcaccgguuaaccgaucgccugcaagucgcgaucaaaguuauuccccgaaaccgugugcuaggauggagcccucucuccgacucuguaacaugcccacuggaaguggcccuucuguggaaggucggcgcuggcgggggacauccgggugugauaagauugcucgauugguuugagacucaggaaggcuucaugcugguucuggagaggccccucccugcacaggacuuauuugauuauaucaccgagaaagggccacugggagaaggccccucacgguguuucuuuggucagguggucgccgcuauucaacacugccauagucgcggggugguacacagagacaucaaggaugagaauauucuuaucgacuugaggcggggaugugcaaagcugauagauuucggcagcggcgcccuacuccaugacgaaccuuacacagauuuugacgggacccgcguuuauuccccacccgaguggaucucucgacaccaguaccacgcucugccggccacuguguggucgcuugguauucuguuguaugauauggucugcggagacaucccuuucgagagagaccaggaaauucucgaggcggaacugcauuuucccgcacacgugucaccagauuguugcgccuuaaucaggcggugucuggcuccuaaacccagcagucguccaucccucgaggaaauacuucuggaccccuggaugcagaccccugccgaggaugugccauugaacccgucuaagggcgggcccgcaccucuagcuuggagccugcucccauga

SEQ ID NO: 60720 - RNA, 981 nt, Artificial Sequence
  derived and/or modified sequence opt3 from PIM3__Homo_sapiens__NP_001001852
augcugcucagcaaguucggcucccuugcccaccugugcgggcccggagguguggaccauuugccugucaaaaucuuacagccagcuaaggcagauaaagagucuuuugaaaaggccuaccaaguuggcgcggugcuggggucaggaggcuucgguaccguauaugcugggaguagaauugccgacggacuaccgguggcagucaaacacgugguuaaggagagggugacagaauggggcagccucggcggggccacugucccccuggaggugguacuucugcggaagguuggagcugccgguggcgcacgcggggugauacgauugcucgauugguuugaacguccugacggauuccugcugguccucgagagaccagagcccgcucaggauuuauuugacuucaucacggaaaggggcgcccuggaugagccucuugcgcggcgcuuuuucgcacagguguuggccgcugugagacauugucacuccugcggugucguucauagggacauuaaagaugaaaaccugcuaguggaccuccggucuggggagcugaaacuuaucgauuuuggaucgggcgcccuguugaaggacaccguauacacagauuucgacggcacucgcguguauucaccacccgaguggauucgauaccacagauaucacgggaggagcgcaaccgucuggagucucggagugcuguuauacgacaugguuuguggugauaucccuuuugaacaggacgaggaaauacugcggggccgucuccuuuuccgcagaaggguguccccagagugccaacagcugauccggugguguuugucucuacgaccgagcgaacgccccucccuggaucagauugcugcccauccuuggaugcucggggcggacggaggcgucccagagucaugcgaucugagacuuuguacacuggaccccgaugacguggccaguaccacuucuagcuccgagucauuguga

SEQ ID NO: 60721 - RNA, 492 nt, Artificial Sequence
  derived and/or modified sequence opt3 from PIN1__Homo_sapiens__NP_006212
auggccgacgaggaaaagcugcccccuggcugggagaaaagaaugagcagguccucugggcggguguacuauuucaaccacaucaccaaugcuucacagugggaacgcccaaguggaaacagcuccucugguggcaagaaugggcaaggagagccggcacgaguccguugcucgcaucuccuuguuaaacacucacagagcagaaggcccaguuccuggcggcaggaaaagauuacacgcacuaaagaggaggcccuggaauugauaaacggcuacauccagaagauuaagucuggugaggaagauuuugagagcuuagcgucccaauucucagacuguaguagcgcuaaagccagaggggaucugggagcauuuucuaggggccagaugcagaagccuuucgaggacgccuccuuugcucuacggacgggcgaaaugucagggccaguguucaccgauagcggaauccauauuauccuccgcacagaguga

SEQ ID NO: 60722 - RNA, 402 nt, Artificial Sequence
  derived and/or modified sequence opt3 from PIN4__Homo_sapiens__NP_001164218
augcccauggccggccugcucaaggggcuugugagacagcuggagagguucagcguccaacagcaggcuuccaaaaugccuccaaagggaaaaucugguucaggcaaggcagggaaaggaggcgccgcgagugguagcgacuccgcugauaagaaggcccaggggccgaaaggaggcggcaacgcaguuaaggugcggcacaucuugugcgaaaaacaugggaagauuauggaggccauggaaaaauuaaagucuggaaugcgcuuuaaugagguagcugcacaauacucggaagacaaggcccgacaggguauacccucacugcagcagcacgcuggccaucaccgugaucuaagaagcacccucaucagucugguguccuaucuucaaacaacuccuuga

SEQ ID NO: 60723 - RNA, 525 nt, Artificial Sequence
  derived and/or modified sequence opt3 from PINX1__Homo_sapiens__NP_001271285
augagcaugcuggccgagagaaggcggaagcagaaaugggcuguggacccccaaaacaccgcaugguccaaugaugacucuaaguucggccagcgcaugcucgagaaaaugggguggucaaagggaaaaggucuuggcgcccaggagcagggggcgacagaucacaucaagguccaaguuaagaacaaucaucugggauugggcgcuacuauuaacaaugaagacaacuggauagcccaccaggaugacuuuaaucaguuacuggcagagcuaaacacgugccauggucaggaaaccacagauaguagcgacaaaaaggagaaaaaguccuucucucucgaggaaaaaucgaagaucucaaagaaucgagugcacuacaugaaauuuacuaaggggcguugucaaagccugcauaguagaggagagaggaaccacgauaaucagcggcuucaccauccuggcguacugugccaggccgacggcuccaccgaagaacaggcuccagggucuagcucccgcguguga

SEQ ID NO: 60724 - RNA, 1221 nt, Artificial Sequence
  derived and/or modified sequence opt3 from PIP4K2A__Homo_sapiens__NP_005019
auggccacccccggcaaccuggggagcuccgugcucgcuucuaagacaaaaacuaagaaaaagcacuucgucgcacagaaaguuaaacuuuuuagagccucagacccucuguugaguguguuaauguggggaguaaaucauagcaucaacgagcugucccacgugcaaauuccagucaugcuaaugccggaugacuucaaggcguacucuaagauaaagguggauaaucaucucuuuaacaaagaaaauaugcccucgcacuucaaguuuaaagaguauugcccuaugguuuucaggaaccugcgggaacgcuuugguaucgacgaucaggacuuccaaaauucacuuacgcgaagcgcuccacugcccaacgauagucaggcccguuccggcgcaagauuucauaccucuuacgacaagagguauauuaucaagacaauuacuagcgaggauguggccgaaaugcacaauaucuugaaaaaguaccaccaguauauagucgagugucaugggaucacccuccugccucaguuccugggaauguaccggcucaacguggacggcguagagauuuauguuaucgugacacgcaaugucuuuucccacagauuaucaguguacaggaaauacgaucugaaggguaguaccguggcucgggaagcaagcgacaaagagaaggccaaagaacuuccaacuuugaaggauaacgacuucauuaaugaggggcagaagaucuauauagacgauaacaauaaaaaggucuuucuggagaaacuaaagaaagacguugaguuccucgcucagcugaaacuuauggauuacucucuguuggugggcauucaugacguagagcgcgccgaacaagaggaaguggagugcgaggaaaacgauggagaggaagagggcgaauccgacgggacacaccccgucggaaccccuccagauucaccggguaacacgcucaauagcagucccccucuggcgccaggcgaguucgaccccaacaucgauguguaugggauuaagugucacgaaaauucuccucgaaaggaaguuuacuuuauggcaaucaucgacauuuuaacucauuaugaugccaagaaaaaggcugcccacgcagcuaaaaccgugaagcauggagccggcgcggagauauccacagucaacccagaacaguacagcaagagauuccuggacuuuaucggucacauucucacuuga

SEQ ID NO: 60725 - RNA, 1251 nt, Artificial Sequence
  derived and/or modified sequence opt3 from PIP4K2B__Homo_sapiens__NP_003550
augagcuccaacugcaccucuacaacugccguggcugucgcaccccugucagccaguaagacgaaaaccaagaaaaagcacuucguuugucagaaagugaagcucuuuagagcgagcgagccuauccuuuccguacugauguggggcgugaaucauacaauuaacgaauugucuaaugucccagugccgguuauguuaaugcccgacgauuucaaggcuuacucgaaaauaaagguggacaaccaccuguuuaauaaagagaaccuaccuucaagguucaaguuuaaagaauauugcccaauggucuuccggaaucuccgcgagcgauuugggaucgaugaccaagauuaccagaacagcgugacucguagugcccccauuaauuccgacucucagggaagaugugguaccagguuccugacaaccuaugaucggcgcuuuguaaucaagacuguuagcuccgaagacguggcagagaugcauaacauucuuaagaaauaccaccaguucaucgucgagugccauggcaauacacuguugccucaauuucucgggauguauagacugaccguggauggaguggaaacguacauggucguuacuaggaacguguucucacaccggcugaccguacaccgcaaguaugaccucaaaggcaguacaguggcccgagaggcuagcgauaaggaaaaagcaaaggacuuaccaacuuuuaaagauaaugacuuccugaacgagggucagaaacuucaugucggggaggaaucuaagaagaauuucuuggagaagcugaaaagagacguggaauuucuagcccagcucaagauaauggauuacucccugcuuguuggaauccacgacguggauagggcugagcaggaagagauggaggucgaggaacgggccgaagacgaggaaugugagaacgauggcgugggcgggaaccuguugugcucauacggaacacccccugacagcccagguaaucuccugaguuucccgcguuucuucggccccggggaguuugauccuucuguagacguuuaugcgaugaaaucccaugaaagcucgccaaagaaggagguguacuucauggcaauuaucgauauuuuaacccccuaugacaccaaaaagaaagccgcucacgccgcaaagacggucaaacacggagcuggcgccgaaaucucuacugugaacccugagcaauacuccaagcgcuuuaaugaauuuaugucaaacauacugacauga

SEQ ID NO: 60726 - RNA, 1212 nt, Artificial Sequence
  derived and/or modified sequence opt3 from PIP4K2C__Homo_sapiens__NP_001139731
auggccagcuccucugugcccccugcuaccgucucagcagccacagcgggcccagggccgggauucgguuuugcuaguaagacuaaaaagaaacacuucguucagcaaaaggugaaaguauuuagagccgcagacccccuggugggcgucuuccucuggggcguggcccauagcaucaacgagcuuucccagguuccuccacccgugaugcuguugccugaugacuuuaaggcuucuucgaagauuaaagaauacugcccacaggucuucaggaauuuacgggaucgcuuuggaauagacgaucaggacuaucuggugucacuaacgcgaaaucccccuagcgagagugaaggcuccgauggucguuuccucaucucuuacgacagaacccugguaauuaaggagguuagcuccgaagauaucgcagacaugcacucaaaccuuaguaacuaucaucaauacauugugaaaugucacgggaauacacuguugccacaguuucucggaauguauagggucagcguggauaacgaggacucuuacaugcuggugaugcggaauauguucucccaucgccugccgguccacagaaaguaugaucucaaaggcucauuaguuagcagggaggccagugacaaggaaaaggugaaagagcugcccacucuuaaggacauggacuuuuugaacaaaaaucagaagguauacaucggcgaagaggagaaaaagauauuccuggaaaaacuaaagcgggauguggaguuucucguccagcugaagaucauggauuacucucuucuguuggggauucacgacaucauucgcggauccgaaccugaggaagaggcuccagugcgagaggaugaaagcgagguugacggugauugcucgcucaccgggcccccugcccugguggggucuuauggaacauccccagaaggcaucgguggguacauacauucacacagacccuuaggaccgggcgaguucgaaaguuucauugacgucuaugcgaucaggagcgcagagggcgccccucaaaaagagguguacuuuauggggcugauugauauccucacccaguaugacgcuaagaaaaaggccgcacaugcugccaaaacuguaaagcacggagcgggugccgaaaucuccacaguucaccccgagcaguacgcaaagcgguuccuugauuuuauuaccaacauauucgcuuga

SEQ ID NO: 60727 - RNA, 1569 nt, Artificial Sequence
  derived and/or modified sequence opt3 from PIP5K1A__Homo_sapiens__NP_001129108
auggccagcgcuuccucuggccccucaaguagcgugggguucuccucuuuugacccugcagucccaucgugcacccugucaagcgccgcgaguggaaucaagagaccgauggcuuccgagguucccuacgccucugguaugccuauuaaaaagauaggccacaggagcguggauuccucaggggaaacaacuuauaaaaagacgaccaguagcgcacucaaaggagccauccagcuuggcauuacacauacuguagguucucuguccaccaagccagagcgggacguguugaugcaagauuucuacgucguggaaucaaucuuuuuccccagcgaggggaguaacuuaaccccugcucaccauuauaaugacuuucgcuucaagacauacgcaccaguugccuuucgauauuuccgugaacuguuuggaauuagacccgaugacuaccuauauucucucuguuccgagccucugaucgagcuuugcagcucgggcgcuucuggcucccuguucuacgugucaagugaugacgaauuuauaaucaaaacuguccagcacaaggaggccgaguucuugcagaaacuccugccaggguacuauaugaaccugaaucagaacccgaggacacucuuacccaaguuuuacggacuguauugugugcaagcggguggcaaaaauauucggaucguaguuaugaacaaucuuuugccucgcagcgugaagaugcauauuaaguacgaucugaaaggguccaccuauaagagaagggcaucucagaaagaacgggagaagccacuacccacguucaaagaccucgauuuccugcaggacaucccugauggacuuuuucuggacgccgacauguacaacgcuuugugcaagacucuccagcgcgauugucuggucuuacagagcuucaaaauaauggacuauucacugcucaugaguauucacaauaucgaucacgcccaacgagaaccacuuuccagcgagacccaguacucuguggacacaagaaggcccgcaccgcagaaggcucuguacucaacugccauggaaaguauucaaggcgaggcgcggcguggugggaccauggaaacagaugaccaguuugugaagaaauuggagcauagcuggaaggcccuaguccacgauggagacaccguuuccgugcaucgcccuggcuucuaugcagagagauuucagagguucaugugcaacacgguauuuaaaaagaucccccugaaaccaucuccuucgaagaaguuccggagcggcuccucauuuagucgacgcgcugggucuagcggaaauuccuguaucacuuaccaacccucagugagcggugaacacaaagcccaggucacaaccaaggcugagguggaaccaggcguucaccucgggagacccgaugugcugccucagacuccaccgcuugaggaaauuucugagggaucccccauaccugacccaaguuucagcccccuggucggcgagacauugcagaugcucaccacgucuaccacacuggaaaaauuagagguggccgaauccgaguuuacucauuga

SEQ ID NO: 60728 - RNA, 1509 nt, Artificial Sequence
  derived and/or modified sequence opt3 from PIP5K1B__Homo_sapiens__XP_006717364
augagcuccgccgcugagaacggcgaagcagcccccgggaagcagaaugaggagaaaaccuacaagaaaacagcgucuucagcuaucaagggagccauucaacuggguauaggcuauacuguggggaaccucacgaguaaaccugaaagagacguccuuaugcaggauuucuacguuguggaaagcguauuucugccauccgagggaucuaauuugaccccggcacaccauuaucccgacuucagguuuaagacauacgccccuuuagcuuuccgguauuuucgcgagcuguucggcaucaagccagaugacuaccuauauucgauuugcucagaaccccucaucgagcugagcaacccuggugcaagugggucccuguuuuucgugacuucugaugacgaauuuauuaucaaaaccguccagcacaaggaggccgaguuccuucagaaauugcucccaggauacuacaugaaucugaaccaaaauccccgaacacugcucccuaaguuuuauggcuuauacuguaugcagagcggcgggauaaacauccguauugugguuaugaauaacgugcugccaagauccaugaggaugcauuucaccuaugaucuuaaaggaucaacuuacaagcggcgcgcuaguagaaaggaaagggagaaaagcaauccgacauuuaaggacuuggauuuccugcaggacaugcacgaaggucuauauuucgauaccgagacguacaacgcccucaugaaaacucugcagcgggacugccgcguccuugaaucuuuuaagaucauggauuauucccuguugcucggcauucauuuccuggaccacucauuaaaagagaaggaggaagagacaccccaaaaugugccugacgcgaaacgaaccgggaugcagaagguacuguacagcacugcaauggaaaguauccagggaccaggcaagucuggugaugggauaauuaccgagaaccccgacacaaugggaggcaucccugccaaaucccacagaggcgaaaagcuccuucuguuuauggggauuaucgauaucuugcagagcuacaggcuaaugaaaaagcuggagcauucguggaaagcucucguuuaugacggagauaccgugucuguccaccggccauccuucuacgccgaccguuuucugaaguucaugaacucacgcguguuuaagaaaauucaagcacuuaaggcuagucccagcaaaaagagauguaauuccauagccgcgcugaaagccacgucucaggagaucgugagcucaauuagucaggaauggaaggaugagaagagggacuugcucacugaaggucaauccuucagcucucuggaugaggaagcauuaggcucacggcaucgaccggaccuggucccuaguacacccagccuauuugaggcugccucccucgcuaccacuaucucuucgagcucccuguauguuaacgagcacuacccacacgaucgcccuacacuuuauucaaauaguaaauga

SEQ ID NO: 60729 - RNA, 1923 nt, Artificial Sequence
  derived and/or modified sequence opt3 from PIP5K1C__Homo_sapiens__NP_001182662
auggagcuggaagugcccgacgaggccgaaagcgcugaggcaggcgccgucccuuccgaagcggcuugggccgcagagucuggggccgcugcaggacucgcccagaagaaagcugccccaaccgagguucuuucaaugacagcgcaaccgggucccggccacgggaagaaacugggacauagaggcguggaugcaaguggugaaacuacguacaagaaaaccacaagcuccacuuugaagggggccauccaguuaggaauuggcuauaccguaggccaccugucuucgaagccugagagggacgugcuaaugcaggauuucuacgucguggaaucaauauuuuucccaagcgaggggaguaaccucacacccgcucaucacuuucaggacuuccgguuuaaaaccuaugccccuguugcauuccgcuacuuucgagagcuguucggaauccguccagaugacuaucuuuacucccugugcaaugaacccuugauugagcucucuaacccuggugcuagcggcucccuguuuuaugugacuucagaugacgaguucaucauuaagacagucaugcauaaagaggccgaauuucugcaaaagcucuuaccaggguacuacaugaaucugaaccagaauccgagaacccuuuugcccaaauucuauggacuguacugugugcagaguggcgguaagaacaucaggguaguugugaugaauaacauacuaccucgggucgugaagaugcaccucaaauuugaucugaaggggagcacguauaaacgcagagcgucuaagaaagagaaggagaaauccuucccaacuuacaaggaccuugauuucaugcaggacaugcccgaaggacuguugcucgaugccgacaccuuuucagcacuggugaagacauuacaaagggacugccugguccucgagagcuucaaaaucauggauuauagucuucuguugggcguucacaauauugaccagcaugaacgggagcgccaggcucagggcgcccaaucuacuuccgaugaaaagcgaccuguggggcagaaagcucuauacagcaccgccauggagucgauccagggaggugcagccagaggcgaggcuauugaaucugacgauacaauggguggaaucccagcgguaaacggcaggggugagcggcugcuccugcacauagggauuaucgacauucuucaauccuaucguuuuaucaagaaacuggaacauaccuggaaggcauuggugcacgauggcgacacggucucagugcaccgccccaguuucuacgccgagagauuuuucaaguuuaugagcaauacuguuuucaggaaaaacuccucucucaagagcucaccgaguaaaaagggacggggcggggcucuguuagccgugaaaccucugggacccacagcagccuuuuccgcuagccagaucccaucugaacgagaggaggcccaguacgaucuacgcggugcaagaucauauccuacccucgaagacgagggcaggcccgaucugcuuccauguacucccccuaguuucgaagaggcgacaaccgcuagcauugccacgaccuuguccucuacaucgcugagcauaccagagcgguccccgucagaaaccagugagcagccccgcuacagaaggcguacucaaucuagcgggcaggacggacggccucaggaagaaccacccgcagaagaggaccuccagcaaaucacaguccagguggagccugccugcuccguagaaauuguugugccaaaggaggaagaugcuggcgucgaggccucacccgcaggggcuagcgccgcgguggaagucgagacugccucucaggcuuccgacgaggaaggggcaccggccagucaggcuagcgaugaggaagacgccccugcaaccgauaucuauuuuuga

SEQ ID NO: 60730 - RNA, 1185 nt, Artificial Sequence
  derived and/or modified sequence opt3 from PIP5KL1__Homo_sapiens__NP_001128691
auggccgcucccagcccuggcccaagagaggugcuggcaccgucccccgaagccgggugcagggcggucaccucuucacggcgcggacuccuuuggcgacugcgugacaagcagaguagauuggguuuauucgagaucagcccuggccacgaacugcaugggaugacauguaugaugcaagcuggacuaugggccgcaacucagguuuccauggaucacccacccacgggcccuccaucuagggacgauuuuucggaggugcucacccagguacaugaagguuucgagcuggggacacuugccggacccgcuuuugcauggcugcggcgcucauugggccucgccgaggaagacuaccaggcugcccugggcccugggggaccauaucugcaauuccucagcaccaguaaauccaaggcgagcuuuuucuuaucucacgaucagagauuuuuccugaaaacucaggguaggcgggaggugcaggcacuuuuggcccaucugccgcgcuacguccaacaccuacagcgacacccccauucccuccuggcuagacuucugggcgugcacucauugaggguugaccgggggaagaaaacauauuuuauugugaugcagagugucuucuacccugccggacguauaagcgaacgcuaugauaucaagggcugcgaggugucuagauggguagacccagcacccgaggguuccccucucguucugguguuaaaggaucugaacuuucaggggaaaaccauuaaucucggaccacaaaggucaugguuccuucggcagauggaacuggacacuacauuuuugcgagagcuaaacguccuggauuacagccuccugaucgcuuuccagcgccuucaugaagacgagagaggccccggcaguucucugauuuucaggaccgcccgguccgugcaaggggcgcagagcccggaagagucgcgcgcccagaauagaagguugcucccugaugcacccaacgcucugcacaucuuagacggaccagagcagcguuauuuucuggguguggucgaccuagccacgguuuacggccuccggaagcgacuggaacaccuuuggaaaacuuugagauacccugggaggaccuucucuacagugucccccgcucgcuaugcccggagacugugucaauggguagaggcacauacugaauga

SEQ ID NO: 60731 - RNA, 441 nt, Artificial Sequence
  derived and/or modified sequence opt3 from PIP__Homo_sapiens__NP_002643
augagacugcuccagcuucuguucagggccagccccgcuaccuuguuacuggugcuaugccuccaacugggcgcaaacaaggcccaggacaauacacggaaaaucauuauaaagaacuuugauaucccuaaauccguccgcccaaaugacgagguuacugcggugcuugcuguacagacggaacugaaggaguguaugguggucaaaaccuacuugauuucuucaaucccgcuccagggggccuucaacuauaaguacacagcaugccugugugaugacaaucccaagacuuuuuauugggauuucuacaccaaccgaacagugcaaauugccgcuguuguggacgucauccgugaacugggaauaugcccugaugacgcagccgugaucccaauuaaaaauaacagauuuuauaccaucgagauucucaagguagaauga

SEQ ID NO: 60732 - RNA, 1173 nt, Artificial Sequence
  derived and/or modified sequence opt3 from PIPOX__Homo_sapiens__NP_057602
auggccgcucagaaggaccugugggaugcaaucgugauuggcgccgggauacaaggaugcuucaccgcguaccaccucgcuaaacauagaaagaggauccuucuguuggagcaguuuuucuuaccccacagccgggguuccucucauggccagucacgcauuauccgaaaagccuaucuggaagacuuuuacacacguaugaugcacgaguguuaucagauuugggcacaacuagaacaugaggccgggacucagcuccacagacagacgggacugcuucuguugggcaugaaggaaaaccaggagcucaaaaccauccaagcuaaucugaguaggcagcgggucgagcaccagugccugagcuccgaggaacucaagcagcgcuucccuaacauaagauuaccaaggggugaaguugggcugcuugauaauucuggaggcgugaucuacgcauauaaggccuugcgggcucugcaagacgccauucgccagcuaggcgggaucguacgagauggagagaaaguggucgagauuaacccgggucuccuggugacaguuaagacuaccucgagaucauaccaggcgaaaagccuugugaucacagcaggccccuggaccaaucaacuguugaggccucucgggauagaaaugccacugcagacuuuacggauuaacgucuguuauuggcgugagauggugcccggaaguuacggcguaucccaggccuuuccuugcuuccuguggcucggucuuuguccacaucacaucuacgggcugcccacaggagaauauccuggcuugaugaagguuucuuaccaucacggcaaucacgcugacccagaggaacgcgauugcccgaccgccagaacggacauuggggaugugcagauccuaagcuccuuugucagggaccaucugcccgaucucaaaccugagccagcagugaucgagucauguauguauacuaacacccccgacgaacaauucauucuggaucggcacccuaaguacgacaauauagugaucggagcugguuuuaguggccauggguucaaacuugccccagucguuggaaagauucuguaugaguugagcaugaagcucacacccucuuacgaccuggcgccguuucgaaucucccgcuucccuucauuaggcaaagcccaccuguga

SEQ ID NO: 60733 - RNA, 873 nt, Artificial Sequence
  derived and/or modified sequence opt3 from PIR__Homo_sapiens__NP_003653
augggcagcuccaagaaagugacccugucuguccucucaagagagcagagugaagggguuggagccagggugcggcgcagcaucggucgacccgagcuuaagaaccuggacccuuucuuguuauuugaugaguucaaaggcgggcguccaggaggcuuuccggaccacccccauagagguuucgagacaguauccuaccugcuagaagggggaucuauggcucacgaggauuuuugcggccauacuggcaagaugaauccuggggaccuccaauggaugacggcaggaagggguauucugcacgccgagaugccauguucggaagaacccgcgcauggccuucagcugugggugaacuugcggucaagcgagaaaauggucgaaccucaguaucaggagcucaagagugaagagauaccaaagcccuccaaagauggggugaccguugcugugaucucuggagaagcccugggcauuaagagcaaagucuacacacgcacuccuacccuguaucucgacuucaaguuagauccaggugcaaaacacucccaaccgauccccaagggguggacaucauuuauuuacaccaucaguggagacguguauauaggcccugaugacgcccagcagaagaucgagccacaccauacugcuguacugggcgaaggggauagcguucagguggagaauaaagaccccaagagaucucacuucguccuuauugcaggagagccuuugagggaaccagugauccaacauggucccuuugugaugaacacaaaugaggaaauuucccaggccauccuggauuuccggaacgcuaaaaauggcuuugagcgcgccaagaccuggaaaucaaagauagggaacuga

SEQ ID NO: 60734 - RNA, 1230 nt, Artificial Sequence
  derived and/or modified sequence opt3 from PISD__Homo_sapiens__XP_005261512
auggccaccagcgugggccacagaugccuggggcuccuucauggagucgcucccuggagguccucucugcacccuugugagaucacagcauugucacagaguuuacaaccacugcggaagcuaccguuccgcgccuuucgaacugacgcgcguaaaauucauacggcucccgccagaaccauguuccuccugaggccucuuccaauacuguugguuacagguggcggguacgcaggauaucggcaguacgaaaaguaucgcgagagagaacucgagaaacugggccuggaaauucccccuaagcucgccggucacugggagguggcuuuauacaaaagcguaccaacuaggcugcuuucccgggcaugggggcgcuugaaccagguggagcugccccauuggcuacgaagaccugucuauucucucuacauuuggaccuuuggagugaauaugaaggaagccgcuguugaggaucugcaccacuauaggaaccuuucggaguucuuucggcguaagcugaaaccacaggcccgcccggugugcggcuugcauucagucaucagccccagugacggcagaauccucaauuucgggcaagugaagaacugugaaguagagcagguuaaaggagugacauacucccuggaaucuuucuuagguccuaggaugugcaccgaggaucugccauuucccccugcggcaagcugugacuccuuuaagaaucagcucgucacucgggaaggcaacgagcuuuaccacugcgugaucuaucuggccccaggggauuaccauuguuuccacucacccacagacuggaccgugagucaccgacgccauuuuccgggcagcuugaugucugucaauccuggaauggcuagauggauaaaagaacuauucugccacaacgagaggguugugcugacgggugauuggaagcauggguuuuucucccucacugccguaggagcaaccaaugugggcucaauccggauuuauuucgaccgcgaucugcacacaaacagccccagacauaguaagggcucuuacaaugacuuuuccuucgucacucacaccaacagggagggggugccaaugcguaaaggagaacaccuuggugaguuuaaucugggcagcacaaucguuuugauuuucgaagcuccuaaggauuuuaacuuccagcucaaaaccgggcaaaagauccgguuuggagaggcccugggcucguuauga

SEQ ID NO: 60735 - RNA, 813 nt, Artificial Sequence
  derived and/or modified sequence opt3 from PITPNA__Homo_sapiens__NP_006215
auggugcugcucaaggaguacagagucauccuucccguuagcguggacgaauaucagguaggccaacuguacuccguggccgaggcuucuaaaaacgaaaccgggggaggugagggcgucgaaguguugguuaaugagccuuaugagaaggauggggaaaaaggacaguacacacacaagauuuaucauuuacagucaaaagugccaacuuucgucaggaugcuggcaccggagggcgcccuaaacauacacgaaaaggcguggaaugcuuaccccuauugccggacggugaucaccaacgaguacaugaaggaggacuuucucauuaaaaucgaaacauggcauaagccugaucuggguacucaggagaauguacacaaacuugaaccagaggccuggaagcauguugaagcaguguacauugacaucgccgaucgcagucaaguccugagcaaagacuauaaggcugaggaggaucccgcaaaguucaaauccauaaagaccgggcgaggaccuuugggcccaaacuggaaacaggaacucgugaaucagaaggacugucccuacaugugcgccuauaaacuggugacagucaaguuuaaaugguggggccugcagaacaagguugagaauuucauccacaagcaagaacguagacucuuuaccaacuuccacaggcaguuauuuuguuggcuggauaaauggguggaccuuacuauggaugacauucggcgcauggaggaagagacaaagagacaguuggaugagaugaggcagaaagacccuguaaaggggaugaccgcugacgauuga

SEQ ID NO: 60736 - RNA, 3732 nt, Artificial Sequence
  derived and/or modified sequence opt3 from PITPNM1__Homo_sapiens__NP_001124320
augcugaucaaggaguaccacauucuccuucccaugagccuggacgaauaucagguggcccaauuguacaugauacagaaaaaguccagagaggaaucuucaggcgaggggaguggagucgaaaucuuagcuaacaggccuuauaccgaugguccaggcgggagcggacaguacacacauaaaguuuaucacgugggcucccauauuccggguugguuccgggcacugcuacccaaggccgcgcuccagguagaggaggaaucuuggaaugcuuacccuuauacucgcacgcgauauaccugcccauuuguggagaaauucucgaucgaaauugagacauacuaccugcccgacgggggacaacagccuaacgucuuuaaucuuucaggcgccgagcguagacagaggauccuggauacuauagacaucgugcgggaugcaguugccccaggcgaauacaaggcugaggaagacccccgcuuguaucacagcgugaagaccgggagaggaccucucagugaugacugggcaaggacagccgcucagaccgguccacugaugugugccuacaaacugugcaaggucgaguuccgguauuggggcaugcaagcgaaaauugaacaguuuauccaugauguggggcuccgccgaguaauguuaagagcacacaggcaggccugguguuggcaggacgaguggacugagcuguccauggcugauauucgggcccuugaagaggaaacagcacguauguuggcucaacgcauggccaagugcaacaccggaucugagggcagcgaagcgcagccgcccgguaaaccuuccacggaggccagaucagcagcuaguaauacugggaccccagacggacccgaggccccuccaggccccgaugcuagcccggacgccucuuucggcaagcagugguccucaagcaguaggucuuccuacagcucgcaacacgggggagcaguuucuccucagucccugucagaauggcggaugcagaacaucgcccgagacagugagaauagcuccgaagaggaauuuuucgaugcucaugaggguuuuucugacagcgaggaaguguuccccaaggagaugacaaaauggaacucaaaugauuuuauagacgcguucgcaaguccagucgaagccgagggcacuccugagcccggggcugaagccgcaaagggaauugaggauggcgcccaggcuccacgcgacuccgaaggucuagauggggccggcgagcucggagcagaagcgugugcugugcacgcccuguuucuuauccugcauagcggcaacauuuuggacucugggcccggagaugcaaauucaaaacaagccgacgugcagacccucaguagcgcuuucgaggccgucacaagaauccacuucccugaggcacugggucacguugcuuuaaggcuggugccaugcccgcccaucugugccgcggccuaugcucucguauccaaccuuucuccuuacucgcaugauggcgacagccugucccggucacaggaccacauuccauuggcagcccuaccccugcucgcuaccaguucuagccgcuaccagggggccguggcaacggucauagcgagaacuaaucaagccuauuccgcuuuucugaggucaccugaaggagccggcuucugcggucagguggcacuuaucggggauggcguuggaggcauucugggguuugacgcuuugugucauagcgccaacgcaggaacagguucucguggcuccagucggcgagggagcaugaauaacgagcuccugucuccagaguucggacccgugagagauccguuagccgacggcgucgagggucuggggaggggcuccccugaaccaucagcucuacccccucagcgcauccccagugauauggcgagcccagagccugagggaucgcagaacucccuccaagccgcacccgcuaccacuucuagcugggaaccacggagagccucaacagccuuuugcccgccugcugcaaguuccgaggcccccgacggcccaucuagcaccgcgaggcuggauuucaagguguccggguuuuuccuuuuuggaucacccuugggccugguacucgcucugcgcaaaacgguuaugccugcccuugaagcacagaugcgaccagccugugagcagauauacaaucuguuccacgcugcagaccccugcgccagccgguuggaaccucuccuggcgccgaaguuucaggcuauugccccauuaaccgugccccguuaucaaaaauucccucugggugaugggaguucucuacuccuggcagacacacuucagacucauuccagcuuguuucuggaggagcucgaaaugcuggucccaucgacccccacaucaacuucuggagccuucuggaagggcagugaguuagcuaccgauccuccggcccagcccgcagcuccauccacaaccagcgaaguggucaagauccuggagagauggugggguacuaaaaggaucgacuacucucuuuauugcccugaggccuugacggcguuccccacagugacccucccacaccuguuucacgccagcuacugggaauccgcagauguuguggcuuucauucuacgccaaguaaucgagaaggaacggccucagcuggccgagugugaagaacccucaauuuauaguccagcuuuuccgagagagaaauggcagaggaagcgaacucaggucaaaauacgcaacgugaccagcaaucaucgggcaucugacacaguugugugcgaaggcagaccucaaguccucuccgggagguucauguacggaccccuggacgugguaacccuuacuggcgagaagguggauguuuacaucaugacacagccauugucagggaaguggauucacuuuggaacggaagucaccaacaguagcggccgucugacuuuccccgugccuccagagcgcgccuuagguaucgggguguaucccguccggaugguugugagaggagaccauacauacgccgaauguugccucaccgugguagcuaggggcacagaggcggucguguuuuccaucgaugguucuuucacugcaucgguuagcauuaugggcucagacccuaaagugcgagccggggcugucgaugugguucggcacuggcaggacuccggauaucugauaguguacguaaccggccgcccggauaugcagaagcacagagucguggccuggcuuagucaacauaauuuuccacacgggguggucucuuucugugacggacugacgcaugaucccuugaggcagaaagcaauguuucuccagagccugguucaggagguggaacuaaacaucguagccggcuaugguuccccuaaggacguggcugucuacgcggcccuggggcucucacccucucaaaccuauauugugggacgggcaguucgaaaacugcaggcucagugccaauuccuuagcgauggcuacguggcccacuugggucagcuggaggcaggcagucauucccacgccagcucugggccaccuagagcugccuuaggaaagucauccuacggcgucgcggcacccguggacuuucuccgcaagcagagucagcugcuuaggagccgugggccaucgcaagccgaacgggagggaccuggcacaccgcccacuacccuggcuagagguaaagccaggucuaucucccuaaagcucgauagcgaagaguga

SEQ ID NO: 60737 - RNA, 2817 nt, Artificial Sequence
  derived and/or modified sequence opt3 from PITPNM3__Homo_sapiens__NP_001159438
auggccaaggcuggcagagcagggggacccccuccagguggcggggccccguggcaccugaggaacgugcucagcgacuccgucgagucuucagaugacgaguucuuugaugcgcggggagagggcaccgcucccugcacaaguagcauccuucaggaaaaacaacgcgagcuguaccgaguuuccuugcguagacagagguucccugcccaggguucuauugaaauacaugaggacucggaggaaggguguccacagcggucaugcaagacucacguguuacugcuaguacuccauggaggcaauauccuggauacgggcgcaggggaccccagcuguaaagccgcugauauucacaccuuuaguuccgugcuugagaaggucacacgcgcacauuucccugccgcucugggacacaucuugauuaaauuugugccaugccccgccaucuguucugaagcguucagccucguuucccaccugaacccuuauucacaugacgaggguugccugaguagcucucaagaucacgugccacucgcagccuuaccgcugcuugcuauauccucaccccaguaccaggacgccgucgcaacugugaucgagagagcuaaucagguauauagggaauuuuugaaaagcagugauggcauuggguucucuggacaaguuugucugaucggcgacugcgugggugggcuacucgccuuugaugcgauuuguuacuccgccggaccuagcggcgacucgccagcaucuuccucacggaagggcaguaucagcuccacccaggacacacccgucgcuguggaggaagauugcucucuggccagcucaaagcgccuuaguaaguccaacauagacauuagcucugggcuggaggaugaagaaccuaaacgaccauugcccagaaagcagucagacaguagcaccuaugauugugaggcuaucacucagcaucacgccuuccucuccucuauucacucgagcgugcugaaagacgaauccgagacaccggcagccggagguccucaauuacccgaagucucacugggcagguuugauuucgacguuagugacuuuuuccucuucgggucuccacuuggacugguguuggcuaugcggcguaccguacuaccuggccuggaugguuuucaggugcgccccgcgugcagccaggucuacuccuucuuucauugcgcagauccaucagccagcagacucgagccccugcuugaaccuaaguuccaccuggugccaccgguuucugugcccagguaucaacgguuuccuuugggggacggccagucccuccuguuagcugacgcccugcauacgcacaguccacuauuccucgagggaagcucucgagauuccccuccccugcuugacgcaccagccucacccccgcaggcuagucgcuuucagagaccuggcaggcggaugagcgaggggucgucccauucugaaagcucagagaguuccgauucuauggccccagucggagcaagccgcaucacugcgaaguggugggguuccaaaagaaucgacuacgcuuuguacugucccgaugugcugaccgccuucccuacaguagcacucccccaccuguuucacgccucauauugggaaagcacugacguuguggcuuucauucuuaggcaagucaugcguuacgagagugugaauauaaaggaaucugcccggcuggauccagcagcuuuguccccugccaacccccgagagaaauggcucagaaagaggacccaggucaaacugcgcaaugugacagcgaaccaucgggccaaugacguuaucgcugcagaggauggcccacagguguuaguagggagauuuauguauggaccgcuggacauggucgcccuaaccggcgaaaagguggauauucucguuauggcugagccuagcucggguaggugggugcaccuggacacggaaaucacuaacucaucugggcgcauaacauacaaugucccccgaccacggcgucuuggcgugggaguauaucccgugaaaaugguugucagaggcgaucagaccugcgccaugaguuacuugacugugcugccuagggggauggaguguguggucuucuccauugacggcagcuuugcagcgucuguuagcaucauggguuccgacccaaaggugcgccccggcgccguggauguaguccggcauuggcaagaccucggguauaugauccuguacauuacaggaagaccugauaugcagaagcagagggugguuucaugguuaagucagcacaacuucccgcaaggcaugaucuucuuuagcgacggucuggugcacgauccacuucgacagaaagcuauuuucuugcgcaaucucaugcaggagugcuuuauaaagaucucugccgcauacggguccaccaaagacauuucagucuauagugugcugggccuacccgcuagccagaucuucaucguuggacggccuacgaagaaauaccaaacccagugucaguuucuguccgaaggcuaugccgcacaucucgccgcucuggaggcgucucacagaucgaggccaaagaagaacaauagccguaugauucuucgcaaagggucauucggauugcaugcccaacccgaauuucugcggaagagaaaccacuuaaggcgaacaauguccgugcagcagccugauccgcccgcagcuaacccaaaaccugagcgggcccagagucaacccgaaucugacaaggaucaugagcgcccacucccugcccugagcugggcuagaggacccccaaaauucgaguccguaccguga

SEQ ID NO: 60738 - RNA, 3117 nt, Artificial Sequence
  derived and/or modified sequence opt3 from PITRM1__Homo_sapiens__NP_001229236
auguggagaugcggcgggaggcagggacugugugugcuccggcgccuuagcgguggccacgcccaucaccgagcuuggcguuggaacuccaauagagcaugcgagagggcccugcaauacaaguugggggacaaaauccauggauucaccgucaaccagguuacaucugugcccgaauuauuucugacugcgguaaagcuaacgcacgaugacaccggcgcucgguaucuccaucuggcccgcgaggauacaaauaaccuuuucucagugcaguuuagaacuaccccuauggacaguacaggugucccacacauucuggaacacaccguguugugugggagccagaaauacccgugcagggaucccuucuuuaagaugcucaaucggucccugucuacuuucaugaacgcauuuacagccucggacuauacccuguacccuuucucaacgcaaaauccaaaagauuuucagaaccucuuaagcguuuaucuggacgcuacuuucuuucccugucuucgcgaguuggauuucuggcaggaaggauggcgacuggagcaugagaauccuagugacccacagacccccuugguguuuaagggcgucguguucaacgaaaugaagggcgcauucacagauaaugagagaauauuuucccaacaccuccagaacaggcugcuuccugaccauacuuacucuguaguuagcgggggagauccacugugcaucccggaauugaccugggagcagcucaaacaguuccacgccacacacuaucaucccuccaaugcucgguuuuucaccuacgguaacuuuccucuggagcaacacuuaaagcagauucaugaagaggcccugucaaaauuccagaagaucgaaccaaguacggugguccccgcgcaaacuccuugggacaaaccacgugaguuucagauuacauguggccccgacagcuucgcaaccgauccgucuaagcagacuacaaucuccgugucauuucuccuuccugacauaaccgauacguucgaagccuuuacccugagcuugcuaaguucucugcucacauccgggcccaauagcccauucuacaaggcucugaucgagucgggacuuggcacugacuuuucuccugauguggguuauaacggguacacccgcgaggccuauuucuccgucggacugcagggcauugcagaaaaagacaucgagacaguuagaucauugauugauaggacuaucgacgaagugguagagaagggcuucgaagaugaccggauagaggcucuccugcacaaaauugagauccaaaugaagcaucagaguaccagcuuuggguuaaugcugacauccuacauugccucuugcuggaaccacgauggagaccccguggaacuacucaaacuggguaaucagcuugcgaaguuccgacaguguuugcaagagaacccaaaauuucugcaggaaaaggucaagcaguauuucaaaaauaaccagcacaagcucacccugagcaugcgccccgacgauaaauaccaugagaagcaagcccagguggaagcaacuaaacuuaagcagaagguugaggcucugucaccuggcgacagacagcaaaucuaugagaaaggguuggaacucaggagucagcaguccaagccacaagaugccagcugccugccggcuuuaaaagugucugacaucgagcccacgauuccugucacagaacuggaugugguacuaaccgccggagacauaccaguucaguacugugcacagcccacuaauggcaugguguacuuucgggccuucucaagucucaacacccugccugaggagcuucgcccauauguccccuuguuuugcagcgugcugacaaagcucgguugcgggcuguuagauuacagagaacaggcucaacagaucgagcugaaaaccggcggaauguccgcgucuccgcacguccuuccugacgauucgcauauggacacuuaugaacaggugggcguuuuguucagcucccucugucuggauaggaaucuaccagacaugaugcagcuguggucagagauuuuuaacaaucccugcuucgaagaggaggaacacuuuaaggugcucguaaagaugacagcacaagagcuggccaacgggaucccugauaguggacaccuuuacgcuucuauacgugccggucggacguugacccccgcaggcgaccugcaggaaacuuucagcgggauggaccagguccgauuaaugaaaagaauugccgagaugacagauaucaagccaauccucaggaaacugccucgcauuaagaaacaucuucugaauggagacaacaugcgguguuccgugaaugcuacaccccagcaaaugccacagaccgaaaaggccguugaggauuuucuaagaucaaucggcaggagcaagaaagagcgccgaccggugcggccucacacugucgaaaagcccgugccaucuuccagugguggggacgcacauguaccccacggcagccaggugauucguaaacucguuauggagccuaccuucaagccauggcaaaugaaaacgcauuuccugaugcccuuuccugucaacuaugugggagaaugcauaagaaccgugccguacacagauccagaccacgcgucucuaaagauccuggcuaggcucaugacugccaaauuccugcacaccgagauucgcgaaaagggcggggcauauggagguggcgccaaacuuucccauaaugggaucuuuacauuguacucauaccgggaucccaacacuaucgagacccugcagaguuucggaaaggcugucgacugggccaagagcggcaaauuuacgcagcaggauauugacgaggcaaaguuaucgguuuucuccacaguggaugcuccuguggccccaucugacaaagguauggaucacuuucucuaugggcugagcgacgaaaugaagcaagcgcauagagagcagcuuuucgccguaucacacgacaagcugcuagcugucagugauagguaccucggcaccggaaaauccacucauggccuggcaauauuggggcccgaaaacccuaagaucgccaaagacccgucuuggauuauccaguga

SEQ ID NO: 60739 - RNA, 945 nt, Artificial Sequence
  derived and/or modified sequence opt3 from PITX1__Homo_sapiens__NP_002644
auggacgccuucaagggcgggaugagccuggagagacuccccgaaggacuuaggccuccaccgcccccuccacacgauaugggucccgcuuuucaucuggcacggccugccgacccacgcgagcccuuggaaaacuccgcgucugagucaagugauaccgaauuaccugagaaagagcgaggcggggaaccaaagggaccggaggacagcggcgcuggugggacaggaugcggcggcgccgaugaccccgcgaaaaagaaaaagcagcguagacaaaggacucacuucacgucccagcagcugcaggaacuagaggccaccuuucaacggaaucgcuacccugauaugucuaugagagaggaaaucgcuguguggacaaaccucacugagccaaggguccggguuugguucaagaaucgccgagcaaaauggagaaagagggaacggaaccagcagcuggaccuuuguaaagggggauaugugccccaguuuucgggucugguacaaccuuacgaggauguguaugccgcuggcuacucauauaauaacugggccgcaaagagcuuggcaccagcccccuugaguaccaaauccuucacauuuuucaauucuaugagcccgcuguccucacagaguauguuuagcgcuccuucuuccauuucaagcaugaccaugcccaguucuauggggccaggagccgucccuggcaugcccaacuccggucugaauaacauaaauaaccucacugggagcucguuaaauucugcaauguccccaggagcuugccccuacggcaccccugccucaccauauaguguguaccgugacacauguaacagcucccuggcgucucuucgccucaagagcaagcagcauucaaguuucggcuacgggggacugcaggguccggccuccggccuaaaugcaugccaauauaacagcuga

SEQ ID NO: 60740 - RNA, 975 nt, Artificial Sequence
  derived and/or modified sequence opt3 from PITX2__Homo_sapiens__NP_000316
augaacugcaugaagggcccccugcaccucgagcauagagccgcugggaccaaacuuagcgcaguguccucuucaaguugucaccauccucagccacuggccauggcgagcgucuuggcuccgggacaacccagguccuuagacucuucgaagcaccggcuggaaguucauacaaucucagauacuagcaguccugaggccgcagaaaaagacaagucccagcaggguaaaaaugaggaugugggcgccgaagacccaucuaagaagaaacgccagcgacgucaaagaacgcacuucaccagccagcagcuacaggagcucgaggcuacauuucaaaggaaccgguaccccgauauguccacucgcgaagagauugcaguauggaccaaucugacagaagccagagugagggucugguucaagaaccggcgcgcuaaauggcgaaagagagagaggaaucagcaggccgagcuuugcaaaaacggguuuggaccucaguucaauggccugaugcaaccauaugacgauauguaccccgguuauucauacaacaauugggcggcaaagggguugaccagugccagccucucuacuaaguccuuuccuuucuuuaacucaaugaaugugaacccacugagcagucagucuauguucuccccgcccaauagcauaucgucuauguccaugucaaguagcaugguuccuuccgcugugacaggagucccaggcucuagccugaacucacucaauaacuuaaacaaucugaguucccccagccuuaacucugccgugccuaccccagcaugucccuaugcuccgccuacgcccccauacguauaucgggacacuugcaauucaaguuuggccagccugcgucuaaaagcgaagcagcacuccucuuuuggcuacgccucgguucaaaacccugcaagcaaucucuccgcuugucaguacgccguggaucgccccgucuga

SEQ ID NO: 60741 - RNA, 909 nt, Artificial Sequence
  derived and/or modified sequence opt3 from PITX3__Homo_sapiens__NP_005020
auggaguucggccugcucagcgaagccgaggcuagaucccccgcacuuucucugucagacgccgggaccccucacccacaguugccggaacauggaugcaagggucaagagcacagugauagcgaaaaagcguccgcuucuuuacccggcgggucgccugaggacggaucacugaagaaaaagcagaggcggcagcgcacacauuuuacuagccagcaacuacaggagcucgaagccacguuccagcgaaaccguuacccagauaugaguaccagagaggaaaucgcaguguggacaaaucugacugaggccaggguccggguuugguuuaaaaaccgcagagcuaaguggaggaagcgggagcgcucccagcaagcagaacuuuguaaaggcucuuucgccgcuccccuggguggguuggugccuccauaugaggaaguauaccccggauauagcuacggcaauuggccuccaaaggcccucgcgccgccccuggcagccaaaaccuuuccuuucgcuuuuaacuccgugaaugucggcccacuggccucacagcccguguucaguccuccaagcucuauugcagcuuccaugguucccucagccgcggccgcaccggggacagugccuggacccggugcucuccagggcuuagggggaggcccaccuggucuggcccccgcugccgucagcaguggggcagugucuugcccauaugccuccgcugcggcagccgcugccgcagccgcuagcucgcccuacguauaucgagacccuuguaacucuucccuugccucauugagacugaaggcaaaacagcacgcgaguuuuagcuacccagcuguucauggaccgcccccugccgcaaaucuauccccaugccaauacgccguggagaggcccgucuga

SEQ ID NO: 60742 - RNA, 2490 nt, Artificial Sequence
  derived and/or modified sequence opt3 from PIWIL1__Homo_sapiens__NP_001177900
augaccggcagagccagggcucgggcacgcgggcgagcccguggacaggagacagcgcaacugguggguagcacugcuucccagcagcccggcuacauccagccuagaccacaaccgcccccugccgaaggggaguuguucggaaggggccggcagcgcgguacggcagggggaaccgccaagucucagggccuucagauuucagcuggcuuucaagaacugaguuuggcagagagagggggaaggcggcgcgacuuccacgauuuaggugucaacacacgacagaaucuggaccauguuaaagaaagcaagacuggcuccucugggauaaucgugagacuaucgaccaaccacuuuaggcucacaucacggccacagugggcccuguaucaguaccauauugauuauaauccccuuauggaggcucgucgccugagaagcgcccuccucuuccaacacgaggaccugaucggaaaaugccaugcguuugauggcaccauucuguuccucccuaagagguuacagcagaaaguaacugaaguguuuaguaagacacggaacggugaggacguccgaaucaccauaacgcugacuaaugaacuuccacccaccuccccuacauguuugcaauucuacaacaucauuuuucgcagacugcuaaagaucaugaaucuccagcagauugggaggaacuauuacaauccaaacgauccgaucgacauacccucucaccggcuggugauuuggccuggauucacuaccagcauccuucaguaugaaaauuccauuaugcugugcacagauguuucacacaaaguguugcgcagugagaccguccucgacuuuauguucaacuuuuaccaucaaacggaggagcacaaguuccaggaacaggugagcaaagagcugaucggcuuaguaguucugacuaaguacaauaacaaaacauauagaguggaugacaucgauugggaccagaauccaaagucuaccuucaagaaagcagacggcuccgaagucucauuucucgaguacuauaggaagcaauacaaccaggagauuacugaucuuaaacagcccgugcuggugagccagccuaagcgucggcgagggccaggagguacauugcccggcccggccaugcuaauaccugaacuguguuaucucaccgggcugacggacaaaaugagaaacgauuucaaugucaugaaggaccuugcuguucauaccaggcugacacccgagcaacgccagcgggaagugggaagauugaucgauuacauucacaaaaacgacaauguacagagggagcuccgcgauuggggccugaguuuugacucuaacuuacuguccuucagcggucgaauccuacagacugaaaagauacaccaagggggcaagaccuuugauuauaauccacaguucgccgacuggucgaaagagacacggggagcaccucucauuucugugaagccccuggauaacuggcuuuugaucuacacucguagaaauuacgaggcugccaacucccugauccagaaucucuuuaaagucaccccagcgaugggcaugcaaaugaggaaggccauuaugaucgaaguggacgaccgcacagaggcauaucugcggguucuucagcagaaagugaccgcugauacucagauugucgugugccuguugucaaguaacagaaaggacaaguacgaugccaucaaaaaguaucucuguacggacugccccacaccuagccaauguguaguugcuaggacccuggggaaacagcagacugugauggccauagcaaccaagauugccuuacagaugaauugcaaaaugggaggugaacuguggcgagucgauaucccacuaaagcucgugaugaucgucggcauugacuguuaccaugauaugacagcugggcgccgguccauagcgggauucguggcaucuaucaacgagggcaugaccagaugguuuucaaggugcauuuuccaagaccguggucaggaacugguugaugggcuuaagguguguuugcaggccgcucugcgcgccuggaauagcugcaacgaguauaugccgagucggaucauuguauacagagacggcgucggagauggccagcucaaaacucuggugaauuaugagguuccccaauuuuuagacugccugaaguccaucgggaggggauacaacccucgacuuacagugauagucgugaaaaagcggguaaacacgcgcuucuuugcacagagcgguggcagauugcagaauccacuccccgggaccgugaucgauguugaagucacuaggccugagugguacgacuucuucauugugucucaagccgugcggucaggaagugucagcccaacacacuauaacguuaucuacgacaauuccggccugaaacccgaucauauucagcgacuaaccuauaagcugugucacaucuacuauaacuggccggugucugcuucgacaugcuga

SEQ ID NO: 60743 - RNA, 2922 nt, Artificial Sequence
  derived and/or modified sequence opt3 from PIWIL2__Homo_sapiens__NP_001129193
auggaccccuucagaccuagcuuuaggggccaguccccaauccacccgucucaaugccaggccgugcggaugcccggguguuggccucaggcuucaaagccacuggaucccgcacucggacgcggugccccugcgggccgagggcaugucuucggaaaaccagaggaacccaguacccagcguggcccugcucaaagagagagcguuggucuuguguccauguuuagggggcugggaauugaaacaguaucuaagacuccauugaaacgggagauguuaccgucgggccgcggcauacuggggagaggacuaucagccaaccucgugaggaaggaccgggaggaacugagccccacguucugggauccuaaaguccuugcagccggugacaguaagauggcugagaccuccgugggcuggucucgcacacuggggcgaggaagcuccgaugcaucauugcucccacugggcagagccgcuggugggaucaguagggaaguugacaagcccccuugcacuuuuagcaccccaucucggggacccccgcagcuguccucaccucccgcccucccacagagcccuuuacacagucccgaucguccacuggugcuuacagucgagcauaaagaaaaggaguugauugugaaacagggcucuaagggcacaccccaaucccuggggcuaaaucucguaaaaauccagugucacaacgaggcgguuuaccaguaucaugugacuuucagcccuaaugucgaaugcaagucgaugcgcuuuggaaugcugaaggaccaccaggcagugacagguaacgugaccgccuucgauggcucuauucuuuaccugccagucaaauugcaacagguucucgagcugaagucccagagaaaaacggacucagcugaaaucaguauaaagauccaaaugacuaaaauuuuagagccguguagcgaucugugcauccccuuuuauaaugugguauucaggcgggugaugaagcuccuugacaugaaacuggucgggcgaaacuuuuacgauccuaccuccgccaugguguugcagcagcaccgccuacagauuuggccaggauaugcagcuucuaucagaaggacagacggcggucuguuccuccuggccgacguuagccauaaggugauacggaaugauuguguccuugacgugaugcacgcgauuuaccaacagaacaaggaacauuuucaggaugagugcacuaaacuguugguagggaauaucguuauuacccgcuauaacaauagaacauacaggaucgacgauguggacuggaacaagacccccaaagauucauucacgaugagugacggcaaggagaucacuuuccucgaauacuauuccaaaaauuacggaauuacagucaaggaggaagaucagccucuguuaauacaccguccaagcgagcggcaagacaaccacggcaugcugcuaaagggggaaauccuccugcuucccgaguugucuuuuaugaccgguauuccggagaaaaugaagaaagauuuccgagccaugaaggaccuggcacagcagaucaaucucucaccuaaacagcaucacagugcucuggaaugucuucugcaaagaauagccaagaacgaggcugccacuaacgaauugaugagguggggacuccgccugcagaaggacgugcauaaaauugagggccgggucuuaccaauggaaagaaucaaucugaagaacaccagcuuuaucaccucccaggagcuaaauugggugaaagagguuacgagggaucccucuauucucaccaucccuaugcacuucugggcacuguuuuaucccaagcgcgccauggaccaggcucgagaacuugugaacauguuggagaaaauugcggggccaauaggaaugcggaugucgccucccgcauggguagaacugaaggaugaccguaucgagacauacgucagaacuauucaaagcacccucggcgccgaggguaagauccagauggugguuugcaucauuauggggccaagggaugaccuguauggcgcuauaaagaaguuauguugcgugcaguccccggucccuucacaagugguaaaugugcgcacaaucggacagcccacucggcugagaaguguugcccagaaaauucuuuugcagaucaacugcaagcucggcggggaacuguggggagucgauauuccacuaaaacaacugauggugaucgguauggacguguaccaugaucccucuaggggcaugcgaagcgucguuggguucguggcauccauaaaucucacccugacaaagugguauucacgcgugguauuucagaugccucaccaggagaucgucgacagccuuaaauugugucuggugggaucuuuaaagaaguucuacgaaguuaaccacugccucccagagaaaauuguggucuaccgggauggcguguccgacggucagcugaagaccguugccaauuaugaaaucccccaacuucagaaauguuuugaggcuuucgagaacuaccagccuaagauggugguauuugucgugcagaaaaagauuaguacuaaucuguauuuggccgcaccgcaaaacuucgugacgccaacacccgggaccgucguugaucauacuaucaccagcugcgaauggguggacuuuuaccuccuggcgcaccauguaagacagggcuguggaauaccuacacacuaugugugcguccuaaauaccgcuaaccugucuccagaccacaugcagaggcucacuuucaagcugugucauauguacuggaauuggcccggcacaauucgugugccugccccgugcaaauaugcacacaaacuugccuucuuguccgggcauauccugcaccaugagcccgcuauucaauuaugugaaaaccucuuuuuccuguga

SEQ ID NO: 60744 - RNA, 2649 nt, Artificial Sequence
  derived and/or modified sequence opt3 from PIWIL3__Homo_sapiens__NP_001008496
augcccggcagagccaggacccgggcucgcgggcgagcacguagaagggagagcuaccagcaagaagccccuggagguccacgggcgccgggcuccgcuacaacucaggagcccccucagcugcagucuacgccacgcccccuccaagaagaggugccugucguuagaccacuucagcccagggccgcacgcgggggagccggcgguggggcucagucacagggagugaaggaaccuggcccagaggcaggccugcacaccgccccguugcaagagcggcgaaucgggggaguauuccaggacuuaguggucaacacaagacaggauaugaaacaugugaaggacaguaaaacugguagcgaaggcaccguugugcagcugcuagcuaaucacuuuagggucauuucccggccccaauggguggccuauaaguacaacguagauuauaaaccugacauagaggaugggaaucuccguacaauccugcuugaccagcaucgcagaaaguucggagaaaggcacauuuuugauggcaacucucuguugcucucgcggccacugaaggagcgacgcguugaguggcugucaaccacuaaagacaagaauaucgugaaaauuacagucgaauuuagcaaggagcucacccccacgaguccugauugcuuaagauacuauaacauccuguuuaggcggacuuucaaacuuuuggacuuugaacaggugggucgcaauuacuauaccaagaagaaagcgauacaacuguacagacaugggacaucccuagagaucuggcucggauacgugacuucuguccugcaguaugaaaacagcauuacccuuugugcagauguuucccacaagcuguugaggaucgagacagccuacgacuucauuaaacguaccucagcucaggcccagacgggcaauauccgggaggaagugacuaacaagcucauaggcaguauuguacugacaaaauauaauaacaagaccuaccgaguggaugacaucgacuggaaacaaaauccagaggauacuuuuaacaagagcgacgggucuaagauuacauauaucgauuacuauagacagcagcacaaagaaaucgucaccgugaagaaacagcccuuacugguuucccaaggaagguggaagaaaggucucacgggcacccagcgcgagccgauucuucugauaccucaguugugccauaugacagggcuaacugacgaaaucuguaaggauuacucaauugugaaggagcuggcaaaacacacccggcucagccccagaaggcgccaucacacacugaaggaguucaucaauacucuucaggacaacaaaaagguccgagaacuguugcaacucugggaucugaaauuugacaccaacuucuuaagugugccaggacggguacugaagaaugcuaacauaguucagggccguagaauggugaaggccaauucucagggugauugguccagggagauucgcgaacuaccucuccugaacgcgaugccccuucacagcugguugauccuguacucgcggucuucccauagagaggccaugucacucaaagggcaucugcagagugucacagcaccaaugggcaucaccaugaagcccgcugaaaugauugagguggacggagaugccaauagcuauaucgacacucuuaggaaauacacgcgaccuacacugcaaaugggcauguccugcuugcucgucuuuaaggugauuuguauacugccaaacgacgauaaacgccgguaugacucuaucaagagauacuuaugcaccaaguguccgauucccagccagugcguugugaaaaagacucuggagaaaguacaggcuaggaccaucgucacaaagaucgcccaacagaugaauuguaaaaugggaggggcacuauggaagguggaaaccgauguucagcguacuauguucguggguauugacugcuuccacgauauagucaaccgccagaaaucaaucgccggcuuuguggcuaguacaaaugcggagcucacgaagugguauucccaauguguaauucagaagaccggggaggaacuggugaaagagcuugaaaucugcuugaaggcagcccuggacguuuggugcaaaaacgagagcucuaugccucacucagucauuguguaccgggauggagugggcgacggucagcuccaggcucuguuagaucaugaagccaagaaaaugaguacuuaucugaagacaaucagcccaaauaacuucacccuugcauuuauagucguuaagaaaagaaucaauacaagguucuuuuugaagcacggguccaacuuccaaaaucccccuccaggcacugugauugacguggagcucacccgaaacgaaugguacgauuucuucaucguaucucagucgguccaggacggaacggugacccccacacacuacaacguuauuuaugauacuaucggccugagcccggacaccgugcagcggcuaacauacugucugugccauauguauuacaaucucccugggauaauucgcgucccagcccccugucacuaugcucauaaacuggccuaccuugugggacaauccauccaccaggagccuaacagaucauugaguacuaggcuguuuuauuuauga

SEQ ID NO: 60745 - RNA, 2559 nt, Artificial Sequence
  derived and/or modified sequence opt3 from PIWIL4__Homo_sapiens__NP_689644
augagcggcagagccagggugaaggcucgggggaucgcacgcucccccucugccaccgaggucggacguauucaggcgucaccucugccacgaaguguugaccucagcaacaaugaggcuuccucuucgaacgguuuccuuggcacaucaagaauaagcacuaaugauaaauacgggaucaguuccggagacgccggcucuacguuuauggaaaggggugugaagaacaaacaagauuucauggaccugagcauuugcacccgggaaaaguuggcacacguacgcaauuguaaaacaggguccucaggaaucccggugaaguuagucacuaaccuguuuaaucuagauuucccccaggacuggcagcucuaucaguaccaugugaccuauauuccugaucuggccaguagaaggcuucggaucgcucuguuguacagccacucugagcucuccaacaaggcaaaagccuuugacggcgcuauacuguuccugucacaaaagcucgaagagaaaguuacagaguuaagcagugaaacccagcgcggcgagacuaucaagaugacaauuacccugaaacgagaacuuccaucuuccagccccgugugcauccaggucuuuaauauuaucuucagaaagauauugaagaaacugucgauguaucagauugggaggaacuuuuacaauccuucugagccaauggagaucccccaacauaagcuaucccucuggccuggauucgccauuucagugaguuauuuugaacggaaacugcuuuucagcgcggauguauccuacaagguucugcguaacgagacgguguuggaauuuaugacugcacucugucagcgcaccggucugucuugcuucacacagacuugugagaaacaguuaaucggccugaucguccucaccagauacaauaacaggacauauagcauugacgauauagacuggucagugaagccaacccacacguuccaaaaacgggaugggacugaaaucacauacguggacuauuacaagcagcaguaugacauuaccgucagugaucuuaaucaaccgaugcugguuuccuugcuaaagaaaaagcgaaacgacaacagcgaggcccagcuggcucaucucauccccgagcugugcuuucuuacuggacugacagaucaggccaccucugacuuccaguugaugaaagcaguggcugaaaagacgcgccucucaccuaguggcagacaacagaggcuggcccgguuaguagauaauauacagcgcaacaccaaugcgagauuugagcuggaaacauggggucuacacuucgggagccagauuucccucacuggaaggaucgugccaucugagaaaauccugaugcaagaccacauuugucagcccgucucggccgcagauuggagcaaggacauccguaccugcaagauucuuaacgcucaguccuugaauacauggcugauacucuguucagaucggacugaauacguggccgagaguuuucugaacugccuucgaagaguugcuggcucuaugggcuucaauguggacuauccuaaaaucauuaagguccaggagaacccagccgcauuugugagggccauccaacaguacguagaucccgacguucagcuggugauguguaucuugccgagcaaucagaaaaccuacuaugacuccauuaagaaauaccucucaagcgauugcccuguccccucucaaugcgugcuggcucgcacauuaaacaagcaggggaugaugauguccauagcgaccaagaucgcaaugcagaugacuuguaaacugggaggugaacuaugggccgucgagauuccacucaagagucugauggugguuggcaucgacgugugcaaagaugcucuuagcaaggacguaauggucgugggguguguugccucugugaauccucggauuacgagaugguucuccaggugcaucuugcaacgcacaaugaccgaugucgcagacugucugaaaguguuuaugacuggagcccucaacaagugguauaaguacaaucaugaucugcccgcucgaauaaucguauaucgggccggcgugggugacgggcaguuaaaaacccugauugaauacgagguuccacagcuuuugucaagugucgcagaaagcucguccaacacaucuagccgucucucagugaucguggucagaaagaaaugcaugcccagguucuuuaccgagaugaaucgcacuguucagaacccuccacugggcacagugguggauagugaggcgacgcggaacgaaugguaugacuucuaccuaauuucccaaguagcuuguagaggaaccgucucuccgacuuacuauaaugugaucuacgaugacaacggccugaagcccgaucacaugcagaggcucacauuuaaacugugccaucuuuauuacaauuggccugggauaguuagcgugccagcccccugucaguaugcacacaaguugaccuuccuggucgcccaguccauucacaaagagccuucauuagaacucgcuaaccaucuguucuaccuuuga

SEQ ID NO: 60746 - RNA, 1368 nt, Artificial Sequence
  derived and/or modified sequence opt3 from PJA1__Homo_sapiens__NP_071763
augggccaggagagcuccaagcccguguggccuaacccaaccgggggauaccaaucuaauacagguagaagguauggccggcgccacgccuacgucucauuccgaccgcccacgagucagcgugaaagaaucgcuagccagaggaaaacuaacuccgagguuccuaugcaucggucugcaccaucgcagaccacaaagcgcucaagaagccccuuuaguacuaccaggcgguccugggacgauucugaaagcuccgggacaaaucugaacauugacaaugaggauuauucaaguaccagccgcuggcgagacacugccaacgauaaugaaggacacucugacggccucgcgagaaggggucguggggaguccucaagcggauacccugagccaaaauaucccgaagauaagcgggaggcucgcagugaccaagugaaaccugaaaagguaccaagaaggcggcgaacaauggccgauccggacuucuggacccauucugaugacuacuauaaguacugcgaugaggacuccgacagcgauaaagaguggauagcagcccuucgcagaaaguacaggucgcgggaacagacgcugucuuccucaggcgagaguugggaaacuuugcccggcaaagaggaacgcgagccuccacaggcuaaggugagcgcauccaccgggacaucucccggaccuggugccagcgcuucagccggcgcgggggcaggagccagugcuggcuccaacgguagcaauuauuuagaggaagucagagagccaucucugcaggaggaacaagccucacuagaagagggggagauccccuggcuccaguaccacgaaaacgacaguagcuccgagggagauaaugacucuggccaugaacugaugcagccgggcguguuuaugcuugaugggaacaauaaccuggaggacgauucgagcguuuccgaagacuuggagguggauuggucacucuucgacggauuugcagauggucugggcgucgcugaggccauuaguuauguggacccucaguuccugacuuacauggcgcucgaagagagguuagcccaagcaauggaaaccgcucuggcccaccuugagucuuuggcuguagacguugagguggccaaucccccagcaagcaaagaauccaucgaugcccugccugagauucuagucacagaagaccacggggcugugggacaggagauguguugccccaucuguugcucagaauaugugaagggcgaggucgcgaccgagcucccaugucaucacuacuuucauaagcccugcguuagcauauggcugcagaaaucugguacguguccugugugccguuguauguucccaccgccccuuuga

SEQ ID NO: 60747 - RNA, 2127 nt, Artificial Sequence
  derived and/or modified sequence opt3 from PJA2__Homo_sapiens__NP_055634
augagccaguacaccgagaaggaacccgccgcuauggaccaagaguccggcaaagcaguguggccuaagccagccgggggauaucagacaaucacugguagaagguacggccggcgccacgcguaugucucuuucaaaccgugcaugacgcgacaugaacguucacuggggagagcuggagaugacuacgagguucucgaacuugaugacgugcccaaggagaacaguagcggcuccucuccucuggaucagguagacucgucauugccaagcgagcccauuuuugagaaaagugagaccgaaauaccuacaugugguuccgccuuaaaucagacuaccgagucuagccaauccuucguggcaguccaccauucagaggaagggagggauacacugggaaguagcaccaaccuacacaaucauucugagggcgaauauaucccaggcgccugcuccgcuucaagcgugcagaacgggauugcacucguucacacugacaguuacgaucccgacggaaagcacggugaggauaaugaccaucugcagcuuucugccgaaguggucgagggcucccgguaucaggagagccuggggaacacaguguuugaauuggagaaucgcgaagcugaggccuacaccggacucucgccuccaguaccgucuuucaacugugaaguuagagaugaguuugaggaacuggacuccgugccccuggucaagucaagugcgggcgacacggaguucgugcaccaaaauagccaggaaauccagagguccucucaggaugagauggugagcacuaaacaacagaacaauaccucacaggaacggcaaacagagcauaguccugaggacgcagccugcgguccagggcacauuuguuccgaacagaacacuaaugaucgcgagaagaaccacggaagcucucccgaacaggucguucgaccuaaagugagaaagcucaucucaaguagccagguagaccaagagaccggcuuuaauaggcaugaggcuaaacagcgguccgugcagcguuggcgcgaagccuuagaggucgaagagucuggcucggaugaccugcuuauaaagugcgaagaguacgauggggagcacgacuguauguucuuggauccacccuauagcagagugaucacacagagggaaaccgagaacaaccaaaugacguccgaaucaggagcaacugcuggucggcaggagguugacaauacauuuuggaacggcugcggggauuacuaucagcuguacgacaaggacgaagauaguucugaguguagcgacggagagugguccgccucacuaccgcaucgauucagcggcaccgaaaaagaucagucuuccagugacgagagcugggaaacucucccugguaaggaugagaaugaacccgagcugcaaucugacuccucagggccagaggaagagaaccaggaacuuagucugcaggagggcgagcagaccagcuuggaagagggagaaauuccuuggcuccaauauaaugaggugaacgaaucguccucugaugagggcaaugagcccgcgaacgaauuugcccagccagcauucaugcuggacgggaauaacaauuuagaggaugacagcucagucagugaagaucuggacguggauuggucccucuuugacggauucgcugacggucuuggcguagccgaggcuaucucuuacguugauccccaguuccugacauauauggccuuggaagaacgccuagcacaagccauggagacggcucuggcgcaccucgaaagccuggcaguggacgucgagguggccaacccuccagcuuccaaagaaucaauugaugggcuuccggagacccuggucuuggaagaccauacagccaucggacaggagcagugcugucccauaugcugcagcgaguacauuaaggaugacaucgcaacugaacucccuugucaccacuuuuuccauaaaccaugcgugaguauuuggcugcagaagucuggcaccugucccguuugcagaaggcacuuuccuccagccgugaucgaggcuuccgccgcacccagcucggaaccggauccugacgcgccacccucaaaugauucuaucgcugaggccccuuga

SEQ ID NO: 60748 - RNA, 12909 nt, Artificial Sequence
  derived and/or modified sequence opt3 from PKD1__Homo_sapiens__NP_000287
augcccccugccgcuccagcccgacuggcccucgcgcuuggccugggguugugguuaggagcucuggccgguggcccggggaggggaugcggccccugugagccuccaugccuauguggucccgccccuggggccgcuugccgggugaacuguagcggacgcggccuccgaacccugggcccagcacuucguauccccgccgacgcuaccgcccuggaugucucccacaauuugcucagggcgcuggacguugggcugcucgcaaacuuaucugcccuggcugaacuugauauuucaaauaacaaaauaagcacuuuggaggaaggaaucuucgccaaucuguuuaaccuaagcgagauuaaucucuccgguaacccuuucgaaugcgacuguggccuggcauggcuuccaaggugggcugaggagcaacaggugcggguagugcagccggaagccgcgacgugcgccgggcccggaucucuggcaggccagccuuugcucgguaucccacuguuagauucgggguguggagaggaauacgucgcuugccugcccgacaauucaagcggcaccguggccgcuguuaguuuuuccgccgcacaugagggccuccuucagccugaggccuguucugcuuucugcuuuagcacagggcagggacuggcggcauuguccgaacaggguuggugccuauguggcgccgcucagccaucaagugccagcuucgcaugccugucucucuguuccgggcccccgccucccccagccccuacuugccgcggacccacccugcuucagcacguguuuccagcuucacccggcgccacacuggucgguccucaugggccauuggcaagcggccagcucgcggcuuuccacauugccgcaccgcugcccgugaccgccacuagaugggauuuuggagacggcagugcugagguagaugccgcagggccugcugccucucauagguauguuuuaccaggacgguaccacgugacagcgguccuggcccuaggugcuggcuccgcacuccuggggaccgacgugcaaguggaagccgcucccgccgcacuugaguuggucuguccuagcucgguucagucugaugaaucccuggaccucucaauccagaaccgcggaggcaguggucuggaggcggccuauagcauaguggcucuuggggaggaaccagcccgagcaguacacccccugugcccguccgauacggagaucuucccuggcaauggacauuguuacagauugguggucgaaaaagcugccuggcuccaagcacaggagcagugccaagccugggcuggcgcggcccuggcaaugguggacucuccagcuguucagagguuuuuagugagccgggucacucguucacuggacguguggauuggguucaguaccguacagggaguugaagugggucccgccccucagggcgaggccuuuucccuagagagcugucaaaacuggcuccccggggaaccacacccugcuacagcagagcauugcguccgccugggacccacuggcugguguaauaccgaucuuugcucugccccacacucauaugugugcgaauugcagccgggugggccuguccaggacgcggagaaccugcucgugggcgcucccaguggagaucugcagggcccauuaacaccccuggcccaacaggacgggcuuagcgcaccucacgaaccaguugaggugaugguauuccccggauugagacucuccagggaggccuuccugaccacggcugaauuuggcacucaggagcuacggcgaccugcacagcugcgccuccaagucuacagacugcuuucuacagccgguaccccggaaaaugggucggagccagagagcaggucccccgauaaccggacucaguuggcgccugcuuguaugccaggaggccgcuggugccccggugccaacaucugucugccuuuagacgcaucaugccauccgcaggccugugcuaauggcugcacaagugggcccggacucccaggcgccccuuaugcacuguggagagaguuccuauuuucugugcccgcugggccuccagcacaguacagcguuacccugcacggacaagauguguugaugcuccccggcgaccuggucggucuacagcaugaugcggggccaggagcccugcuccacuguuccccggcaccuggccaucccgguccacaggcucccuaccugucagccaacgcuagcucuuggcuuccucacuugccagcacaacuggagggcacgugggccugccccgccugugcuuuaaggcuccuggcggcaaccgaacagcuuacagugcugcuagggcuccguccuaauccgggacugcgguugccaggccgauaugagguaagagccgaaguggggaacggaguuuccaggcacaaucugaguugcagcuucgacgucgugucucccguggcuggcuuacgcgucauuuacccugcaccccgggaugguagacucuauguuccaacuaacggguccgcacuggugcuucagguggacucaggagccaaugcuaccgcgacagccagguggccuggcgguaguguaagcgcacgcuuugagaacgucugucccgcucugguggccacuuucguuccaggcugcccuugggagaccaaugacacauuguuuucgguggucgcacucccguggcuguccgaaggggagcaugugguugaugugguagucgaaaacucugccagccgagcuaaucuaucacugcgggugaccgccgaggaacccaucugcggacuucgugcgacuccaaguccugaggcaagagugcuccagggcguccugguuagguacucccccgugguagaggccgggucugacaugguguuccgcuggacgauaaacgauaagcagagcuugacauuucagaaugucguguucaacguuauuuaucaguccgcugccguguuuaaacugucauuaaccgcuagcaaucacgucaguaacgugacuguuaacuacaaugugaccgucgaacggaugaacagaaugcagggacuccaaguaucuacagugccagcaguucuguccccuaaugccacccuugcucugacugccggcguguuggucgacagcgcaguggagguagcguuccucuggacauuuggugauggggaacaggcccugcaucaguuccagcccccguauaacgagucguucccagugccugaccccucagucgcucaaguucuaguggaacacaaugugaugcacacguacgccgcaccaggagaguaccugcuuaccguccucgcuucuaacgccuuugagaaucugacucaacaggugcccguuaguguaagggcauccuugccuagcguggccgucggcgugucugauggcguuuuaguggcugggcgaccggucacauucuauccccauccacugccuagccccggaggugugcucuacaccugggacuuuggcgauggguccccuguacugacacaaucacagccagcggccaaccacacuuaugcaagucgcggaaccuaccauguccggcuugaagugaauaacacgguuagcggcgcugccgcccaggcagacgugagagucuucgaggaacugagggguuugucuguggauaugucccuagcuguugagcagggggcccccguggucgugucagcggcuguacaaaccggagacaauaucacauggacuuuugauaugggcgacggcaccgugcugagugggccugaggccacaguugaacacgucuaucuccgugcacagaacuguacugugaccgugggagccgcuagcccagcaggucaucuggcccgcucccuucacgucuuaguauucgugcuggagguucuccggguggaacccgcggcuugcauuccgacgcagccugacgccagauugacagcauacgucaccggcaauccagcccacuaucuguuugauuggacuuucggggacggaucuucgaacacaaccgugaggggcugucccacuguuacccauaauuuuacacgaagcgguacguucccucucgcucuggugcuuucaucccgggucaaccgcgcccacuacuuuaccaguaucugcguggagccagaaguagggaacgugacucugcagcccgagagacaauucguucaguugggagaugaggcauggcuagucgcuugugccuggccgccuuuucccuacagguauacaugggacuucggcaccgaagaggcggccccaacacgggcacgaggcccugaagugacuuucaucuacagagaucccgggucuuaucuggugaccgucacggcuagcaauaacauuuccgccgcaaaugacucagcucucguugaggugcaggaaccaguauuagugacaucuauaaaggucaacggaagccugggucuugagcugcagcaacccuaccucuuuagugccgugggccgcgggaggccugccuccuauuugugggaucugggagacggcgguuggcucgaggggccagaaguuacccaugcguacaauagcacuggagauuucaccgugcgugucgcuggcuggaacgagguaucucggucagaagcauggcugaaugugacaguuaaaagaagggugcgcggccuugucgugaacgccucccgaacugucgugccgcuaaaugggaguguuagcuuuucgaccucucuggaggcuggauccgacgugagauauagcuggguauugugcgaucgguguacacccaucccugguggcccaacgauuucauacaccuucaggaguguggggacuuuuaacaucauagucacagccgaaaaugagguuggaucugcacaggacuccauuuucguguacgucuuacagcugaucgagggccuccaggugguaggugggggacgcuauuuucccaccaaccacacugugcaacugcaggccguugugcgugauggcacaaaugucagcuacucauggaccgcuuggagagaccggggcccugcgcuugccgggaguggaaaggguuucagccugacggugcucgaagcaggcacuuaucauguccaguugagggcuaccaacaugcugggguccgccugggcagacugcacaauggauuuuguggagccaguuggauggcuaaugguagccgcuucucccaauccugccgcggugaacaccagcgucacucuguccgcagaacucgccggcgguucaggggugguuuacacauggucucuugaggagggccugaguugggaaaccucggagccguucacaacucacagcuuuccaacccccggauuacacuuggugacgaugacagcuggcaacccucugggguccgccaaugcaaccgucgaaguggacguacaagugcccguuucuggacucucaauccgcgcuagcgagccagguggcuccuucgucgccgcugggaguucugugccuuucuggggacagcuggccacuggcaccaacgugagcugguguugggcaguccccggugggucauccaagcgaggcccacauguuacaaugguguuuccggaugcgggaacuuucaguauuagacuuaaugccagcaacgcuguaucuuggguguccgccaccuauaaucugacggcagaggaaccuaucgucggccucguguugugggcuucaagcaaaguuguggcccccgggcagcugguccacuuucagauuuuacuagcagccggaucggcggugacauuccggcugcaaguagguggcgcuaacccagagguucuccccgggccuagguuuucucauaguuucccacgcgugggagaccacgucguguccgugagaggcaagaaucacgucagcugggcccaggcacagguuaggauagugguacuugaagccgugucaggucugcagguccccaacugcugugagccugggaucgcuaccggcacugaacggaauuuuacagcccgugugcaacgcggaucccgaguugcauacgcuugguauuucucuuugcagaaagugcagggcgauagccuggucauucucagugggagagacgugaccuacacuccgguagccgcgggacugcuugagauccagguuagggcuuuuaacgcccucggcuccgaaaaucggacacugguguuggagguccaagaugcagugcaguacguugcccugcagagcgguccaugcuucaccaaccgcucugcucaauuugaggcagccacgucacccaguccuagaaggguggcguaucauugggacuucggggauggauccccaggccaggacacugaugaaccccgggccgagcacagcuacuuacgaccuggugacuauagaguccaggugaaugcuucuaaccuaguaucguuuuucguggcacaggccaccgucacaguucaagugcuggcuugccgcgaacccgaggucgacgugguacucccacuucaggugcugaugaggcggucacagcguaauuacuuggaagcccauguugaucugagagacugugugaccuaucagacagaguacaggugggaggucuaucgcacugcaagcugccaacggccgggccgaccugcuagaguggcccuccccgggguugaugucuccaggccacgccuggugcuuccucgguuagcgcugcccgugggacacuacuguuucguauuugucgugaguuucggcgacaccccacucacgcagucuauccaggccaacguuacaguggcaccugaaagauugguccccauuauagaagggggcagcuaccgugugugguccgauacuagggaccugguucuagauggcucagaaaguuaugacccgaaucuggaggauggugaccagaccccacucucuuuucauugggcuugcguggccagcacacaacgggaggcagggggaugugcccuuaacuucggcccucgcgguuccucaaccguaacuaucccccgagaaagacuggcugccggcgucgaguacaccuuuagcuugacaguguggaaggcggggaggaaagaagaggcuacgaaccagacugugcugauucggucuggacgcguuccaaucgucucccucgaaugcgugaguuguaaggcacaggccguauaugaggugagcagaucguccuacgucuaucuggagggaaggugcuuaaauuguucuucagggagcaagcgaggacggugggcugcccguaccuucaguaacaaaacacuugugcuggaugaaaccacuacauccaccggcucugcagguaugagacucguucuacgcagaggggugcugcgggacggagagggcuacacguuuacuuugacaguccugggcagaagcggggaagaggaaggaugcgccucaauucgccucucccccaauaggccuccgcuugguggcaguugucgacuguucccauugggggcugugcacgcgcugaccaccaagguucacuuugagugcacuggauggcaugaugccgaggacgcaggcgcaccccucguguaugcuuuacugcuucggagaugcaggcagggucacugugaagaguucugcguauacaaagggagccugucuucauacggagcaguccuaccucccggcuuucgcccacauuucgaagugggccucgccguugugguccaagaccagcugggggcugccgugguagcguugaaccguucccuggcaaucacacucccugagcccaauggaagcgccaccggucuuacaguguggcugcacggcuuaacugcuucuguccugccaggguugcuccggcaggccgauccucaacacguuauagaauauagucuggcccuugugacggugcuuaacgaguacgagagagcucuggacgucgccgcggaaccgaagcaugagaggcagcaccgcgcccagauccggaaaaauauuaccgaaacacucgugucgcugagaguucauacuguagaugacauccagcaaauugcugcagccuuggcucaguguaugggacccuccagagagcuggugugcaggagcugucucaagcagacccuucacaaacuggaggcaaugauguuaauccugcaggccgaaacaaccgcuggcacugucacgccaaccgccauaggugauucaauuuugaacaucacaggggaccucauucaucuggcaucuagcgaugugcgcgccccucaacccuccgagcuaggagcggaaaguccaucaagaaugguugcuucucaggccuauaaucuuacuagcgcacugaugcggauccucaugaggucccgugugcugaacgaggaaccuuugaccuuagccggcgaggagauagucgcucagggcaagcgaagugacccccgcagccugcucugcuacgggggagccccggguccaggcugucacuuuuccaucccugaagcauucucuggggcucuugccaaucugucagaugugguacagcuaauuuuccugguggacagcaaccccuuuccauucggauauaucucgaauuacacagucuccaccaagguugcgaguauggcauuucaaacucaggccggcgcucagauucccaucgagagacucgccucugaacgggcuauaacagugaaagucccuaacaauagcgauugggcagccaggggucaccgcucauccgcgaacucugccaacagugugguugugcaaccccaggcuagcguaggggcaguggucacguuggacuccucaaauccagccgcuggacugcaucuucagcugaacuauacccucuuagauggccacuaccugagcgaggaaccugagccguacuuggccguguaucugcauucugagcccagaccaaaugaacacaacugcagugcaucccggaggauucgaccugagagccuccagggcgccgaccaccgucccuacacuuucuuuaucucaccagggucuagagacccugcuggauccuaucaucuuaaucugucgagccacuuccgcuggagugcgcuacaaguuucugucggucuguacacaucccucugucaguauuuuagcgaagaggauaugguguggcggaccgaaggcuugcugccccuugaggagaccucaccgaggcaggccgugugccugacaagacauuuaacugcauucggggcuagucucuuuguaccuccaucccacguccgcuucguguuucccgaaccuacggccgacguuaacuacaucgugaugcugaccugugcagucugcuuggugacauauaugguuauggccgcuauucugcauaagcucgaucagcuugacgcgagccggggaagggccaucccauucugcggccaacgagguagauuuaaauacgagauucuggugaagacuggguggggacggggcucuggcaccacagcacacgucgggauaaugcuauacggaguggauucaaggagcggucaccgccaucuggacggcgaucgugcuuuccacagaaauucccucgacaucuuccgaauugccacaccccauucuuuggggaguguauggaaaaucaggguguggcacgauaacaagggacugucgccugccugguuuuuacagcauguuauuguccgggaccuucagacugcucgcagcgcauucuuucuggugaaugauuggcucuccguggaaacggaggccaacggcggucuggucgagaaggaaguuuuggcugcgucagacgccgcacugcucagauucaggcggcuucugguggccgagcuacagcgcggguuuuucgacaaacacaucuggcugucuauaugggauagaccaccccgaagcagguuuacacggauccaacgugcuaccuguugcguauuacucauuugucuguucuugggagcaaaugccgugugguauggcgcugucggcgacagugccuacuccacugggcacgugucacgccuuucuccgcugagcguugauaccguggcagucggacucguauccagugugguuguguauccugucuaccuggcgaucuuguuucuguucagaaugagcaggucuaagguggccgguucacccuccccaacacccgcuggccaacaggugcuagacauugauagcugccucgacaguucuguccuugauuccucguuucugacuuucagcggguuacaugccgaagcauuuguuggacaaaugaaaucagaccuguuccucgaugacuccaagucucugguguguuggccuaguggcgaggguaccuugagcuggccagaucuucugucagaccccuccaucguagggagcaaccuccggcagcuggcuagaggccaggccggacacggccuagggccugaagaggauggauucucuuuggcgaguccauauuccccggccaagagcuuuucagcuucugacgaggaccugauacagcaagugcucgcagaaggugucucgagccccgccccuacacaggauacgcauauggagaccgaccuucuguccaguuuaucuucaacuccaggcgaaaagacagagacccuggcucuccagcgccugggggaauugggacccccuagcccaggccuuaauugggagcagccccaagcagcccgacuguccaggacuggucucguugaggggcugcggaagagacuauuaccggccuggugcgcuagucuggcacacggcuugucucuccugcuuguggccguggcggucgcuguaagcggaugggugggcgccuccuucccuccagggguuucaguggcauggcugcucaguucuuccgccaguuuucuggcuucauucuugggaugggaaccccuuaaaguccugcuagaggcccucuacuuuagccugguggcaaagcguuuacacccugaugaagacgauacacugguugagucgcccgcugugaccccagucuccgcccgcguaccgagggugcggccuccccaugguuucgcguuguuucucgcaaaagaagaggccagaaaggucaaacgacugcacggcaugcuuaggucucugcucguguauauguuguuccugcuuguuacgcuguuagcuaguuacggggacgccagcugucauggacacgcuuaccgccuacagucagcaauuaagcaggagcuccauucccgggccuuucuggcgaucaccagaucugaggagcuguggccauggauggcccacguguugcuccccuauguccacggcaaccagagcaguccugaacuggguccacccaggcuucgccaagugcgucugcaggaggcuuuauacccugauccaccgggcccccggguacauacaugcuccgcagccgggggauucagcacuucugacuaugaugugggcugggagucaccucacaauggguccggaaccugggcuuacagcgccccagaccuccugggcgcauggaguugggguucuugugccguuuaugauucagggggauacgugcaggaauugggccuuucccuggaggaaagcagagaccgacuaagguuucuccagcugcauaacuggcuggacaaccgcucgcgggcugucuucuuggagcucacaagauauucucccgcggugggucugcacgccgcaguuacucuuaggcuggaauuuccugcugccggccgcgcauuagccgcucucagugucagaccauucgcgcugcggcgacuauccgccggguugagccugccccuucucaccucagugugccugcuguuguucgcaguacacuuugcuguggccgaggccaggacauggcaucgugagggaagauggcggguccuucgccucggcgcuugggcaagguggcuguuaguggcccugaccgcggcuacugcccuaguucgacucgcacaacugggggccgcugauagacaguggacgcgguucgugcgcggaaggccuagacgguuuacaucuuucgaccaggucgcacaauugagcuccgccgcucguggccuggccgcgagucuucucuuucuguuacuggugaaggcagcccagcaguugcgcuucguaaggcaguggucaguuuuugguaaaacccucugucgagcucugccggaacuucugggggugacucuaggacucgucgugcugggcguggccuacgcacaauuggcuauccugcuuguuagcuccugcgucgauucucucuggaguguggcccaggcgcuguuaguacugugucccgguaccggcuugagcacacucugcccagccgaguccuggcaccugucaccucuucugugcguggggcuaugggcacucagacuguggggagcuuugcggcugggcgccgucauucuuagguggcgcuaccaugcuuuaagaggggaacuguaucggcccgcaugggagccacaggacuacgaaaugguggaacucuuccugaggcgccuacgauuguggaugggacugucuaagguuaaagaguuuagacacaaggugcguuucgaaggcauggagccucuccccucgcggagcuccagggguaguaaagucucuccagaugugccgccucccagcgccgggucagacgccucccauccaagcacgucuaguucccagcuugauggacugucaguaagccucggccgccugggcaccagaugugaacccgagccuucucgguuacaagcuguuuuugaagcauugcugacucaguucgacaggcuuaaucaggccacagaggauguguaucagcuggagcaacagcuccacucgcugcaggggcgaagauccagucgcgcgccagcuggaagcucacggggucccucuccuggccuaaggccggcccuucccucccgucuggcaagagccagccgcggggucgaccucgcuaccggaccaaguaggacuccuuugcgggccaagaacaaagugcaccccucauccacauga

SEQ ID NO: 60749 - RNA, 8550 nt, Artificial Sequence
  derived and/or modified sequence opt3 from PKD1L1__Homo_sapiens__NP_612152
auggccgaagaagcugcacagaauaucagcgacgaccaagaacggugccugcaggccgcguguugccucuccuucggaggggaacuuucugugucaaccgacaagaguuggggacugcacuuguguagcugcucucccccugguggcggguuaugggucgaaguuuacgcuaaucacgugcuguugaugagcgauggaaaauguggcugcccauggugugcccucaacgguaaggcagaagacagggaaucgcagucaccgagcaguuccgccucucggcagaaaaauauuuggaagacaacuagcgaagcugcacuguccguagugaacgagaagacgcaagccgucgugaaugagaagacccaggcuccccuugauugcgacaacucagccgaucgcauaccucacaagccauuuaucauuaucgcgcgagcauggaguagcgggggaccccguuuccaccacagaaggcugugugccacaggcacugcugacucuaccuuuuccgccuugcuccagcugcagggcacaaccucagcagcugccccuugcagccugaaaauggaagcgaguuguugcguucuccgguuacugugcugugccgaggauguggcaacugggcuuuugccaggaacagucaccauggagacgcccacuaagguggcucgcccuacccaaacaucuucccagagaguaccacuguggccgauuagccauuuccccacuucgccuaggucuucccacggucuaccacccggcaucccucggaccccaucauuuacagccagucagagcggguccgaaauccucuaucccccgacccagcacccucccguugcuauccuggcccgcaauucugacaacuucaugaauccagugcuuaacugcagccuggaggucgaagcacgagccccucccaauuugggauuuagagugcauauggcuucaggcgaggcgcucugucugaugauggauuucggugacaguuccgggguggaaaugagguuacacaacaugagcgaggcaauggccgucacggcuuaccaucaauauucuaaaggaauauuuuuccaucugcuccacuuucagcuugauaugucaacuuacaaggaggccgaaacacagaauaccacucugaacguuuauuugugccaaagugagaauagcugucuagaagacuccgacccaucuaaccugggcuacgagcucaucucggcauucgugacaaaaggcguauauaugcugaaggccgugauuuacaacgaauuucaugggaccgaggucgagcuuggacccuacuauguggaaaucggucacgaggcuguuagcgccuucaugaacuccucaagugugcaugaagaugagguccugguguucgcagacucucagguaaaccagaaguccacgguugugauacaccauuuuccuuccauuccaucauacaaugucagcuucaucucucagacccaagugggcgauucccaggcguggcacaguaugacagucugguauaaaaugcagagcgugucuguuuacacuaacgggaccguguuugcuacagacacugauauuaccuucacagccguaaccaaggaaacuaucccguuggaguuugagugguauuucggagaagaucccccuguccggacgacaucccguucaaucaaaaagcgccucaguauuccacagugguacagagugaugguuaaagcaagcaauaggaugucguccguggucucugagccccacgugauucggguacaaaagaaaaucguggccaaccgacugaccagcccuucaagugcuuuaguuaaugccuccgucgcauuugaaugcuggauuaacuucggcacugauguggcuuaucugugggacuuuggugaugggaccgugucucuaggcagcuccucaagcagucaugucuacucucgcgagggagaguucacaguugaagugcucgccuuuaauaacguguccgcgagcacccugagacagcagcuuuucaucguaugugagccaugccagcccccguuggucaagaauaugggcccugggaaggugcaaauauggaggucgcagccaguucggcugggagugacuuuugaagccgcugucuucugugacauuucacagggucucucuuacacauggaaccugauggauagugagggccuucccgugucccugccugcagccguugacacgcaccgccagaccuugauccuccccagccauacucuggaauaugggaauuacacagcuuuagccaaagugcaaaucgagggaucuguagucuauagcaacuacugcgugggccuggaggugagagcacaggcgccagucuccguuauuucagaagguacccaccuauucuuuaguaggacaacuagcucuccuaucgugcuccgugggacccaguccuucgaccccgaugacccaggcgccacgcugcgguaucacugggagugugcuaccgccggaucaccggcacauccuugcuuugauaguagcacagcucaccaacuugacgccgcagcccccacuguauccuucgaagcucagugguugucugauucguacgaccaguuucuggugaugcuccgagucagcucaggcgggagaaauuccagugagaccaggguguuccugucuccauaucccgauagcgcguuucgcuucguucauauuuccugggugucauuuaaggacacauucgucaacuggaacgaugaauuaucucugcaggccaugugcgaggacuguagcgagauaccuaaucuuaguuacuccugggauuuguuucucgugaacgcaacugagaaaaaucggaucgagguuccauucugcagaguggucggacugcuagguagccugggccucggggcuauuucugaaucaucccaacugaaccuuuugcccaccgagccuggaacggccgacccggaugccacaaccacuccauuuaguagggaacccagcccuguaacacugggccagccagcuaccucggcaccccgcgguacuccuaccgagccgaugacagggguguacuggauacccccagccggcgacucugcgguuuuaggagaggcuccugaagagggcucccucgaccuggaacccgggccacagagcaagggaucacuuaugacgggccgaagugagcggucucagccuacccacucccccgauccacaucugagcgacuucgaggccuauuacucagauauccaagaagcaauuccgaguggugggcgucagccugccaaagacacuagcuuccccggauccggcccaucuuugagcgcugaggaaucccccggugauggcgacaaucucguggauccuucacugucugcagggagagccgagccaguccuaaugauagacuggcccaaggcgcugcucggaagggcuguguuucagggcuauaguucgagcgggaucacagaacagaccguaacaauuaagccuuacucccugucuucaggagagacuuaugugcuucaagucagcguugccuccaaacacggcuugcuggguaaggcacaguuauaccucaccgugaacccggccccacgcgauauggcuugucaggugcaaccccaccaugggcuggaggcccacacggucuucaguguguuuugcaugucuggaaaaccugacuuccauuaugaauuuagcuaccagaucggcaauacaucaaagcacacccuuuaccauggucgggauacucaguauuacuucguucugcccgcaggcgagcaccuagacaacuauaaaguaaugguguccaccgaaauuacagaugggaagggaaguaagguccagccauguacugugguugugaccguccucccuagauaccacggcaaugacugccugggggaggacuuguauaacagcucucugaaaaauuuauccacacuccaacugaugggaucauacacggaaaucaggaacuauauaaccgugaucacucgcauucuuagcagacugucgaaggaggauaaaacagcuucuuguaaucaguggagucggauccaggacgccuugauuuccagcguaugcagacucgcguuugucgaucaggaggaaaugaucggcucagugcugaugcuaagggaccugguuuccuucucuaacaaacuugguuuuaugagcgccgugcucauacugaaauacacccgugcauugcuggcucaagggcaguucaguggacccuuugucauugauaagggcgugcgcuuagagcucaucggucugauuucccggguuugggaagugagcgagcaggaaaauucuaaggaggaggucuacagacaugaagagggcaucacugugauaucagaccuucuguuggggugucucagucugaaccacguauccacaggacagauggaguucaggacccuacugcauuauaaccuucaaagcucugugcagucgcucggcucaguucagguccaucugccaggggauuuggccggacacagcccugcuggcgcagagacgcaguccccgugcuacaucagucaauuaauucuguucaaaaagaaucccuauccagguucucaggccccugggcagaucggaggcguggugggccucaaccuguacacuuguagcucccgacggcccauuaaucgccaauggcuuagaaaaccagucaugguagaguuuggggaagaggacggacuggauaacaggcggaauaagaccacauucguguugcuacgagacaaaguuaaccugcaucaguuuaccgaacucucagagaauccucaggaaagucugcagaucgagauagaguucucuaagcccgugacuagagccuuuccggucaugcuuuuagugcgcuucagcgaaaaaccaacaccuuccgauuuucugguuaagcaaauuuauuucugggacgagucaaucgugcagaucuacauucccgcugcgagccagaaggacgcaucugucgguuaucucuccuugcuggaugccgacuacgauaggaaaccacccaaccguuaccucgcuaaggccgugaauuauaccguacacuuucaguggauccggugccuguucugggacaaaagagaauggaagagugagagguuuagcccucaaccgggcacaucgcccgaaaaagugaacugcuccuaccaucgccuugcagccuucgcucuguugcgaagaaagcuaaaggcgucuuuugagguuucagauauuagcaaacugcagagucacccagagaaucucuuaccuuccauauucaucauggggucugucauucuguauggauuccuuguggccaagagcagacagguggaccaucacgagaaaaagaaagcaggcuacaucuuucugcaggaggcuucacuccccggucaccaauuguaugccgucguuauugauacuggguucagggccccugcacgccugaccuccaagguguacaucguacucuguggagacaacggccugagugaaacgaaggagcuuagcugcccagaaaaaccccuauuugagcguaauucuagacauacauucauacugucagcuccugcccaguugggcuuacugcggaagaucaggcucuggcacgauucccgcgggccaagccccggaugguuuauuucucaugugauggucaaagagcugcacaccggucagggcugguucuuuccggcgcaauguuggcuuagugcagggcgacacgacggaagaguggaacgggagcugacuugccuccagggcgguuugggguucaggaagcuguuuuauuguaaauucaccgaauaccuagaggauuuucauguuuggcugucgguguacucccgcccuagcucaucuagauaucuccacacaccaaggcuuacugucagcuucucccuguuaugcguauacgccuguuugaccgcucugguggccgcuggaggccaggagcagccccaucucgacguuaguccuacgcugggcucauuucggguggggcuucugugcacacucuuggcaucuccaggagcccaacuguuaagccuacuguuccgucucuccaaggaagcucccgguagugcccgcgucgagccgcacagcccucuucgaggcggggcacagaccgaagcgccccauggaccaaacuccuggggcagaaucccugaugcccaggagcccaggaagcagccagcuucugccauucugucagguagcgggcgggcacaacgcaaagcugccucggacaauggaacugcaugucccgccccuaagcuacaggugcacggcgcugaccacuccagaacaagucugaugggcaaaucucauugcuguccaccgcacacccaggcgcccagcucagggcucgaaggacugaugccucagugguccagggcccuucaaccaugguggucuagugcagucugggcuaucugcgguacugccagccucgccugcucccugggcacaggguucuuggcauaucgguuuggacaggagcagugugugcaguggcugcauuuacuaucacugagcguugugugcuguauauucauuacccaaccccucaugguaugccuuauggcucugggcuuugccuggaagcgacgagcggauaaccacuucuuuacggagucuuugugugaagcuacucgcgaccuggauagugagcucgccgaaagguccuggacccggcugccuuucagcucaucuugcuccaucccagacugugccggugaaguggaaaaaguccuugcagcucgucagcaggcaagacacuuaaggugggcccaucccccuucgaaggcgcaacugcgcgggacacggcagcgaaugagaagggagagccgcacccgggcugcccucagagauaucaguauggacauuuugaugcugcuacugcuccuuugcguuauauacggacguuuuucucaggaugaguauucccugaaccaggcaaucaggaaagaguucacacggaaugcccgcaacuguuugggcggccugcgaaauauugcugacuggugggauuggagccucacuacccuguuagacgggcuuuacccgggagguacgccaucagccagagugcccggcgcacaaccuggggcucugggaggcaagugcuaucucaucgguaguuccgucauuaggcagcuaaagguguuuccccggcaccuguguaaaccaccucgccccuucagcgccuugaucgaggauucuauaccaacaugcucaccggaaguagggggcccugagaaccccuaccugaucgacccagaaaaucagaacgugacucucaauggacccggcgggugcggaaccagagaggauuguguucuuagccuggguaggacacgaaccgaggcgcauacugccuugucccggcugcgugcaucuauguggauugacagaaguacccgcgcugugucgguccacuuuacacucuacaacccuccaacgcaguuauucacuagcgugucccugagggucgaaauccuucccaccggcucacuggugccuucuagccuaguugagaguuuuuccauuuuccggucagacucugcccuccaauaucaucugauguugccgcagcugguauuccucgcacuuagccugauccacuuaugcgugcagcuguacagaaugauggauaagggggucuuguccuauuggcgcaaaccaaggaauuggcucgaacugagugugguuggagugagccuaacauacuaugcugucucuggccaccuugugacccuggccggugacguaacuaaccaguuucaucgagggcucugucgggccuucauggaucugacauugauggcgucauggaaucaaagagcuagguggcugcgcggcauacuccuuuuucuguucaccuuaaagugcguguaccugcccggcauucagaacacgauggcauccuguagcaguaugaugcgucacucuuugccuuccaucuuuguugccggccucgucggggcucugaugcuagccgcacuuucgcaucugcaccgguuccuccugagcauguggguguugccacccggaacuuuuacagacgccuucccugguuuacuguuucauuuccccagaaggucacagaaagauugccuccuuggccuguccaagucugaccaacgcgcuauggcguguuauuuugggauccuacugauugugagugccacccucugcuucggaauguugcgaggcuuucugaugacccuuccacagaagcggaaauccuuccagucaaaguccuucgucagacugaaagauguuacugcauacaugugggagaaggugcucacauuuuuaaggcuggagaccccgaaauuggaagaggcugaaaugguagagaaucacaacuacuaucuggacgaguucgccaaucuccuugaugagcugcuaaugaagaucaacggucugagcgacucucuccaguugccucugcuugagaagacaaguaauaacacuggggaagcacgcacggaggaaagcccccugguggauauaagcucauaccaagccgcugagccagccgacauuaaagacuuuuga

SEQ ID NO: 60750 - RNA, 2976 nt, Artificial Sequence
  derived and/or modified sequence opt3 from PKD1L2__Homo_sapiens__NP_001070248
augagcgccgugggccugguccuccuuguucuggcuuugagauuaagggcaaccacagugaagcccgaggaaggguccuucugcucuaacucacagguagccuuucgggacgcguguuacgaguucgugccucugggacgcacuuuucgagaugcucaaaguuggugcgaaggucagggcgggcaccuagucuucauccaggacgagggaacgcagugguuucuccaaaaacauauuagccaggaucgugaaugguggauaggccugaccuggaaucuugccagaaacgguacaacugaggggccaggaaccuggcuggacacauccaaugugaccuauucuaacuggcacggcggccaggcagccgcugcaccggauacuugugggcauaucggaaggggucccucgucagaguggguuacaagcgacugcgcccagaccuucgcuuuuaugugugaguuccgggugggccaaaguuuggccugcgaggggcucaaugcgacgguccacuguggacugggccaggugauucagguacaggaugcaguuuacggucgccaaaacccucauuuuugcacucaggacgccgggagaccauccgaucuggaacagggauguucuugggcuaaugugaaggaggaggucgccggccaaugccaggaacuccagagcugucagguggcagcugacgagaccuauuucggcaacuuaugccccacacaaggguccuaccugugggugcaguaucagugcagggaagcccuucaguugauggucucaagugagagcuuuaucuucgauaauguuacuauuucucugaccuggcuacucuccccuuacaucggaaaccugucauguauaaucagcacaggugacagucacaccuuugauccauauaaucccccuucuguguccagcaacguaacgcaccaauucacuucgccaggcgaguucacaguguuugcggaaugcaccacuucugaguggcaugucacagcccagcgccaggugaccguucgggacaaaauggaaacgcuuuccgugaccgcauguucagggcugagucagagcggagcuggcccguugugccaagccgucuucggugacccccucuggauucagguggagcuggaugggggcacaggaguaacuuacaccguuuuacugggcgacaucacacucgcugaauccacuacccagaaggggucucuuccuuacaaucugauuuuggaucgagagacacagaaacuaaugggaccagguagacacaggcuggaaauccaagccaccggcaacacuacgacaagcaccauaucacggaauauuacugugcaucucgucgagcugcuuagugggcugcaggcauccugggccagcgaccacuuggagcucggacaggaucuguuaaucaccauuucucuggcucaaggcacacccgaagaacuaaccuuugaaguggcgggucucaacgcaacuuucucacacgagcaggucaguuuuggggaaccuuucggcaucugucgucuggccgugccaguugagggaacauuucuugugacgauguugguacgcaacgcuuucagcaaucugucccucgagaucggcaacauuaccauaacugcccccucugggcugcaggaaccgucgggaaugaaugcagaggguaagagcaaggacaaaggcgauauggaagucuauauccagccugggcccuacguggacccauuuacaaccguuacacuuggauggccugauaacgacaaggagcugagauuccaaugguccugcggcucauguugggccuuguggaguucuugcguggagaggcagcuccugcggacugaucagcgagaauuagucgugcccgcuagcugucugccacccccugacuccgccguaacccuacgccucgcagugcugagaggucaggagcuugaaaauagggcggagcaaugcuuguauguuucagcuccaugggaacugcggccgcgcgucagcugugagagaaacugcaggcccgugaaugccucuaaagacauucuccugcgugugacgaugggggaggauuccccugucgcaauguuuaguugguacuuagacaacaccccaacagaacaggccgagccccugcuugaugcuugccgguugcgaggcuucuggccuagaagccucacucugcuacagucuaauaccuccacacugcuccugaacucaaguuuucuucagagcaggggagaaguuauccgcauacgggccacugcauugaccagacaugcuuauggcgaggacacguacgugauuucgacagugccacccagggaaguaccggccuguaccaucgcgccugaggaggggacuguccugacauccuucgccaucuucugcaaugcuucuaccgcauuaggaccacucgaauuuuguuucugccuggagagcggcucaugucuucacugcggucccgaaccugcccugcccaguguguauuugccacucggggaggaaaacaaugauuuuguucugacuguggucauuuccgcuaccaaccgcgccggagacacacaacagacgcaggcaauggcgaagguggcccuaggcgauaccuguguugaggacguggcuuuccaagccgcaguaucugagaaaaucccuacugcucugcagggugaaggcgggcccgagcagcuccugcagcuugccaaggcagucagcuccauguugaaucaagaacaugagucacagggaagcggccagagucugucuauugaugugcgacagaaggugcgggagcacgucuuagggucccucagcgccguuacaaccggacuggaagacgugcaacguguacaggagcuugcugaagugcugagagaggucacaugcaggucgaaagaacuaacuccaucagcgcagggcucuuguaugggugauaguugggagggggccccgccugcagcucaugugucccacgcccgcuga

SEQ ID NO: 60751 - RNA, 5199 nt, Artificial Sequence
  derived and/or modified sequence opt3 from PKD1L3__Homo_sapiens__NP_853514
auguucuuuaagggcgggagcuggcuguggcucuacauccgaacauccauuauacuugggucugagcugaacucacccgccccucacggucagaauaacugcuaucaauugaauagguuccagugcaguuuugaagaggcucagcauuacugccacgugcagcggggcuucuuagcacauaucuggaacaaagaaguccaagaccugauucgcgauuaucuagaggaagggaagaaaugguggaucggacagaauguuaugccacucaagaaacaccaggacaacaaguacccggccgauguggcggcuaauggacccccuaagccacugagcuguacauaucuuucccgaaacuuuauucguaucucuucgaaaggugacaagugccuguugaaauacuauuucauaugucagacuggggauuuucucgacggagaugcccauuacgagagaaauggcaacaauucacaccuguaccaaaggcacaagaaaacgaagcggggcguagcaaucgcccgcgacaagaugcccccugggccaggacaucugcccaccacaugccacuauccucucccagcucauuuaagcaaaacucugugucacccgauuagucaguuccccuccgugcuuucuagcaucaccucccaggucacaucagcagccagugagccuagcucucagccauugcccgugauuacccaacugacuaugccuguuuccgugacacacgcuggucagucacuagccgaaaccacgagcaguccaaaggaggaaggccaucccaacacuuuuaccucuuaccuccaggucucccugcaaaaagcgagcggacaggugaucgaugagauagcaggaaauuucucgagagccguacacggccuucaggcucugaacaaguugcaggaggccugcgaauuucuccaaaaacugacagcauuaacuccgagguucucuaagccugcucagguuaaucugauuaacucccucaucuaucuuucagaggaacuguugcggauucccuuucagaacaauaacagucuagguuucaaagugccaccuaccgucugucccuuccauagccugaauaacgugacaaaggccggggagggauccuggcucgaaucuaagcgccacaccgagccaguggaggacauccuggaaaugagccuugucgaguuuggcaauaucggcgaagcguuccuggagcagaaccaaucacccgaaaguuccguuacguugacuagcgccaaugcaacacuccuguuaucucgacagaacauuucaacccugccucuaaguagcuacacucucgggcauccagcuccggugagacugggauuucccuccgcccuugcuuugaaagagcugcucaauaagcacccugguguaaacgugcagauaacaggccuggccuucaauccauuuaaagaucuugacaacaggaauaucgucgggucuauuggaucggugcuguugagcgcaaaccggaagcuccugcagguucacgauuuaauggaggacaucgaaauaaugcuguggcguaaugugucccuagagacccaucccacgucacucaacaugaguacccaccaacugacaauuacugucaacgugaccucucuugaaaagagcuugaucguauccaucgacccugauucaccacugcucaugacacuguauuuaggcuuccaguaccagcccaauugcacucauuuucaccugaacauuacccuuccgaaggacaagguuuggcagaaagaugaggaguauacauggguguugaauccugagcaccuccaacaugguaucgggaccuacuacauuacugccguccugagcgagcgccaggaaggcgcucagcaaacgccaucucuaguguccgucauaacagcggugacccaguguuauuacugggagauccacaaccagacuuggaguagcgcaggaugccagguuggcccccaaucuaccauucugagaacacagugccucuguaaucaucugaccuucuuugccuccgacuucuuugugguaccuaggacugucaacguggaagauacaaucaaacuuuucuugcggguuacgaauaaccccgugggggucucacuguuagcuagucuccugggauuuuaugugaucaccguagugugggcccgcaaaaaggaccaggcagauaugcagaaaguuaaggucacugugcuugccgacaaugauccaagcgcucaauuccacuaccugauucagguguauacagguuacagaagaucggccgcaaccacagcgaaggucguuauaacuuuguauggcuccgaggggaggucugagccucaucaccucugcgacccccagaaaaccguguucgaacggggaggccuggauguguuucuacugacgaccuggacaagccucgguaaccugcacucacuucgcuuguggcaugacaauagugggguauccccaucuugguacgucagccaggugaucguuugugacauggcugugaagagaaaauggcacuuccugugcaacuguugguuagccgucgaucucggcgacugcgagcuggauaggguguuuauuccgguuuccaagcgugaacuuuucucauuucggcaucuguucagcaguaugaucguggagaaauuuacucaagacuaccuauggcucucuauugcaacccgacacccuuggaaucaguucacaagaguacagaggcuguccuguugcaugacuuugcuguuauguaacauggucaucaaugugauguuuuggaagauaaacagcaccacggccaagcgcgaugaacaaaugcggcccuucgcuguggccuggucggagcuccuggucucaauccauacagcaguuauucuuuuuccaaucaaccuggugauuggaagauuguucccccucaucgagccucaggaaacccugccacuauuucccccuauacaggcuucuugccugagugacgccuccguagagccgcuuagcgcgacuaugguggucgaagaacuaaaagaaacagugagguuccuguugcgccgaaauaccuaucuguuaucuaagugugagcagccacccuggagcuccugggauauuacuaaacucguuaagcugcuuucaagucuggugagcucucacuuggagggccaagggugccaccagcagggagaacggcauugggcccgugucgugccugagaaccaccaucacuucugcuguuaccuccacagaguucugcagaggcuaaaaucccaucuggguacccuuggccucacacaagggcaccagucaugcgacuuucuggaugcugcaagucaguugcagaaguuacaagaacugcucgagacgcauauccugccaaccgaacaggagcccagccgcgaggugacuuccuucgccauucuuucuucggaagagggcaaaaagccuaucagcaauggccugucaaagugguugacauccgucuguuggcuacugcucgguuuuaccagucuggcuucugccuucuuuacagcacuuuauagcuuagaacuguccaaagaccaggcgacuucauggaugauaucuaucauucucagcguauugcagaacaucuucauuagucaaccggugaagguuguguuuuucaccuuucuguacucccucaugaugagccggaugcccagacugaauaaagagaacgagcagcagacgaagaggauccuugcccuguuggcuaaauguucuucauccgucccagggagucgagauaagaauaacccuguguauguagcccccgcaauaaauagcccaacaaagcacccugaacgcacccucaaaaagaaaaagcuguucaaacucacuggcgacauuuuagugcaaauccuguuucuuacccugcucaugacagcuaucuacucggccaagaacucuaaucgguucuauuugcaucaggcaauuuggaagacuuucucccaccaguuuagcgagaucaaacugcuccaggauuucuaccccugggccaaccacauucugcuuccaucacuauacggagacuauagaggcaagaaugcuguccuggaaccgagucauuguaaaugcgggguucaauugauauuucagaucccuaggaccaagacauacgagaaaguggacgaaggacaguuagcguucugugauaacggccacacgugcggucgucccaagucucuguuuccagggcuccaucugcgccgguucuccuauauuuguagccccagaccuauggugcuuaucccaaccgacgagcugcacgagaggcucacuucaaagaaugaaaacggauuuaguuacauuaugcgaggcgccuucuuuaccagcuugcggcuggaguccuucaccucucuacagaugagcaaaaaggguugcgucugguccaucauaucacaagugaucuauuaccugcucguuuguuauuacgcauuuauucagggcugccagcuuaaacagcaaaaguggcgcuucuuuacugggaaaagaaacauccuggauacaucuauuaucuuaauaaguuucauuuugcugggacucgacaugaagucgaucagccugcacaaaaagaauauggcuagguaccgggaugaccaggaucgauucaucuccuuuuaugaagccguaaaggugaacucugccgcuacccaucuugucggcuuccccgugcugcucgcaacgguucaguuguggaaucuguuaagacacucaccucgccuaagggugauuagccguacucugucccgggccugggacgaggucgugggguuucuccuuauaauccugauuuugcugaccggauacgcgaucgcuuucaaccuccuguuuggcugcaguauuucugauuauagaacauucuuuagcucagccguaaccgucgugggucuucucauggggaucucccaucaagaagagguuuucgcacuggacccgguguugggaacuuuucugauauuaacaagugucauccuaauggugcugguugugauuaaucucuucgucagcgccauccuuauggcuuuuggcaaagagaggaagucucugaaaaaggaagcagccuugauugauacccugcuccagaaacuguccaaccuuuuagguaucucauggccacagaagacaagcucggagcaggcggcuacuaccgccgugggcucugacacggaaguacuggaugagcuccccuga

SEQ ID NO: 60752 - RNA, 2907 nt, Artificial Sequence
  derived and/or modified sequence opt3 from PKD2__Homo_sapiens__NP_000288
auggugaacagcuccagaguccagccccaacagccuggcgacgccaagaggccaccggcuccccgggcaccugauccagggcgccugauggccggaugcgcggcuguuggugccucucucgcagcccccggcgggcuuugugagcagcgaggacuggaaaucgagaugcagcguauuagacaagcugcagccagggacccuccagcuggcgccgcggcaucacccaguccuccauugagcuccugcucucggcaggccuggucgcgcgauaauccggguuucgaagcugaggaagaggaggaagagguggaaggggaggagggaggcaugguaguggaaauggacgucgaguggagacccggcucaaggcggagcgccgcaaguuccgcugugucuagcguuggggcccgcucccgaggauuagguggcuaccacggggcgggacauccuucaggcagaaggcggcgucgcgaagaucaggguccacccuguccuaguccagucgggggaggcgacccccugcacagacaucuaccgcucgagggccagccucccaggguggccugggcagaacggcuggugcgagggcuucgcggacugugggguaccagauugauggaggagagcucuacaaacagggaaaaauaucucaaguccguacugcgggagcugguuacuuaccucuuauuucugauagugcuuugcaucuugacguauggcaugaugucaagcaaugucuacuauuacacccgcaugaugagucaacuguuccuagauacaccagugucuaaaacugaaaagaccaacuuuaaaacacucuccagcauggaggacuucuggaaguuuaccgaagggucgcugcuugauggacuguauuggaagaugcagccuucuaaucagacugaggcugacaacagauccuucauuuucuacgagaauuugcuccugggcgugcccaggauccgucaguuacggguccgaaacgguucauguaguauuccacaagaucugagagacgaaaucaaagagugcuacgauguuuauagcguguccucugaagacagggcccccuucgggccucgcaauggcacagcuuggauauacaccagcgagaaggaccucaacggaucaagucacuggggcaucauugccacguauuccggggcaggauacuaucuugaucugagccggacuagagaagagaccgccgcucagguagcgucuuugaaaaagaauguguggcuagacagggguacacgcgcaacuuuuaucgauuucucagucuacaacgccaauauuaaccuguuuugugugguucgacuccugguggaguucccagcuaccggcggggucaucccgaguuggcaguuucaaccccuuaaacugauacgguaugugacaaccuucgacuucuuuuuggccgcaugcgaaauuaucuucugcuuuuucaucuuuuacuacguaguugaggaaauucucgagauccguauucauaagcugcacuauuucaggagcuuuuggaauuguuuagauguggucauagugguccuguccgugguugccaucggaauuaacaucuacagaacgucuaacguggagguacuacuccaguuccuggaagaccagaauacuuuuccuaacuucgagcaccuugcuuauuggcagauacaauuuaauaacauugccgcagucacaguguucuuuguuuggaucaaguuguucaaauucaucaauuuuaaccgcaccaugucgcagcugagcacuacaaugucccggugugcgaaggaucucuucggcuuugcuauuauguucuuuaucauuuuccuggccuacgcacagcuugccuaucugguguuugguacccaggucgacgauuucucaacguuucaagaaugcauauucacccaguuuagaaucauuuugggggacaucaauuucgcugagaucgaagaggccaacagggugcucggcccaauuuacuuuacaacuuucguauucuuuauguucuuuauacuguuaaauauguuccuggcaaucauuaacgauaccuauagugaggugaaaucugaccuagcucagcagaaggccgaaauggagcucagcgaccugauccgaaaaggauaccauaaggcgcuuguuaaauugaagcugaagaaaaauacagucgaugacauuuccgaaucacuccgccaaggcgggggaaagcugaacuuugaugaguuacggcaggaccugaaagguaagggccacacugaugccgaaaucgaggcuauauucaccaaauacgaccaggauggggaccaggagcuuacagaacaugagcaccaacagaugagagaugacuuggaaaaggagagggaagaucucgaccuggaucacagcucucuaccccguccuauguccagucgcagcuuuccacggucucuggacgacuccgaggaggaugacgaugaagacucaggacauaguagcagaaggcgaggcucgaucuccucuggugugagcuaugaggaauuucaggugcucguccggcgcguugauagaauggagcacucaauugggaguaucguguccaagauugacgcagugaucguaaaacuggagauaauggaaagggccaaacuuaagcggcgagaggucuugggcagacuguuagauggaguggcugaagacgagcgccucggcagggauucugaaauucaucgugagcaaauggagcggcugguuagagaggaacuugaaaggugggagagcgacgaugccgcaucccagaucucacacgggcugggaacccccgugggcuugaauggucagccgcgcccucgaagcaguagaccaucuuccagccagucgacugaagggauggagggagcgggcgguaacggcucaucuaauguccauguguga

SEQ ID NO: 60753 - RNA, 2277 nt, Artificial Sequence
  derived and/or modified sequence opt3 from PKD2L1__Homo_sapiens__NP_001240766
augaaccccagaaggcggcacaccggcccucgcugcccagccgcugcaagcaucuccgugaaggccucugaggcgucacugccguguccccucgggcuuuggggaacaacucugacggaaaauaccgcugagaaccgagaauuguacauuaaaacaacuuuacgugagcugcuagucuauauaguuuuccucguggacaucugccugcuuaccuacgguaugacaaguagcuccgccuauuacuauaccaagguaaugucugaacuguuuuugcauacuccuucggauacaggcgugucauuccaggcaauuagcaguauggccgacuuuugggauuucgcucaagggccacuccuggacucccuguacuggaccaaaugguauaauaaccagucucucggacacggcagccauuccuuuaucuacuacgagaauauguuacuggguguccccagacuuaggcaguugaaggugcggaacgauucauguguugugcacgaggacuuccgcgaagauauucugaguugcuaugacgucuacagcccugauaaagaggaacagcuaccauuugggcccuucaauggaacggcauggacuuaucauucucaagacgagcucggcggcuuuucccacugggggagacugaccucauacagcggagguggcuauuaccuugaucugccugggaguaggcagggaucugccgaggcuuugcgggcccuccaggaaggccugugguuagaccgcgguacacgagugguauucaucgauuuuuccguuuauaacgcgaauauaaaccuguucugugugcucagacuugucguggaguuuccagcaacugggggagccaucccgagcuggcagauuaggaccgugaagcugauccgguacgucucgaauugggacuucuucauuguuggcugcgaagugaucuuuuguguauucauauuuuacuauguggucgaggaaauuuuggagcuacacauccaucgucugcgcuaccucucuuccauuuggaacauccuggaccuugugguuauccuguugucaauuguggcugucggcuuccacauauuuagaacacucgaggugaauaggcugauggggaaguuacugcaacagcccaacaccuaugccgauuucgaauuucuagcauucuggcagacgcaguacaauaacaugaacgcuguaaaucucuuuuucgccuggaucaaaauuuuuaaguauaucaguuucaacaaaacuaugacacaacugagcuccacccuugcgcggugcgccaaggacauauugggauuugcaguuauguucuucauuguguuuuucgcuuacgcccagcuggguuaucuccuguuuggcacucaggucgagaauuucucuacauuuaucaaauguaucuucacccaauuucgaauuauccuuggggauuucgacuacaacgcuauugauaaugccaaccgcauacugggaccugcauacuuugugacguaugucuucuuuguguucuuuguuuugcucaauauguuccuggccaucauuaacgacaccuacagcgaagugaaggaggaauuagcuggccagaaggaugagcugcagcuaucagaccuccugaaacaggguuauaauaagacacuuuugagacugaggcuccggaaagagcgcguaagugauguccaaaaggugcugcaagggggcgaacaggagauccaguucgaagacuuuacuaacaccuuaagagagcugggacaugcggaacacgagaucacagagcuuacugcaaccuucacaaaauuugauagggacggcaaucguauuuuggacgaaaaggagcaggagaaaaugcggcaggaucucgaagaggaacgaguugcccugaacaccgagauagaaaagcuagggagauccaucgugagcucuccacagggaaagucaggucccgaggcugccagggcaggcgggugggucaguggagaagaguucuacaugcugacucgccgggugcuccagcuggagacgguacuugaaggcgugguuagccaaauugacgccgucgguuccaaauugaagaugcuggagagaaaagggugguuagcuccuucuccaggcgugaaggaacaggccaucuggaaacacccccagccggcgccugcagugacacccgauccauggggaguccagggcgggcaagagucggaaguuccuuauaagagggaggaggaagcucucgaggaacgccgacugagccggggagagauucccacccuucagcguuccuga

SEQ ID NO: 60754 - RNA, 1482 nt, Artificial Sequence
  derived and/or modified sequence opt3 from PKDCC__Homo_sapiens__NP_612379
augagaaggcggcgcgccgcuguggcagccggcuucugcgcgagcuuucugcucggguccguccuuaacguucuguucgcucccggaucugagccuccacgaccgggucagucacccgaaccuaguccagcccccggcccugggcguagaggaggcaggggugaguuggcacggcaaauccgcgccagauacgaagaggugcagagguauagccgcgggggaccaggccccggcgcugggcggccugaacgaagaagguuaauggaccuggcaccaggagguccgggccuaccccggccucguccacccugggcccgcccucucuccgauggggcuccaggauggcccccggccccuggccccgguucuccagggccuggacccagacugggcugugcggcacuuaggaauguaucgggcgcccaguacauggggucaggauauaccaaggcuguguaccggguccgacugccagguggcgccgcaguggcuuugaaagccguugacuuuagcgggcacgaucucggaaguugcgugcgcgaguucggcgucagaagggguuguuaucggcuggcggcccauaagcugcucaaagagaugguguuacuggaacgccuuagacaccccaacguauugcagcuguacggguauugcuaccaagacuccgaggauauuccugacacacuaacuacgauaaccgaacucggcgcaccaguugagaugauccagcugcuucagacaucuugggaggauagguuucguauuugucugagcuugggacggcuccugcaucacuuagcucauuccccgcugggcucagugacucuccuugacuuccgacccagacaguuuguccugguggauggggaauugaaggugaccgaccuagaugacgccagggucgaggaaacaccuugcgcuggaaguaccgauuguauccuggaguucccagcccgcaauuuuacucuccccugcagcgcacaagguuggugugaaggcaugaacgagaaacggaaucuguacaacgccuauagauucuuuuucacauaccuucugccucacucugcuccacccuccuugaggccgcuccuggacucaauuguuaaugcgaccggggaguuagcauggggaguggacgaaacgcuggcccagcuagagaagguacuccaccuguaucgcagcggccaguaccuucagaacaguacugcuucuuccagcaccgaauaucaaugcaucccugauucgacaauaccacaggaggacuaccgauguuggcccucuuaucaucacgguuccugcuugcugucaguguuuaaucucgccgaagcagucgaugugugcgagagucaugcccagugucgggcuuucguugugacuaaccaaaccacauggaccgggcgucagcuggucuucuuuaagacgggcuggagccaggugguaccugaccccaauaaaacuacauacguuaaggccuccggauga

SEQ ID NO: 60755 - RNA, 6762 nt, Artificial Sequence
  derived and/or modified sequence opt3 from PKDREJ__Homo_sapiens__NP_006062
augagacccggaccugcccugcuccuucugggggugggauugagcuuauccgucgguaggcugccacuaccgcccguuccucggggagcucaggccgccgugucuggggcgccaggaggccuccugcgcggugcucccgggcuuggaguacgaggcggccgugcccuguugucacucagaccuagugcagugagggccgggggagcuguccugagcggucggggcucccugugcuucccacacgggggaaccggccgcagaugguacugucucgacuuaagggugcugcuuucugcacaacgguugcccuggccugccgcuccagcccuggcgcuaguugaucuccagcugucggcacgcggugggcgacuuucacugacauggagcgugagauugccgaggagucccggacggcucgccugggcuuuucgucugcgcuuacugggcccuggcgccgcaagaccagcuucccccgccgcgagggucucuccucggagcgccgcaccagggccccgaccgcagcagggauucguggcucgcacugagugcccuacggacggucccgccagaguaaugcuccaagcuguuaacuccucaagucauagggccguggaaagcucugucuccugucagaucaaugcaugcgugauucagcgggugcgcaucaacaccgaucagaagggcgccccagucagacuuucaaugcaagcugaggcgacaaucaaugcaagcguucagcuggacuguccugccgcuagggccauugcacaguauuggcaaguguuuaguguacccgccguggggcaagcuccagauuggacucagcccuuggaccuaccucagcuggaaauccguaacucuccacucuucauucacaucccgaauaacucccugcaauggggagucuacguguuuaauuucaccguuagcauaacaaccggcaaccccaaaaugccugaggugaaggauucggacgccgucuauguguggaucguacggucuucccuucaggcaguuaugcugggugaugcgaauauuacugcuaacuuuacagaacaguugauccucgacgggucaaccaguagcgauccagacgccgauagcccccugcagggcuuacaauucuuuugguacugcacgacugacccucgaaauuauggaggcgacagaauuauccuggggucuaaagaggugugucauccagagcaggcaaaccuaaaguggcccugggccagcggaccgguccucacccugcuuccugaaacauugaaaggugaucacguguacuucuuuaggauggucauacgcaaggacucacggacugcuuucagugauaagagagugcauguucugcagggcccaaaagccauugcacacauaaccugcauugagaauugugaaaggaacuuuaucguguccgaccgcuucagccucuuccugaauugcacaaacugugcuucucgagauuuuuauaaguggucaauccuuaguagcuccgggggagagaugcuguucgacuggaugggcgagaccguaacgggucggaacggggccuacuugucuauuaaagcguuugccuuccgucacuuucucgaagcugaguucucgauaagccuguacuuagcaugcugguccggcgucacuucaguguuuagacauaguuucaucauuaaucacggaccccagaucggcgaaugcaagauaaacccugccaaagggauugcucugaucacaaaguuuguugugcaauguucuaauuucagggauaagcaugucccccuaaccuauaaaaucauugugagcgaccuccacuccguaggagagaucucaagcgugaaggaaaacacucuggguacaauucuuuacuugggcccacagucuaccguuccucccuccuuucugccagucgggaugcucgccagucaguauggacugaaaauauacgcacagguguaugauagcuuaggcgcguucucucaagugacgcugcacgccaccgcucaggccccgacagacaaaaauuccucaaaaacuguccuuaaccaguugcucaguuuuaccguugguccuagcucgcugcuauccacacugauccagaagaaagauuuccuccccgcaggguaccugcuuuauauuguggcuucuguguugaauaacaugaagacugagcugccauuacgcgacgaccggguaaaucucagaaagcaucugaucgaucaguccuuccuucugcccgucucaaccuugguggagaucggccagguugugaugacaauuaccaaacucacucagaagccuagugaauuuacgugggacgcccagaaaagggcaacaaugcgagucuggcaagccaaccaggcucugcaggaguaccaacagaaggauaaacgcuuccgguccgaacagauagagaucgugucuaccggcauucugaugagccuguccaauauccucaagaugacuucaccacaccagguugugaaggaccccuuuuacguaauugaaagccugagugauaccauccuugcgaacaaagucccuggcaauaagacaaccucuaugagaacuccgaacuucaauauguaugugaaaaagguggagaaaugggggauaaaccaauuguuuaggaacgagaagcauugccguaauuguuucuacccaacacugaacgucuccagcguucccggauuaucggccaauggcccuaucucaacgauguuuugcgacuucaccaacgaucucuuuccauggcugaaugaccaggaaaacacuucuguggagguaagugguuuccgcaugacagggguggcagauaauggauccguccuugaaauuacccccgacguggcugagguuuaucuggugcggaagaaccuaacauuugccgccuucaaucucacugucggcccuaacagcgaaguggaugguucucugaaaaagaccacgggcggguuuagcuuccagguugacuccaccguguugagagagguccugguacacaucgugacagagguuaugguguuauucacuguccucguguacaccggaucacagauuacaccgacugcucugguagcaaccuuucuugugccccaugauaucccaccuuucgccagucaaagcgcgcuguuugaccccgcuuguacggucaaaaaggccaggguugugugcuugccagugucucuccugcagcuaauagcacagcacucccacucaccucauuguacagucaguauugugcugcaagcaccccgauucguuaugaaacuuaaugacaagcucguacggaucagcaucuuuuccgugcagugccuggauauguauggcauucagucugaauggcgcgagggguacuguauauugggagaaaagaccucgugguaugagguccacugcaucuguaaaaacgugguuagagcuaggcggcagcugggcacuauugguuuaacagggauccaucuccacacccacuacgugauggcaaaggucauugugaucccaaauccgguagaccugcgacuuaacauaauuaaaagccugcaucaaaauccugucacuuuguucaccgugcucuuuaucauccugcuauacguuggacuggccuucugggcgcuuuauagagaugagauggaccagcaccuccgcggccaugugauuguccugcccgauaacgacccauacgauaacuugugcuauuuagugacaaucuuuacggguucaagguggggcuccgggacccgugcuaauguuuucgugcagcugcggggaacugucaguacaucugacgugcacugccucagccauccccacuuuaccacacuguacagaggcuccauuaacacuuuccuucugaccacgaagucagauuugggggacauacacucuaucaggguauggcauaauaacgaaggacgcagcccuaguugguaucuaucccgaauuaaaguggagaaucuguucagcagacacaucuggcucuuuauuugucagaaguggcugucuguugauacaacccuugaccggacuuuccaugucacccacccagaugaaagguuaacacgcaaagacuuuuucuuuaucgacgugucauccaaccugcguaagaaucauaugugguucaguauauuugccagcguggucgcaaagacuuucaacagacuccaacgguugucgugcugucuggccaugcuccugucuucccuucugugcaauaucauguuuuucaacuugaauaggcaggagcagaccgaaagccgcgagcgaaaauacaugagaucaaugaugauuggcaucgagaguguacuaauuacaauccccgugcagcugcucauaacguuuuuauucaccuguucucaacggaagccucaggcugaucugaaagaaguuuccccgcagaagcacccacuuaugagcgaggccucagaacacugggaggaauaucugaggaaauggcaugcauacgagacugcuaaggugcacccccgcgaggucgccaagccugcgaguaaagguaagcccagacucccaaaagccagcccuaaggcaacauccaaacccaagcauaggcaccggaaggcucagauuaaaaccccagaaacuuuggggccuaacacaaauucuaacaauaacaucgaggacgaucaagacgugcacagcgaacagcauccgucccagaaggaucugcaacagcucaaaaagaaaccccguaucguucugccaugguggugcguguacgucgccugguuucuuguguucgcuaccucaucuauuaguucguucuuuauaguauucuauggacuaacguacggcuaugacaagagcaucgaguggcuguuugcauccuucuguucuuuuugccagucaguguuguuaguucagccuagcaagauuauccugcucuccgguuuccgcacuaacaaacccaaguacuguaaaaaucugaguuggucuaccaaguauaaauacacagaaauucgacuugauggcaugagaaugcacccagaggagaugcaaaggauccaugaccagauaguccggauccgcgggaccagaauguaucagccucugacugaagaugagauuaggaucuuuaagcggaaaaagcgaauuaagagacgcgcccucuuguuccugagcuacauccuaacacacuuuauauuccuggcccuccuucugauuuuaaucguguugcugaggcauaccgacugcuuuuacuauaaccaguucauccgggaucguuuuucaauggaccucgcuacagugacuaaacuggaagacauuuacagauggcuuaauuccguccugcuccccuugcugcacaacgauuuaaauccgaccuuccuaccagagaguagcucuaagauccugggacucccucuuaugaggcaaguucgcgcgaaauccucagagaagaugugucugcccgcagaaaaauucgugcagaacagcauacggcgagagauucacugccauccaaaguauggcaucgaccccgaagauacgaagaauuacucgggguuuuggaacgagguagacaaacaggccauugaugaaucuacaaauggauucaccuauaagccucagggcacucaaugguuguacuauaguuacggucugcuccacaccuacggguccggaggcuaugcucuguacuuuuucccggagcagcagagauuuaacagcacacuuaggcucaaagagcugcaagaaucaaauugguuggacgagaagacuugggccgugguccuggaauuaaccacguucaaccccgauaucaaucuauuuugcuccauaucugugauuuucgagguuagccagcugggcguggucaacacaaguaucucccuccauagcuuuucucuugcagacuucgaucgcaaagccucagcugaaaucuaucuguacguagcgauuuugaucuuuuuccuggccuaugugguugacgagggguguauuauaaugcaggagcgggcaaguuacgugagauccgucuauaaucuccugaacuuugcucuuaagugcaucuucaccguguuaauuguccuguuccuccguaagcacuuuuuggccacuggaaucaucagguucuaccugagcaauccagaagauuuuauuccuuuccacgcagugucucagguugaccauauaaugcggaucauucuagguuuucuacucuuccuuacaauccugaaaaccuugcgcuacucgcgauuuuucuaugaugugagacuggcccaaagggcuauucaggccgcgcuccccggcaucugucacauggcauuuguagugucagucuacuucuuuguuuauauggccuucggguaccugguguuuggacagcaugaguggaacuauagcaacuuaauacacuccacucagacagucuucaguuacugcgugucugcuuuccaaaauaccgaauuuagcaacaaucggauccuuggcguacuguuccucuccucauuuaugcuagugaugauuuguguucugaucaacuuguuccaggccgugauucugagugcuuaugaggaaaugaagcagccugucuacgaggagccaucugacgaaguggaggcaaugacguaccucugccgcaaacuuagaacuauguuuagcuuccugaccucccagucaaaggccaaagacgaacccgaguuuuucaucgauauguuguauggucaaccugagaagaauagccauagguaccuggggcucaagacacgaaacauaaauggcaagaagauggucuauuuagugguuuga

SEQ ID NO: 60756 - RNA, 10191 nt, Artificial Sequence
  derived and/or modified sequence opt3 from PKHD1__Homo_sapiens__NP_733842
augaccgcauggcugaucagccucauguccauugaagugcuucuguuggcugucagacacuuaucucugcacauagaacccgaggaaggcucacuagcagggggaacauggaucacuguuauuuucgauggucucgagcugggcgugcuuuacccuaauaaugggagccagcuggaaauccacuuggugaacgugaauauggucgugccugcccucaggagcguuccgugcgauguguuucccgucuuccuggaccugccugugguaacgugucggacccgcuccguucucucugaggcgcaugagggauuauauuuucuggaggcuuacuucggcggucaacuugugucgucaccaaaccccgggccucgagauagcugcacauuuaaguucaguaaagcccagacuccaauuguccaccagguguaucccccuuccggagugccaggcaaguugauccaugucuacggcuggauaaucaccgggcgucuggagacauuugacuucgaugcagaauauauugacucuccgguuauccuagaggcccagggagauaaaugggugacccccuguagccucauuaauagacaaauggguuccugcuacccuauccaggaggaccacggccuggggacucuucagugucacguagaaggagauuauauaggcucacagaacgugaguuuuagcgucuucaauaaggguaaaucuauggugcauaagaaggcuuggcugauuuccgcaaaacaagacuuguuucucuaccagacacacucagagauccugagcguuuucccagaaaccgggaguuuaggaggcaggacgaacauuacuaucaccggcgacuuuuucgacaauucugcccaggugacaaucgcugggauucccugcgauauacggcaugucuccccucgcaagaucgaguguacuaccagagccccaggaaaagacgugaggcugacaacgccccagccggguaaccggggccuccuuuucgaaguaggggacgcgguugagggacuggaguugaccgaagcaacuccuggcuaccgcuggcaaauugugcccaaugccagcucgccauuugguuucuggucucaggaggggcagccuuuucgagcuagacuauccggcuucuuugucgcccccgaaacaaacaauuauaccuucuggauccaagcagauucacaggcuagucugcacuuuagcugguccgaggaaccaaggacuaaggugaaagucgccucuauaagcgugggaacagcggacugguucgauucaugggagcagaaccgggacgagggcaccuggcagcaaaagacgcccaagcucgaacugcuugggggagccauguacuaucuggaggcagaacaccaugguauugcuccuagucguggcaugcgcaucgggguucagauccacaauaccugguugaacccagaugugguaacaacuuaccucagagagaaacaucagauuaggguccgggcccagcgacugccggaagugcaaguuuuaaacguguccggacgcggcaacuuuuuccugaccugggacaacgucagcucucagcccaucccugcuaaugccacagcacaccuaauucagacuaccauagaggagcuccuggccgugaagugcaaacuugaaccauuguggucaaacauccugcucagacuggguuuugagagggggcccgaaguaaguaauagcgauggcgaccuuacauccggaaccgagccuuucuguggccgguuuucucugcgccagccaagacauuuggugcucacucccccggcugcgcaaaagggguauaggcuggaucaguacacgcacuuaugccuggcauauaaaggacacaugaacaagauucuaaaaaugaucguuucguucacaaucgguuuccagaauauggucaagaacaccacuugugacuggagccucacccguacauccccugagucauggcaguuugauugcaccgaccugugggaaacuugcgugcgguguuucggcgaccuucaaccacccccugccaauagucccguguugguccaucagauuaaccugcucccacuggcucaggagacaggguuauuuuacguugaugaaauaaucauugccgacacgaaugugaccgugucucaagcagauagcggaacugcccgaccuggcgguaaccugguagaguccgucucagugguugggagucccccuguguacucugucacauccuggcuugcuggcugcggaaccgaauugccgcucaucacagccagaagugugccuacugagggcaccgaggaagggagcggacugguucuagugacgacccagaggcgccagcggacaucucccccacugggcggucacuucaggauucaacuccccaauacuguaaucuccgacgucccugugcaaauaucagcacaucaucugcaccagcuuuugcagaacaaugcggaugacuuuaccaguagauaucugaacgcuagcgauuucacagugaaggaggacuuauacacuuguuaugaacaugucuggacccucucgugguccacgcagaucggggaucugccaaacuuuauucgcguuucugacgagaaucuuacaggagugaaccccgccgcagccacccgaguaguguacgauggcggugucuuccugggcccuaucuuuggggacauguuggcuacugccaaucaacacacacaggugguugugcgggucaacgaugugccggcacauugcccaggaagcuguucauuccaguaucuccagggcaguacccccugcguucacuccgugugguacucuauugacggggacaucaaucugaugauauauauuacuggaaccggcuuuagcggugauucccaauuccuacaggucacaguaaacaaaacgucauguaaggugaucuuuagcaaucagaccaacguugugugccaaacugaccugcucccugucgggaugcaucguauucugaugcuugugagaccaaguggauuggcuaucucugccacaggcgaagaucuguucuuaaauguaaaacccaggcucgacaugguggagccuucccgcgcggccgauauagguggccugugggcuaccauccgggggagcucgcuugagggagucucacugauucuauucggcucuuacaguugugcaaucaacguugccacauccaauagcucuaggauucaaugcaaggugccgcccagagggaaagacggacgaaucgugaacgucacugugauacgcggcgauuacagcgcuguucucccacgggccuuuaccuauguauccucacugaauccugugauugucacguugaguagaaacaucagcaauaucgccgguggggaaacacuggugauuggaguugcgagguuaaugaacuacaccgaccucgauguggagguccacgugcaggacgcccuggcucccguacacacucagucugccuggggccuugaagucgcacugccaccuuugcccgcuggucuccaucguaucuccgugucaauuaacggcguuaguauacacagccaagggguggaucugcauauccaguaucuaaccgaggucuucuccauugaaccauguugcggaucucugcuuggcgggacaauccucucgauuagcggaaucggcuuuucacgcgacccggcccugguguggguuuugguggguaaucgguccugcgauauagucaaccugacugaggcaaguaucuggugugagaccuuaccugcaccccagauuccagacgcuggggcgcccacagugccugccgcaguagaagugugggcuggaaauagauucuuugccaggggcccaucucccagccucguuggcaagggguucacguuuauguacgaggccgcugcaaccccugucgugacugccaugcagggagaaaucacaaacuccucacugucucuucacguggguggcagcaaucugaguaacuccgucauuuugcucgggaaucugaacugcgacguagagacccagagcuuccagggaaaugugucucuaucaggcuguuccaucccgcugcauagucuugaggcggguauauauccacuccagguucgacagaagcaaaugggguuugcuaacaugagcgugguccugcagcaguucgccgugaugccccggauuauggcaaucuuuccuucgcagggaucugccugcggcggcacuaucuugacaguucgcggguuacugcucaauuccagaaggcggagcgugcgagucgaucugucaggacccuucaccugugugauucuuagucugggugaccacacgauauugugccaaguaucucuagaaggcgauccacugccuggggcuuccuucagccucaacgugacuguucuggucaauggacuuaccucagagugucagggcaacugcacauuauuuaucagagaagaggcaagucccgugauggacgcccugagcaccaauacuuccgguucucucacaaccguguugauucgcgggcagaggcuggcgacaacugcugaugaaccaauggucuucguugacgaucaacucccuuguaacgugaccuuuuucaacgccagccacguagugugccagacgcgugaccuggcaccgggaccccauuaccuuuccgucuuuuauacacggaauggcuacgccuguucaggcaacgugucuagacacuucuacaucaugccacagguuuuucauuauuucccuaaaaauuuuagucugcacgggggaucguugcuaaccauugaggguacuggccugagggggcagaacaccacaagcguguacaucgaucaacagacuugccucaccgucaauauaggagcugaguuaauccgcugcauuguacccacgggcaacgguuccguggcccuggaaaucgagguugacgggcuuugguaucacauuggagugaucggcuacaauaaggcauucacaccagaacugauaucuauuucacagagcgaugacauccucaccuuugcugucgcccagaucuccggcgcggccaacauugacaucuucauagggaugaguccuugugugggagucucugguaaucauacuguguugcaaugcguugugcccagccugccggcaggcgaguaucacguacgaggguacgauuguauuagaggaugggcuucauccgcccucguguuuacaagucgggucaucauuaccgcuguuacugaaaacuucggcugccugggugggaggcuugugcaugucuucggagcaggcuuuagcccaggcaaugugucugccgccguauguggggcuccuugccgcgugcuagcgaacgcaacaguuuccgccuucucaugucugguguugcccuuagacgucagccuggcuuuucucugcggacugaaacgugaggaggauucgugugaagccgcaagacacaccuaugugcagugcgaccuuacggucgccauggcuacugagcagcugcucgaaucuuggccauacuuguacaucugugaggaaaguucccagugccuguucgugcccgaucauugggcggagagcauguuuccuucauucuccggucuauuuauaucuccgaagcuggagcgggacgaaguucucauuuauaauagcaguugcaacaucaccauggagacagaagccgagauggagugugaaacccccaaucaaccaaucacaguaaaaauuacugagaucaggaagcgcuggggccagaacacccaggggaauuucucccuucaauuuugccgaagauggagccggacgcacucuugguucccugaaaggcugccccaggauggagacaacgugacagucgagaacggccaguuauugcugcucgauacuaauaccucaauucugaaccuucugcacauaaagggugggaaacucaucuuuauggcaccuggcccaauugaauugcgcgcucaugccauccuggugagugacggaggcgaguuaagaaucggguccgaggauaagcccuuccagggaagggcacaaauuacacuauacgguagcucuuauucgaccccauuuuucccauacggcguuaaauuccuggccgugcggaaugggacucucucacuucacggaagccugcccgaagucauagugaccuguuugcgugcuacagcccaugcgcuggacacgguacucgcacuggaggaugccguggacuggaacccgggcgacgaaguugucaucauuuccgguacuggggugaagggcgcuaaaccuauggaggaaaucgugaccgucgagacaguucaggauaccgaccuuuaucucaagaguccacugcgcuacucucacaauuuuacugagaacuggguggccggagaacaccauauuuugaaggcuacaguagcacuguuaagccgauccaucaccauacagggcaaucuaacgaacgagagagaaaaacugcucgugucaugccaggaggccaaugcucccgaagggaaccuucaacacugucuguauaguaugucugagaagauguugggaagcagggauaugggugcccgggucaucgugcaguccuucccugaggaaccaucacagguucagcugaaaggcgugcaauuucagguccucgggcaggcauuccauaagcaccugagcucucuuacuuuagugggagcgaugcgcgaguccuuuauucagggcugcacaguaagaaauaguuucagcaggggucugucgaugugugggacccucggcuugaaaguugacuccaacguguuuuacaauauccugggacaugcccuacuggucggaaccugcacugaaaugcgguacauuucuugggaggcuauccacgggcgaaaggaugacuggucaggacacggcaacauaauuagaaauaacgugaucauucaagugagcggugccgaggggcucaguaaccccgaaaugcuuacaccguccggaaucuauauauguucuccuaccaaugucaucgagggcaaccgcguuugcggugcaggcuacggguauuucuuucaucugaugacaaaucagacuagccaggcucccuugcugucauucacgcaaaacauugcccacuccuguaccagguacggacucuuuguguauccaaaauuccagccucccugggauaauguaacaggcacuacccuguuucagaguuucacagugugggaaagcgcagggggagcccagaucuuccggucuucaaacuuacgucuuaagaauuuuaaggucuacuccugcagagacuucggcauugaugugcuggagagcgacgcuaacaccucuguuacugauagucuccuacugggucauuuugcgcacaaagggucguugugcauguccagcggaaucaagacgccaaaaaggugggaacugauggugucaaauaccacauucgucaacuuugaccucauaaauuguguggccauucgcacuugcucugauuguagccaaggccaggguggcuucaccguaaagacaucccagcuuaaauuuaccaacaguucaaaucugguugcauuccccuuuccucacgcugccaucuuggaggaccuggacgggucucucagcggaaagaaccggucccauaucuuagccaguauggagacucugagcgcauccugccuuguaaauucuucauucggccgagucgugcacgggagcgcuuguggaggcgguguucuguuucauagaaugucgauugggcuagccaacacaccagaaguguccuaugaucucacgaugaccgacaguaggaacaagacuacaaccgucaauuacgugcgcgauacccugucuaacccgcggggauggauggcguugcugcucgaccaggagacauacagccuucaaucagaaaaucuguggaucaacagauccuuacaguauucugcuacuuucgauaauuuugcccccggcaacuaccuguugcucguacacacggaccugccuccauaucccgauauacuacuucguugcggcaguaggguggggcugagcuucccuuuccucccaucccccggacagaaucaggguugugacugguuuuucaacucacaacugcggcaguugaccuaccuggucagcggcgaggggcagguucaagugauucuccgcgucaaagaaggaaugccuccgacaaucucugcaaguacuuccgccccagagagcgcucuuaaguggucacugcccgagaccuggcagggcguggaagaggguuggggaggcuauaauaacacaauuccuggccccggcgaugacguauuaauccugccaaaucgaaccguguugguugauacugaccucccauuuuucaaagggcuguacgugaugggaacgcuagacuuucccgucgauagaucuaacgugcuuuccguugcaugcauggucauagccgguggcgaacugaagguggggacacucgagaauccacuggaaaaagagcagaaguuguuaauccugcucagggcgucggagggaguguucugugaccggaugaacggcauucauaucgauccggguaccauugggguauauggaaagguccaccuuuacagcgcuuacccuaaaaauaguuggacucaccugggcgccgacaucgcaucuggcaacgaacgcauuaucguggaggaugccguugacuggagaccccaugauaagauagugcuauccagcucaaguuaugaaccacacgaggcugagguccugaccgugaaagaaguuaaggggcaucacgugaggauuuacgagcgacucaaacaucggcacaucggauccguacacgucacagaagacggucgucauaucagauuggccgcagaggugggccugcuuacucgcaacauucagauacaacccgaugugagcugcagggggcggcuguuuguuggaucuuucagaaagucaagccgcgaagaguuuuccggcguccuccaguuacugaauguggagauccagaacuucgguucuccuuuguauaguucgguagaauuuagcaauguguccgcugggucauggauuaucucuagcacccugcaccagaguuguggaggcggcauucaugccgcggccucccacgggguccuccuuaacgacaauaucguguucggaacagcaggucacggcauagaucuggaggggcaggcuuacacgguuaccaacaaucuagugguccugaugacucagccagccuggucaacaaucuggguggcaggaauuaagguuaaccaggugaaagacaucaaucuccauggcaacguagucgcugguucugaaagguugggguuucacauucgaggacauaagugcagcuccugcgagcugcuuuggagugauaauguggcccacagcucucugcauggcuuacaccucuauaaagaaucaggccuggacaacuguacccggaucuccggguucuuggccuucaagaauuuugacuacggagcgaugcugcacguugagaacagcguggagauagaaaauauuacucucgucgauaacacaaucggucuucuggcugugguauauguguucagugcaccccagaacucugucaaaaagguucaaaucgugcuaagaaauuccgugauugucgccaccucgagcucauuugacugcauacaggauaaagugaagccucauuccgcuaaccugacgucuaccgacagggccccgaguaauccacgcggcgggcguaucgggauucucuggcccguuuucacaagcgagccuaaccaguggccacaagaacccuggcacaagguacggaaugaucauucaaucuccggcauuaugaaauugcaggacgugacuuuuagcucuuucgucaagaguuguuacuccgaugaccuggaugugugcaucuuaccuaacgcagagaauagcgguauaaugcaccccaucaccgccgaaagaacaaggaugcuuaaaauuaaggacaaaaacaaguuuuacuucccaucacugcagccgcgcaaggaucucgggaaaguuguguguccugagcuggacugcgcuucuccccgaaaguauuuguuuaaagaccuggauggacgggcgcucggccuuccaccucccgucucgguguucccaaagacugaggccgaauggaccgccagcuuuuucaaugcuguaacaaccgagcaggcccugaaaaucuccgaauga

SEQ ID NO: 60757 - RNA, 231 nt, Artificial Sequence
  derived and/or modified sequence opt3 from PKIA__Homo_sapiens__NP_006814
augaccgacguggagacaacuuacgccgauuucaucgcuagcggcagaacggggaggcggaacgcaauucacgacauacuggucuccucugccucaggaaauaguaacgaacucgcgcuuaagcuggcugguuuggauaucaauaaaaccgagggcgaagaggacgcccagcgcagcuccacagaacaaucuggggaggcacagggagaggccgcuaagucggaaucauga

SEQ ID NO: 60758 - RNA, 258 nt, Artificial Sequence
  derived and/or modified sequence opt3 from PKIB__Homo_sapiens__NP_001257323
augagccaccaggacguggccaugagaaccgauuccucuaagaugacagacgucgagucaggcguugcuaacuucgcaaguagcgccagggcggggcggcgcaaugcucugcccgauauccaauccucugccgcaacugacggaacgucggaucucccucuuaaacuggaagccuugucagugaaggaggacgcuaaagaaaaggaugagaaaaccacacaggaccaguuagaaaagccacagaacgaggagaaguga

SEQ ID NO: 60759 - RNA, 1725 nt, Artificial Sequence
  derived and/or modified sequence opt3 from PKLR__Homo_sapiens__NP_000289
augagcauccaggagaacauuuccucucugcaacucagaucaugggugaguaagagccagagggaccuugccaaauccauacugaucggcgcucccgggggaccugcagguuacuugcggcgcgccucugucgcgcaguuaacccaggaacugggcacagcuuucuuucaacagcagcagcuaccagccgcaauggccgauacuuuccucgagcaccugugccuucuggacauugauucggaaccgguugcugcacgaucaacgagcaucauugccaccaucgggcccgcuagucguuccguggagagauugaaggaaaugauaaaagccggaaugaauaucgcgaggcucaacuuuucucauggcagccacgaguaucaugcagaguccauugccaauguacgggaagcuguggagucauucgccgguaguccucugagcuaccgcccagucgcaaucgcucuggacacaaaggggcccgaaauuagaacuggaauccuccaaggcggcccugagucugagguggaauuaguuaaagggucccaggugcuggucaccguggauccagccuuuaggacacggggaaacgcgaauaccguauggguugacuaucccaacauagugcgcgucgugccuguggguggccgaauuuacaucgaugacgggcuuauuucauuggucguucagaagaucggaccagagggccuggugacucagguagaaaaugguggggugcuaggaagcagaaagggcgucaaccucccgggcgcccaaguggaucugcccgggcuuagugagcaggacguuagggaucugcgguucggaguggaacacggugucgacaucguguuugcaucuuucguacguaaggcuuccgauguugccgcugugcgcgccgcauugggcccugaggggcauggaauuaaaauaaucagcaaaauugagaaucacgaaggcgucaagagauuugacgagauccucgaagugucggacgguauaauggucgccaggggcgaucuggggauugagaucccagcugaaaaaguguucuuagcgcagaagaugaugaucggacgguguaaccuggcaggcaagcccguugugugcgccacacaaaugcucgagucuaugauuaccaaaccucgaccaacgcgcgcugagacuuccgacguagccaaugcaguccuugauggggccgacuguaucaugcugucaggagaaaccgcuaaggguaacuuucccguggaggccguuaaaaugcagcacgcaauugcgagagaagcugaggccgcaguguaucauaggcaguuguucgaggaacuacggcgcgccgcuccgcugaguagagauccuacagaggucacugccauaggcgcaguggaagcugccuuuaagugcugugcggccgcuaucauuguacucaccacaaccgggaggagcgcacagcugcuuucccguuaccggccccgagccgcugugaucgccguuacgagaucugcacaagcggccaggcagguccaccugugccgcggaguguucccauugcucuaucgggagccucccgaagcuaucugggccgacgauguggacagaaggguccaguucggcauugagagcgguaaacugcgcggguuuuuacgaguuggcgaucuggugauagugguaacuggauggcggccaggcucaggguacacaaauaucaugcguguccuaaguauuuccuga

SEQ ID NO: 60760 - RNA, 1818 nt, Artificial Sequence
  derived and/or modified sequence opt3 from PKM__Homo_sapiens__NP_001193725
augcaguggagcuccgagagaggcgaaaggcugcucacccccggggccuguucuucagaggugccuagugcugucccaagccgguccggagguucuccgggccacacaguuuucucgucagaacgcagccuucuggugcgaccccguagucauccugagccaaagggggaacacuacguaacuggaucccccacgccugagaaccaaagaaccucugcagccaugagcaaaccacauuccgaggcgggcacagcuuuuauccagacucagcaguugcacgccgcaauggccgacaccuucuuagaacauaugugcaggcuggauauugacucacccccuauaacagcucggaauaccgguaucauuugcacuaucgggccagcaagucgcagcguggagacacuaaaggaaaugauuaaaucuggaaugaacgucgccagacucaauuuuucccacggcacccacgaguaucaugcugagacgaucaagaacgugaggacugccaccgaaucauucgcgagcgauccgauacuguaccggcccguugcaguggcccuugacacaaaaggcccugagauccgcacugggcugauuaagggaagugguaccgcugaagucgaguugaagaaaggcgccacacucaagaucacccuggauaaugcauauauggaaaaaugugacgagaacauucuguggcucgauuacaagaauaucugcaaagugguagagguugggucuaagauauauguggacgauggauuaauuucccugcaagucaagcagaaaggcgcugacuuucuugugacggaaguggagaacggugggagcuugggaucgaagaaaggcgucaaucugccaggcgccgcgguugaucuacccgccgugucugaaaaggacauccaggaucucaaauucgggguagagcaggacguggacauggucuuugcauccuucauucgaaaggcuucagaugugcacgaaguuagaaaagugcugggagagaaggguaagaacaucaaaaucauuaguaagauagagaaucaugaaggcgucaggcgguuugacgagauccuugaagccagcgaugggauuaugguggcucguggagaccugggcaucgagauaccugccgaaaaaguauucuuggcacaaaagaugaugauuggucgcuguaacagagccgggaaaccaguuaucugcgcuacucagaugcucgaguccaugaucaagaagcccaggccgacacgggcggagggcucugauguggcaaaugccguccuggacggagcugauuguauuauguuaagcggcgaaaccgccaaaggggacuacccucuggaggcagugcgaaugcagcaccucaucgcccgcgaagcugaggccgcaauguuucacagaaaacuuuucgaggaacuggucagggcgucaagucauuccacugauuugauggaggcuauggccaugggaagcguggaagcaucuuauaagugccuagccgcugcccugauuguucucacagagucaggucggagugcacaccagguggcucgcuacagacccagggccccaauaaucgcgguaacccguaacccucaaacggcccggcaggcucaucuguaccgaggcauuuuucccguccuuuguaaggacccagugcaggaagcaugggccgaggauguugaccugagagugaauuucgcuaugaacgucgggaaagccaggggauucuuuaagaagggcgacgugguaaucguguugaccgguuggcgccccgggagcggcuucacaaacacuaugcggguugucccugugccauga

SEQ ID NO: 60761 - RNA, 1293 nt, Artificial Sequence
  derived and/or modified sequence opt3 from PKMYT1__Homo_sapiens__NP_001245379
augcuggagagauggcaccagcuccaacccaggcgggugagcuuccgcggcgaagccuccgagacccuucagucuccuggguacgacccaucacgaccggaaaguuucuuucagcagagcuuucaacgucuguccagauugggacaugguucuuauggcgaggucuucaagguuaggucgaaagaagaugggcgguuauacgcugugaagcgcucaaugagccccuuuagaggaccuaaagacagggcacggaagcuggccgagguaggcagucacgagaaagugggucagcauccaugcuguguccgccuagaacaggcgugggaggaagggggaauccucuaucugcagacagagcuuugcggccccucccugcaacagcacugugaggcuuggggcgccucuuugccugaagcacagguguggggguaccuccgagauacucugcuggcccucgcucauuuacacagccagggacugguucaccuugacgugaagccagcaaacauuuucuugggucccagagggaggugcaagcugggcgauuuuggacuacucgucgagcugggcacggccggugcuggggaagugcaagagggagacccucgguauauggccccagaacuucugcagggcuccuacggcaccgcggcagauguauucucauuggggcucacaauacuggagguugccuguaauauggaguuaccgcauggaggugaaggcuggcagcaacugcgucagggguaucuucccccugaguuuacugcuggacucaguagcgaacugcgcucuguguuggucaugaugcuagagccagaccccaaacugagagccaccgcagaagcucuccuggcccuuccugugcugaggcagccacgggcguggggcguguuguggugcauggccgcagaggcucucucccgagguugggcccuguggcaggcuuuacuggcccuacucuguuggcuguggcacgggcuugcacaucccgccucaugguugcaaccgcugggcccucccgcuacaccaccuggaagucccccaugcagccuccugcuugauucuucccugagcucgaacugggacgaugacucuuugggccccucccucucaccugaggcgguccuggcacgcaccguugggaguacuagcacaccaagauccagguguaccccgcgggaugccuuagaccugucugacaucaauagcgaacccccucgcggaucauucccaaguuuugagcccagaaaccuacucucccuguucgaagauacgcuugacccuacuuga

SEQ ID NO: 60762 - RNA, 2829 nt, Artificial Sequence
  derived and/or modified sequence opt3 from PKN1__Homo_sapiens__NP_002732
auggccagcgacgcugugcaguccgagcccagaucuuggucacugcucgaacaacuuggccuggcaggggccgauuuggcggcuccuggaguccagcagcaguuagagcuggaaagggagcggcuacgccgagaaauccguaaggagcucaaacugaaggagggugccgaaaaccuuagaagggcaaccacagaccugggccggaguuuggggccaguugagcuccugcugcgcggaagcuccagaaggcucgauuuacugcaccaacagcuucaggaauugcaugcccacgugguacugccggaccccgcugcaacucaugauggcccucagucuccaggugccgggggacccacgugcucggcuaccaaucuaucacggguggccggccucgagaaacaacuggcgauugagcuuaaggucaaacagggcgcagaaaacaugauacagacauacagcaaugggaguacuaaggaccgcaagcuguugcucaccgcccagcaaaugcugcaggauuccaaaacaaagaucgacauuauccgaaugcaguuaagaagggcucugcaagccggacagcucgagaaccaggcagcuccugaugacacccaggguucuccagaucuuggcgccguggaacugcggauugaggaauugcgucaccauuuccgcguugagcacgcgguggccgagggggcaaagaauguccuaagacugcucagcgcugccaaggcucccgacaggaaagccguguccgaagcacaagagaagcugacugaaucaaaccagaaacuuggacuguugcgggaggcccucgaacgacgccugggcgaguuaccugcugaucacccaaaagguagacugcuaagggaggaacucgcggcagccaguagcgcugccuuuucuacacggcuggcagggccguuccccgccacccauuauuccacgcuuuguaagccugcuccauugacuggaacccuggagguacgcguugugggcugcagagaccuccccgaaacaaucccuuggaauccaacucccucaaugggcgggccgggaaccccugacagcaggcccccauuucugagucguccugcccggggucuuuacucucgauccggcagccugucggggagaucuuccuugaaagcagaggcggaaaacacaucagaggucaguaccgugcucaagcuggauaauacgguggucggacagacuagcuggaaacccuguggcccaaacgcuugggaccaguccuucacauuagagcuggaaagggcccgcgagcuagaacucgcaguuuucuggcgggaucaaagaggucugugcgcccuuaaguucuugaaacuggaggacuuucucgauaaugagaggcacgaagugcagcuggacauggagccccagggguguuuaguagcugaagugaccuuccgcaacccugucauagagcgaaucccacggcugcguagacagaagaagaucuuuucuaaacaacagggcaaggccuuccagagggcacgccagaugaauauugauguggcuacuuggguucggcuuuugagaaggcucauuccgaacgccacaggaaccggcacguuuagccccggggcgucaccuggaagugaagcccgaaccacaggugacaucuccguggagaaacugaaucuaggcacugauagcgacucuucaccacaaaagaguagccgcgaucccccuuccucuccaucgagccuguccucacccauacaggagaguaccgcuccggaacucccuucugagacacaggaaacuccagggcccgcacugugcagcccucuucggaaaucccccuugacccuggaggacuucaaguuuuuagccguccucggaagaggccauuucgguaaggugcugcuuucagaauuuaggccaagcggggagcuguuugcuauuaaagccuugaagaaaggcgacaucguagcacgugaugagguugaaucucucaugugugagaagcgcauucuggcggccgugacauccgcuggacacccuuuccuagucaaccuguuuggcugcuuccaaacccccgaacacguguguuuugucauggaguauagugccgggggagaccucaugcugcauauccacagcgauguguucucugaaccacgggcaaucuuuuacuccgcuugcguugugcuugguuugcaguuccugcaugagcacaaaauuguauauagagacuuaaagcucgauaaccugcuucuggacacugagggcuacgucaagauagccgauuuugggcuauguaaagaaggaaugggcuauggugacaggacgucaacauucugcgggaccccggaguuucucgcaccugaagugcugacugauaccaguuacacacgagccguugacugguggggcuugggagugcuguuauacgagaugcucgucggcgagagccccuucccaggggaugacgaagaggaaguguuugauucgaucguaaaugacgaggugcgguauccccgcuuccuguccgcugaagcgauuggaaucaugagaaggcuucugcggcgaaacccugagagacgcuugggcucuagcgagagggacgccgaagauguuaagaaacagccauucuuucguacccucgguugggaggcacugcuagcucggagacugcccccuccguucgucccaacucuuucagggaggacagacgugaguaauuuugaugaagaguucacgggagaagcccccacccucuccccuccacgcgacgcccgaccccugacugcugcagagcaggccgcguuuuuggauuucgacuuuguggcuggcgguugcuga

SEQ ID NO: 60763 - RNA, 3036 nt, Artificial Sequence
  derived and/or modified sequence opt3 from PKN2__Homo_sapiens__XP_011540071
auggccagcaaccccgagagaggcgaaauccugcucaccgagcuucagaauugcgggcacuccggaggucuggcuuguuucauuuacugggaauuucaaggcugggagaaggugcagaacgaaaaaucuggggacucaaggaguuugccuuucagcgagaaugucuccgcaguucagaaguuagauuuuucugacacaauggugcagcaaaaacuggaugacauaaaggaucggaucaaacgcgagauucgaaaggaacuaaagaucaaagagggagccgaaaaccuccguaagguaacuacggacaaaaagucgcuggcguauguggauaauauucuuaaaaagucaaacaagaaacuggaggaguugcaucacaagcuccaggaacugaaugcucauaucgucgugagcgacccagaggauauaaccgacugcccgagaacacccgauacuccuaacaaugacccaagguguaguaccuccaacaaucggcugaaagcccuccagaagcaguuagauaucgaacugaaaguuaagcaaggcgcagagaacaugauucagauguacucuaaugguagcuccaaagaccgcaaacuucacgggacagcccagcaguugcugcaagacucaaagaccaagaucgaagugauuagaaugcagauccuacaggcuguccaaacuaacgagcucgcauucgauaaugccaagcccgugauaaguccucuggagcuuaggauggaagaacugcggcaucacuuucgcauugaauuugcuguagccgagggagcgaaaaacguuaugaaguugcucggcagcggcaaagugacagaccgaaaggcacugucugaagcccaggcuagauuuaacgaguccucacagaaguuagaucugcucaaauauagccuugagcagaggcugaaugaagucccaaagaaccaccccaaaagucggaucauuaucgaggaauugucucuaguggccgcauccccuacccugagcccacgucaaucgaugaucucuacgcagaaucaguacuccacucucucaaagccggcugcccugaccgggacacuugaggugcgccugaugggaugccaggacauuuuggaaaacguccccgguagaaguaaagcgacuagcguugcccucccuggcugguccccaucugagaccaggagcucauucaugagucggacauccaagagcaagucugggucaagucgaaaucuguuaaaaaccgaugaccugagcaacgaugugugugcaguacuaaagcucgacaauacgguggucggacaaacuuccuggaaacccauaucuaaccagucgugggaucagaaguuuacacuggagcuugaccgcagcagagaauuggagaucuccguguauuggagggauuggcggucacugugcgcuguuaaauuccuccgccuggaagacuuucuugacaaucagagacauggcaugugucuguacuuggagccucaagguacccucuucgccgaggugacuuucuucaacccagucauugaaaggcgucccaagcugcagcggcagaagaaaaucuucaguaagcagcaagggaaaacauuuuuacgagcuccgcagaugaauauaaacauugccaccuggggaagacuggugaggcgcgcaaucccuacgguaaaucacucuggcaccuucagcccccaggccccaguuccuacaacugugcccgucguggauguccggaucccacaacuagcucccccugcguccgacucaaccgugacaaagcucgauuuugaccuggagccagaaccgcccccugcaccacccagagccagcucucuuggcgagauugaugaauccagugaguugaggguucuggacaucccugggcaggauagcgagacuguguucgacauucagaacgaucgcaauucuauacucccaaaaucccagucagaauauaagcccgacaccccgcaaaguggacuggaguacagcgguauccaggaauuagaggaucgacggucgcagcagcguuuucaauucaaccugcaggacuuuagaugcugugcuguacuuggcagggggcauuucggaaaagucuugcucgccgaauacaagaacacaaaugagauguuugcaauuaaggcccugaaaaagggcgauaucguggcucgcgacgagguugacucccuaaugugcgaaaaacggaucuucgagaccgugaacucugucagacacccuuuucuggugaaucucuucgccuguuuucagacuaaggaacacguaugcuucgugauggaguaugcagcggguggggaucugaugaugcauauucacacggacguuuucagcgaaccaagggcugucuuuuacgccgcaugcguggugcuuggcuugcaguaucugcaugagcacaaaauagucuaccgagauuuaaagcucgacaaccugcuucuggauacagagggauucguuaagaucgccgacuuuggcuuguguaaagaagggaugggauauggugaucgcaccucaacuuucugcggcacccccgaguuucucgcuccugaagugcugacagagaccaguuacacucgggccguggacuggugggggcuaggaguacugauuuaugagaugcucgucggcgaaucccccuucccaggugaugacgaggaagagguguuugauucuaucguuaaugacgaagugagauacccuagguuccugagcacagaggcaauuuccaucaugcgucgccuuuugcggagaaaccccgagaggcgacugggggcuucagaaaaggaugccgaggacgucaaaaagcauccauuuuuccgguuaauagacuggagcgcgcucauggauaaaaaggugaagccgccuuuuauccccacgauucgcggcagagaagacguuaguaauuucgaugacgaguuuaccucugaagccccaauccugacucccccuagggagccacggauucuuuccgaggaggagcaagaaauguuccgagauuucgacuacaucgcugauugguguuga

SEQ ID NO: 60764 - RNA, 2670 nt, Artificial Sequence
  derived and/or modified sequence opt3 from PKN3__Homo_sapiens__NP_037487
auggaggaaggcgcccccagacagccugggccaagccaauggccgcccgaggacgaaaaggaggugaucaggcgggcuauucagaaagaacugaagauaaaagagggagucgagaaccuccgccgaguugcaaccgaucguagacaccuuggucaugugcagcagcuguugagguccucuaaucggcgcuuagaacaacugcacggcgagcuaagagaacuccaugccaggauccugcuuccugggccaggacccggcccugcggagccaguagcuucagguccccggccuugggccgagcagcugcgcgcacgacacuuggaagcccucagaaggcagcugcauguggagcugaaggucaaacagggggcugaaaacaugacacacacuugcgcaaguggaacgccaaaggagcggaagcucuuagccgcugcccaacagaugcugcgugacagccagcuuaaaguggcguugcugcgcaugaagauuuccucucuagaagcaucgggcucaccggagcccggcccugagcuccuggccgaagaguugcagcacagacugcauguugaagcugccguggcagagggggcuaaaaaugucgugaaguugcucagcaguaggcggacccaagaucgaaaagcccuggcggaagcccaggcacaguuacaagaguccucucagaagcuggaccuccuucgccuggcuuuggagcagcuacuggaacagcucccacccgcccacccucugagaagcaggguaacacgggagcuucgcgcugccguuccaggauacccccaaccguccgguacuccugugaagcccaccgcacugacaggcaccuugcaggucagacuccuggggugugaacaguuacugacugccgugccaggaagguccccugcugcggcacuagccaguagccccucugagggcuggcuccguacaaaagcuaagcaucagcggggucgaggggaacuggccuccgaggugcuugcagucuugaaaguugauaacagagugguaggacaaaccggcuggggccagguggccgagcagucaugggaccagacguucgucaucccacuggaaagggcucgcgagcucgaaauuggggugcacuggcgggauuggagacaacugugcggaguugccuuucuuaggcuggaggacuucuuggauaaugcaugucaccagcucagccugaguuuagugccccagggucugcuauuugcgcaggucacuuucugcgacccugugaucgagcgccgaccacggcuccaacgucaggaaagaauauuuucuaagaggcgcggccaggauuuccugcgggcuucccaaaugaaccuugggauggccgcauggggaagauugguaaugaaucugcucccgcccuguagcucgccuucuaccaucuccccacccaaaggcugcccuaggacaccaacuacccugcgagaggccucagaccccgcuacaccgaguaacuuuuuaccuaagaaaaccccacugggugaagagaugacgcccccucccaagccaccucgccuuuauuugccccaggaaccaacuagcgaggagacaccgcggaccaagagaccucauauggaacccaggacucgucgcgggccaucacccccugccucuccaacacggaaacccccuagacuccaggauuucaggugucuggcaguucuaggccgaggacacuuuggcaaggugcugcucguccaguucaaagggaccggaaaguacuaugcuauuaaagcccugaagaagcaagaggugcuuagccgggacgaaaucgagucauuguacugcgaaaaacgcauucuggaggcggucgguuguacgggccauccguuuuuacucagucugcuugccugcuuccagaccuccagccacgcuuguuuugugacagaguucguuccagggggagaccugaugaugcagauccaugaagauguguuccccgagccucaggcaagauuuuauguagccugcgucguguugggccuccaauuccugcacgaaaagaaaauaauuuacagggaccuaaagcuggauaaucuccugcuugacgcucaggguuuucuuaaaaucgccgauuucgggcugugcaaggagggcauuggauuuggcgaccggacuucuaccuucugugggacaccagaauuuuuagcacccgagguucucacucaggaggcguauacccgagccguggauugguggggacuggguguccuucuguacgaaaugcuagugggcgagugcccuuucccgggggacacagaagaggagguauuugauuguaucgugaacauggacgcucccuacccaggauuccucucaguucagggccuggaauuuauccaaaaguugcugcagaaaugcccugagaagagauuaggugccggggaacaggaugcagaggaaauuaaaguccaacccuucuuucgcaccacuaauuggcaggcucuccuggccaggacgauacagccaccuuucgugcccacacuuuguggcccagcagaccugcguuauuucgagggagaguuuaccggcuugccgccugcccucacucccccagcuccccacagucugcuaaccgcgcggcagcaagccgcauucagagacuuugauuucgugagcgaaagguuucuggagccuuga

SEQ ID NO: 60765 - RNA, 960 nt, Artificial Sequence
  derived and/or modified sequence opt3 from PKNOX1__Homo_sapiens__NP_001273187
auggugaaggccauccagguccugaggauucaccuccuugagcuggaaaaaguuaacgaguugugcaaggacuucuguagcagauacauagcuugcuuaaaaaccaagaugaacuccgaaacacugcuaucuggcgagcccgggucaccuuauaguccagugcaaagccagcagauccaguccgcaauuacuggaacgaucucuccgcaagguauuguagugcccgccucggcgcuccagcagggcaaugucgcuauggccaccguggcagggggaacaguuuaccagccugugacugucgugaccccacaaggccagguaguuacacagacccugucacccgguacuauccggauacagaauagccaacuucagcugcaguugaaccaagaucucaguauccugcaucaggacgauggguccucuaaaaauaagcgcggagugcugccuaagcacgccacaaacgucaugcgaagcuggcucuuucagcauauuggccacccauaucccaccgaagacgagaaaaagcagaucgcugcacaaacgaauuuaacucugcuucaggugaacaauugguucauuaacgcccguagaaggaucuugcagccuaugcuggauuccucauguagugagaccccaaaaacaaagaaaaagacugcucagaaucggccggugcaacgcuuuuggcccgacagcauagccucuggcgucgcgcagccuccacccuccgaacuaaccaugucagagggggcaguugugacaauuaccacgccuguaaacaugaauguggauagccuccagagucugucuuccgacggagccacucuugcuguccagcaagugaugauggccggucagagcgaagaugagucgguugacucuacagaggaagaugcaggcgcucuggccccagcgcauaucuccggguuggugcucgagaacucagacagucugcaguga

SEQ ID NO: 60766 - RNA, 1332 nt, Artificial Sequence
  derived and/or modified sequence opt3 from PKNOX2__Homo_sapiens__XP_005271700
augaccgccacagcucagcccccuagcaaggcacaagccgugcacaucuccgcgccaucugcugccgcaucaacuccgguccccagugccccuauugacccacaggcucagcuggaggcagauaaaagagccguuuacaggcauccccucuucccucuucugacguuguuauuugaaaagugcgagcaggcuacccaaggcagcgaauguauaacauccgccucuuucgacguggauaucgagaacuuuguacaccagcaggaacaggagcauaaaccauucuuuucggacgaucccgagcuggacaaucuaauggugaaggcgauucaaguccuccggauccaucugcuugaacuggagaaagugaacgaauugugcaaggauuucuguaaucgcuauauuacuugccucaagaccaaaaugcacucagacaaccugcugcgaaaugaucucgggggaccuuacagcccaaaccagccgaguaucaauuuacacucccaggaccugcuucagaacucucccaauagcauguccgguguuucaaacaauccucaaggcauaguggucccagcaagugccuugcagcaggggaacaucgcuaugacaaccgugaauagccaaguaguuucuggaggcgcccuguaucagcccgugacuauggucacaucccagggucagguggugacccaagcaauuccucagggggcuauccagauucagaacacgcaagucaaucuagaucucacuucacugcuugacaacgaggauaagaaaagcaagaacaaacguggaguucugccaaagcacgccaccaauaucaugagaaguugguuguuucagcaucucaugcaccccuacccgacagaggacgaaaagaggcagauagcggcccagacuaaccugaccuuacugcaagugaauaacugguucauuaaugcacggcgcagaauccuccagccuaugcuugacgcuucuaaccccgauccagccccuaaagcuaagaaaauuaagucccagcauaggcccacacagcgguuuuggccaaauagcaucgccgcaggcguacugcaacagcagggcggggcccccggaaccaacccugacgguucgaucaauuuggauaaccuacaaucucuguccucagacagugcuacgauggcgaugcagcaggcaaugauggccgcucacgaugacagccucgauggcacugaggaagaggacgaagaugagauggaggaagaggaagaggaggaacuggaggaagagguggacgaacuucagacaaccaaugucuccgaucugggguuggagcacucugacagccucgaauga

SEQ ID NO: 60767 - RNA, 2244 nt, Artificial Sequence
  derived and/or modified sequence opt3 from PKP1__Homo_sapiens__NP_000290
augaaccacagcccccugaagaccgcccucgcuuacgagugcuuccaggaccaagauaauuccacacuugcacugccuucugaccagaaaaugaagacuggcacgucagggagacagagggugcaggaacaagucaugaugaccguuaaacggcagaagaguaaaagcucccagucuucgacauugucacauagcaaccgcggaaguauguaugaugguuuagccgacaauuacaacuauggcacuaccucccgaucuagcuacuauuccaaguuucaggcggggaauggaucauggggcuacccaaucuauaacgguacacugaagcgugagccggauaauagaagguucaguagcuacucucaaauggaaaacuggucccggcacuacccccgcgggucauguaauaccacuggagcuggcagcgacauuugcuuuaugcagaaaauaaaggccaguagaucugagccugaucuauauugugacccaaggggcacacuccggaaagggacccugggauccaagggucagaaaacgacucagaaccgcuacagcuucuauucgaccugcucuggccaaaaggcaaucaagaaaugucccgugcgaccuccauccugcgccucaaagcaggaucccguauacauuccuccaaucaguuguaauaaagaccuuagcuuugggcauuccagagcuucuagcaagauuugcucagaagauaucgaguguaguggacugacaauaccgaaagcagugcaguauuuguccagccaagacgagaaguaccaggccaucggcgcuuauuacauucagcacacuugcuuccaggaugaaucugccaaacaacaggucuaccagcucggugggaucuguaagcugguggaccugcucaggucacccaaccagaauguucaacaggcggcagccggagcuuuacggaaccugguguuucguaguaccacaaauaaacuugagacccgcagacagaacggcauuagggaagccgucagcuugcugcggcgaacgggcaacgcagagauccagaagcaacuaacugggcuccuguggaaucuuuccucuacagacgagcugaaggaagaguugauagcugaugcccucccugugcuggcggaccgcguaauuaucccauucucgggauggugcgaugguaacagcaauauguccagagaaguuguggaccccgaggucuuuuucaacgccaccggcugcuuaaggaaacggcuggggaugcgcgaacuccuugcacuggugccucagagagcuacuucaaguagggugaauuugucuagcgccgaugcuggacgucagacaaugcggaacuauuccggccuaauugacucacugauggccuacguccagaauuguguugcagccagccgaugcgaugacaagucuguggagaacuguaugugcguacuccauaaucuguccuauagacuugaugcugaggugccaaccagguaccgccaacuggaauauaacgcgcggaaugcauacacggagaaaaguagcaccgguuguuuuucuaacaaguccgacaagaugaugaauaacaauuaugauugccccuugccggaagaggaaacaaacccuaaagggucaggcuggcucuaccacagugacgccaucagaacuuaccugaacuuaaugggaaagagcaaaaaggacgcuacccuggaggccugugcaggcgcccuacagaaucucacagcuucgaaagggcugauguccucuggaaugagccagcuuaucgguuugaaggagaagggccugccccaaauugccaggcuccugcagucagggaacagugaugucgugcgcuccggagcaucucuucugagcaauaugucccgacacccauugcuccaucggguuaugggcaaccagguguucccugaagucacucgucuguuaaccucacacacagguaauaccagcaacagugaggacauacugucuuccgcgugcuauacugugagaaaucuaauggcuagccagccccaacucgccaaacaguacuuuucgucaucuaugcugaacaauaucauuaaccuuuguaggaguuccgcaagcccaaaggccgcugaagccgcacgcuugcugcucucugauauguggagcuccaaagagcugcaggggguauuacggcagcaaggcuucgacagaaauaugcugggaacgcuugcuggcgccaacucauugaggaauuucacaagucgauuuuga

SEQ ID NO: 60768 - RNA, 2514 nt, Artificial Sequence
  derived and/or modified sequence opt3 from PKP2__Homo_sapiens__NP_001005242
auggccgcucccggcgccccugcagaguacggguauaucagaaccgugcugggacagcaaauucucggucagcuugacagcuccucucuggcguugccaucagaagcuaaguuaaaacuggccggcaguagcgggaggggaggccagacagucaagucccuacggauacaggagcaaguucagcagacucucgcacgcaaaggucgaucuucgguggggaacggaaaucugcaccguacgucaagcguaccggaauacguguauaaccuucaucuggucgagaaugauuucgugggcggcagaagucccguuccuaagaccuacgacauguugaaagccgggacaacugcuaccuaugaaggaagguggggucggggcacagcacaguacuccucucaaaagagcguggaggagcgcucccucagacacccacugaggcggcuggaaaucucacccgauaguagcccugagcgcgcccauuauacccacucugacuaccaguacucccagcgaucacaggcugggcauacucuccaccaccaagaaagcagaagggccgcguuacuggucccaccccgguaugcacguagugagauugugggaguaucucgcgccggcacaaccuccagacagaggcauuuugauacguaccaccggcaguaucaacaugguagcguuucggacacuguguucgauucuaucccugcuaacccagcccuuuugaccuacccgcgacccgggacaucccgcucaaugggaaaucugcuagagaaggaaaacuaucucacugcaggccugaccgucggccaggugagaccucuugugccacugcagcccgucacacagaauagggcuagucggagcuccuggcaccaaucuagcuuucacucaacccgcacguugagagaggccgggccuaguguugcgguggacuccagcggaaggcgugcccaucucacuguaggucaggcagcugccggcgggucuggaaaccuguuaacagaacggucaaccuucacugauagucagcugggcaaugcugacauggagaugacacucgaacgagccgugagcaugcuugaggcagaucacaugcugccauccagaauuucugccgcugcgaccuuuauccagcaugagugcuuccaaaaaucggaagcaaggaagcgcgucaaccaguugcgggguauacuaaaacugcuccagcugcuuaaggugcagaaugaggacguucaaagagccguguguggggcucugaggaacuuggucuuugaagauaaugacaacaaacucgagguggccgaacugaauggcguaccccgcuuacugcagguucuaaagcagacgcgagaccucgagaccaagaaacagaucacaggacugcuuuggaacuugagcuccaacgauaagcugaaaaaucucaugauuacugaggcacugcuuacccugacagaaaacaucauuaucccguucucaggcuggccugagggggacuaccccaaggccaauggauugcucgauuuugacauauucuauaacgugacugguugccugcggaauaugaguucugcuggcgccgaugggcguaaagcaaugagaaggugugacggauuaauugauagccugguccacuacgugcgcggcaccaucgcggacuaccaaccagaugacaaggcuacagaaaacugcgucuguauucuacauaaucucuccuaucagcuggaggccgaacuuccugagaaauacucacagaacaucuauauccaaaaucggaacauucagaccgauaauaacaagagcauagguugcuuugggucuagauccaggaaggugaaagagcaguaccaggacguucccaugccagaagagaagaguaaucccaaaggcguggaaugguuguggcacagcaucguaauucgaauguaucugucucucaucgcaaaguccguccgcaacuacacucaagaggccucacugggagcuuuacagaaucugacggccggcagugggccuaugccaacaagcguggcacagaccguugugcagaaagagucgggacuucaacacacucggaagauguugcaugucggugacccguccgugaagaaaaccgcuauaucucuccugagaaaccuaagcaggaaccugucacuccagaaugaaauugccaaggagacacugcccgaucuuguaaguaucaucccugacaccgugccauccacugauuugcugauugaaacaacggcgucugccuguuauaccuuaaacaauaucauucagaacagcuaccagaaugcucgugaccuccugaacacuggcgggauacagaaaaucauggcaauuuccgccggagaugcuuacgccucaaauaaggcaagcaaagcggccaguguucuucuguauucuuugugggcucacacagagcuccaucacgccuacaagaaggcacaauucaaaaagaccgacuuugucaacucccgcacagcuaaagccuaucacagccugaaggauuga

SEQ ID NO: 60769 - RNA, 2394 nt, Artificial Sequence
  derived and/or modified sequence opt3 from PKP3__Homo_sapiens__NP_009114
augcaggacggcaacuuccugcucagcgcccuucaacccgaggcuggggugugcucccuggcauugccuucugauuuacagcuggacagaaggggagccgaagguccagaggcggaacggcuacgcgcugcccgaguccaggagcagguucgugcaagacuccugcaacuuggccagcagccgaggcacaauggggccgcugaacccgagccugaggcagaaaccgcccggggaacaucacgcggccaguaccauacucugcaagcugguuuuaguagcagaucccagggguugucuggagauaagacgucgggcuucaggccaaucgccaaacccgcguauucacccgcaagcuggaguucccggucugccguggaccucagcuguucccgccgacugucaagugcucacaacggcgggagcgccuuuggagcagcugguuacggcggggcccagccaaccccuccuaugccaacaagaccgguaucuuuccaugagaggggaggcguggguucccgggcggauuaugacacucugucacuccguagcuuacgccuggggcccggaggccuugaugacagauacaguuuggucucugaacagcuggagccugccgcaaccuccacauauagggcuuuugccuacgagcggcaagcuagcucgucuuccucacgagccggcgggcuagauuggccagaagcaaccgaggugagucccagccgcacuauuagagccccugcuguuaggacacuccagcgguuccaguccucucaccgcagcagaggaguggguggcgcggucccaggggcagugcuggaacccguagccagggcuccgucaguucguagucuuucccugagcuuggccgacucuggacaucucccugaugugcacggcuuuaauucauaugguagucaccggacccugcaacgauuaagcuccggguucgacgauauagaccugcccucugcagucaaguaccucauggccucggacccaaaccuucaggugcugggcgcugccuacauccagcauaaaugcuauagcgaugcagcggcuaagaaacaggccagauccuugcaagcagugccuaggcuagucaagcuguuuaaucacgccaaccaggagguucagcgccaugcuacgggagccaugcggaaucucauuuacgacaacgcagauaauaagcuggcucuuguggaagagaacggcaucuucgagcuguugagaacucucagggaacaggacgaugagcugcgcaaaaauguaaccgggauuuuauggaaccugucaaguucugaccaccuaaaggaucgacucgcccgggacacacuggaacaacuuacugauuuggugcugagcccccucuccggagcggguggcccaccccugauccagcagaaugccucagaggcugaaauauuuuauaacgcaaccggguuccuucguaaucugagcucugccucccaggcuacaagacagaaaaugagggagugucacggauuggucgacgcccucgugaccaguaucaaccaugcacuggaugcgggcaagugcgaggacaaaagcguugaaaacgccgugugugucuuacgcaaucugucuuaccggcuauaugacgagaugccuccauccgcucuccaaagacuggaagguagggggcgacgcgaucuugccggcgcaccgcccggagaggugguaggcugcuuuacgccucagucacggagauugagggaacugccacucgcugccgacgcacugacuuucgccgagguuaguaaggaucccaagggguuagaguggcuguggagcccucagauugugggacuuuacaaccguuugcuccaacgcugugaacugaaucggcacacaaccgaggcugcggccggugcacuacagaacaucacugcuggcgacagaaggugggccgggguccugucgcgacucgcccuggaacaggagcggauucuuaauccauugcuggaucgcgugagaacagcugaccaucaccaauuaaggucccucaccggacugauccggaaccuuucucgaaaugcaagaaacaaagaugagaugagcacgaaggucgugucacaucugauagaaaaauugcccggcaguguuggugagaaguccccgccugccgaagugcucguaaauauuaucgcgguccugaacaaucuagugguugcuucuccaauugccgcacgcgaccugcucuauuucgaugggcugaggaaacuuaucuuuaucaagaaaaagcgugacagccccgauuccgagaagucaagccgggccgcuaguucuuugcuggcaaacuuauggcaguacaauaaacuccacagagacuucagggccaagggcuaccgcaaagaagauuuucugggaccuuga

SEQ ID NO: 60770 - RNA, 3450 nt, Artificial Sequence
  derived and/or modified sequence opt3 from PKP4__Homo_sapiens__NP_001005476
augcccgccccugagcaggcuagccugguggaagagggccaaccacagaccagacaggaagcagccuccacagggccgggaauggagcccgaaacuacggcgaccacaauccucgcuucugucaaggagcaggagcuucaauuccagaggcugacucgggaauuggagguugaacgccagauuguggccucacaguuagagcgaugccgucugggugcagagaguccuagcauagccuccaccucuucgacagaaaaaucauuuccauggagaagcaccgacguacccaacacuggcgugaguaagccuagggucuccgaugcugugcaaccaaauaacuaccuaauccggacagagcccgaacaggggacccucuauucuccugagcagacgagccugcacgaauccgagggaucacuuggcaauagucgcagcucuacucagaugaacuccuacucagacagcgguuaucaagaggcagggaguuuccauaauucucagaacguuuccaaagccgauaauagacagcaacacagcuuuauuggaucgaccaacaaucauguggucaggaacucucgggcugaaggccagacacuggugcagccauccguagccaaucgcgcgaugcgaagaguuucaagugugccgagcagggcacagucccccucuuacgucaucagcacuggcgugucaccuagucggggguccuugcguaccagccucggaucugguuucggcucaccaagugugacagacccccgcccucugaacccaagcgccuauuccucuaccacgcugcccgcugccagagcagcuucgccguacagccaaaggccugccucccccacugcgauucggcgaaucgggucagucacaagucgccagaccucuaauccaaacggaccuacuccccaguaucagacaaccgccagaguuggcagcccacucacguuaaccgaugcacaaacaaggguggcuucccccucacagggucagguagggagcagcuccccuaagcggaguggaaugacugccgugccacagcaccugggcccgagccuucaacgcaccguccaugacauggagcaguuuggccagcagcaauacgauauauacgaaagaauggugcccccuaggccagacucuuugacagggcugcguuccucauaugcuagucagcacagccagcuaggacaagaucuccggucggccguuucccccgaccugcacaucacuccuauuuacgagggucgaaccuauuacucuccaguguauagaagccccaaucauggcacagucgaacuucaggggucacagaccgcacuguacaggacuggaagugugggcaucgguaacuugcagcgcacguccucucaacggagcacacucaccuaucagagaaacaauuacgcccugaacacuaccgcuacauacgcggagccguauaggccuauucaguaccgcguacaggaguguaauuauaaccgauuacaacacgcaguuccagccgaugacgggaccacucggucccccucaaucgauagcauacagaaagacccucgugaguucgcuuggagagaccccgaacugccagaagugauucauaugcuccagcaccaguuuccuaguguccaagccaaugcagccgcuuaccuucagcaccugugcuucggcgauaacaaggugaagauggaggucuguagguugggaggcaucaaacaucuaguggaccugcucgaucaccgcguucuggaagugcagaagaaugccugcggggcacuucggaaccugguauuuggaaaaucuacagacgagaauaagauugcgaugaaaaacgucgguggcauccccgcuuugcucagacuguuaaggaaguccaucgaugccgaggugcgagaacugguuacgggggugcuauggaaucucagcucgugugacgcagucaagaugaccauuauacgcgaugcccugucaacucuuacaaacaccgugaucguaccacauucuggauggaauaacaguuccuucgacgaugaccacaaaauuaaguuucaaacaucuuuggugcugcggaauacuaccggcugccucagaaaccugucuagcgcuggugaggaagccaggaaacagaugcguuccugugaggggcuuguugauucacuguuguaugucauccauacgugcgugaacaccagugacuacgacagcaagacaguggagaauugugucugcacucuccgcaaccugucuuaucgguuagaacuggagguuccgcaggcaagacuacucggccugaaugaacuugaugacuugcugggaaaagaguccccuucaaaggauagugaacccagcuguuggggcaaaaagaagaaaaagaaaaagaggaccccacaggaggaccaaugggauggggugggacccauaccuggucucuccaaaucuccaaagggcguggagaugcuguggcaccccucgguagucaagccuuacuuaacacugcuugcugaaagcucaaacccggccacuuuggagggguccgcgggaagucuccagaaucugucugccggcaacuggaaauucgcugcauacauucgagccgcugugcggaaggaaaaaggucuaccaauccugguugagcuccugcgcauggacaaugauagaguggucagcuccguggccaccgcacuuaggaacauggcguuggacguucggaauaaggaacugaucgggaaauaugccaugcgagauuuagugaacagacuccccggcggaaauggcccuucaguacugucugacgagacgauggcugccauuugcugcgcacuucacgaggucacaagcaagaacauggaaaaugcuaaggcccuggcagauagugggggaaucgagaaauuggugaacauuaccaagggccgcggugacagguccagccucaaaguggucaaggccgcugcgcagguucugaauacucuauggcaguaccgugaucugcggucuauauauaaaaaggacggguggaaccaaaaccauuuuaucacaccagugucaacccucgaaagagacagguucaagucccaccccagucugagcacuaccaaucagcagaugucgccuauuauccagucuggauccagcaaaccgucacccaucuacauuaguucuuauuccagcccagcccgcgagcaaaaccgaagacuucagcaucagcaguuguacuauucacaagaugacaguaaucggaagaacuucgaugcauacaggcuguacuuacagagcccucacuccuaugaagaccccuacuuugaugaccgcguacacuucccagcuucuacagauuauagcacgcaguacggccucaaauccaccacuaauuauguggacuuuuacucaacaaagcguccuucuuauagagccgagcaauaccccgguaguccagauucgugggucuga

SEQ ID NO: 60771 - RNA, 1323 nt, Artificial Sequence
  derived and/or modified sequence opt3 from PLA1A__Homo_sapiens__NP_001193889
augcccccuggcccaugggagagcugcuucugggucgggggacugauccucuggcuuuccguggguucuucaggcgacgccccgcccaccccucagccaaagugugcugauuuucaaagugcaaaccuguucgaagggacagacuugaaaguucaguuuuuacuguucgugcccagcaauccuuccugcggacagcuaguagagggaucuucggaucuccagaacucagguuuuaaugccacucuggggacgaaacuuauuauacacggauucagagugcugggcaccaaaccaagcuggaucgacacauuuauuaggacuuugcuccgggcgaccaacgcuaaugucaucgccguggauuggauuuacggcaguacagggguuuauuucuccgcagugaagaacguccugggagugucugaaagcuccauccauauaaucgguguaucacugggcgcccacguugggggaauggugggccaacucuuuggugggcaguuaggacagauuaccggccuggaccccgcuggcccugaguacacucgcgcaagugucgaggaacgacuugaugccggggacgcuuuguucguggaggccauccauacagauaccgacaaucugggcauucguaucccagugggucacgucgauuauuuuguuaacggcgggcaggaccaaccgggaugucccacguucuuuuacgcgggcuauagcuaccuaauaugcgaucauaugagagcagugcaccucuauauuucugcccuggaaaauuccuguccucuuauggcuuucccaugcgccucauacaaagcauuccuggcugguagguguuuggacugcuuuaaccccuuccuccugagcuguccucggaucggguuaguagagcagggcggagugaagauugaaccacugcccaaggaggucaaaguguaccuccuuacuaccaguucugccccguauugcaugcaccauucccugguugaguuucacuugaaggaacuacgcaauaaagacacaaacaucgaggugacuuuccugagcucgaauaucaccucuuccucaaagauuacaauaccuaaacagcagagauacggcaaggggaucauugcgcaugccacgccccaaugucagaucaaccaggucaaguuuaaauuccaaaguagcaauaggguguggaagaaagaucggaccacuauaauuggaaaguuuugcacagcacuccugccaguaaacgaccgcgaaaagaugguuugccuuccugagcccgugaaccugcaggcuuccgucaccgugucuugugauuugaagaucgccugcgucuga

SEQ ID NO: 60772 - RNA, 498 nt, Artificial Sequence
  derived and/or modified sequence opt3 from PLA2G10__Homo_sapiens__NP_003552
augggcccccugccugugugccucccaaucaugcuucuguuguuacugccgagccuacuccugcuucuguugcuccccgggccuggauccggugaggccucuaggauucugagaguccaccggcgcggcauacuggaacucgcugggaccguuggaugugugggcccacgaacacccaucgcauacaugaaguaugguugcuucuguggguuaggaggccauggccagccucgugacgccauugauuggugcugucacgggcaugacugcuguuacacuagagcggaggaagcuggaugcucaccaaaaacggagagguauaguuggcaauguguaaaccagagcgugcugugcggucccgccgaaaauaagugucaggagcuuuugugcaaaugcgaucaggagaucgcaaacugucuggcccaaaccgaauacaaucuaaaguaucucuuuuacccucaguuccugugcgagccagacuccccgaaaugugauuga

SEQ ID NO: 60773 - RNA, 570 nt, Artificial Sequence
  derived and/or modified sequence opt3 from PLA2G12A__Homo_sapiens__NP_110448
auggcccugcucagcagacccgcucuuacccuguuguuacugcuaauggcagccguggucaggugccaggagcaagcgcagacaacugacuggcgggcuacgcucaagaccauccgcaacggcguucacaaaauugauacauaccugaaugccgcacuugaccugcucgggggagaagaugguuugugucaguauaagugcuccgacggcucuaaaccuuucccacgauacggguauaagccgucacccccuaacggauguggcaguccacuguuuggugugcaucugaauauagggauccccagccucacuaaaugcuguaaccagcacgaucguugcuacgagaccuguggaaaguccaagaaugacugcgaugaagaguuccaauauuguuuaucuaaaauuugcagagacguacagaagacacugggccuuacccagcaugugcaggccugugaaacuacagucgaguugcuguuugauucggugauccaccuaggcugcaaaccuuaccucgacucacaaagggcugcaugccggugucauuaugaggaaaagaccgaucuguga

SEQ ID NO: 60774 - RNA, 588 nt, Artificial Sequence
  derived and/or modified sequence opt3 from PLA2G12B__Homo_sapiens__NP_115951
augaagcuggccagcggcuuccucgugcuuuggcuguccuuagggggagguuuggcucagucugacaccucacccgauacagaggaaaguuacagcgacuggggccugagacaccuaaggggguccuuugagucugucaacucguauuucgauucauuucucgaacugcuuggaggcaaaaaugguguuugccaauaccggugucgcuaugggaaggcaccuaugccacgaccgggauacaaaccccaggagccuaacggcugcggcagcuauuuccugggguugaaggugccagaaaguauggaccucggaauccccgccaugacuaaauguugcaaucagcuggauguauguuacgacacgugcggugcgaacaaguaucguugugaugcuaaguuuagauggugccugcauuccauuuguucugaccucaaaaggagcuuaggcuucguguccaaggucgaggccgcaugcgauucacugguggacaccguuuuuaauacaguguggacucuugggugucggccuuucaugaacagucagcgcgccgcuugcauaugcgcagaggaagagaaagaagaguuguga

SEQ ID NO: 60775 - RNA, 1239 nt, Artificial Sequence
  derived and/or modified sequence opt3 from PLA2G15__Homo_sapiens__NP_036452
augggccugcaccucagacccuacaggguggggcuucugccugacggauuguuauuccugcuacuccugcuuaugcuguuggccgauccagcucucccggcaggucggcaucccccugucguucuggugccaggcgaccuggggaaccagcucgaggccaaguuagauaaacccaccguagugcacuaucugugcagcaagaaaacagaauccuacuuuacuaucuggcuuaauuuggagcugcuacucccugucauuauagacuguuggaucgauaacauucgccugguguauaauaagacgucucgagcgacccaauucccagacggaguugaugugcguguccccggcuuugguaaaacauucucacuugaauuucuggacccuaguaagagcuccguggggucuuacuuccauacuaugguagagucguugguuggauggggcuauaccagaggcgaagaugugaggggagcuccauacgacuggcggcgcgccccgaacgagaaugggcccuauuuucucgcacugagagagaugaucgaagagauguaccaguuauacgguggcccugucgugcugguggcccacucaauggggaacauguauacacucuacuuccuucagaggcagccacaggcuuggaaggauaaauauauucgggcauuugucagccugggagcccccuggggcgguguugcuaagaccuugcgcgugcuagccaguggggacaauaaccgaaucccuguaauaggaccacugaaaaucagagaacaacagagguccgcggugucuacuagcuggcuccugcccuacaauuauacaugguccccggagaaggucuucgugcagaccccuacgauuaacuacacucuucgggauuaucguaaauuuuuccaagacaucggcuuugaggacggcuggcugaugcgccaggauaccgaaggguugguugaggcaacaaugcccccaggagugcagcuccauugccuguacgguacuggcgucccuacccccgacucauucuacuaugaaaguuucccagauagagaccccaagauuuguuuuggggauggagacggcacagugaauuuaaagagcgcccugcagugccaggcuuggcaaucuaggcaggagcaccaaguacuacuccaggaacugccugguuccgagcacaucgagaugcuugccaacgcaaccacguuggcuuaccugaaacggguucuccuggggccauga

SEQ ID NO: 60776 - RNA, 489 nt, Artificial Sequence
  derived and/or modified sequence opt3 from PLA2G16__Homo_sapiens__NP_009000
augagagcccccaucccugagccaaagccgggcgaccugauugaaauauucaggcccuuuuaccggcacugggcuaucuaugugggggauggauacgucguucaucucgcaccuccaagcgagguggccggugcgggcgcugccuccguaaugucugcacuuaccgacaaagccauugugaagaaagaacuguuguaugaugucgcugggucagacaaguaccaggugaacaauaaacacgaugacaaguauagucccuuaccuugcagcaagaucauucaacgcgcagaggaacugguuggacaggaggugcuauacaaacucacauccgagaacugugaacauuucgucaaugagcugcgauauggcguggcccguucugaucagguaagagacguuaucauagcugccucgguggcggguauggggcuugcagccaugucacugaucggagucauguuuagcaggaacaagcggcagaaacaauga

SEQ ID NO: 60777 - RNA, 447 nt, Artificial Sequence
  derived and/or modified sequence opt3 from PLA2G1B__Homo_sapiens__NP_000919
augaagcugcucgugcuugccguccuguugaccguugcugcagccgacagcggcaucucccccagagcgguguggcaguucaggaaaaugauuaagugcguaauaccugggucugauccauuuuuagaguacaacaauuauggauguuacugcggucugggcgggucaggaacaccgguggacgaacuagauaaauguugccaaacucacgacaacuguuaugaucaggcuaagaaacucgacaguugcaaguuccugcuugauaaucccuacacgcauaccuauagcuacuccuguucuggcucggccaucacaugcucaagcaagaacaaagagugugaagcauuuauuugcaauugugaccggaacgccgcuaucugcuucaguaaggcaccuuauaauaaagcccacaagaaccuggauacuaaaaaguacugccaguccuga

SEQ ID NO: 60778 - RNA, 1530 nt, Artificial Sequence
  derived and/or modified sequence opt3 from PLA2G3__Homo_sapiens__NP_056530
augggcgugcaggccgggcuguucggaaugcucgguuuucuuggcgucgcucugggagggagccccgcauugagaugguacaggaccuccugccacuuaacaaaggccguuccuggcaacccacuggguuaucuaucuuuccucgcgaaagacgcucaagggcuggcccuuauccaugcacggugggaugcccaccgccgacugcagucauguaguugggaggacgaaccggaguugacugcugcauacggagcccucugcgcucaugaaacggccuggggcagcuuuauucacacccccggcccugagcugcagcgugcgcuggcaacacuccagucccaaugggaagccuguagagcuuuagaggagucuccagccggggcaaggaagaaacgggcugccggacagucgggugugcccggcgggggacaucagcgcgaaaagagaggcuggacuaugccugguacccuguggugcgggguaggagauucagcgggcaauagcagugagcuuggcguguuccaggggccagacuuguguugcagggaacacgaucgguguccccaaaacauauccccucugcaguauaauuacggaauccgcaacuaucgauuucacacaauuucucauugcgacugugauaccagauuccagcagugccuacaaaaucagcacgacagcaucuccgauauugucgguguggccuuuuucaacguucucgagaucccauguuuugugcuggaggaacaggaggcaugcgucgcuugguacugguggggcgggugcaggauguauggaacugugccgcuugcccggcugcaaccccguacauucuacaaugcuucauggaguagccgcgccaccucuccuacgccauccucaagaagccccgcaccuccaaaacccaggcagaagcagcauuugcggaagggcccgccucaccagaaagguaguaagcgacccucuaaagccaacacuaccgcucuccaagacccaaugguauccccucgccuggauguugcgcccacaggguuacagggcccacagggaggccugaagccccagggggcaagauggguguguaggagcuuucggcgccaccucgaccaaugcgaacaucagauaggaccuagagagaucgaguuccagcuucugaacucggcccaggaaccauuguuucacuguaauugcacuaggcgucuagcucgguuccugcgacuccauucuccgcccgaggucaccaauaugcugugggaacuucuggguacaaccuguuucaaauuggccccuccacucgauugcguggagggcaagaacuguuccagagaccccagggcaauucgcgugucagcccggcaccugagaagguuacaacagcgccgacaucagcugcaggacaaggggacggaugaacggcaaccuuggccaagugagccccuacguggaccgaugagcuuuuacaaucagugccuccagcugacucaagcugccagaaggccugaccgccagcagaaauccuggucucaguga

SEQ ID NO: 60779 - RNA, 2250 nt, Artificial Sequence
  derived and/or modified sequence opt3 from PLA2G4A__Homo_sapiens__NP_077734
augagcuucaucgaccccuaccagcacauuauaguggagcaucaauauucccacaaguuuaccgucguugugcugagagccacaaaaguaacuaagggcgcuuucggggauaugcucgacacgccugauccauacguggaacuuuuuaucucuaccacaccggacucaaggaaacggacucgccauuucaacaaugauauuaaccccgucuggaaugagaccuuugaauuuauccuggacccuaaccaggagaauguguuggaaauuacauuaauggaugcaaacuauguuauggacgagacccugggaacugccacauuuaccgugaguagcaugaaggucggugagaaaaaggaagugccauucaucuuuaaucagguaacggagaugguucuagaaaugucccucgaggugugcucuugucccgaucugcgauucucgauggcgcuuugcgaccaggagaagacuuuucgucaacagagaaaagaacacauaagggagucaaugaagaaacuguugggcccuaagaacagcgaagggcuccauagugcucgggaugucccagugguggccauccugggauccggcgguggguuccgcgcaauggucggauuuucuggcguuaugaaagcccuguacgagagcggcauucucgacugugcuaccuauguggcaggguuauccggaucaacaugguacaugaguacucuguauagccaccccgauuucccugaaaaggguccagaggagaucaaugaagaacuuaugaagaacguaucucacaauccguugcugcuacucacaccccagaaagugaagagauacgucgaaucccuguggaaaaagaaaucaagcggccagccugugaccuucaccgacauuuuugggaugcuuaucggagagacgcugauacauaacaggaugaauacuacauugaguucucucaaggaaaaaguuaacaccgcccaaugcccacugcccuuauucacuugucugcacgugaagccugacgucuccgagcucauguuugcugauuggguggaguucagcccauacgaaauuggcauggccaaguaugguacauuuauggcgcccgaccuuuucgggucgaaauuuuucaugggaaccguaguuaagaaauacgaggaaaauccgcugcauuucuugaugggcguguggggcucugcauucuccauccuauuuaaccggguccugggggugucaggaagucagagccgcgguuccacgauggaggaggagcucgagaacauuaccacaaagcacaucgucucuaaugauagcucagacagugaugacgaaucccacgagccuaaaggcacugaaaacgaggaugccgggagcgacuaucagucugauaaucaggcuucauggauccaucgaaugauuauggcccuggugagugacagcgcacuuuucaacaccagagagggaagggcuggcaagguucacaauuuuaugcuggguuugaaccucaauacauccuacccccugucuccauuaucggauuucgccacucaagacagcuucgacgaugacgaacuggaugcggccguggcagacccugaugaguuugaacggauauaugagccccuagacguaaaguccaaaaagauccaugucguggauucagggcucaccuucaaccugccauacccccuuauuuugcguccucagcgcggcguugaccugaucauaaguuuugauuucucugcuagaccaagcgacuccucaccgcccuuuaaagaacuccugcuugccgagaagugggcuaaaaugaauaagcugccuuucccaaagauugaucccuauguguuugacagggagggauugaaagaaugcuacgucuucaagccuaaaaacccagauauggagaaggacugucccacaaucauccacuuugugcucgccaauauuaacuuccggaaauacaaggcaccgggcguaccucgagaaaccgaggaagagaaggagaucgccgacuuugauauuuucgacgauccagaaagccccuuuucuacuuucaauuuccaguauccuaaccaggcuuuuaaacgccugcaugacuuaaugcacuucaauacgcugaacaacauagaugugaucaaggaggcgaugguugaauccauugaguacagaaggcaaaaucccagucggugcagcgucucucuauccaacguggaagcacgcagauuuuucaauaaagaguuucucucaaagccaaaagccuga

SEQ ID NO: 60780 - RNA, 2346 nt, Artificial Sequence
  derived and/or modified sequence opt3 from PLA2G4B__Homo_sapiens__NP_001108105
auggccguggcugaggucagcagaaccugccugcucacaguuagggugcuucaggcacaccggcugcccuccaaggacuugguaacuccuucugauuguuacgugacguuauggcugccaaccgccugcucacaucgccuacaaacacgaacugucaaaaacaguagcuccccgguguggaaucagucuuuccacuuucguauccauagacagcucaagaacguuauggaacugaaaguguucgaccaggaucuugucaccggcgacgaucccgugcugucgguauuguuugacgcggggacacucagggcuggagaguuccggcgcgaaucauuuagccugaguccucaaggugagggcagacuggaaguugaguucaggcuccaguccuuagccgaucggggagaguggcuggugucuaauggaguccuuguggcacgcgaauugagcugucugcacgugcagcuagaggaaaccggcgaccagaaguccucagagcaucgaguccaacucguugugccagguaguugcgaggggccccaggaagccagcguaggaacuggcacauuuagauuccacuguccugcuugcugggagcaggaacugucuauuaggcuucaggaugcaccagaggaacaacugaaagcccccuuguccgcucucccuucaggccaggugguccggcugguguuuccaaccagccaggagccguuaaugcguguugagcugaagaaggaagccgggcuccgcgagcuugcggugagacugggauucggucccugugcagaagaacaagccuuuuugaguaggcggaaacaggucguggcugccgcacuacgacaggcucugcagcucgacggcgaucugcaagaagacgagauaccuguaguugccaucauggcgaccgggggaggcauucgcgccaugacuucucuuuauggucagcuggcaggguugaaggagcucggacuguuagauugcguguccuacaucaccggcgcuagcggcucgacaugggcccuggcuaaccuauaugaagacccagaguggucucagaaagaccucgccgggcccacugaacugcuuaagacccaggucacaaagaauaaguugggagugcuggcaccuucccaacuccagagauacaggcaggagcuggccgaacgggcucgccuugguuauccaucauguuucaccaaccugugggcguugauuaaugaggcacuccugcacgaugagccccaugaccacaaguuaagugaucagagagaagcccugagccauggccaaaacccgcuaccuaucuacugcgcucucaauacgaaagggcagucccugacuacauuugaguucggagaauggugugaguucucucccuaugaggucggcuuuccaaaguacggugccuucauaccuagcgaacuuuuugggucagaguucuuuaugggccaguugaugaaaaggcugcccgaaagucguaucugcuuccucgagggaauuugguccaaccuguacgcagccaauuuacaggacagccuguauugggcuucugaaccaucacaauuuugggaucggugggugcgaaaccaggccaaucuugacaaggagcagguucccuugcucaaaaucgaggaaccuccaaguaccgcaggcagaauugcggaguucuuuacugaucugcuaacauggaggccgcuggcucaagccacccacaacuuccuccgcgggcugcacuuucauaaggacuacuuccagcacccccauuuuagcacguggaaagcaaccacacuugauggauugccuaaucagcugacuccauccgaaccccacuuaugccuccuggacguggguuaucuuaucaacaccucuugucugccuuugcuccagccaacacgggauguagaccugauacuaucgcuggacuacaaccuccauggcgccuuccaacagcugcagcuuuuggggagauucugccaggagcaagggauucccuuuccgccuaucagcccaucccccgaggagcagcugcagccuagggagugucacacuuucucagaucccacgugcccaggcgcuccugccgucuuacacuuuccccucgugagugacucuuuccgcgaauauagcgcaccagguguucgacggacaccggaggaagcugccgcgggggaggugaaucuguccucaagcgauucuccuuaccauuauaccaaggucacuuacucccaggaagacguggauaaacuucugcaccuaacgcauuacaacguauguaauaaccaagagcagcuccuggaggccuugcgucaggcugugcaaagaaggcgccagcggagaccccacuga

SEQ ID NO: 60781 - RNA, 1656 nt, Artificial Sequence
  derived and/or modified sequence opt3 from PLA2G4C__Homo_sapiens__NP_001152794
augagaaccaggccccggccucgccugcgacguacagagaacuuccucacugccgugcaccauggcaagaaagaagagaaggcugcagucgaaagaaggcggcuucacguucugaaagccuugaagaaauuacgcaucgaggcggacgaagcuccagugguagccgugcuggggagcggagguggccuaagagcacauauugccugccucgggguccuguccgagaugaaggagcagggacuucuggaugcugugacguacuuggcaggcguuucugguucaaccugggccauaaguagccucuauacaaaugacggggauauggaagcucuggaggccgaccugaagcacagguuuacucggcaagaaugggaucucgcgaaauccuuacagaagaccauccaggcagcccgcucugagaacuacucgcugacagacuucugggcuuauauggugauuucaaaacagacccgagagcuuccggaaagccauuugaguaauaugaagaaacccgucgaggaaggaacucugccuuacccaaucuuugccgcaauugauaacgaccuacaacccuccuggcaggaggcuagagccccugaaacaugguucgaguuuaccccacaccacgcgggcuucucugcccucggcgcauuugugagcaucacgcauuucggguccaaguuuaagaaaggaaggcugguacggacucaccccgagcgugaucuuaccuuccugcgcgguuuguggggcucagcucucgggaauacagaaguuauaagagaguauaucuuugaccagcugaggaacuuaacucugaagggacucuggcggcgagccguggcuaaugccaaaaguauuggccaucuuaucuucgcacgccuguugagacuacaggaaagcucucaaggugagcacccuccaccggaagaugaagggggagagcccgaacacaccuggcugacagagaugcucgaaaacuggaccaggacgucccuggagaagcaggaacagccucaugaggacccagagcggaaaggcucacuuagcaaucugauggauuuugucaagaaaacuggcauuugugccaguaagugggaaugggggacaacccacaacuucuuguacaagcauggagguauccgcgacaaaauaaugucuuccagaaagcaccuccaucugguggacgcuggcuuagcgauuaauacucccuucccucuggugcuaccacccacaagggagguccaccucauccugagcuuugauuucucggcaggggacccguuugaaaccauucgugccacgaccgauuauugccggcgacacaaaaucccuuucccccagguugaggaggcugaacuugacuuguggucuaaggccccagcauccuguuacauccugaaaggagagacaggcccugugguaaugcauuuuccccucuucaacauugaugccugcgguggggacauagaggcuuggucagauacuuacgacaccuuuaagcuggccgauacauauacucuugacguggucgugcuguugcucgcacuggcgaagaaaaauguuagagagaacaagaaaaagaucuuaagggaacugaugaauguggcuggccuauacuauccaaaagauagugcccgcagcuguugccucgcauga

SEQ ID NO: 60782 - RNA, 2457 nt, Artificial Sequence
  derived and/or modified sequence opt3 from PLA2G4D__Homo_sapiens__NP_828848
auggagagccugucccccggcgggccuccaggacacccguaccagggugaagccucuaccugcuggcaacucacagugagaguccuugaggcuaggaaccugcggugggcagacuuguuaucagaagccgaucccuauguuauccugcagcuaaguacugcgccuggcaugaaguucaaaacgaagacccucacagacacuagccauccaguguggaaugaggcuuuucgcuuccugauucagucccaggugaaaaacguacuugaacugucuauauacgaugaggacucggucaccgaggaugacaucuguuuuaagguguuguaugauauuucagaaguucuccccgggaaacugcugcgaaagacauucagccaaaguccucagggagaggaagaacucgacguggaguuuuuaauggaagagaccuccgaucguccagaaaaucugaucacuaacaaggucauuguggccagagagcuuucuugcuuggacguacaccuggauagcacaggcuccaccgcaguuguggccgaccaggauaaacuagaacucgagcugguccuuaaggguucauacgaggacacgcagaccaguuuccuggggacugcuagcgcauuuagguuccauuauauggccgcuuuggaaacagagcucucuggacggcugcgcuccucaagaagcaauggcuggaacggcgacaauagugccggguacuuaacugugccccugaggccucucaccaucggaaaagaagugacaauggaugucccagcgccgaacgcacccgguguucggcuucaacugaaggccgagggcuguccugaagaguuggcugugcaccuaggguuuaaucugugcgccgaggaacaggcauuccucucucgccgaaaacagguaguggcuaaggcccugaagcaggcgcuucaacuggacagagauuugcaggaggacgaagucccagugguuggaauaauggccaccggcgguggggcaagggcuaugacgucccucuauggacaucuguuagcccugcagaaacuaggccuccuggauugugugacuuacuuuagcggcaucucggggucuacauggaccauggcucaccuuuacggagaccccgaguggucccaacgggauuuggaagguccuauucguuaugcccgcgagcaccuggcaaagucaaaacucgaggucuucaguccagaaagacuggccagcuacaggcgggagcuugaacugcgagcugagcagggccaucccacuacauuuguggacuugugggcgcucguacuggaguccauguuacacgggcagguuauggaucagaagcugucuggacaacgcgcagcccuagaaagaggccagaacccgcucccucuguaucuuagcuugaaugugaaagagaacaaucuggaaacccucgacuucaaggagugggucgaguucucacccuacgagguggguuuucugaaauauggggcuuucgucccaccugaguuauuuggcagugaguucuuuaugggaaggcugaugcggcgcauccccgaaccaagaauuugcuuccuugaagccaucugguccaacauauuuagcuugaaucuccuggaugcaugguacgaccuaacgucuucaggcgagaguuggaagcagcauauuaaggacaaaaccaggagccuggaaaaggagccccucacaacuuccgggaccucuucgcgucuggaggccagcuggcuucagccuggaacagcuuuggcccaagcauucaaagguuuucugacuggccggccauuacaccagcgauccccgaacuuccuccaggggcugcagcuucaccaagauuauuguucacauaaggacuuuaguaccugggcggauuaccagcuggacucuaugcccagccaguugacaccuaaagaaccaagacucugccugguggaugcugccuacuucaucaacaccuccucacccagcauguuuaggccuggacgccggcuagaccugauucucucuuucgauuauucccugagugcaccauucgaggcccuucagcaaacugaauuguacuguagagcuaggggccugcccuuuccgcgcguugagccuagcccacaggaccagcaccaaccccgagaaugccauuuauucucugauccugccugucccgaggcaccaauccuccugcacuuuccucuugugaaugcuuccuucaaggaccauucagcccccgguguacagcggaguccagcggagcugcaagggggccaggucgaucuaacgggagccacaugcccguauacccucagcaacaugacuuacaaggaagaggacuuugaacgucuguugagacugucggauuauaaugugcagaccucccagggcgcuaucuuacaggcacucaggacagcccugaaacaccgcacccuugaggcucggccucccagagcccagacuuga

SEQ ID NO: 60783 - RNA, 510 nt, Artificial Sequence
  derived and/or modified sequence opt3 from PLA2G5__Homo_sapiens__XP_011539888
auggaggugagaaccaagaggccccggaucggcacagacacuaaccgcccuuucgucgaagaggaaauucagauggccauacgaacgccagagaugaaagggcugcucccgcuugcuugguuucuggcaugcagcguucccgccgugcaaggagguuuguuagaucugaaguccaugaucgaaaaaguaaccggcaagaaugcgcuaacaaacuacggguucuauggauguuacugcggcuggggugggcguggaacuccuaaagacggcaccgauugguguugcugggcucacgaccauuguuauggcagacucgaggagaaggggugcaauauuaggacacagucuuacaaguaucgguuugccuggggaguggucaccugugaaccaggucccuucugccacgugaaccugugugcaugcgaucgcaaacuuguuuacugucugaagagaaauuugaggucauauaacccucaguaccaguacuuuccaaauauccucugcaguuga

SEQ ID NO: 60784 - RNA, 2259 nt, Artificial Sequence
  derived and/or modified sequence opt3 from PLA2G6__Homo_sapiens__NP_001186491
augcaguucuuuggcagacuggugaacaccuucagcggggucacaaaucucuuuuccaaccccuucaggguuaaggaaguggccguagcugacuacacuucuucagaucgggugcgcgaagagggacaacuuauccuguuucagaauacgccuaaccgaaccugggacugcgucuuggugaauccacguaacagucagagcgguuucagauuauuucagcuggaacuagaggcagaugcccucguuaauuuccaccaauauuccucucagcugcuuccguuuuacgaaucgucaccccaggugcugcauacagaggucuugcagcaccucacugaccugauuaggaaccauccuagcuggaguguggcgcaccuggcuguagagcucggcauacgggaauguuuccaucacucccgcaucauuucuugcgccaauugugcagagaacgaagaggggugcaccccauuacaccuggccuguagaaaaggagauggcgagauccuuguugaauuggugcaauauugccauacacagauggacgucaccgauuacaagggugagacuguguuucacuaugcugugcagggggacaauagccagguccugcaacuacucggaaggaacgcaguugccggccugaaucaggugaacaaucagggccuuacaccccugcauuuggcuugucaacucgggaaacaggaaaugguacgggugcuguuacugugcaacgcccgcuguaacauuaugggaccuaaugguuacccaauccacuccgcgaugaaguucucacagaaaggcugcgcagagaugauaaucaguauggauagcucucagauucacuccaaggacccccgauauggggccucaccucuccauugggcuaagaacgccgaaauggcaagaaugcuucugaaaaggggauguaaugucaacagcaccaguucugcuggcaauacggccuugcacguggcgguuaugcggaaccguuuugauugcgccaucgugcuacugacucauggugcaaaugcugacgcccgcggggagcacggaaacaccccacuccaucuggcuauguccaaggauaaugucgagaugauuaaagcccuuaucguguucggcgcagaaguagacacaccgaacgacuucggcgagacucccaccuuucuggccagcaagauagggagacaauugcaggaucucaugcacauuucgagggcucggaaaccugcguucauccugggaucuaugcgagacgaaaagcgcacacacgaucauuuacugugccuagacgguggcgggguuaagggacucauuaucauccagcugcuuauugcaauagagaaagccuccggcguggcuaccaaggauuuguuugacugggucgccgguacgucaacugggggcauccuggcacucgccauucugcacaguaaaagcauggcuuacaugagaggaauguacuucaggaugaaggaugaaguguuucggggcucccgcccauaugagucugggccccuugaggaguuccugaaaagagaauuuggagaacauacaaagaugaccgacgucaggaaaccuaaggugauguugacugguacacucagcgaucgucagccagccgagcugcacuuauuccggaauuacgacgcacccgaaaccguucgagagccgagauuuaaccaaaaugugaaccugaggccucccgcgcagccaucagaucagcuaguauggcgcgcugcccggaguuccggcgcagccccuacguauuucagacccaaugggagguuucucgacggaggccugcuugcuaacaacccaaccuuggacgccaugacagagauccacgaauacaaucaggaucugauacgcaagggucaagcaaacaaagucaagaaacucagcauugugguuucucuggggacuggccgaucaccccaggugccugucaccuguguggacguauuccggccaaguaauccgugggaguuagcuaagacaguguuuggagccaaagaacugggcaagaugguugucgauugcuguacugaccccgaugggcgugcgguggacagagccagggcuuggugcgagauggugggaauccaguauuuccgccuuaacccucaguuggguaccgauaucaugcucgacgaggucagcgauacaguucuggugaaugcacuaugggaaaccgagguguacauuuaugaacaucgggaggaguuccaaaagcugauccagcuccugcuuuccccauga

SEQ ID NO: 60785 - RNA, 1326 nt, Artificial Sequence
  derived and/or modified sequence opt3 from PLA2G7__Homo_sapiens__NP_005075
auggugcccccuaagcugcacguccucuucugccuuuguggcugccuggccguuguguacccauuugacuggcaguauaucaacccgguagcucauaugaaaagcuccgcaugggugaauaagauucaggucuugauggccgcggcuucuuucgggcagaccaaaauacccagaggaaacgguccuuacucagugggcuguacagauuuaauguuugaccacacuaauaaggggacguuccugaggcuauauuacccaagucaggauaacgaccggcucgauacccuguggauccccaauaaagaguauuuuuggggacuuagcaaguuccugggcacacauugguugauggguaacauucuccgccugcuguuuggguccaugacuaccccugccaauuggaacucuccacuccgacccggagaaaaguacccuuuaguuguguucucgcacggccugggcgcauuucguacacuuuauucagccaucgggauugacuuggcuagccauggauucaucgucgcagccguggagcacagagauaggagugcuuccgccaccuacuacuuuaaagaccagucugcggcagaaauaggugauaagagcuggcuguaucuacggacucucaaacaagaggaagagacacacauccgcaaugagcagguaagacagagggccaaggaaugcucccaggcucugucacuuauucuggacaucgaucauggcaaaccaguuaagaacgccuuggaccucaaguucgauauggagcaacugaaagacaguauugaccgggaaaagaucgcagugauagggcacagcuuuggaggcgcuaccgucauucagacguuaucugaggaucagcgcuuccgaugugguaucgcccuggacgcguggauguucccgcucggggaugagguguacuccaggauuccccagccucuguuuuucaucaauucagaauauuuucaauacccagccaacaucauuaaaaugaagaaaugcuauagccccgacaaggagagaaaaaugauaacuauccggggaagugugcaucagaauuucgcagauuuuaccuucgcuacaggcaagauuaucggccacaugcuuaaguugaaaggggacauagauucuaacgucgccauugaccuauccaauaaggcuagccuggccuuucuccagaaacaccugggacuucauaaggauuucgaccaaugggauugucugaucgaaggugacgacgagaacuugaucccuggcacuaacauuaauaccacaaaccagcacaucaugcuccaaaauucgucugggauugaaaaauacaacuga

SEQ ID NO: 60786 - RNA, 3975 nt, Artificial Sequence
  derived and/or modified sequence opt3 from PLA2R1__Homo_sapiens__NP_001007268
augcugcucagccccucccuucuguuguuacugcuacucggcgccccuagagggugcgcugagggaguggcagccgcgcugaccccagaaaggcuucuggaguggcaggacaaggguaucuucgucauucaaucugaaucauugaaaaaguguauacaggcuggcaaaaguguucucacacuggagaacugcaagcaggccaauaaacacaugcuguggaagugggugagcaaccaugggcucuuuaauaucggaggcuccgguuguuuagggcugaacuucucugcaccggaacagccccuuucguuguacgagugcgauucaacucugguaagccuacgguggcgcuguaaucgaaagaugauuacgggaccucuccaauauagugugcaggucgcccacgacaacaccgugguugcuucccguaaauacauccauaaguggauuucuuauggcagcggcgggggagauaucugcgaguaccugcacaaagaccuucauacaauaaaggguaauacucacggcaugccauguauguuucccuuccaguauaaccaccaguggcaucacgaaugcaccagagaggggagggaagaugaccuguuguggugugcaacaaccucccgguacgagcgcgaugagaaauggggauuuugcccugacccaacuucagccgaagugggcugugauacaaucugggagaaggaccucaauagucauauuugcuaucaauucaaccuguuaagcucucuguccuggucagaagcucacagcaguugccagaugcagggugggacccuccuuucuaucacggaugagacugaagagaauuuuauuagagagcacauguccagcaagaccgucgaaguguggaugggacugaaccaguuggacgagcaugccggcuggcaauggucggauggcacaccccuaaauuaccugaacuggucuccugaaguaaauuucgagccauuuguugaagaccacugugggacuuucuccucauuuaugccgagugcguggaggagccgggacugcgaguccacccuccccuacaucuguaaaaaguaucugaaccauauagaucacgagauuguggaaaaagacgcauggaaguacuaugccacacauugcgagccuggauggaacccauacaaucgcaacuguuauaaacuucagaaggaagagaaaaccuggcacgaagcucugcgaucuugccaggccgauaauagcgcauugaucgacauuacgucacucgcugaggucgaguuccuggugacuuuacugggugaugaaaacgccagugagacauggaucggccuauccagcaauaagauccccgugucuuuugaauggucaaacgacaguagcgucauuuucaccaauuggcacacucucgagccucauauauucccaaacagaucccaacuguguguuucugcggagcagucggaagggcacuggaaggugaaaaauugcgaggaaaggcuuuucuacaucuguaagaaagccggacauguauugagcgaugcagaguccggcugccaggaagguugggagcggcacgggggcuucuguuauaagauugacacagugcugcguucauuugaucaggcuaguucuggauacuacugucccccggcccucgucaccaucacgaaccgcuucgagcaggcuuuuauaaccagccugauuuccucagugguuaaaaugaaggacagcuauuucuggaucgcccuucaagaucagaaugacacaggcgaauacacuuggaagccuguggggcagaaacccgagccaguccaauauacccacuggaacacacaucagccuagauacucuggagguugcguggcaaugaggggccggcacccccuggggcgaugggaaguaaagcauugccgccacuuuaaagccauguccuugugcaagcagccaguugagaaucaggaaaaagcugaguaugaggaaagauggcccuuccauccuuguuaccucgacugggagagugaaccaggacuggcgagcugcuuuaagguguuccacucugagaaggucuuaaugaaaaggacuuggcgggaagcagaggccuuuugugaggaauuuggcgcucaccuggccuccuuugcacauaucgaggaagagaacuucgugaaugagcuacuccacucaaaguucaacuggaccgaagaacgccaauuuuggauugguuucaacaaaagaaauccgcugaacgccgggaguugggaauggagcgauaggacacccgucgugucguccuuucuugacaauaccuauuucggcgaggaugcucguaacugcgccguuuacaaggcaaauaaaacuuugcugccucuccauuguggaucuaagcgggaauggaucugcaagauuccacgagacgugaaacccaagauaccuuuuugguaccaguaugauguaccauggcuguucuaccaggacgcggaguauuuauuucacacguucgcuagcgaguggcugaacuuugaguucgucuguucauggcuucauagugauuugcucacaauccacuccgcccacgagcaggaauuuauucauucuaaaaucaaggcacugagcaaauacggcgccuccugguggaucgggcuacaagaggaaagagcuaaugacgaguucagguggcgcgauggaacccccgugauuuaucagaacugggacacuggucgggagagaaccguuaauaaccagucacaaaggugcggcuuuauaagcaguaucacagggcuguggggaucugaagaguguuccgugagcaugccgucgauuugcaagcgcaaaaaggucuggcucaucgaaaagaaaaaggauaccccuaaacagcacggcacuugcccaaaggguuggcuguacuucaauuauaaaugucuuuugcugaacauucccaaggacccuucaucuuggaagaauuggacacaugcccagcacuucugcgcagaggaagggggcacguuaguggcuaucgagagugagguagaacaggccuuuauaaccaugaaccucuucggacaaacuacauccguguggaucggccugcagaaugaugacuacgagaccuggcuuaacgggaaacccguugucuacagcaacuggucuccauuugacauuaucaauauuccuagccacaacacaacugaagugcagaagcauaucccccugugugcguugcucuccucaaauccaaacuuccacuuuaccggaaaaugguauuucgaggauugcggcaaggaggguuacggguuugugugugagaaaaugcaggacacgaguggacauggcgucaauaccagcgauauguauccgaugccuaacacacuggaguacgguaaucgaacuuauaagauaauuaacgccaauaugaccugguacgcugcaaucaagacaugccuaaugcacaaagcccaacugguuucuauuacugaccaguaucaucaguccuuccucaccguggugcugaaccggcuuggcuacgcucacuggaucggguuguuuacgacagauaauggacugaacuucgacuggucagauggcaccaagaguagcuuuacuuucuggaaagacgaagaguccucuuuacucggggauuguguauucgccgacucgaauggacguuggcacagcacagcaugcgaaucauuucugcagggcgcgauaugucaugugcccccagagaccagacaauccgagcaccccgaacuuugcagugagacuucuaucccuuggauuaaguucaaaagcaacuguuacuccuuuucaaccguccuggauucuaugagcuucgaagccgcucaugaguuuugcaagaaggaagguaguaaucuacucacaaucaaagacgaggccgagaacgcauuccuguuggaagaacuguuugcuuucggguccagcguucagauggugugguuaaacgcccaguuugauggaaauucuaaguga

SEQ ID NO: 60787 - RNA, 2388 nt, Artificial Sequence
  derived and/or modified sequence opt3 from PLAA__Homo_sapiens__NP_001026859
augaccagcggcgccacaagauacaggcuguccugcucucuccgggggcacgagcuugacgugcgcggacuggucuguugcgcuuaucccccuggugcauucguuucagugagucgagaucguacuacgagauugugggccccagacagcccgaacagguccuuuaccgaaaugcauuguaugucuggccacucgaauuucguaucaugcguguguaucauucccagcagugauauauacccucauggguuaaucgcgacaggaggcaacgaccacaauauuugcaucuuuucccuggauucuccaaugccccuauauauucucaagggucauaaaaacacugucuguagccuguccucagggaaguucggaacccuucugaguggcagcugggacacaaccgcuaaagugugguugaaugauaagugcaugaugacucuccagggccacacagccgcaguuugggccgugaaaauccugccugagcaagggcugaugcucaccggaucugcugacaagacggucaaguuauggaaagcaggucggugugaacgcacuuuuuccggccacgaggauugcgugagagggcuggccauacuuucagaaaccgaguucuugagcugugcuaacgacgccaguaucaggcgguggcagauuacaggagagugccuggaaguauacuauggccauacuaauuacaucuauucuauuuccguuuuuccaaacugccgcgauuucgugaccacagcggaggaccgaagccuaagaaucuggaagcacggugaaugugcacagaccauaaggcuccccgcccagucgauuuggugcuguugcguccuggauaauggggacaucguggugggagcuucugacggcauuauccgggucuuuacggaguccgaggaucguacugccucagcagaagagaucaaggcuuucgaaaaagagcuuagucaugccacaauugacagcaaaaccggcgaucugggggacauaaacgcggaacaauugccuggacgcgagcaccucaaugagccagguacuagagaaggccagacaaggcugauccgggauggggagaagguugaagccuaccagugguccgugucugagggacgauggauuaagaucggcgacguaguggguagcucaggggcaaaccagcaaaccaguggcaaagucuuauacgaaggaaaggaguuugauuauguguucuccauagacguuaaugagggcgggccgagcuacaaacugcccuauaacacgucugaugacccuuggcucaccgcuuacaauuuucuucagaagaacgaucugaacccaauguucuuggaccagguggccaaauucauuaucgacaauacaaagggacagaugcuaggucugggcaaccccucauuuagugauccuuucacugggggaggccgcuaugucccagguagcuccgggucuucgaauacccuccccacagcugacccguuuacuggcgccggaagauacgugccuggcagcgcauccauggggaccacaauggccggaguagaucccuucaccgguaacucagcuuauaggagugcggcaucuaaaacuaugaauaucuacuuuccaaagaaggaagccguuacguucgaccaagcuaacccuacacagauucugggcaaacuuaaggagcugaaugggaccgcccccgaagagaaaaaguugacugaagaugaccucauccuguuagagaaaauucugagccuaauauguaacuccucaagcgagaagccaaccgugcagcaacuccagauccuguggaaggcaauuaauugccccgaagauaucgucuuuccugcccuugacaucuugcggcugucuauuaaacacccauccgugaacgagaauuucuguaacgaaaaggagggagcucaguuuaguagccaucucauaaaucugcuuaacccgaaaggcaagcccgccaaucagcuguuggcacuccgcacauucugcaacuguuuugucggucaagcggggcagaaacugaugaugucucagagagaguccuuaaugucacacgcuaucgaacugaagaguggcagcaacaagaauauucauaucgcccuagcaacccucgcccugaacuacucggugugcuuccacaaagaucauaauauugagggaaaggcucagugucuuuccuugaucucuacuauacuggaaguugugcaagaccucgaggccacauuuaggcuguuaguagcacugggcacgcuuaucagcgaugacucaaacgcuguccaguuggccaaaagucucgggguggauucccagauuaagaaauauucuagcguuuccgaaccugcgaaggugucagagugcugccguuucauccugaaucuacuguga

SEQ ID NO: 60788 - RNA, 639 nt, Artificial Sequence
  derived and/or modified sequence opt3 from PLAC1__Homo_sapiens__NP_068568
augaagguguucaaauuuaucggccugaugauucuccuuaccagcgccuucuccgcugggucuggacagucacccaugacaguccugugcaguauagacugguuuaugguuacugugcacccuuucauguugaacaaugauguaugugugcauuuucacgaguuacaucugggucuaggcugcccaccgaaccacguccaaccccaugcauaccaguucacguauagagugaccgaaugugggaucagggccaaggcgguuagccaggacauggugauuuacuccacagagauccacuauucuucgaaaggaacuccuucaaaguuugucauuccagugagcugcgcugcaccccagaaaaguccuuggcucaccaagccauguuccaugcggguagccucuaagagccgcgccacagcucaaaaagaugaaaagugcuacgagguuuucucccugucacagaguagccagcgacccaauugugacugcccuccauguguguuuucugaagaggagcacacccaggucccgugccaucaagcaggcgcccaggaagcucagccccuucagccuucccacuuccuggauaucucagaggacuggagcuugcauacugaugacaugauagguaguauguga

SEQ ID NO: 60789 - RNA, 348 nt, Artificial Sequence
  derived and/or modified sequence opt3 from PLAC8__Homo_sapiens__NP_001124187
augcaggcccaagcucccguggucguugugacccagccuggcguagggccaggaccggcaccccagaacagcaauuggcagacagguaugugcgacuguuucuccgauugcggcgugugucugugcgggacuuuuuguuucccuugccucggaugucaagucgccgcggacaugaacgagugcugucuuugcggcacgucuguggcuaugagaacccuguacaggacacgguaugguaucccagggucaauuugugaugacuacauggccacuuugugcugcccccacuguaccuuaugccagauaaagcgcgauaucaaucgacguagagcaaugaggacauuuuga

SEQ ID NO: 60790 - RNA, 1503 nt, Artificial Sequence
  derived and/or modified sequence opt3 from PLAG1__Homo_sapiens__NP_001108106
auggccaccgugauccccggcgaccugagcgaggucagagauacacagaagguuccuuccgggaaaaggaagcggggagaaacuaaaccacgcaagaacuucccgugccaacucugugacaaggcuuuuaauucuguggagaaacuuaagguacacucauacagucauacgggugaacgacccuauaaaugcauucagcaggauuguaccaaggcauucgugagcaaauacaagcugcagcgucacauggccacacauuccccugagaaaacucacaagugcaacuauugugaaaagauguuucauagaaaagaccacuugaagaaucacuuacauacccacgauccaaacaaagagacauucaagugcgaggaauguggcaaaaauuacaacaccaagcugggguuuaaaaggcaucuagcgcuccacgcugccacuucuggagaccugacaugcaaggucugucuucaaaccuucgagucgacgggcgugcuguuggaacaccucaagucacaugcagguaaaagcagugggggaguuaaggagaaaaagcaccagugcgagcauugugaucggcgcuuuuauacuagaaaagacgugaggcggcacauggucgugcauaccggccgcaaggauuuccugugccaguacugcgcccagcgauuuggcagaaaggaccaccugacaaggcacaugaaaaagucccauaaucaagaacucuuaaaaguaaagacugagcccguugauuuccuggacccuuuuaccuguaacgugucugucccaauaaaagaugaacuuuugcccgugaugagccugccuuccucagagcuacucaguaagccauucacaaauacccugcagcuuaaccuguauaauacgccguuucagagcaugcagucuuccgggucagcucaccaaaugaucacuacauugccccucggaaugaccugcccuauugacauggacacugugcauccaagccaccaccugaguuucaaguaccccuucucuuccacaagcuacgcaaucucgauuccugaaaaagagcagccauuaaagggugagaucgaaucuuaucugauggagcuccagggcgggguccccuccucaagucaagauagccaggccuccucuagcucaaaacuuggacuggacccgcagauaggcaguuuggaugacggugcuggggaucuaucccugagcaagucuucaaucaguauuagcgacccucucaacacccccgcccuggauuuuucccagcuuuucaauuuuaucccacugaacggaccucccuacaauccauugucuguuggcucgcucggcaugagcuauucccaagaagaggcgcauucaagugugucucagcugcccccucagacgcaggacuuacaagauccagcaaacaccauugggcugggaagccuacacucccucucagccgcuuucacaagcucucuguccaccaguacuacacuuccgcgguuucaucaggccuuccaguga

SEQ ID NO: 60791 - RNA, 1236 nt, Artificial Sequence
  derived and/or modified sequence opt3 from PLAGL1__Homo_sapiens__NP_001275966
auggccacccacagcccccagaagucccaucaaugcgcucacugugagaaaacauucaacagaaaggaccaucugaaaaaucaccuccagacucaugauccuaacaagauggcauuuggcugcgaagagugugggaaaaaguacaauacgaugcuuggauauaagaggcaccuggccuugcacgcggcuucuucaggugacuuaaccugcggcgugugugcccuggaacuagggaguacagagguccuccuggaucaucuuaaagcacacgccgaagagaagccaccgagcggaacuaaagagaagaaacaucagugcgaccacugugaacggugcuucuacacccgcaaggauguucgacgucaccuggugguacauacaggcuguaaggacuuuuugugccaguucugugcucaaagauuugguaggaaagaucaccucacccggcauacuaagaaaacacacucccaggagcugaugaaggaaucucugcagaccggggaccucuuaucgacguuccauacuaucucacccagcuuucagcugaaagcagccgcccuuccuccauuccccuugggagcuagugcgcaaaacggccuggcauccucucuaccugccgaggugcacagccucacccuguccccacccgagcaggcugcccagccuaugcagccacuuccggaaucacuggcaaguuugcaccccagcgucucuccuggcuccccacccccuccacuccccaaucauaaguauaacacaacuucaaccagcuacaguccgcuggcuucuuuaccucugaaagccgauacaaagggguuuugcaauauuucccucuucgaggaccuuccccugcaagaaccacagagcccucagaaguugaaccccggauuugaucuagcgaaagguaaugccggcaaggugaaccugccaaaagagcuccccgcagacgcuguuaaucugaccauaccugccucgcuugaucugucuccauugcucggguucuggcaacugccgcccccugcuacgcagaacacuuuuggaaauuccacauuagcccugggcccaggugaaucacuaccccaccgccucaguugccuggggcagcagcaacaggagccuccacuugcaaugggaaccgugagcuugggccagcugccccucccgccuaucccacaugucuucuccgccggcacugggucugcuauucugccccacuuccaccaugcguuuagauga

SEQ ID NO: 60792 - RNA, 1491 nt, Artificial Sequence
  derived and/or modified sequence opt3 from PLAGL2__Homo_sapiens__NP_002648
augaccacauucuuuacuagcgugcccccuuggauccaggacgccaagcaagaggaagaggucggcuggaaacugguuccaagaccgagggggcgggaagcugagucccaggugaagugccagugugaaauuucuggaacgcccuucucaaacggugagaaacuccgcccucacagucuuccacagcccgagcaacgaccuuacagcugcccacagcugcauuguggcaaggcauuugccuccaaauauaaguuguaccgucacauggcgacccauucugcucagaagccccaccagugcauguauugugauaaaauguuccauagaaaggaccacuuaaggaaucaucugcaaacacacgauccuaacaaagaagcccuacacugcucggagugugggaagaauuacaacacuaaacucggauaucggcgccaucuggcaaugcacgccgcuucaagcggcgaccuuaguugcaagguaugucugcagaccuuugaauccacacaggcauugcucgagcaccugaaggcccauucuagaaggguggcugguggggccaaagagaagaaacacccaugcgaucauugugaccggcgcuucuacacccgaaaggaugucagaaggcaccuggugguucauacuggacggaaagacuuucucugccaguauugcgcgcaacguuucggccgcaaggaucacuuaacaagacacgugaaaaagagccauucccaggaacugcuuaagauaaaaaccgagccggucgacauguugggccugcuaucauguaguagcacggugucuguaaaggaggaacucucccccguucugugcauggcaucaagggaugugauggggacuaaagccuuuccuggaaugcuuccaauggguauguacggcgcucacauccccaccaugccuagcacaggggucccacauagucuggugcacaauacuuugcccaugggaaugucuuacccgcucgaauccagcccuauuucgucucccgcccagcugccaccuaaguaucaauuaggcuccaccucauaccugcccgacaaacucccaaagguggaggucgauaguuuccuugcagagcugcccgguagcuugucccuaucuagcgcugaaccucagccagccucaccgcagcccgcggccgcagcugcccugcucgacgaggcucugcuugccaagaguccugcaaaccuguccgaagccuugugugcugcgaauguugacuuuagccaccuccugggguucuuaccacugaaccuacccccuugcaauccacccggagcaacaggcggccucgugaugggguauucucaggccgaggcucaaccgcugcuuaccacguugcaggcccagccucaggauucaccaggagccgguggcccccugaacuuugggccucuccauagucugcccccaguauucacuagcggacuuuccucuacaacccugccucgguuccaccaagcauuucaguga

SEQ ID NO: 60793 - RNA, 1689 nt, Artificial Sequence
  derived and/or modified sequence opt3 from PLAT__Homo_sapiens__NP_000921
auggacgccaugaagagaggccugugcugugugcuccuucugugcggggcugucuucguuagccccucccaggagauccacgcaagguuucggcgcggagcccgaucuuaccaagugauuugucgugaugagaaaacccagaugauauaucagcagcaucaaucaugguugagaccuguauuaaggaguaaccggguggaauacugcugguguaauagcggucgcgcgcagugccacuccgucccagugaagucuuguucggaaccgagaugcuucaacggcgggacaugucagcaggcucuguauuuuucagacuucguuugccaaugucccgagggauuugccggcaaaugcugcgaaaucgauacuagggcaacguguuacgaggaccaggguauuagcuaucgggggaccuggaguacagccgaguccggagcugaaugcacuaauuggaacucuagcgcacuagcccagaagccuuacuccggccgccgaccagaugcuaucagacucggccuggggaaucauaacuauuguaggaaucccgaccgggauucaaaaccuuggugcuacguguucaaggccggaaaguacaguagcgaguuuuguucuaccccagcgugcuccgaagguaacucagacuguuauuucggcaaugggagcgcauaccguggaacacacagucuuaccgagucuggcgccuccugccugcccuggaacagcaugauuuugaucgguaaagucuauacugcucagaauccuucggcccaagcacucgggcugggaaagcauaacuacugucgcaauccagauggcgacgcuaaaccguggugccacgugcugaagaacagaaggcucacaugggaguauugugauguacccucuugcucaaccugcggcuuacggcaguacucccagccucaauuucgaauaaaagggggacuguucgccgacaucgcgagucacccauggcaggccgcaauuuuugcuaagcaucgcagaagccccggugaaagguuccuuuguggcgggaucuugauuuccucuugcuggauccugagcgccgcucacuguuuucaggagcgguucccuccacaucaccuaacgguuauacucggacgcacuuauagagugguccccggcgaagaggaacagaaguucgagguggagaaauacauugugcacaaggaauuugaugacgacaccuacgauaaugacaucgcccugcuucaacugaaaucagauaguuccaggugcgcacaggagagcucugucguucguacaguguguuugccgccugccgaccuccagcugcccgauuggacugaaugcgaguuaucagguuaugggaagcaugaagcucugaguccauucuacagcgagcggcucaaagaggcgcacguacgacuuuauccuuccucuagauguaccucgcagcaucuguugaacaggacagugaccgacaacaugcuaugcgcaggcgauacgcgcagcggaggcccccaagccaaucugcacgacgcuugucagggggauuccggagguccacucgucugccugaacgacggccggaugacucuuguggggauuaucucauggggacugggcuguggucagaaggauguucccgggguguacacaaaagucaccaauuauuuggacuggaucagagacaacaugaggccuuga

SEQ ID NO: 60794 - RNA, 1245 nt, Artificial Sequence
  derived and/or modified sequence opt3 from PLAU__Homo_sapiens__NP_001138503
augguguuccaccugagaaccagguacgagcaggccaacugcgacugucucaauggcgggacaugcgucagcaacaaguauuuuuccaauauccauugguguaacugccccaaaaaguucggaggucaacacugugaaauugauaaaucuaagacuugcuacgagggcaaugggcauuuuuaucggggaaaggcuucaacggacaccaugggccgcccuugucuuccauggaacagugcaacaguucugcagcagacuuaccacgcccaucgaagcgaugcguugcaguuaggucuggggaaacacaauuauugccguaacccggacaauagaaggcggcccugguguuacgugcaaguaggacuaaagccucucgugcaggaaugcaugguccacgauugugcugacggcaaaaagccauccucucccccugaggaacugaaauuccagugcggccagaagacccuucgcccaagauuuaaaauaaucgggggagaguucacaaccauugagaaccaacccugguuugccgcaaucuauaggcggcaucgcgguggcucggugacuuacguuugcgggggaucacugauuagcccuuguugggugaucagugccacacacugcuucauagauuacccaaagaaggaagacuauaucgucuacuugggccgauccagacucaauucuaacacccagggugagaugaaauuugaaguggagaaucugauucugcauaaggauuauagcgcugacacgcucgcacaccacaacgauaucgccuuacugaaaauuagguccaaggaggggcggugugcucagccgucacguacuauccagaccauaugccuucccaguauguacaaugacccucaauucggaacaagcugugaaauuacuggcuuuggcaaagagaacucuaccgauuauuuguacccagaacagcugaagaugacaguaguuaaacuaaucucccaucgcgagugccagcaaccccacuauuacgggucagaagugaccacgaagaugcucugugccgcggacccucaguggaagacugacagcugccagggagauagugguggcccacuggucuguucucuucaggggagaaugacacugaccggaauuguguccuggggcagggguugcgcauugaaagacaagcccgggguguacacucgggucagccauuuccucccguggauccgaucgcacacaaaagaggagaacggccuggccuuauga

SEQ ID NO: 60795 - RNA, 846 nt, Artificial Sequence
  derived and/or modified sequence opt3 from PLAUR__Homo_sapiens__NP_001005376
augggccacccuccccugcucccacuucuguuguuacugcauaccugcgugccggccagcugggggcuaagauguaugcagugcaagacaaacggagacuguagggucgaggaaugcgcucucggucaagaucugugucggacuacgaucguucgccuuugggaggaaggcgaggaacuggaguugguggagaaauccugcacccacucugaaaagacaaaucgaacucucucauaccguaccgggcugaaaauuacaagucugaccgagguaguguguggacucgacuuaugcaaccagggcaauagcgguagagcagucacuuauuccaggucucgguaccuggaauguauaucgugcgggucaagcgauaugaguugugagcgcggaagacaucagucccuucagugcaggucucccgaggaacaaugcuuggacgugguuacacacuggauccaggagggcgaagagggccggccuaaggaugaccgccaucugcgaggguguggauaucuaccagguugccccggcagcaacggguuccacaauaacgauaccuuucacuuccucaaauguugcaauacgacuaaguguaacgaaggaccuauucuggagcuugagaaucugccacagaacggcagacagugcuacuccuguaaggguaauucaacccaugggugcaguagcgaagagacauuuuugaucgacuguaggggacccaugaaccaaugccucguggccacuggcacccacgaacggucucuguggggcuccugguuaccuuguaaaucaacaaccgcgcugcguccaccgugcugcgaggaagcucaggccacgcaugucuga

SEQ ID NO: 60796 - RNA, 4344 nt, Artificial Sequence
  derived and/or modified sequence opt3 from PLB1__Homo_sapiens__NP_001164056
augggccugagacccgggaucuuccuccuugagcuguuguuacugcuaggacaggguaccccucaaauucacacaagcccaaggaaguccacucucgaaggccagcuguggccggagacgcuuaaaaacucucccuuuccuugcaauccaaacaagcugggggugaauaugcccucaaaaaguguccauagcuugaagccuuccgacauaaaauucguugccgcuaucggaaaccucgaaauuccacccgauccuggcaccggugaccuggagaagcaggauuggacagaacggccacagcaaguguguauggggguaaugacugugcugucugacaucauucgcuacuuuucgccgucaguccccaugccugugugccacaccggaaagcgaguuaucccacaugauggcgcagaggaccucuggauacaggcccaggaguuagugcguaauaugaaagaaaaccugcagcuugauuuccaauuugacuggaaguugaucaaugucuucuuuagcaacgcgagucaguguuaucugugccccuccgcucagcaggccccuucucuaagcacagugcuccugucccaaaauggccuugcagccgggggaguagaugagcugauggguguuuuggacuaccuccagcaggaagugccaagagcuuucgucaaccugguggauuuaucagagguggcagaggucaguaggcaauaucacggcaccuggcugagccccgccccggaaccuuguaauugcucugaggaaacuacacggcucgcuaaaguugugaugcagugguccuaccaggaggccuggaacucacuucuggcgagcagucgcuauucugaacaggaguccuuuaccguaguguuccaacccuuuuucuacgagacgacuccaucuuugcauucggaagacccuagacuacaggauucuaccacacuggcauggcaccucuggaauaggaugauggagcccgccggggaaaaggacgagccacuguccgucaaacacggacggcccaugaaguguccuucacaggaaaguccauaucuuuuuagcuaccgcaacuccaauuaccugacucgauugcagaagccgcaagacaaacucgaggugagagagggcgcugaaauuaggugccccgauaaggacccuucugauaccguuccaacaagcgugcaucggcugaaacccgccgacaucaacgucauuggugcauuaggggauucacugaccgcuggaaacggcgccggcaguacgccugggaaugugcuagacguacucacucaguaucguggacuguccuggagcguugguggcgaugagaacaucgggacagugaccacucuugcgaauauauugcgcgaguucaacccaucucugaagggauucucagucggcacagguaaagaaaccagucccaaugccuuucucaaccaggcaguggcugggggcagagccgaagaccugccgguccaggcuaggcggcuuguggaucugaugaagaaugacacgcgcauucacuuccaagaggauuggaaaaucauuaccuuguuuaucggaggcaacgaccucugugacuucugcaaugaucugguuccucgagccuuugugaacuuaguaacaguccuggagaucgugaaucuaagagaacucuaccaggagaagaagguuuauuguccaaggaugauucugcggagccuuugccccugcguguugaaauucgacgauaacuccacugaacuggcaacccucauagaguuuaauaagaaauuccaggagaagacacaucagcugaucgaaucugggcgcuacgacacuagagaggauuuuaccgucgugguacaaccuuucuuugaaaacguggacaugcccaaaacaucggagggauuaccagauaauagcuucuuugccccugacuguuuccacuucuccucaaagagucacucuagggcugcgagcgcacuguggaacaacaugcuugaacccguuggucagaagaccacucgucauaaauuugagaauaagauuaacaucacgugcccaaaucagguccaaccguucuugcggacauauaaaaacuccaugcagggccacgggaccuggcucccuugucgagauagagcccccucagcucugcauccaacuagcgugcacgcccuaaggcccgcagacauacagguggucgccgcucugggagauucucucaccgccggcaaugguauuggguccaagccugacgaucugccagacguuacaacccaguaccgcggccuuaguuauagcgcaggaggcgacgggucuuuggagaacgugacuacacugcccaauaucuuacgggaauuuaacagaaaucucacgggauacgcgguggguaccggcgaugcuaacgacacuaaugccuuccugaaccaagcaguaccuggggccaaagcugaggaucuuaugucccagguccagacacugaugcagaagaugaaggacgaucauagggugaauuuucacgaagacuggaaaguuaucaccguguugauuggaggcucagaucucugcgacuacuguacagauaguaaccuguauagcgccgcaaauuucguccaccaucuacgcaacgcucuggacgugcuccaccgagagguuccgcgggugcugguaaaccuugucgauuuucuaaauccaacuaucaugcgucaaguguuccuggguaaccccgacaagugcccugugcagcaggccucggucuuauguaauugcguucucacccugagagaaaacucccaggagcuugcgaggcuggaggccuuuucucgcgcuuaccggagcucaaugagagaauugguggggaguggcagguaugauacgcaagaggacuucuccguagugcuccagccauuuuuccagaauauucaacugcccgucuuggcagacggacugccugauaccagcuuuuucgccccggacuguauacaucccaaccagaaauuccacagccaguuagcucgagcccucuggacaaauaugcuggaaccacuuggcuccaagacugagacccuggauuugcgcgcagaaaugccuaucacaugccccacucagaacgagccauuucuccggaccccuagaaauucaaacuacacguaucccauuaaaccagcgaucgagaauugggggagcgacuuccuguguacagaauggaaggccaguaacucugugccgaccuccguucaccaacuaaggccugcugauaucaagguggucgccgcacugggagacagccuuacuacagcugugggcgcccgucccaauaacucgucagaucucccaaccucuuggcgcggucugaguugguccauugggggagacggcaauuuggagacucauaccacacugcccaacauauuaaagaaguuuaacccuuaccuccuggguuucagcacgucuaccugggaaggcacugcagggcuuaauguugccgcugagggagcgcgggccagagauaugccagcacaggcuugggaccugguggagaggaugaaaaacagccccgauaucaauuuggaaaaggacuggaaacucgucacacuguuuauuggcguaaacgaccuaugccacuauugcgagaauccugaagcccaucuggccaccgaguacgugcagcacauccagcaagcucuugauauucucuccgaggaacugccgcgagcauucguuaacguggucgaggugauggaauuggccucauuauaccaggggcagggaggcaagugugcgaugcuggcugcccagaauaacugcacaugucuccggcauagucaaagcucucuggagaaacaggaacuuaagaagguaaauuggaaccugcagcacgguaucuccucauuuaguuauuggcaccaguacacucaacgcgaggacuucgcaguggucguucagccauuuuuccagaauaccuugacgccccuaaacgaaagaggggauacagaccugaccuuuuucagcgaggauugcuuccauuuuuccgacaggggacacgccgagauggcuauagcacucuggaauaacaugcuggaaccugugggccggaaaacuaccucuaauaacuucacacauucgcgagccaaacuuaaaugucccagcccagagucaccuuauuuauacacucugagaaauucccgccucuugcccgaucaagcggaagaggcuccagaagugcuguauugggccgucccuguggcagccgguguuggccucguaguggggaucauuggaaccgucguguggaggugccgucggggcgggagaagggaggacccgcccaugagucugcgcacaguugcucuuuga

SEQ ID NO: 60797 - RNA, 1662 nt, Artificial Sequence
  derived and/or modified sequence opt3 from PLBD1__Homo_sapiens__NP_079105
augaccagaggcgggcccggagguaggccuggccugccacagccgcccccucuccuucuguuguuacugcuacucccacugcuucuggugacagccgagcccccuaagccagcuggggucuacuaugcaacugccuacuggaugcccgcggagaaaacgguucaagugaagaacguaauggacaaaaauggagaugcuuauggcuucuacaacaauagcgugaagaccacagguugggggaucuuggaaauucgggccggauauggcucccagacucucucuaacgaaauaaucauguuugucgcaggcuuccuggagggguaccugaccgccccucacaugaaugaccauuauacaaaccucuacccacaguuaauuaccaaaccgucaaucauggauaaggugcaggacuuuauggaaaagcaagauaaauggacucgcaagaauauuaaagaguacaagacagacaguuucuggcgacacaccggauauguuauggcucagaucgauggucuguacgugggcgccaaaaagcgugcaauacuugaggggacgaagcccaugacuuuguuucagauccaguuccugaacagcgucggagaccuacucgaucugauuccuucccuuucuccaaccaaaaauggcucgcugaagguguuuaaaagaugggacaugggucauugcucagcuuugaucaagguacuccccggguucgaaaacauucuguuugcccacagcaguugguauacauacgcggcaauguuaaggaucuauaaacauugggauuucaauguuauagacaaggauacuuccucuagccggcuguccuuuucaaguuacccuggauuccucgagagccuugacgacuuuuauauucugucuuccggcuugauccuacugcaaaccacaaacucaguguucaauaaaacccuccugaagcaggucauuccagaaacgcuucugagcuggcagcgcgugagaguggccaacaugauggcugauaguggcaagaggugggccgacaucuucucuaaauacaauuccgggacuuacaacaaccaguauauggucuuggaucucaagaaaguuaagcugaaucacagcuuagacaaaggaacacuguacaucguggagcaaauucccaccuauguagaguacucggaacagacugaugugcuacggaaggguuauuggccgucuuacaacgucccuuuucacgagaagauauauaauugguccggcuacccccuccuggugcagaaacuuggguuggacuacucauaugaucuggcaccacgcgcuaagaucuuccgaagagaccaaggaaaaguuacagauaccgccaguaugaaguacauuaugagguauaacaauuacaaaaaggacccuuauagccggggcgaucccuguaacacgaucugcugucgugaagaccucaauuccccaaaccccucuccuggugggugcuacgacaccaagguggcggauauauaucuggccagccaguacacaucauacgcaauuaguggcccaacuguccagggaggccuuccgguguuucgcugggacagauucaauaaaacccugcaucaggggaugcccgagguauauaacuuugauuucaucacaaugaagccuaucuugaaacucgacauuaaguga

SEQ ID NO: 60798 - RNA, 3651 nt, Artificial Sequence
  derived and/or modified sequence opt3 from PLCB1__Homo_sapiens__NP_056007
auggccggcgcucagcccggggugcacgcacugcaacucaagccugucugcguuagcgacucccuuaaaaagggaaccaaauucgugaagugggaugacgauucuacaaucguaacuccaauuauacugagaacggacccgcagggauuuuucuuuuacuggaccgaucagaacaaagagacagaauuguuagaccugucacuugugaaggaugccagguguggccggcaugcgaaggcucccaaagacccuaagcuccgcgagcugcuugaugucgggaauaucggacgacuggaacagcguaugauuacugugguuuauggcccagacuuggugaacaucagucaccucaaucuggucgccuuccaagaggaaguggcaaaagaguggaccaacgagguauuuagccuggccacaaaucucuuagcucagaacauguccagagaugcauuccuggaaaaggccuacaccaaacuuaaguugcagguuacucccgaggguaggauuccucugaagaauaucuaucggcuauuuucugcugaccgcaaaagaguggaaacagcccucgaggcgugcucgcugccaucaagcaggaacgauaguauaccccaggaggacuucaccccugaagucuaccggguguuucuuaauaaccuguguccacgcccggagaucgacaauauuuucuccgaauuuggggcaaagucuaaacccuauuugacgguggaucaaaugauggacuucaucaaccucaagcagcgagauccuagacugaaugagauuuuauacccaccccugaaacaggaacagguccaaguucucaucgagaaguaugagccuaacaauagccuugccaggaaaggacagauauccguggacggcuuuaugcgguaccugucaggcgaagagaacgggguagugaguccagaaaaguuggaucuaaacgaggacaugagccagccccugucucauuacuucauuaauuccucacacaacacuuaucucaccgcuggacaacuggccgguaauagcagugucgaaauguaccgucaggugcuucugucuggcugccgcuguguugaguuggauugcuggaaggggagaacagcagaggaagaaccggugaucacucauggauucaccaugacaaccgaaauuuccuuuaaagaggucaucgaagcuaucgccgagugugcguucaagacgagcccuuuucccauucuccugucguucgagaaccacguggacucuccaaaacagcaggccaagauggcagaauauugcagguuaauauuuggcgaugcucugcuaauggagccucucgaaaaauacccccuggaguccgguguaccacuucccucaccuauggacuugauguauaagauccugguuaagaauaaaaagaaaagucacaagagcuccgaggggucugguaaaaagaagcucagcgaacaagccucaaacacuuacagugauuccagcucuauguucgagccaucaaguccgggcgcuggcgaagccgacacagagagcgacgaugacgaugacgaugacgauuguaaaaaguccucuauggacgaagggaccgcaggaucggaggccauggcuacugaggaaaugagcaaucuggugaacuauauucagcccgucaaauuugaguccuucgaaaucucaaagaaacggaauaagaguuuugagaugucuagcuucguggaaacaaagggucuugagcagcugaccaaauccccugucgaguuuguggaauacaacaagaugcaguugucacgaauauacccaaaaggcacgcgcguugauagcucuaauuauaugccccaacucuucuggaacgcggggugccagaugguggcacugaauuuucagaccauggacuuagccaugcagauuaacaugggaauguacgaguauaauggcaaguccgguuacagacugaaaccugaguucaugaggcggccagauaagcauuucgaccccuuuacagaggggaucguagauggcaucgucgcuaacacucuaagugugaaaauuaucagcggacaauuccucucugacaagaagguuggcaccuauguggaagucgacauguuugggcugccgguggauacacgcagaaaagccuucaagacuaaaaccucccagggaaacgcaguaaauccugugugggaggaggaaccaauuguuuuuaagaaagucgugcuucccacauuggccugucugaggauagcuguguacgaggaagguggcaaguucaucgggcaccguauucucccuguccaggccauccggcccggauaucauuacaucugccugcgaaacgagagaaaucagccauuaacccugccugcaguuuuuguguacauugaggugaaggacuauguacccgauacuuacgcggacgucauagaagcucuuucaaacccaaucagguaugugaauuugauggagcaacgcgccaaacagcucgcagcccugacgcuagaagaugaggaagagguuaagaaagaggcugacccgggcgaaacaccuagugaggcccccagcgaagcacggaccacuccagcugagaacggugugaaucacaccacaacccugacucccaagccuccaucgcaggcccuccacucccaacccgcgccugggucugucaaagccccggcuaagacagaagaucugauucagagcgugcuuacggagguugaggcacagaccaucgaagaguugaagcagcaaaaaucauucgugaagcugcagaaaaagcauuacaaagaaaugaaggacuuaguaaagagacaccauaaaaagacuacagaucucauuaaagagcacaccacaaaguauaacgaaauccagaaugacuaccugaggcgccgagccgcucuugagaaaagugccaagaaagauuccaagaagaaaucugagccaagcucccccgaccauggcucaagcacuauagaacaggaucuggcagcguuggacgccgagaugacccaaaagcucaucgaccugaaagauaagcagcagcagcaacuacugaaccuccggcaggaacaguauuacagugagaaauaccaaaagcgugagcacauuaagcugcuuauccagaaauugacggacgucgcugaagagugccagaauaaccagcugaagaaauuaaaggaaauuugugagaaagaaaagaaggagcucaaaaagaaaauggauaagaaaagacaagagaagaucaccgaagccaagucuaaagacaagucccagauggaggaagagaaaacagaaaugauaaggagcuauauucaggagguggugcaguacaucaagcgccuggaggaagcacaaucgaaacggcaggagaagcuagucgaaaagcacaaagagauuagacagcagauccuggaugaaaagccuaaacuacaaguugagcucgagcaggaauaucaggacaaguuuaaaaggcugccauuggagauacuggaguucgugcaggaggcuaugaagggaaaaaucucagaggauucuaaucauggcagugcccccuuaucccucagcucugacccugggaagguaaaccacaagacuccgagcuccgaagaacugggaggugauauucccggcaaagaauuugacaccccacuuuga

SEQ ID NO: 60799 - RNA, 3546 nt, Artificial Sequence
  derived and/or modified sequence opt3 from PLCB2__Homo_sapiens__NP_001271226
augagccugcucaaccccgugcuucugccuccaaaggucaaagccuacuugucccagggcgagagauucaucaagugggacgaugaaaccacaguugcuucuccggugauuuuaaggguagaccccaaaggguauuaccuguauuggacuuaccaaucaaaggagauggaauuucuagauauaacgaguauccgggacacccgcuucggaaaauuugcaaagaugccuaagagccagaaacuccgagauguguucaauauggacuuuccagauaacuccuuccugcuuaagacacugacugucgugucuggucccgacaugguugauuugaccuuucacaauuucgugucguauaaagagaacgucggcaaggccugggcggaagacgugcucgcucugguaaaacauccucugacagccaaugcaucacguagcaccuuucucgauaagauuuuaguuaagcugaaaaugcagcuuaacagugaggggaagaucccagugaaaaauuucuuucagauguuccccgccgacagaaagagggucgaggcugcauuguccgccugccaucugccuaaaggaaagaacgaugcuauuaauccagaagacuuuccggagcccguguacaaaucuuuccuaaugagccucuguccucggccagaaaucgacgagauauucacuuccuaucacgccaaggcgaagcccuacaugacaaaagagcaccugaccaaguuuaucaaccaaaaacagcgcgauucaagacuuaauagucuguuguucccuccagcaaggcccgaccaggugcagggccucauugauaaguacgaaccgagcgguaucaacgcccaacgggggcagcugucuccugagggaauggucugguuuuuaugcggccccgaaaauuccguucuggcucaggacaaacuccuucugcaucacgauaugacgcagccauugaaccacuauuucauuaauucaagccauaacacuuaccuaaccgccggccaauuuagugggcugucuuccgcagagauguaucgccaggugcuccugagcggaugucgaugcguagaacuugacuguuggaaggguaagccucccgaugaggagccaaucauaacacacggcuucacuaugaccacagacaucuuuuucaaagaagcuauugaggccauugcggaaucggccuuuaagaccucucccuacccuaucauccuguccuucgagaaccauguggauucaccaagacagcaagcaaaaauggcugaauauugcaggacgauuuuuggggacauguugcucacugagccgcuggagaaguuccccuuaaaaccuggagucccacugcccaguccugaagaucuacggggcaagauacucaucaagaauaaaaagaaccaguuuagcgguccaacauccucuagcaaagacaccgggggagaggccgaaggcucaagucccccguccgcuccugccgugugggcaggcgaggaagggacugagcuggaggaagaggaaguugaggaggaagaggaagaggaaagcggaaaucuugacgaggaggaaauuaagaaaaugcagucugaugaggguacagccggcuuggaagugaccgcuuacgaggaaaugucaagucuggucaacuauauccagccaacgaaguucgugagcuucgaguuuuccgcgcaaaagaaucguucuuacguaauaucgagcuucaccgagcucaaagcauacgaccugcuuuccaaggccucaguucaguuuguggauuauaacaaacgccagaugaguagaauuuaccccaaggggacaaggauggacucuagcaauuauaugccucagauguucuggaacgcuggaugucaaauggucgcccugaauuuucagacuauggauuugcccaugcagcagaacauggcaguguucgaauuuaauggccaauccgguuaccuccugaaacacgaguucaugcggcgaccagacaagcaguuuaacccuuucucagucgaucgcaucgacgugguuguggccaccacauuaagcaucacuguaauuucugggcaguuucuguccgaaagaagugucaggaccuauguggagguugaacuauucggccuccccggagauccaaaacggcgcuacagaacaaagcugagcccgucuaccaauuccaucaacccuguguggaaggaggagcccuuugucuucgagaaaauucuuaugccagaguuggcuucacugaggguggccguaauggaagagggcaauaaguuccucgggcaccguauaauccccauuaacgcacugaacaguggauaucaucacuuaugccugcauagcgagucgaauaugccucuuacuaugccagcguuguuuaucuuccucgaaaugaaagacuacauccccggugcuugggccgaucugacgguggcacuagccaacccuauuaaguuuuucuccgcucacgacacaaaaucuguuaagcugaaggaggccaugggcgggcucccggaaaaaccauuuccccuggcaagcccugucgcuucacaggugaauggagcccuugcgccaaccaguaacggcucccccgccgcucgggccggugcacgagaggaagcuaugaaggaggccgcagagccuagaacugcgucuuuggaagaacugagggaauuaaaagggguggucaagcuccaacgccggcaugagaaagaacugagagagcuugagaggcgcggcgcccgacggugggaggaacuguugcagcguggagcugcccagcucgcagaacugggcccgcccgggguuggaggugugggcgcuuguaagcuagggccaggaaagggcagcaggaaaaagagaucccugccucgcgaggaaucagccggugcagcccccggggagggcccagagggaguggauggccggguaagagaacucaaagacaggcuggagcuugaauugcugcgacaaggggaggagcaguacgaaugcgucuuaaagcgcaaagagcagcacguggcugaacagauaagcaagaugauggagcucgcgcgggaaaagcaagccgcagagcugaaagcucuuaaggagaccagugaaaaugacacaaaagagaugaagaaaaagcuggaaaccaaaagacuagagaggauccagggaaugacuaagguuacaacggauaagauggcccaggaacgucucaaacgcgagauuaacaauucucacauccaggaggugguccaagugauuaagcagaugaccgaaaaccuggagcggcaucaggaaaaauuggaggaaaagcaggccgcuugucuggagcaaaucagagagauggaaaaacaguuccagaaggaggcauuagccgaauaugaggcgaggaugaagggccucgaggcugaaguuaaagaguccgugcgagccugccugcggacuugcuuuccuagcgaagcaaaggacaaacccgagcgcgccugugaaugcccaccggagcuuugugagcaagauccucugauagcuaaggcagacgcccaggaaucgagauuguga

SEQ ID NO: 60800 - RNA, 3504 nt, Artificial Sequence
  derived and/or modified sequence opt3 from PLCB3__Homo_sapiens__NP_001171812
auggccggcgcucagcccggggugcacgcacugcaacucgagccuccaaccgucguugaaacacuuagaaggggaagcaaguucaucaaaugggacgaggaaaagcugaugacugugguauccgguccggaucccgugaacacggucuuuuugaauuucauggccgugcaggacgauaccgcgaaaguuuggucugaggaauuauuuaagcuggcuaugaacauucuagcccagaaugcaucacggaacacauuccuccgcaaagccuacacuaagcugaaacuucaggugaaucaagacggccgaauaccugucaaaaacauccugaagauguuuagugcugauaaaaagcguguggagaccgcauuggagagcugcgggcucaaauucaauagauccgaaucuauuaggccagacgaguuuucgcuggaaaucuucgagcgguuucugaacaagcucuguuuacgccccgauauugacaagauccugcuugagauaggagccaaaggcaagccuuauuugacacuggaacagcuaauggauuucaucaaucagaaacagagagacccaaggcucaacgagguacuguaucccccucuucggccaucacaagcucgccuguugauugaaaaguacgagccgaaucagcaguuucucgaacgagaucagaugagcauggaggguuucaguagauaccuugggggagaggaaaacggcaucuuaccccuggaggcccucgaccuuuccaccgauaugacucaaccucugucugcguauuuuauuaauagcucccauaacacauacuugaccgcaggccagcuagccgggacgucaaguguugaaauguauaggcaggcucugcucuggggaugccgguguguggagcuggacgucuggaaaggucguccacccgaagaggagccuuucaucacucacggcuucaccaugacaacugaagugccacuucgcgacgugcuggaggccauagcagaaaccgcuuuuaagacaagccccuacccggucauuuugucuuucgagaaucauguugauuccgccaaacaacaggcgaagauggccgaauacugcagaucaaucuuuggggacgcacuccugauugagccuuuagauaaguauccccuggcuccaggagugccucuacccagcccacaggaccucaugggcaggauccugguaaagaacaagaaacggcaccgacccagugccggugggccugauucugcuggacgcaagagaccacuugagcaguccaacagcgccuugucggaaucuuccgcagccaccgagccgucaaguccccaacugggcagcccuuccucugacagcuguccaggccucucaaauggggaagaggugggacuggagaaacccagucuugaaccucagaagucccugggugaugagggcuugaacagggggccauacguccucggacccgcugaccgggaagaugaggaagaggacgaggaagaggaagaacagacggauccgaagaaaccuacuacagacgaaggcaccgcgagcucugaggugaaugcaacugaggaaaugucaacacugguuaacuauaucgagccagugaaguucaaaaguuuugaagccgcucgcaagagaaauaaaugcuucgagaugagcuccuuugucgaaaccaaggccauggagcaguuaacgaagucucccauggaguucguggaauacaacaaacaacagcugucgaggauuuauccuaaggguacccguguagacagcuccaauuacaugccccagcuauuuuggaacguugggugucagcucguggcacugaauuuccaaacacuugaugucgccaugcaguugaacgcuggcguguuugaguauaauggacggucaggcuaccugcucaaaccagaguucaugcgaagaccugacaagaguuuugaucccuucacugaggucauaguggacgggaucguugccaacgcacugagggugaaaguaauuucuggacaguucuuaagcgaucgcaaggucgguaucuacguggagguugacauguuuggccugccaguggauacccggagaaaguauaggacacgcacuucccaggggaacucauucaauccggucugggacgaggaaccuuuugauuuccccaaagugguacuuccaaccuuggcgagccuccgaauagcugccuuugaagagggaggcaaguucgugggucaucggauucugcccguuucugcaauccguuccggguaccacuaugucugccuaagaaaugaagccaaccaaccucugugucucccagcucugcuuaucuacacagaggccagugacuauauucccgaugaccaccaggauuacgcagaggcuuugaucaacccuauuaaacaugugagccugauggaccagagggcccgccaauuagcggcccucauaggcgaaucugaggcucaggcaggacaggaaaccugccaggacacucaaucccagcagcugggcucacagccgaguagcaauccaacgcccucgccucuugaugccuccccacggagacccccugggccgacaaccucucccgcuagcacuucacugaguuccccaggacaaagggacgauuugaucgccucuauucucagcgagguggcaccuacaccccuggacgaacuacgaggucacaaggcgcuggucaaacuccgcucccggcaggagagagaucugagggagcuucguaagaaacaucagcgcaaggccguuaccuugacccggagacuguuagacggccucgcucaggcccaagcagaagggaggugucgacugcggccaggagcucuuggcggugccgcagauguggaggacacuaaggaaggggaggaugaagccaaacgcuaucaggaguuucagaacagacaagugcagucacugcuagagcucagggaagcucagguagacgcggaggcccagcggcgacuggaacacuugagacaagcacugcagcgcuuaagggaggucgugcucgaugcuaauacaacgcaguucaagcgucugaaagagaugaacgaacgggagaagaaagaacuucagaagauccuggacagaaagaggcacaauagcaucagugaggccaaaaugcgcgauaagcauaaaaaggaagccgaguugaccgagauuaaccgaagacacauaacugaaucuguuaauuccauccggaggcucgaggaagcucaaaaacagcgccaugaccgucugguggcaggccagcagcaaguccuacagcagcuggccgaggaggaaccuaagcugcucgcgcagcuggcucaagagugccaggaacagagagcccgguugccccaagagauuaggcgcagccuguuaggagaaaugccagagggccucggggacggaccgcugguggcaugcgccucgaacggccacgcuccugguucaucugggcaucuuaguggagcagauuccgaaagccaggaggagaauacacagcuguga

SEQ ID NO: 60801 - RNA, 3585 nt, Artificial Sequence
  derived and/or modified sequence opt3 from PLCB4__Homo_sapiens__NP_000924
auggccaagcccuacgaguucaacuggcagaaagaagugccuagcuuucugcaagagggcgcugucuucgacagauaugaagaggaauccuuuguuuucgagccaaauugccucuuuaagguggaugaguucggguuuuuccuuaccuggaggucugaaggaaaagagggucagguacuggaauguucauugaucaacaguauucggagcggcgcaauaccgaaggaccccaaaaucuuagccgcgcuggaggcuguggggaaguccgagaaugaucuagaaggacgcauugucugcguguguucuggcacagaccucguuaacaucucguuuacuuacaugguggccgagaauccugaagucacgaagcaguggguggagggucugcgaucaauuauccacaacuuccgugcaaauaacguaagcccaaugaccugccuuaaaaagcauuggaugaaacuggccuuuaugacaaauacuaacgggaagauacccguuagaaguaucaccaggacauucgcuuccggaaaaaccgaaaaggugauuuuucaggcauugaaggagcucggccugccuucuggcaaaaaugaugagaucgaaccaacugccuucagcuaugagaaguucuacgaacugacacagaaaauuuguccccggaccgacaucgaggaucucuuuaagaaaauaaacggggacaagacggauuauuuaacugucgaccaacugguguccuuccuuaaugaacaccagcgcgauccuagauugaacgagauucuguuuccauucuacgacgcuaaaagggccaugcagaucauugagauguaugaaccggaugaggaccuaaagaagaaaggacucaucucaagugacgguuuuugccgguaccugaugagcgaugaaaaugcgcccguguuccuugaccgccuggaguuguaccaagaaauggaucauccucucgcacacuauuuuaucucuuccucacauaacaccuaccugacaggccgacaguucgggggaaagagcagugucgagauguauagacagguuuuacuggccggcuguaggugcguggagcucgacuguugggaugguaaaggggaagaccaggagccaauuauaacucacggaaaggcuaugugcaccgauauccuuuuuaaagacguaauucaagccaucaaggaaacagcauucgugaccucugaguaccccgucauacuguccuuugagaaccacuguagcaaguaucagcaguacaaaaugucgaaguauugcgaagauuuguucggcgaccuacugcucaaacaagcucuggagucucauccucuugaaccaggccgggcccugcccuccccgaaugauuugaagcguaaaauucucaucaagaacaagcgccugaaaccugagguggaaaagaaacaguuagaggcgcugagaucaaugauggaggccggggaaagugcaagccccgcuaauauccuagaggacgacaacgaagaggaaauugaguccgccgaucaggaggaagaggcucacccagaauuuaaguucggaaaugagcucucugccgacgaucugggucauaaagaagcaguugccaacagcgugaagaagggccuugucacgguggaggacgagcaggcuuggauggcgucauacaaauacguaggggcaacuacaaauauccacccuuauuugaguaccaugauuaacuacgcccaacccguuaaguuccagggauuucacguggcugaagagaggaauauacauuauaacauguccagcuucaaugaaucugucggccuggguuaccucaaaacucacgccaucgaguuugugaacuauaauaagcggcagaugucacgaauuuacccaaaagggggccgcgucgauaguagcaacuauaugccccagaucuucuggaaugcaggaugccaaauggugucccugaacuaccagacaccugaccuugccaugcagcugaaccagggcaaguuugaguacaaugggucuuguggauauuugcucaaaccagauuucaugagaaggccggaccggaccuuugaucccuucucggaaacgccuguugacggugugaucgcugcaaccugcagcguacaagucauuuccggccaguuucugucagauaagaagauagggacauacguggagguugacauguauggauuaccaacugauaccauccgcaaagaguucagaacaaggauggugaugaacaauggccugaaccccgucuacaaugaggaaaguuuuguguuccguaagguaauucuaccugaccucgccgugcugcggaucgcgguuuaugacgauaacaauaaacuuauuggucagcgaaucuugccacuggacgggcuccaggcuggcuacagacauauaucucugaggaacgagggaaauaagcccuuaagccugccgacuaucuuuuguaacauuguccuuaaaaccuaugugccugauggcuucggggacaucguggaugccuuguccgacccaaagaaguuccucucaauuacagagaaacgcgcagaucaaaugcgggccaugggaaucgaaaccagcgacauagcugauguccccucugacacuuccaagaaugauaaaaaggguaaagccaacacggcaaaggcuaauguuacaccucagaguagcucugagcugagacccaccacuaccgccgcgcuagccuccggcguggaagcuaagaaagggauugagcugaucccacaggugaggauugaagaccucaagcaaaugaaagcauaccugaagcaccuuaaaaagcagcagaaggaguugaacucacugaaaaagaaacaugccaaggagcacaguacaaugcagaaauuacacugcacccaaguagauaagaucgucgcucaguacgacaaagaaaagagcacucaugagaagauacucgaaaaagccaugaagaaaaagggaggcucgaauugucuggagaugaaaaaggaaacagagaucaagauucagacgcuuaccuccgaccacaaaucuaaggugaaagagaucguugcacagcauacuaaggaauggagcgagaugauuaacacacacucagcggaagaacaagagauccgcgaucugcacuugagucagcagugcgaacuccugaaaaagcuacugauaaacgcccaugagcagcaaacccagcagcucaagcugucccacgaccgagaaucuaaagagaugcgggcucaucaagccaagauuagcauggaaaauuccaaagcaaucucacaggauaagagcaucaaaaacaaggcugagcgugagagaagggugcgcgaacuuaauaguucuaacacaaagaaauuuuuggaggaacggaagagacuggccaugaaacaguccaaggagauggaccagcucaaaaagguccaauuagaacaccuggaguuccuugagaagcagaaugaacagcugcuaaaaagcugucaugcagugucgcagacucaaggugagggggaugccgcugacggcgaaauuggaucaagggauggcccucagaccucuaacaguuccaugaagcuccagaaugcgaacuga

SEQ ID NO: 60802 - RNA, 2334 nt, Artificial Sequence
  derived and/or modified sequence opt3 from PLCD1__Homo_sapiens__NP_001124436
augcagugccugggcaucagaagcaggucccggucucgcgagcucuaccuucaagaacgaucacugaagguggccgcuuugaacgggcguagauuaggacugcaggacgaugaggaccuacaggcacuccugaaagguagucagcuucugaaggucaaaagcuccucuuggaggcgggaacgcuucuauaaguugcaagaggauuguaaaaccauuuggcaggaaucgagaaagguuaugaggacacccgagucacagcucuuuagcauagaggacauccaggaagugcggaugggccaccgcacugaggggcuggaaaaguucgcccgagauguaccugaggacagaugcuuuaguauuguguucaaagaucaaaggaauacgcuggaccucaucgcgccauccccggcugaugcccagcauugggucuuaggacugcacaagauuauccaucacucuggcagcauggaccagcggcagaaacuucaacauuggauacacuccuguuugcguaaggcagauaaaaacaaggacaauaagaugucauuuaaagagcugcagaacuuccuaaaggaacucaauauccagguggaugacaguuacgcccgcaaaauuuuuagagagugcgaccacagccaaaccgauucucuggaagacgaggaaaucgaggcuuucuauaagaugcuuacacagaggguugagauugaucggacuuuugcagaagccgcugguuccggggagacccugucaguggaccaguuggucacauuccuccagcaucaacagcgagaagaggccgcgggacccgcacuggccuuaagccugaucgaacgcuacgagccuagugagaccgcuaaagcccagagacagaugacuaaggauggcuuucucauguaucuucugucugcagacggcuccgcuuucagcuuggcccacaggcggguguaccaagauauggggcagccacuaucgcauuaucugguaucuuccucacacaacacauaccuccuggaagaccagcuugcgggacccaguagcaccgaggccuacauacgcgcacuguguaaagguugcagauguuuggaacucgauugcugggacggcccuaaucaggagccaauuaucuaucacggguacacguuuacuuccaagauucuguucugugauguuuuaagggcuauccgugacuaugccuucaaggcuucucccuacccugugauccugagccuagaaaaccauugcacccucgagcaacagcgggucauggcccgacaucugcacgcaauucuuggaccaauguugcugaauagaccgcucgacggcgugacaaacucacugcccaguccugagcagcuuaaagguaagauacuguugaaagggaagaaacucggaggccuguuaccacccggcggggaaggagguccugaggccacuguggucuccgaugaagacgaggcugcggagauggaagaugaggcaguuaggagccgcgugcagcacaagccaaaggaagacaaacugcggcuagcccaagagcucucugauaugguaaucuauuguaagucagugcauuuuggcggguucaguagccccggaaccccgggccaggcuuuuuacgaaauggccuccuucucugagaauagagcacugaggcuuuugcaggagucggguaacggguuuguccgccacaaugugggccaccugagccgaauuuauccugccggauggcggacagacuccucaaacuacagucccguugaaauguggaauggcgggugccaaaucguggcucucaacuuccagaccccaggaccugagauggaugucuaccagggucguuuucaggacaacggcgccugcggguaugugcugaaacccgcauucuuaagagauccaaauggaacguuuaaccccagggcgcuggcucaaggcccuuggugggcccgcaagcggcuuaauauaagaguaauuucuggucagcaguugccaaaaguuaacaagaauaagaacagcaucguggacccgaaagucacuguggaaauccauggggucuccagggauguggcaucacgacagacagccguuauuaccaauaacggcuucaaucccuggugggacacugaguuugcuuucgaagugguagucccugaucucgcccugauccgcuuucuaguggaggacuacgacgcaagcucuaagaacgauuucauuggacaauccacaauaccacugaauagucucaaacagggcuaucggcacguucaucugaugagcaagaacggggaccagcaccccucugcuacccuuuucgugaaaaucuccuugcaggauuga

SEQ ID NO: 60803 - RNA, 2370 nt, Artificial Sequence
  derived and/or modified sequence opt3 from PLCD3__Homo_sapiens__NP_588614
augcugugcggcagauggaggcggugucgccgacccccugaggaaccaccgguggccgcucaggucgcagcccaaguugcggcucccguggcccucccuagcccacccaccccuuccgacgggggaacaaagcguccaggucuuagagcacugaaaaagaugggcuugacugaggaugaagacguaagggccauguuacgggggucucgccugagaaaaaucaggucacggacguggcacaaggagcgccuauaccgacuccaggaagauggacugagugugugguuccagagaaggauuccccgggcuccuagccagcauauauuuuucguccaacacaucgaggcagugcgugagggccaucaguccgaaggucuucgcagauuugggggagccuucgcuccagccaggugccugaccauugcguuuaaaggccggcgaaagaacuuggaccucgcagccccgacagcugaggaagcccagcgcuggguuagaggccugacuaagcugagggcacggcucgaugcuaugucucagcgcgagagauuagaccacuggauccauucguaucugcacagggccgauucaaaucaagacagcaaaaugaguuucaaggagauuaaaucccuuuugcguauggugaacgucgauaugaaugacauguacgcguaucugcuauuuaaggaaugugaucacucuaacaaugaccggcucgagggggccgaaaucgaggaguuccugcgaagacuucugaaaaggcccgaauuggaggaaauauuucaucaguacagcggagaggaucgcgugcucuccgcaccugaacuguuagaguuccuggaagaccagggugaggagggcgcuacccucgcccgggcucagcaacuuauccagacauaugaacugaacgagaccgccaagcagcacgaauugaugacucuagacggguuuaugauguaccugcucucaccagagggagcagcccuggauaauacacauaccugcguauuccaagacaugaaccagccccuugcucacuauuuuauuaguagcucucacaauacguaccugacugauucccagaucggcgguccuucaagcaccgaagcguacguuagagcauucgcccagggguguaggugcguggaguuggacuguugggagggaccaggcggcgaacccgucauuuaucaugggcacacacucacuucaaagauccuguuccgcgauguggugcaagcuguccgagaccaugccuuuaccuuaucuccguacccuguuauacugucccuagagaaccacugcggacucgaacagcaggcagccauggcucggcaucuguguacaauucuuggugauauguuggugacccaggcccuggacagccccaauccagaggagcucccuucgcccgaacaacugaaaggccguguacuugugaaggggaaaaagcugccagcagcgagaucugaggauggaagggcuuuguccgaccgcgaagaggaagaggaggaugacgaagaggaagaggaagaggucgaggccgcagcccagcggagacucgcuaaacagaucucacccgaacugagugccuuagcaguguauugccacgcuacgaggcugcgaacucuacacccugccccaaacgcgccgcagcccugucaaguuagcucccucucugagcgcaaggccaaaaagcugauucgggaagcuggcaauagcuucgugagacauaacgcaaggcagcuuacacgugucuacccuuugggucugcgcaugaauagugccaacuauaguccacaggagauguggaacuccgggugccagcucguggcucugaauuuucaaacccccggcuacgaaauggacuuaaacgccggacgguuccugguaaauggccagugcggguauguucuuaagccugcauguuugagacagccagauagcacuuuugaccccgaguacccgggaccuccaaggacaacccucucuauccaagugcugacggcgcagcagcuacccaaacugaacgccgagaagccucacucaaucgucgauccccucgugcgaauugaaauacauggugucccagcugacugcgcccggcaggagaccgauuacgugcugaauaacggcuucaauccucgcugggggcaaacacuucaguuucaguugagagcacccgaacuggcuuuaguuagguucgugguagaggacuaugaugccaccaguccaaacgacuuugucggacaguucacucucccgcugagcucccuuaaacaaggcuaccggcacauccaccuguugucuaaggauggugcaucgcucagcccugccacacuguuuauucagauccgaauacagagauccuga

SEQ ID NO: 60804 - RNA, 2289 nt, Artificial Sequence
  derived and/or modified sequence opt3 from PLCD4__Homo_sapiens__NP_116115
auggccagccugcuccaggaccaacuuaccacagaucaggaccuguuguuaaugcaggagggcaugcccaugagaaaggugagguccaaaucuuggaagaaacugcgguacuuccgccuacagaacgaugggaugacugucuggcacgcucgacaagcacguggaucagccaagccuaguuuuagcaucuccgacguugaaacgauuagaaauggucaugauucugagcuccugaggucgcuugcggaggaacugccauuggaacagggcuucaccauaguguuucacgggcggcgcucaaaccucgaccugauggcuaauagcguagaggaggcccagaucuggaugagaggacugcagcucuuaguggaucuggucacaaguauggaccaucaagaaaggcuugaucagugguuguccgacugguuccagcggggcgauaaaaaccaggacgguaagaugucuuuucaagaggugcagcgccugcuacaccucaugaauguugaaauggaucaggaguaugcauucagccuguuucaagccgcugacacuucccagucagggacccuugagggagaagaguucgugcaguuuuacaaggcacugacaaaacgagccgaaguccaggaguuguucgaaaguuuuagcgcugacggccaaaagcucacccuguuagaguuccuggauuuucuccaggaggaacagaaagagagagacugcacuucugaacuugcccuggaguugauugauagguaugaaccguccgacucaggcaagcuacggcaugugcugagcauggauggguuccucaguuaccuguguucuaaagacggagauaucuucaaccccgcgugccuuccuauuuaucaggacaugacacaaccacugaaucacuacuuuaucuguuccagccacaacaccuauuugguaggugaucagcucugcggccagucgucuguugagggguacauacgugcacugaagcgcggauguagaugcguggaggucgacgugugggauggccccuccggugaaccuguggucuaccaugggcacacguuaacuucaaggauccuguucaaggacguuguggccaccguagcucaguaugccuuucaaacaagugacuacccagugauucuaagccucgagacucauuguuccugggaacagcagcagaccauggcacggcaccugacagagauccuuggagaacaauugcugucuaccacgcucgauggcguccugcccacucagcuuccuagcccagaggagcugcgacgcaaaauuuuggugaagggcaaaaagcucacacuggaagaggacuuagaauaugaggaggaagaggcugaaccggagcuggaagagucagagcuagcccucgaaagucaguucgagaccgaacccgagccucaagaacagaaucugcagaacaaagauaagaaaaagaaguccaaaccaauccuuugccccgcguugagcucucugguuauauaccucaagucagugaguuuuaggagcuucacucacuccaaagagcauuaucacuuuuacgagauuucuucguucagcgaaacaaaggccaaaagacugaucaaggaggcagggaaugaauuuguccagcauaacaccuggcaauuaucccggguguauccuucaggacugcgcacggacaguucuaauuacaacccacaggagcuuuggaaugcugguugucagaugguagccaugaacaugcagaccgcuggcuuggaaauggauauuugcgacgggcacuucagacaaaacggaggcugugguuacguucucaagcccgauuuucugagggacauccagagcuccuuccauccggagaaaccuaucucacccuuuaaggcccagacacuacugauucaggugauaagcgggcaacagcucccaaaagucgauaagacuaaagagggcucuaucguggacccucuggucaaggugcagauuuucggaguucgucuugauaccgcacggcaagaaacaaauuauguggagaacaauggcuucaaccccuacugggggcagacuuugugcuuucgaguacuggucccagaauuagccaugcucagauucgugguuauggacuaugauuggaaguccaggaaugacuuuaucggacaguacacccugcccuggacaugcaugcagcaagguuaucgccacauacaccuucugaguaaagacggcauuagcuugcggccugcuucuaucuucguguacaucuguauucaggaggggcucgagggagaugaauccuga

SEQ ID NO: 60805 - RNA, 5985 nt, Artificial Sequence
  derived and/or modified sequence opt3 from PLCE1__Homo_sapiens__NP_001159451
auggugagcgagggcuccgccgcugggagagacuucgcaggaauggaagaggucaggcagcugcacguucgguuuugcaaggguaucaaaauuuggcaucaagccugguuccucuguucucuucugggccgcgaaccccaggagcgagaagcggggugccaguugugguuauguacccugucagcugugcuaaagguaggauggcucuuuccucugagugaggugccaaacuucacacuucugaaagauggcugcgguuguuggcguuugaaggaggaccagauauacaaugccgucagaagggaagagacugaaaacacgguggggagccuccugcacuuucugaccaaacucccggcauccgagacagcccauggacggaucucuguuggccccugcuuaaagcaaugugugcgcgauacugucugcgaguauagagcuacccugcagaggacaucgauuucacaguacaucaccggcagccuuuuggaagcaacuacaagucugggggcccgguccggacuacucucuaccuucgguggcagcacggggcgcaugaugcugaaggagcgacagccuggaccauccguggcuaauucaaacgcccuucccaguagcucugcgggcauuuccaaagaacugaucgacuugcaaccucucauacaguuuccagaggaaguagcaucaauccugauggagcaggagcagacuauuuauagaaggguuuuacccguggauuaccuguguuuccucacccgggaccuugguacaccugaaugccaaagcagucugccauguuugaaggccucuaucuccgcuagcauucuaacuacccagaauggggagcacaacgcccuggaagaucucgucaugcguuuuaaugaggugucgucuugggugacauggcugauccuuaccgcaggauccauggaagagaaacgcgaggucuucucauaucugguucauguggcuaagugcugcuggaacaugggcaauuacaacgccguaauggaauuuuuggcgggccucagaaguaggaaagugcugaagauguggcaguucauggaccaaagcgauauagagacgaugcgguccuuaaaggacgccauggcacagcacgaaucuagcugugaguaucgaaaagucgugacucgcgcucugcacauuccggggugcaagguugugcccuuuuguggagucuuccuaaaagaacucugcgaggugcuggauggugccucaggccuuaugaaguuguguccuagauacaauagucaggaggaaacacuggaguucguagcugacuacuccgggcaggauaacuuucuccaaaggguuggacagaauggccugaaaaacagcgaaaaggagucuaccgugaauucaaucuuccaggucauucggaguugcaaccgcagccuugagacugacgaagaggacuccccaucugaagguaacucgagcagaaaauccucacugaaggauaagaguagguggcaguuuaucaucggggacuugcucgauucugacaaugauauuuucgagcaaagcaaagaauaugacucccauggcucagaggauagccagaaggccuuugaccacggaacagagcugauacccugguacguguuaucuauccaggcagauguccaucaguuccugcuacaaggcgccaccgugauucacuaugaccaggauacgcaccucuccgcucguuguuuucugcagcuucagccugacaacaguaccuugacauggguuaaaccaacuaccgcgagccccgcaucuuccaaggccaaacugggggugcucaauaacacagcugaaccgggaaaguucccucuguuagguaaugccggccugucaagucuuacugaggggguauuggaccucuuugcagucaaggccguguacaugggacaucccggcaucgauauacacaccguuugcgugcaaaacaaacuggguagcauguuccuaucggaaacaggggucacccugcucuauggccugcagacuacggacaaucggcuuuugcauuuuguggcuccaaagcacacagccaaaaugcuguucuccggauuacucgagcugacccgagcaguaagaaagaugaggaaauuuccugaucagcgccaacaguggcuucggaagcaguacgugucucuguaucaggaagacggcagauacgaggggcccacuuuggcgcaugcuguugagcucuucggagguaggcgcuggagcgcccgaaacccaucacccggcaccagugcaaagaaugccgaaaaaccuaacaugcaacggaauaacacacuggggauuuccaccacuaagaaaaagaaaaagauccuaaugcguggagagucuggcgaagucacagaugacgagauggcuacgagaaaggccaaaaugcacaaggaauguaggagccgcuccgguucagauccacaggacaucaaugagcaggaggaaagcgaggugaacgcaauugcuaauccgcccaacccucugccaagucggagagcccacucucucaccacugcggggucccccaaccuggccgcuggcacaagcucgccuaucaggccagugucaucucccguccuuaguuccagcaauaaaucuccgagcuccgcauggucaaguagcucuuggcauggacgaauuaagggcgggaugaaaggauuccaguccuuuaugguuucagauaguaacaugagcuucguggaauuuguggaguuguucaaguccuuuucuguacgcucgcggaaagaccugaaggauuuauucgacgucuacgccgugccuugcaauagaagcggcucagaguccgcuccacucuauaccaaccugacaauagaugaaaauacuagugaccuucaacccgaccuggaucuacucaccaggaacguuucugaccuggguuuguuuaucaagagcaaacagcagcuguccgauaaucagcgucaaauuucagacgccaucgcagcggccucuaucgugacgaacgggaccggaauugagagcacaaguuuaggcauauucggugucggcauccuccagcugaaugauuuucuugugaacugucagggggaacacugcacuuacgacgagauucuguccaucauucaaaaguucgaaccuagcaucucuaugugccaucagggauugaugucauuugagggcuucgcucgcuuucucauggauaaagagaauuucgccuccaagaacgacgaaagucaggagaauauaaaagaacugcagcuaccccugagcuauuacuauaucgagucgucucacaacaccuaccuuacagggcaccaacucaagggagaauccagcguugagcuguauucacagguguugcugcagggcugucggaguguagaguuagauugcugggacggugaugacgggaugccaauuaucuaccauggacacacucucaccacgaagauuccuuucaaagaagucguggaggcaaucgauagaucugcuuuuauaaauuccgaccugcccauuaucauuagcaucgaaaaccauuguucacuuccacagcaaaggaagauggccgagauauucaaaacaguguuuggcgaaaagcuggucaccaaauucuuguuugagacugacuucagugaugacccgaugcucccuagccccgaucagcugcgaaagaagguucuacugaaaaacaagaaacuuaaggcacaccagacaccaguggacauccucaaacagaaggcccaucaacuggcuuccaugcagguacaggcguacaaugguggcaacgccaauccccggccugcaaacaaugaggaagaggaagaugaggaggacgaauaugauuacgacuaugagucuuugagcgaugacaacauuuuagaagaucgcccagagaauaaguccugcaacgacaaacugcaguuugaauacaaugaggagauccccaagagaauuaaaaaggcugacaacucagccuguaauaaagggaagguguaugauauggaacucggagaggaauucuaccuggaccaaaacaaaaaggagucuaggcagaucgccccugaacuuagugaucuggucauauauugccaggcugugaaguuuccgggcuugucgacccuaaaugcaagcggguccucucggggaaaagagcgaaagucaagaaaaagcauuuucggcaacaauccaggucgcaugucccccggggagacugccaguuuuaacaagaccucuggaaaaagcucaugugaaggcaucaggcaaacaugggaggaauccaguagcccucugaacccaacgaccucucucuccgcgaucauucguacucccaagugcuaccacaucucaagccugaaugagaacgcugccaagcggcuuuguagaagguacucgcagaaauuaacacagcacaccgcaugccagcugcuccgcacauauccugccgcuacucgaauugacucuaguaauccgaaccccuugauguucuggcugcaugguauacaacucguugcacugaauuaccagaccgaugaccuuccacugcacuugaacgccgcgauguucgaagcuaauggcggguguggauaugugcuaaagccucccguccugugggauaaaaacugcccaauguaccagaaguuuuccccucucgagagagacuuagauagcauggaccccgccguguauucacugacgaucguuuccggccagaaugugugcccaucuaacagcauggggaguccguguauugaggucgauguacuuggaaugccucuggacuccugccauuuccggacaaaacccauccacaggaauacccucaacccaauguggaaugaacaauuuuuguuccaugugcacuuugaggaucugguuuuccuccgcuuugcaguggucgaaaacaauagcucugccgugacugcucagcguauuaucccccugaaggcccuuaagagaggcuaccggcaccuacagcugaggaacuugcauaaugagguauuagagauaucaagucuguucaucaacucccgccgaauggaagagaacagcucugguaauaccaugucggcaucaagcauguuuaacacagaagagagaaaaugucuccagacucaccgggugaccguccaugggguuccuggaccagaacccuucacaguguuuacgauuaauggcggcaccaaggcuaaacaacugcuucagcagauccugacuaacgagcaagacauuaagccugugacaaccgacuauuuccucauggaggaaaaauacuuuaucuccaaggagaagaaugaaugcaggaaacagccguuccagcgcgccauagggccagaggaagagauuaugcagaucuugaguucuugguuccccgaggaaggauacauggguagaaucguccugaagacucaacaggagaaccuagaagagaaaaauauugugcaggaugacaaggaaguuauacugagcuccgaggaggaaucauuuuucguacaggugcacgaugucaguccugagcaacccaggacagugaucaaagcgccacggguuucuaccgcccaggacgugauucagcagacgcucuguaaggcaaaguauagcuacuccauccuuucaaacccuaaucccagcgauuauguccuguuagaagaggugguaaaagacacuaccaacaagaaaacaaccacuccaaagucuucccaacgugucuugcuggaucaggagugcguguuucaggcucagaguaaauggaagggcgccgggaaauucauucucaagcugaaggaacaaguucaggcuagccgcgaggacaaaaagaaaggaaucucguuugcauccgaacuuaagaaacugacaaagucuaccaagcagccucgaggccucacaucaccgagccaauugcugacuagugaguccauacagaccaaagaagagaagcccguggguggguuaucuagcucagauacgauggacuacagacaguga

SEQ ID NO: 60806 - RNA, 3876 nt, Artificial Sequence
  derived and/or modified sequence opt3 from PLCG1__Homo_sapiens__NP_002651
auggccggcgcugcaagccccugcgccaacggguguggaccuggugcgccauccgacgcugaggugcugcaccucugcagaucucuugaagucggcaccguuaugacacuguucuacucaaagaaaagucagaggccggagcggaagacuuuucaagugaaauuggaaacgcgccagaucaccuggagccgaggggccgauaagauugagggagcaauagacauccgugaaauuaaagagaucagacccggcaagacauccagggauuucgaccgguaucaggaggauccugccuuucgcccagaccagucucauuguuucguaauuuuauacgguauggaauuuagacugaagacucuaucgcuccaagcuaccucagaggaugaagugaauauguggaucaaagggcugacauggcuuauggaggacacccugcaggcacccacuccuuugcagauagagagguggcuccggaagcaguucuauagcgucgaucgcaaccgagaagacagaaucagugccaaagaucugaagaauaugcugucccaagugaacuacaggguuccaaauaugcgguuucuccgugagcgcuuaacagaccuggaacagagaucuggagauauuaccuauggccaguucgcucagcuuuacaggagcuugauguauuccgcccaaaagacgauggaccugcccuuucuagaggcgucaacucuccgggcaggcgaacgaccugagcugugccgcgugagucuuccagaguuccagcaguuucuguuggacuaccaaggggaacucugggccgucgauagauuacaggugcaggaguucaugcugagcuuucugagggacccgcuccgggaaaucgaggaacccuacuucuuccuugaugaguuuguaaccuuccuguuuucuaaggagaacuccguuuggaauagucaguuggacgcuguguguccugauacaaugaacaauccacuaagccacuauuggauuaguucuucccauaacacuuaccugaccggagaccaauucagcucggaaucuucccucgaggccuaugcacgcugccugagaauggguuguaggugcaucgaacuugauuguugggacggccccgaugggaugccugucauauaccacggacauacacugaccacgaagauuaaauuuucagacguguugcacacuaucaaggagcacgcuuucguggccagugaauauccagucauucucagcaucgaggaucauugcuccaucgcgcagcagcguaauauggcccaguacuuuaaaaagguucugggcgacacauuacugaccaaacccguggagauuucugcagacggucuaccgagcccuaaccaacucaagcggaaaauacugaucaagcacaagaaacuugcugaagggucagccuaugaggaaguacccacuucaaugauguacuccgagaaugauauuagcaacucuaucaagaauggaauauuguaccuggaggacccagugaaccaugaaugguauccucacuacuucguccucacaucaaguaaaauuuauuacagcgaggaaaccuccucugaucagggcaacgaggacgaagaggagcccaaggaagugucgagcuccacggagcugcacucaaaugaaaaaugguuucauggcaaacuuggggcuggacgagaugguagacacaucgccgagaggcuguugaccgaauauuguaucgagacaggcgcaccagacgggaguuuccucguucgcgagucugaaacuuuugugggagauuacacccugagcuucuggcggaacggcaagguccagcauugcaggauucacuccagacaggacgccgguacacccaaauuuuucuuaacugauaaucugguguucgacucacuauaugaucucaucacccauuaccaacagguaccucugcgcugcaacgaguuugaaaugcgacuuagcgagccaguuccgcagacaaaugcucacgaaucuaaggagugguaccacgcguccuugacccgggcacaggccgagcauaugcugaugcgugugcccagagacggggcuuuccucgucaggaaacgcaacgaaccuaauaguuaugccauuagcuuucgggcagagggcaagauaaaacacuguagagugcaacaggaaggacagacugucaugcugggcaacucugaguucgauuccuuaguggaccugaucucauacuaugagaagcauccacuuuacaggaagaugaaauugcgauaucccauuaaugaagaggcccucgaaaagaucgggacggcugagccugacuacggagcccuguaugaaggucgcaacccaggcuuuuacguugaggcaaaucccaugccgacauucaaaugcgcggugaaggcucuauuugauuacaaagcccaacgggaggacgaacugaccuucaucaagagugcaauuauacagaacguagagaagcaggaagggggaugguggagaggcgauuauggugggaaaaagcagcucugguuuccuagcaauuacgucgaggaaauggugaacccaguugcccuggagcccgagagggaacaccuugacgaaaauucgccuuugggcgaucuguuacguggagugcucgacguccccgcuugucaaaucgccauucgcccagaaggcaaaaacaaccggcuguucguguuuuccaucucuauggcaagcguagcucacuggucacuugauguggccgcggacagucaggaggaacugcaggauuggguuaagaaaauuagagaggucgcccagacugcugacgcaagguugaccgaggggaagaucauggaacgacggaaaaagauagcccucgagcuguccgagcuagugguguauugccgcccuguccccuucgaugaggagaagaucggaacagaaagagcuuguuacagggacaugucuagcuuuccagagaccaaagccgaaaaguauguuaauaaagcaaaggguaaaaaguuccugcaauacaaccggcuccagcugucccgaauuuauccgaagggccagagacuugauucaagcaauuacgacccuuugcccauguggaucugcgggagucagcugguggcguuaaacuuccaaacuccagacaaacccaugcagaugaaucaggcccucuuuaugacaggacgccauuguggcuacgugcugcaaccuucuacgaugagggaugaggcuuucgacccauuugauaaguccagccuucguggucuggaacccugcgccauuucgaucgagguacuaggggcacggcaccucccuaaaaacggcagaggaauagucuguccguucguggagauugaaguugcuggcgccgaguaugacucaaccaagcagaaaacugaauuuguggucgauaaugggcugaacccaguguggcccgcaaagccuuuccauuuucagaucucuaauccagaguucgccuuuuugagguucguuguguacgaagaggacauguuuagugaucagaacuuccuggcucaagcgacauuccccguaaagggauuaaaaaccggcuaucgcgccgucccucucaagaauaacuacuccgaggaccuggaacuugcaagccuguugauuaaaaucgauauauuuccggcuaagcaggagaauggugaccucucucccuucagcgggacaucccugcgagaaagaggaucagaugccaguggccagcuauuucacggucgggccagggagggcagcuucgaaucucgcuaucagcaaccauuugaggacuuccguaucucccaggagcaucuggcugaccacuuugauucaagagaacggagggcaccucgccgaacuagagugaacggggacaaucggcuuuga

SEQ ID NO: 60807 - RNA, 3798 nt, Artificial Sequence
  derived and/or modified sequence opt3 from PLCG2__Homo_sapiens__NP_002652
augagcaccacagugaacgucgacucccuggccgaguacgaaaagucucagaucaaaagagcucucgagcuuggcacuguuaugacgguguucucauuuaggaagaguacccccgaacggcgcacaguacaagugauuauggagacucgacaggucgcauggagcaaaaccgccgauaagauagaaggguuccuggacaucauggagauuaaagagauccguccuggaaagaauaguaaggauuuugaaagagcgaaagcugugaggcagaaggaggacugcuguuucacaauuuuguaugguacccaguuuguuuuaucuacucugucgcuagccgcagauucaaaagaagacgccgugaacuggcucagcggccugaagauccuucaccaagaggcuaugaaugcaaguacaccaaccauaaucgaguccuggcugcggaaacagauuuacucugucgaucagacgcgcagaaacagcaucuccuugagggaacucaagacuauucugccgcugaucaauuucaaggugucaagugccaaauuucucaaggacaaauucguagagauaggggcucauaaggaugaacuuagcuuugagcaguuccaccuguuuuauaaaaaguuaauguucgaacaacagaaaucuauuuuggacgaguuuaagaaggauuccucaguuuucauccugggaaacaccgaccggcccgaugccagcgcgguguaccuacaugacuuccagcgcuuucucauucacgagcagcaagaacauugggcacaggaccugaauaaaguccgagagagaaugacaaaguucaucgaugacacuaugagggaaaccgccgagccuuuucuuuucguggaugaauuucugacauauuuguucagucgggagaacucuaucugggacgagaaauacgaugcuguggacaugcaggauaugaauaacccacucucccacuauuggauuagcucgucucacaauaccuaccugacgggcgaccaauuacguuccgaaucaagucccgaggccuacauacgcugccugagaauggguuguaggugcaucgaacucgauuguugggacgggccugauggaaagccagucauuuaucauggcuggacucggacaaccaaaaucaaguuugacgacguugugcaggcaauaaaggaucacgcuuucguaacuagcuccuuucccgugauucuuucuaucgaggaacauugcagcgucgagcagcagcgacacauggccaaagcguucaaggagguguuuggcgaccuguugcuaacaaaaccuaccgaagccucagcagaucaacugccaaguccgucccagcuccgcgagaagaucauuaucaaacacaagaagcuggggcccagaggagacguugaugugaacauggaagacaaaaaggaugagcauaaacagcagggugagcuuuacaugugggacagcauugaucaaaaguggacgaggcacuauugugcuauagccgacgcuaaacugucuuucucagaugacaucgaacagaccauggaggaagaggucccucaggauauuccacccacagaauugcauuuuggcgagaagugguuccacaagaaaguggagaagcggacuuccgccgaaaaacuccugcaggaguacugcauggaaaccgggggaaaggacggcacauucuuaguacgcgagagcgaaacuuuuccuaaugacuauacccuguccuucuggagaucugguaggguucaacauugucguauccggucgacaauggaagggggaacccuaaaauacuaucucacugauaaccugacguuuagcuccaucuacgcacuuauucagcacuaccgagagacacacuugagaugcgccgaguucgagcugaggcucaccgacccagugcccaauccgaacccucaugaaucaaagcccugguauuacgauagucugucucgcggcgaggcugaagacaugcuuaugcggauaccaagagauggcgcguuucugaucaggaaacgcgaggggagcgacuccuaugcaauuacuuuccgagcccggggaaaggucaagcacugucguaucaacagagaugguaggcauuuuguguugggcaccucagcuuacuucgagagccucgucgaacuggugucuuauuacgagaaacacuccuuauaucgcaagaugcggcugagauacccuguuacacccgaacuacucgagagguacaauauggagcgagacauuaacagucuguaugaugugagccgcauguacguagacccaucugaaaucaaucccuccaugccucagcggaccgucaaagcccuuuaugauuacaaggcaaaaagaucagacgaguugaguuuuugccgaggggcccugauacacaacgugagcaaggaaccaggaggcugguggaagggugauuaugggacucguauccagcaauacuucccgucgaauuauguugaggacauuuccacagcugacuuugaggaacucgagaaacagaucauugaagauaacccccugggcucuuuaugccgcggaauccuggaccuuaauacguacaacguggucaaggccccucagggcaaaaaucaaaagagcuucguguuuauauuggagccaaaacagcagggggaucccccuguagaguucgcaaccgaccggguggaagaacucuucgagugguuucagucaauuagagagaucacuuggaagauugauacaaaggaaaacaauaugaaauacugggagaagaaccaaaguaucgcgauagaacuguccgaccuaguugucuauuguaaaccaaccucuaagacaaaagauaaucuggagaaccccgacuucagggaaaucaggagcuuuguggagacuaaggcugauuccauuauccggcagaagccgguggaccuccugaaauacaaucagaagggacuuacccgcgucuauccuaaaggucagagaguugauucaagcaacuacgacccauucagguuguggcugugcggcagucaaaugguggccuuaaacuuucagacggcagacaaguauaugcagaugaaucaugcccucuucucucugaacgggcggaccggauacgugcuucagcccgaguccaugcgaacagaaaaauaugauccuaugcccccagagagccaaagaaagauucugaugacuuugaccguaaaaguccucggcgcucgccaucugccuaagcuagguaggucgaucgccugucccuuuguggaaguugagauaugcggggcagaguacgacaauaacaaguucaaaacaacuguggucaaugauaacggccugucaccaauuugggcuccgacccaggaaaaggugacguuugagaucuacgacccuaaucucgccuuccugcguuuuguuguguaugaagaggauauguucucugaccccaacuuccuugcgcacgccacauacccaaucaaagcuguaaagaguggauuucgguccguccccuugaaaaauggcuauagcgaagauauugagcuggcaucuuuacucguguucugugagaugagaccugugcuggaaagcgaggaggaacuuuacuccucaugcaggcagcugcgccgaagacaagaggaacuaaacaaucagcucuuucuguaugacacccaccagaacuugcggaaugccaacagggaugcucuggucaaggaguucaguguuaaugaaaaccaguuacaacucuaccaggagaaguguaacaaacgccugcgugaaaagagagugagcaauucuaaauuuuauuccuga

SEQ ID NO: 60808 - RNA, 5082 nt, Artificial Sequence
  derived and/or modified sequence opt3 from PLCH1__Homo_sapiens__NP_001124432
auggccgaccuggagguguacaagaaccucagccccgaaaaagucgagagaugcauguccguuaugcagucuggcacccaaaugaucaagcuuaaaagggggacaaagggacuggugcgguuguucuauuuagaugaacaccgcacucgacugcguuggagaccuucaaggaaaagugagaaggcuaagauucuaauagacagcaucuacaaaguaacggaaggucggcaguccgagauuuuucaucgccaggcagagggcaauuucgauccaucuuguugcuuuaccaucuaucacgggaaccauauggaaucgcucgaccugauuacaucaaauccggaggaagccagaacuuggaucaccggacuuaaguaccugauggcgggcauaagcgaugaggacaguuuggcuaaaaggcagcggacacacgaucaaugggugaagcagaccuucgaggaagccgacaaaaacggugaugggcuccugaauaucgaggaaauucaucagcugaugcacaagcucaacgucaauuuaccccgccgaaaggugagacagauguuucaagaggcagacacugaugaaaaccagggaacacugaccuucgaggaguuuuguguuuucuauaaaaugaugucccuuaggcgggacuuguaccugcuacuccugucuuauagcgauaagaaagaccaccuuacgguggaagagcuggcccaguuuuugaaggucgaacagaaaaugaauaacgugacuaccgacuacugccucgauaucauuaagaaauucgagguauccgaagagaauaagguuaagaacgugcugggcaucgagggcuuuacaaauuucaugcguucaccugcuugugacauauuuaacccauuacaucacgaagucuaccaagauauggaccagccccugugcaauuauuacauugcaaguagccauaacacuuaucucaccggggaucagcuucugucucaauccaaaguggacauguacgcccgcguguugcaggagggauguagaugcgucgaaguugauuguugggacgguccugauggcgagccagugguacaccacggguauacacuaaccucaaagauccuguucagggacguggucgaaacgauuaacaaacaugcuuucgugaagaaugaguuucccguuauccucagcaucgagaaccacugcaguauucagcagcaacggaaaauagcccaguaccugaagggaaucuucggcgauaagcuugaccugucuuccguggacacuggugaauguaaacaguugccuagcccacagucgcucaaggggaaaauucuggucaagggaaaaaaguuaccguaucaucugggcgaugacgcggaggaaggcgaggugucugaugaggacuccgcagaugaaaucgaggacgaaugcaaguuuaaacuacacuacucaaaugggacaaccgagcaucaaguagaaaguuucauacgaaagaaacucgagagccugcuuaaggagucccagauucgcgauaaagaagaccccgauucuuuuacuguuagagccuugcugaaggcuacacacgagggacucaacgcccaccugaagcagagcccugacgugaaagaaucagguaagaaaagucauggcaggucccuuaugaccaauuucgggaagcacaaaaagacgaccaaaagccggucuaagucauacaguacagaugacgaggaagauacucagcaaagcaccggaaaggagggcggucagcuguaucgcuuggggagaaggcguaaaacaaugaagcucugccgggagcuguccgacuuagucguguacacuaacucugucgcagcucaggacaucguggaugacggcaccacaggaaauguucugucguuuagcgaaacccgagcccaucaggugguacaacagaaauccgagcaguucaugaucuauaaccaaaagcagcuaacuagaauuuacccaucagcguauaggaucgauaguucuaauuuuaacccccucccuuacuggaaugccggcugucagcuggucgcacuuaacuaucagagcgaagggcgcaugaugcaauugaaucgggcuaaauucaaggccaacggaaauugcgguuacgugcugaagccacagcagauguguaaaggcacguuuaaccccuucuccggggacccgcucccugcuaaccccaagaaacagcugauuuuaaagguuauaucaggacaacagcugccaaaaccucccgauagcauguuuggcgacagaggugagaucauugauccauucguggaagucgagaucaucgggcuucccguggacugcuguaaggaucagacaaggguaguggacgauaauggcuucaacccuguuugggaggaaaccuugacuuuuaccguccacaugccagagauugcccucgugcgcuuccuggugugggaccacgauccgauaggacgagacuuugucggccagcggacaguuaccuucucuucccuagugcccggguaccgucauguguaucuggaaggacucacugaggcaaguaucuuuguacacauuacaaucaaugagauuuacgguaaguggagcccucugauccuuaacccaucuuauacgauauugcauuuccugggcgccaccaaaaauagacaauuacaggggcucaagggacuguuuaacaaaaaucccaggcacuccucaagugaaaacaauagccauuacguccgcaagcggucgaucggcgacagaauucuuaggcgaacugcuuccgcgccugcaaaaggucgcaagaagucuaaaaugggguuccaggagaugguggaaaucaaggauagcguuucagaggccacacgggaccaagauggcgugcugagaaggaccacacguaguuugcaggcucgcccagucuccaugcccguggaccggaaccuccugggagcccuaucucugccgguuagcgaaacugcaaaagauauugagggcaaggagaauucccucgccgaagacaaagaugggagaaggaagggaaaagcuucaaucaaggacccucacuuucugaacuucaauaagaaacuuagcaguucuuccagcgccuugcugcacaaggauaccucgcagggcgacacgauagugucaaccgcacauaugucuguaacaggugagcaguuagggaugaguuccccacgaggaggccggacuaccagcaacgcgacaucuaauugccaagaaaaccccuguccuagcaaaucccucucacccaagcagcaccuggcuccagauccugucgugaaccccacucaggaccuucauggugugaaaauuaaggagaagggcaauccagaagacuuugucgaggggaaaaguauccugagcggaucuguucuaucccacucaaaccucgagauuaagaaucuggaaggcaaccgcgggaaaggaagagccgcaaccaguuucagcuuguccgaugugucuaugcugugcucggacaucccggauuuacauagcacggccauacuccaggagucaguaaucucccaccugauugacaaugugacacuuaccaacgaaaaugagccuggcaguucuaucagcgcucugauuggucaauuugaugaaacuaacaaucaggccuugacagucgugucccaccuccauaacaccucaguuaugucugggcacuguccccugccaagccuaggacugaagaugcccaucaaacauggcuucugcaaggguaagaguaaauccagcuuccuuuguucuucaccugagcucauagcacuguccaguagcgagacuaccaagcacgcuacaaauacgguguaugaaaccacuugcacaccaauuucgaaaaccaagcccgacgaugacuugucuuccaaagccaagacagcggcccuggagagcaacuuaccuggcucaccgaauacuaguaggggguggcucccaaagucucccaccaaaggagaagauugggagacgcugaaguccugcagcccugcuucaaguccagaccuuacacuggaggaugucaucgcagaccccaccuuguguuuuaacagcggcgaauccucucucguggagaucgauggggaaagcgagaaucugucccuaacuaccugcgaauaccggcgagagggaacaucacagcuggccucuccucuuaaacucaaguauaaccagggcguuguggagcacuuccaaagaggucugcgcaacggguacuguaaagaaacuuugaggccgaguguccccgagauuuuuaauaacauccaggacguaaagacccagucgauuagcuacuuagcuuaucagggagccggcuucgugcauaaucacuuuuccgacucugaugcaaagauguuccaaacaugcguuccacagcagucaagcgcgcaagacaugcaugugccuguccccaaacagcuggcccaccucccacugccugcucuuaagcugcccuccccauguaaaaguaagucuuugggugaucuaacgagcgaagacauagccugcaacuuugagucaaaauaccaguguaucuccaagaguuucgugaccacuggcauucgugauaaaaaggggguaacagugaagaccaaaagccuggaaccgaucgacgcacucacugagcagcugcggaagcuugucucuuuugaucaagaggacaauugccagguuuuauauuccaaacaggaugcuaaccagcugccuagagcccucgugaggaaguugucaagccgcucgcaaucucgagugagaaauauugcaagucgggccaaagaaaagcaggaggcuaacaagcagaaaguccccaauccauccaacggagcgggcgugguucugaggaauaagcccagcgccccuacaccagcaguaaaccgccauucaaccggguccuacaucgcuggauaucucaaaaauacgaagggcggugggcuggaaggacguggcauacccgagggcgccuguacugcccuucacuacgggcacguggaccaguucugcucugauaacagcguccugcaaaccgaaccuaguuccgacgauaaaccggagaucuauuuuuugcuaagacuguga

SEQ ID NO: 60809 - RNA, 3288 nt, Artificial Sequence
  derived and/or modified sequence opt3 from PLCL1__Homo_sapiens__NP_006217
auggccgagggcgcugcagggagagaagaccccgccccuccagaugcggcuggaggugaggacgauccgagggugggccccgacgccgcaggggauugcgucaccgccgcuagcggaggccggaugcgcgaccgacguuccgguguugcacugccuggggccgcuggaacaccagccgauucugaagcgggccuccuugaggcagccagagcuacucccaggcggucaaguaucauuaaggacccuagcaaccagaaauguggcgggcgcaagaaaacgguguccuucucuucgaugccaucagaaaagaaaauaagcagugccaaugauugcaucuccuuuaugcaagcaggaugugagcugaagaagguaagacccaacucuaggauuuacaaucgguucuuuaccuuggacacagauuuacaggcucugcgcugggagccuagcaaaaaggaccuagaaaaagccaagcucgauaucuccgcgauuaaagagauccgacuggguaagaacacugaaaccuucagaaauaacggccuugccgaccagauaugcgaggacugugcauuuucaauccugcacggggagaauuaugaaaguuuggaucucguggcuaacagcgccgacgucgcuaauauuugggugucuggacugagguaccugguuucccggucaaagcagccacucgauuucauggagggcaaccaaaauacaccgcguuuuaugugguuaaaaaccguguucgaagccgcagacgucgaugguaacgggaucaugcuggaggacacuagcguggaacuuauuaagcaguugaaucccacacugaaagaggccaagauccgccuaaaauuuaaggagauacagaaaaguaaggaaaagcucaccacgagaguaacugaggaagaguucugcgaagcauuuugugagcugugcaccaggccugagguuuauuuccuucuggugcagauuucuaaaaacaaggaauacuuggaugcgaaugaccucaugcuguuuuuagaggcagaacaaggagucacacauaucacugaggauauuugucuggacaucauccggcgauaugaacucuccgaggagggccgccagaaaggcuuccuugccauugauggguucacccaguaccuguugagcucggaaugcgacauauuugacccagagcagaagaaaguggcucaagauaugacacagccccuaucucacuauuacaucaacgccucccauaacaccuaccugauugaagaccaguucagaggaccugcagauaucaaugguuauauaagggcccucaagaugggcugucggucaguggagcuggacgucagugaugggagcgacaacgagccaauucuuugcaaucgcaacaauaugacgacucacguuuccuuuagaucugugaucgaaguaaucaacaaguucgcuuuuguggccagcgaguacccccugauuuugugccucggaaaucauuguucacugccgcaacagaaagucauggcacagcagaugaagaaaguguucggcaacaaguuauauacagaagcgccucugcccagugaguccuaccuaccaagcccugaaaaacucaagaggaugaucauuguuaaggguaaaaagcugcccucugauccagacgugcuugagggggaggucaccgaugaagacgaggaagcugagaugucacgucggaugaguguggauuauaauggcgaacaaaaacagauacgauugugcagagagcugagcgaccucguauccaucuguaagucuguucaguacagggauuuugagcugucgaugaaaagccagaacuauugggaaaugugcuccuucucagagacugaagccagucgcauugcaaaugaguaccccgaagacuuugugaacuacaauaagaaguuccuuucucggaucuauccuagcgccaugagaaucgacuccucaaaccugaauccacaagauuuuuggaacuguggaugccagauugucgcuaugaacuuccagacaccgggccccaugauggacuugcacaccgggugguuucuccagaauggagguuguggcuacgugcugaggccuagcauaaugcgcgaugaggucucuuauuucuccgccaacacgaaagggaucuuaccaggagugaguccccuggcacuacacauuaagaucauuagcggccaaaauuucccuaaaccaaagggugcuugcgccaaaggggacguuaucgaucccuacguguguauagagauccauggcauuccggcggacugcucugaacagcgaaccaagacaguacagcagaacuccgauaauccuaucuuugacgagacuuucgaauuucaagucaaccucccagagcuggccaugauucgguucgugguucuugaugacgauuauaucggagacgaguuuauaggccaguacaccauucccuucgaauguuugcagccuggguaucgucacgugccccugagaucauuugucggagauaucauggagcaugugacacucuucguacacauugcuaucacuaauaggagugguggcgggaaagcacaaaagcgcagccugucggugcggaugggaaagaaaguuagagaauacaccauguuaaggaacauaggccugaagacaaucgacgacauuuuuaaaaucgccguccacccacuucgagaggcuauugauaugcgcgaaaauaugcagaacgccaucguguccauaaaggaguugugcggucucccucccauugcaucucugaaacagugccuacugacccucagcucacggcugaucacgagugacaauacuccauccgugucucuugucaugaaggauagcuucccguacuuggagccucugggggcgauccccgacguucagaagaaaauguuaacagccuaugaucucaugauucaagaauccagauuucugaucgagauggcugacaccgugcaggaaaagauugugcagugucagaaagccggcauggaguuccaugaggaacuucacaaccugggagcaaaggagggcuugaaagggaggaagcucaauaaggcuacugaaucauuugccuggaacauaaccguacugaaaggacaaggcgaucuacugaagaaugcuaaaaacgaggccaucgaaaacaugaagcagauucagcucgcuugccugagcuguggucuuaguaaagcgccaucuuccagcgccgaggcaaagucgaagcguucauuggaagcuaucgaggagaaagaaucuagugaggaaaaugggaagcuguga

SEQ ID NO: 60810 - RNA, 3384 nt, Artificial Sequence
  derived and/or modified sequence opt3 from PLCL2__Homo_sapiens__NP_001137854
auggccgagugcggcagagggggagcugccgguggcgcacugcccaccagcccugggccagcgcucggagcuaagggcgcccuuaaagccggugugggggaaggaggcggcgggggagguaggcugggccacgggcgggcacgcuacgacuccggaggcgucucuaacggugauuguucauuggggguuaguggagacgaggcucgagcaagcccgacacguggccccagaggcguggccuuagcuccuacuccauccgccguagugugcacgcugcccagggaaucuaagccugggggacuaccacggcgcucgucaaucauuaaagaugguaccaagcagaaaagagagaggaagaagacagucagcuucaguuccaugcccacugagaaaaagauaucuagcgcguccgacuguaucaauucaaugguggaaggcagugagcucaaaaagguucggagcaacucucgcauuuaucaucgauacuuucugcuugaugcagacaugcaaucccugagaugggaaccuagcaaaaaggauagcgagaaggccaaaaucgacauuaagaguaucaaagaagugaggaccgggaagaauacagauauauuccggucuaacggaaucuccgaccagauuagcgaggauugcgcuuuuucggucaucuauggcgagaauuacgaaucuuuggaccucguggccaacuccgcagauguagcuaauauuuggguuaccggucugcguuaucugaucucauacgggaaacacacucucgacauguuagagaguagccaggacaacaugcgcacauccugggugucucagauguucagcgaaauagaugucgacaaucugggccauauuacccuuuguaacgccgugcaaugcaucagaaauuugaacccaggacugaagacgucaaaaauugagcuaaaguuuaaggaacuccacaaaaguaaggauaaagcgggcacugaggugaccaaggaggaguucaucgaagucuuucaugaacuguguacaaggccggagaucuauuuccuucugguucaguuuuccagcaauaaagaguucuuggacacuaaggaucucaugauguuucuggaagccgagcaggggguggcacacauuaacgaagagauaucuuuagaaaucauucacaaguacgagcccucaaaagaaggacaggagaaggguuggcugaguaucgacggcuucaccaauuaccucaugagcccugauugcuauauauuugacccagagcauaaaaagguaugucaagauaugaaacagccccuuucccacuacuucauuaacucuucgcauaacacauaucugaucgaagaccaguuccgggggccuagcgauaucaccggauacauucgagcuuugaagaugggcugccgcuccguggagcuagacgucugggacgguccagauaaugaacccgugaucuauacggggcacacuaugacaucacagauuguuuuuagaagugugauagacaucauuaacaaguacgccuucuuugcuucugaguauccgcugauccucugucuggagaaucacugcagcaucaaacaacagaaggucauggugcagcauaugaaaaagcugcuuggcgauaaauuguacaccacuuccccuaacguagaagagucauaccuccccagcccagacguucugaagggaaagauuuuaauaaaagccaagaaacugucuuccaauugcaguggcguggaaggggaugucacagacgaggaugaaggagcagagaugagccaaaggauggguaaggagaacauggaacagccuaauaacgugcccgucaaacgguuccagcuauguaaggagcucucugaacugguguccaucugcaaaucaguucaguuuaaggaguuccaagugaguuuucagguacagaaguauugggaagucuguagcuucaaugaggugcuugccucgaaauacgcuaacgagaauccaggcgacuuuguuaacuauaauaagcgcuucuuggcgagaguguuucccuccccuaugaggauugauucuagcaacaugaauccacaggacuucuggaaaugcgggugucaaaucgucgcaaugaacuuucagaccccgggacugaugauggaucucaacauuggcugguuccgucagaaugguaacugcggguacgugcugcggcccgccaucaugcgagaagagguaucauucuuuagugcuaauacgaaggacuccgugccuggcguuucuccacagcuucugcacauaaaaaucauuagcggacaaaacuuccccaagccuaagggcuccggggccaaaggagaugucguggacccauauguguacgucgaaauccauggcauucccgcagacugugccgagcagagaaccaagacaguucaccagaauggugaugcuccgaucuuugacgaaucauucgaguuucagauaaacuugccugagcucgccauggugagguucgugguacuggaugacgauuauauuggggacgaauuuaucggacaauacacuauuccauucgagugcuuacagaccggcuaccgccaugucccccugcagagccuaacaggugaagugcucgcacacgcgagucuguuuguucacguggcuaucacuaaucggagaggcgggggaaaaccucauaagaggggccuuucuguccgcaaagggaagaagucccgagaguaugccagcuugcggacccuguggauaaaaacaguggaugagguuuucaagaacgcacaacccccaauccgugacgccaccgaucucagagaaaauaugcagaacgcugugguaucguuuaaagagcuguguggauuaucaucugucgccaaucugaugcagugcaugcuugcagugaguccuagguucuugggccccgacaacacuccacucgugguccugaaucuauccgaacaguacccgacgauggagcugcaagguauuguuccugaagugcucaagaaaaucguaacaaccuaugauaugaugauucagagccugaaggcucuuaucgagaacgccgacgcgguguacgagaagauaguccacugucagaaagccgcuauggaauuucaugagcacuugcacucuauugggacuaaggaaggacugaaagagcgcaaguuacagaaagcaguggaaucauucaccuggaauaucacaauccucaagggccaagccgaucugcuuaaauaugcuaagaacgagacccuggagaacuugaagcagauucauuucgccgcaguuuccugcggucucaauaaacccggcacugaaaacgcggacgugcagaagccacggagaucacuggaggucauccccgaaaaagccaaugacgagacaggggaauga

SEQ ID NO: 60811 - RNA, 918 nt, Artificial Sequence
  derived and/or modified sequence opt3 from PLCXD2__Homo_sapiens__NP_001172035
augcuggccgugagaaaggcuaggcggaaacuccgcaugggcaccaucugcagccccaacccuuccgggacaaagacuucuucagaggucuguaaugcagacuggauggccagucuuccaccgcaucugcacaacuugcccuuaagcaaucuggcgauuccuggaucccacgauucuuucucguacuggguugacgaaaaaucaccagugggucccgaucagacgcaagcuauaaagcgacuagcccguaucagccucgugaaaaagcugaugaagaaauggagugugacccagaaccuuacauuuagagagcagcuggaagcaggcauuagguauuucgacuugcgggucuccucuaagccuggggaugccgaccaggagaucuacuuuauucauggacucuucggcaucaaagugugggauggucugauggaaauagacagcuuucugacucaacacccacaggagaucauuuuccucgauuuuaaucauuucuaugcuauggacgagacccaccacaagugcuuaguucugcgcauccaggaagcauuugggaacaaacuuugucccgccugcuccguggagucauugacacugagaacccuaugggaaaagaauugucagguccucauuuucuaccauugcccuuuuuauaagcaauacccauuccuguggccgggcaaaaagauccccgcuccuugggccaacacuacaagugugaggaaacuuauacuguuuuuggagaccacgcucagcgagcgggcgucucgcggauccuuccacguaucacaggcaauucugacuccacgaguuaagaccaucgccagaggcuuaguagggggacugaaaaauacacucguccauagcaacagguggaauagucacggucccucucuucugucccaggaacggagcuga

SEQ ID NO: 60812 - RNA, 966 nt, Artificial Sequence
  derived and/or modified sequence opt3 from PLCXD3__Homo_sapiens__NP_001005473
auggccagcucccagggcaagaacgagcugaaacucgcugacuggauggcaacccuucccgaaucuaugcacucaaucccucugacaaauuuggccauuccagggagucaugauagcuucuccuuuuacauagacgaggcgucuccggugggacccgaacaaccugagacuguccagaacuucguuucgguguuugguacgguagcuaagaaauuaaugagaaaguggcuggccacccagacaaugaauuucacuggccagcuaggggcaggaaucagguauuuugaucuccggauuucaaccaaaccacgcgaccccgauaacgaacuguacuucgcccacggccuuuuuagcgcuaaggugaaugagggucuggaggaaaucaacgcauucuugacagaccaucacaaggaggucguguuucucgauuucaaucauuuuuaugggaugcaaaaauaccaccacgaaaagcugguucagaugcugaaagacauuuauggaaacaagaugugcccugccaucuucgcucaggaggugagucucaaauacuuaugggagaaggauuaucagguccugguguuuuaccauuccccaguagcccuugaaguucccuucuuguggccuggccaaaugaugccagcgccgugggcaaauaccacugaccccgagaagcugauacaguuccuacaggccucuaucacagaacgacguaaaaagggcagcuuuuucauuucccaggugguccucaccccuaaggcuucaacgguggugaaaggggucgccaguggacugagagagacuaucaccgaaagggcacuuccagcuaugaugcaauggguucggacacagaaacccggugagagcggcauuaacaucgugacugccgauuuuguagagcugggggacuucauaucuaccgugauuaaguugaauuacgucuuugaugaaggagaggcgaacacauga

SEQ ID NO: 60813 - RNA, 1827 nt, Artificial Sequence
  derived and/or modified sequence opt3 from PLCZ1__Homo_sapiens__NP_149114
auggagaugagaugguuccugagcaagauccaggacgauuuuaggggcgggaaaauuaaccucgaaaagacccaacggcuucuggagaaauuggacauacgcugcuccuacauccacgugaagcagauuuucaaagauaaugaccgauuaaagcagggacguaucacaauugaagaguuuagagccaucuauaggauaaucacucaucgggaagagauuaucgagauuuucaacacguacucugaaaaucgcaagauccugcuagcuucaaaccucgcacaguuucugacccaagagcaguaugccgcggaaaugaguaaagcuauagccuucgagauuauccagaaguacgagcccauugaagaggucagaaaagcacaccagaugagccuugaagguuuuacaagguauauggauucccgggagugucuguuguucaagaaugaaugccgcaaaguuuaccaagacaugacucauccucucaacgauuauuuuaucucuucgucacacaauaccuaccuggugagcgaccagcugcucggcccaagugauuuauggggguacguauccgcccuggugaagggaugucgaugccuugagaucgacuguugggauggcgcucagaacgagccggucguguaucaugguuacacauugaccucuaagcugcuauucaaaacuguuauucaggcaauacacaaguaugccuuuaugacaagcgacuaccccgugguccucucccuggaaaaucacugcucaaccgcucaacaggaggugauggccgauaaccuucaggcgacguucggggaaagucuguugagcgacaugcucgacgauuuuccugacacucugccaucucccgaggcauuaaaauucaagauccugguaaagaauaagaaaauuggaacccucaaggaaacacaugagagaaagggcuccgauaaaaggggcgacaaccaagauaaggagacugggguuaaaaagcugccuggagugaugcuuuucaaaaagaagaaaacccggaaguugaaaaucgcccuagcucugucagaccucgucauauauacaaaggccgaaaaauuuaagagcuuccagcacagucgucuguaccagcaguuuaaugagaacaauucuauuggugaaacccaagcacgcaaacuuuccaaacugagagugcaugaguucaucuuucacacgaggaaguucaucacucggauuuauccaaaagcuacacgagccgauagcucgaacuuuaacccccaggaguucuggaauaucggcugucagaugguggcguugaacuuucagaccccugggcucccaauggaccugcaaaauggaaaguucuuagauaacggcgguucuggguacauucugaaaccgcacuuucuacgcgaauccaagucauacuucaaucccaguaacauaaaggagggaaugccuaucacucucacaauuagacugaucagcggcauccagcuuccauugacccauuccucuagcaauaaaggcgacucacuggucauuauagaaguuuuuggggugcccaacgaucagaugaagcagcaaacgaggguaaucaaaaagaaugccuucaguccucgguggaacgagaccuucacauuuauuauccacgugccagaacucgcacugauucgcuucgucguggagggacagggucuuaucgcuggcaaugaguuucuggggcaguauacuuugccccuccugugcaugaacaaaggauacagaaggauaccguuauucucccguaugggcgaaagccuggagccugccucucuauuuguuuaugugugguacguccgguga

SEQ ID NO: 60814 - RNA, 3111 nt, Artificial Sequence
  derived and/or modified sequence opt3 from PLD1__Homo_sapiens__NP_001123553
augagccugaagaacgagcccagagugaauaccuccgcccuccagaaaaucgcugcagacaugucuaacauuauagaaaaucuugauacaagggagcugcacuucgaaggcgaggaagucgacuacgauguuucaccuagugacccaaagauccaagagguguauauuccguuuagcgccaucuacaacacucagggguucaaagagcccaauauucagacguauuuguccggaugcccuaucaaggcgcagguauuagaaguggagcgguuuaccucuacaacucgcgucccaucgauaaaccuguacaccaucgaacuaacacauggugaguucaaauggcaagugaagcgaaaguuuaaacacuuccaggaguuucaucgugaacuccugaaguauaaggcuuucauuagaauccccauuccuaccaggcggcacacuuuucgcagacagaauguuagggaggaaccacgggagaugcccucacuuccucgcagcagugaaaacaugauccgagaggagcaguuccugggcagaaggaaacaauuggaagauuaccucacaaaaauacugaagaugccaauguaucggaauuaccaugccaccacggaguuucuggacauuucccagcucucuuucauccacgauuuagggccgaagggaauugaaggcaugaucaugaaacguagcggugggcaccgcauccccggacugaacuguugcggccagggcagagcauguuacaggugguccaagcgguggcuuauugugaaagacucauuuuugcuguauaugaagccugauaguggggccauagcuuucguccuacucguggacaaagaguucaagaucaaaguaggaaagaaggaaacugagaccaaauacgguauucgaaucgauaaucugagccgcacacuuauacugaagugcaacucuuauagacaugcaaggugguggggcggggccauugaggaauuuauccagaaacacggaacuaauuucuugaaggaccaucgguuuggcuccuacgcugccauccaagagaacgcgcucgcaaaaugguauguuaaugccaaggguuacuucgaagauguggcuaacgccauggaggaagcaaacgaggagauuuuuaucaccgacugguggcugucaccagaaauuuucuuaaagcgccccgucguggaggggaauagauggaggcuggacuguauacucaaacguaaggcucagcagggagugcggaucuuuauuaugcuuuauaaagaagucgagcuggccuugggcaucaacagcgaguacacaaagcgaacccuaaugagacugcacccuaauaucaaaguuaugaggcacccagaucaugugaguucuacgguauaccucugggcgcaccaugaaaagcuggugauuauagaccaauccgucgccuucgugggcgggaucgaucuugcauauggacgcugggacgauaacgagcaccggcugacugacguugguagcgugaagagagucacaucgggccccucuuuggggucccucccgccugcugccauggaaucaauggagagucugagguuaaaagauaagaaugaacccgugcagaaccugccaauucagaaaagcaucgacgauguagacuccaagcuaaaaggaauuggcaagccucgcaaguuuucuaaauucagccucuacaagcagcugcaucgacaccaccuucaugaugcugacucaaucaguuccauagacagcaccucuaauacugguucaauccggaguuugcaaacagggguuggcgagcugcacggagagacccguuuuuggcauggcaaagauuauugcaacuucguguuuaaggacuggguccagcucgauaaacccuucgccgacuucauugauagauacagcacgccaaggaugcccuggcacgacaucgcauccgccgugcacgggaaggcugcgcgcgaugucgcacggcauuuuauucagagauggaauuucaccaaaaucaugaagucuaaguauaggucgcugagcuacccuuuucuucugccaaaaucccagacaacugcccacgaauugcgauaucaagugccgggaucaguucaugcuaacgugcagcuccugcgcagugccgcagacuggucugccgguauaaaguaccacgaggaaagcauucaugcugccuacguacacgucaucgaaaauucccggcacuauauuuacaucgagaaccaguucuuuauaucaugugcagaugacaaagugguuuucaauaagaucggcgaugcgauugcucagagaaucuuaaaagcccauagggagaaccaaaaguaucguguguacgucgugauuccccugcuaccuggguuugagggagacaucagcaccggcggugggaaugcacuccaggccauaaugcacuucaacuaucgcacaaugugccggggcgaaaacucuauucugggacagcuuaaggcugaguugggcaaucaguggaucaacuacaucuccuuuugugggcugagaacucaugccgaacucgagggaaaucugguaaccgaauuaauuuaugugcacaguaaacugcuuaucgcagaugacaacacaguuauuauagguagcgcuaauaucaacgacaggucuauguugggcaagcgagauuccgagauggccgucauugugcaagacaccgagacugugccaucagucauggaugggaaagaauaccaggcgggacgguucgcccgcggccucagacugcagugcuuuaggguugugcuagguuaccuggacgaucccagugaggacauccaagauccugugagcgacaaguucuuuaaagaaguaugggucucgacggcugcacggaaugccacaauuuaugauaagguguuccgaugucucccaaacgacgagguucauaaucugauccagcuuagagauuucauaaacaagcccguguuggcuaaagaggacccgauccgcgccgaagaggaacugaagaaaauuaggggguuuuuaguccaguucccuuuuuacuuccucuccgaggaaucucugcuuccaagcgugggcaccaaggaggcaaucguucccauggagguguggacuuga

SEQ ID NO: 60815 - RNA, 2769 nt, Artificial Sequence
  derived and/or modified sequence opt3 from PLD2__Homo_sapiens__NP_001230037
augaccgccacacccgagagccuguucccuacuggcgacgaacucgauuccucucagcuucaaauggagucagacgaaguggauacgcugaaggagggggaagacccagcugauagaaugcacccguuuuuggcaaucuacgaguuacagagucugaaaguccauccccuaguuuucgccccuggagugccaguaaccgcucagguggucgguacagagagguauacuagcggcuccaagguggggaccugcacacucuacucuguucggcugacccacggagacuuuucguggacuaccaaaaagaaauaucgccauuuccaggaacuucaccgagaucuguugcgucauaaggugcucaugucacugcugccccucgcgagauuugccgucgcauacagcccugccagggacgcuggcaaccgggagaugccaaguuuaccccgcgcagguccugaaggguccacaagacacgccgcuucuaagcaaaaauaucuggagaauuaccuuaacagguugcugacgaugagcuucuaucggaauuaccacgccaugacugaguuucuagaagugucccagcucucauucauuccagaucugggacgcaagggccuugagggcaugauacgaaaaagaagugggggacauaggguaccgggucugaccuguugcggccgggaccagguuuguuaccguuggagcaagcgcugguugguggucaaagauucuuuucuccuguauaugugcuuagaaacaggggcgaucuccuucgugcagcuguuugaccccggauucgaggugcaagucggcaagagaucaacugaagcaaggcacgguguucggauugauaccagccaucgaagucucauccuuaaguguucuuccuaccgccaggccagauggugggcucaggagauuacagagcuggcccaggggccuggaagggacuuuuugcaacuacaccggcacgacagcuaugcaccaccccgcccuggcacccuggcuagaugguucgugaacggcgccggguacuucgcggccguagcagaugcuauccucagggcccaggaagagauauuuaucacggacugguggcugucgccagaaguguaucuuaaacgucccgcucauucugaugacuggcggcuggauauuauguugaagcgaaaagccgaggaaggagucagaguguccauccuccuguucaaggagguugaguuagcacuggguauuaauucaggcuacaguaaaagggcccuaaugcuccugcacccgaacaucaaggugaugcgccauccugaccaggucacucuuugggcucaccaugaaaaauugcuggugguagaucaaguuguggcguuucucgggggacuggaccuugcauauggccggugggaugaccugcacuacagauugacagaucucggugacagcuccgagucugccgcuagccagcccccaaccccuaggcccgacucaccagccacucccgaucugagucacaaucaguucuuuugguuagggaaggacuacuccaaccugauaacaaaggauuggguccagcuagaccgcccuuucgaagauuuuauugaccgagagaccacgccacggaugccguggcgugaugugggcgucgugguucauggacuccccgcaagagaccuggccaggcacuucauccaacgcuggaauuuuaccaaaacaacuaaggcuaaauauaagaccccuacauacccauaucuuuugcccaaaagcacuucuaccgccaaccagcugccuuucacacucccaggcgggcagugcaccacugugcagguacugcggucagucgauagauggagugcaggaacguuagaaaauagcauucugaacgcguaccuucauacaaucagggagucccaacacuuuuuguauaucgagaaucaguucuuuauuucuuguucggacggucgaaccgugcucaacaagguuggcgaugaaauaguggaccgcauccugaaggcucacaaacagggguggugcuaccgggucuaugugcuacugccccuccugccgggauucgagggcgauauuagcacuggugggggcaauuccauccaggccauacuucauuucaccuacagaacauuguguaggggagaauacucaauucugcaccguuuaaaggcagccaugggcaccgcuuggcgcgacuauaucaguaucugcgggcuccggacucauggagagcuggguggccacccuguaucugagcuuauuuacauccauagcaaagugcugauugccgacgauagaacaguuauaaucggguccgcaaacauuaacgacaggucauugcucggaaagcgagauagcgaacuggcuguccuaaucgaggacacggaaaccgagccaucucugaugaauggcgccgaauaucaagcggguuccgugauccucggggccaacacucggcccgaucuggaccuucgcgauccuauuugugacgacuuuuuccaguuguggcaggauauggcugagaguaaugcaaacauauacgagcagaucuuuagaugccugcccagcaaugccacaaggucuuuacggacccuccgagaauauguggcugucgagccacuggccacaguuuccccuccccuugcaagaucagaacugacucaagugcagggccaccuagugcacuucccacucaaauuucuggaggaugaaaguuugcugccgccuuuaggaagcaaggagggcaugauuccccucgagguauggaccuga

SEQ ID NO: 60816 - RNA, 1473 nt, Artificial Sequence
  derived and/or modified sequence opt3 from PLD3__Homo_sapiens__NP_001026866
augaagcccaaacugauguaccaggagcucaaggugccugccgaggaaccagcuaacgaacuuccgaugaaugagaucgaagcauggaaagccgcggagaagaaagcuagauggguccuguugguuuuaauucuggccgugguaggcuucggggcacuaaugacccaacucuuucugugggaguauggagaccuucaccuguucggucccaaccagaggccugccccaugcuacgaucccugugaagcuguguuggucgagagcauaccugaaggccucgacuuuccaaaugcauccacagggaaccccucuacuucacaggccuggcugggacugcucgcuggcgcccauaguagcuuagauaucgcguccuucuauuggacgcugaccaauaacgacacacacacucaggagccuucugcacaacagggugaggaagugcuucggcaguugcagacccuggccccaaaggggguuaaugugcgcauugcugucucgaagccgucaggaccccaaccucaggccgaucuacaggcacuccugcagagcggcgcucaagugcgaaugguagacaugcagaaacuuacacauggcguucugcacaccaaguuuuggguggucgaucagacucauuucuacuuggggagugccaacauggacuggcguucccucacacaagugaaagagcugggaguggucauguauaauugcucuuguuuagcgagagaucugaccaagaucuuugaagccuacugguuccucggucaggcaggcagcuccauuccaucaacguggcccagguuuuaugacacucgguacaaccaggagaccccuauggaaaucugccuuaaugggacaccagcucuggccuacuuggcuagugcacccccgccucuaugucccagcggacgcacuccagaucugaaagcccuccugaacguuguggacaaugccagaucuuucauauauguagcugugaugaacuaccuuccuacccuggaguuuucccacccccacagguucuggccagcgaucgaugacggcuugcggcgcgcaacauaugagcgaggugucaaggugagacuccugauuucaugcugggggcauagcgaacccaguaugagggccuuuuuacugucucuagcugcccuccgggacaaucacacccauuccgauauccagguuaagcuguucguggucccugcagacgaggcccaagcucguauuccauacgcccgcgugaaccacaacaaauauaugguaacggaaagagcaacuuacaucggaacaagcaauuggucgggcaacuauuucaccgagacugcgggcacaucucuuuugguuacccagaaugggaggggaggucugcggucccagcucgaagcuauauuucugcgagauugggacucaccguacagucacgaucuugacacgagcgccgauuccgugggcaacgcaugucgccuguuguga

SEQ ID NO: 60817 - RNA, 1521 nt, Artificial Sequence
  derived and/or modified sequence opt3 from PLD4__Homo_sapiens__NP_620145
augcugaagccccucuggaaagccgcuguggcaccuaccuggccaugcagcaugccgcccagaaggccuugggaccgggaggccggcacacuucagguccugggggcguuggcuguuuuauggcugggauccguggcccuaaucugucuccuguggcaaguaccacggcccccuacuuggggucaggugcagccaaaggaugucccccgaucuugggaacacggcucaaguccugcaugggagccacuugaagccgaggcucgucagcaaagagacagcugccagcugguguugguugaauccauuccgcaggaucuccccucugcagccgggucgccuucagcucagccacugggacaagccuggcugcagcucuuagacacggcgcaggagagcgugcaugucgcaaguuacuauuggucccugaccggccccgauauaggugugaacgacucuagcucccagcuuggggaggccuugcugcaaaaacuacagcagcuccugggaaggaauaucucacuugcuguagccacaaguagcccuacucuggcacggaccucuacagauuugcaaguucucgcugcccgcggcgcgcacgugagacaggucccaaugggcaggcugacccgcgggguguuacauuccaaguucuggguggucgacggacgccacauuuacauggguucagccaacauggauuggcgaagccugacucagguuaaagaacucggcgcagugaucuauaauuguagucaucuugcucaggaccuggagaagacauuucaaaccuacuggguauugggggugcccaaggccguccuaccgaaaacguggccucagaacuucucuucccacuuuaauagauuccagcccuuucacggacuguucgauggcgugccaacuaccgcuuauuuuagcgccucgccucccgcacucugcccacaggguaggacacgggaccuggaagcccuucuggcuguuauggggucugcgcaagaguucauuuacgcauccgugauggaguauuuucccacuacccguuucucacauccuccacgcuacuggccggucuuggauaacgcccucagagcugccgcauuuggaaagggcgugaggguacggcuguuaguuggcugugggcugaauacagaccccaccauguucccuuaccuacgaagucuccaggcccugagcaacccagcugccaauguguccgucgacgugaaagucuuuaucgugcccguuggaaaccacucuaauauaccuuucagccgcgugaaccauucaaaguucaugguaacggaaaaagcagcguauaucgguacaaguaauugguccgaggauuacuuuagcucuacugcuggcgucgggcuugugguuacccagucaccaggagcccagcccgcaggcgccacugugcaagaacaguugagacagcuguucgagagggacuggaguagccgguaugcugucggucucgaugggcaggccccgggccaagacugcguguggcagggauga

SEQ ID NO: 60818 - RNA, 1425 nt, Artificial Sequence
  derived and/or modified sequence opt3 from PLD5__Homo_sapiens__NP_001182740
augagccagcaaaagugcaucgugauuuucgcccuggucuguugcuuugcuauacucguugcacuuaucuucuccgccguggacauuaugggcgaggaugaagacgggcugucugagaaaaacugucagaauaagugcagaaucgcguugguagaaaacauucccgagggauuaaauuacucagaaaacgcuccuuuucaccugagucuauuccaggguuggaugaaucuccugaacauggccaaaaagagcguggauaucgucuccucucauugggaccuuaaucacacccauccaucggcaugucagggccaaaggcuguuugagaaauugcuccagcugacaucacagaacauagagaucaagcuggugagcgauguuacugccgacaguaaggugcucgaggcuuuaaaacugaagggggcagaagucacguauaugaauaugaccgccuacaacaaaggacggcuucaguccucuuucuggauuguggauaagcaacacguauauaucggcagcgcugguuuggacuggcagucccuggggcagaugaaagaacuaggaguuaucuuuuacaauugcucaugucucgugcuggaucuucagcgcauuuucgcccuguauaguagcuugaaguuuaagucucgagucccgcaaacaugguccaaacgucucuacggcguguaugacaacgagaagaaacugcaguuacagcugaaugagacuaagucacaagcguucgugagcaacagucccaaacucuuuugcccuaagaauagaucuuucgauauagacgcaauuuacuccgucaucgaugacgccaaacaguacguuuauauugcugugauggacuaccuuccaaucagcucgaccucuacaaagaggaccuauuggcccgaucuggacgccaagauccgggaagcauugguacuacgcuccgugagagucaggcugcuccugucauuuuggaaagagacugauccucuuacauucaacuucauuaguagccugaaggcuauauguaccgaaaucgccaacugcuccuugaaagugaaguuuuucgaccucgagcgggaaaaugcgugugccacgaaagagcagaagaaccauacuuuuccacgccugaaucgaaacaaguacaugguuaccgauggcgcagcuuauauugggaauuucgacugggugggaaacgauuuuacacagaaugccgguacuggcuuagucaucaaccaagcugacgugagaaauaacaggucuauaauuaaacagcugaaggauguauucgagcgggacugguacagccccuaugccaaaacccuacagccuacaaagcagccaaauugcucaagucucuuuaaacugaagccgcuuuccaacaagaccgcaacggaugacacugggggaaaagacccccguaauguuuga

SEQ ID NO: 60819 - RNA, 13725 nt, Artificial Sequence
  derived and/or modified sequence opt3 from PLEC__Homo_sapiens__NP_000436
augagcggcgaggacgccgaagugcgggcugucuccgaggauguuucuaacgggucaagcggaagccccuccccuggugacacccugccauggaaucucggcaagacgcagaggucucggcgcagcggggguggcgcugguucaaacgggagcgugcuugauccggccgaacgagcgguaauccguauugcugacgagagagauagggugcagaagaagacuuucacgaaaugggucaauaagcaccugauaaaagcccagcggcauaucagugacuuguacgaagauuuacgcgacggacacaaccugauuucccugcucgaggugcugucuggcgauagccuucccagagagaagggcaggaugcgguuucauaagcugcagaauguucagaucgcauuggacuaucuccgccaccgacaagugaaacuggucaacauuagaaaugaugacaucgccgaugggaacccuaagcugacccucggauuaauauggacaaucauucugcauuuccagaucuccgacauucaggugucaggucagagugaagacaugacugcuaaagagaaacuuuugcuguggagccaaaggaugguagaaggcuaccaggggcuacggugcgauaauuuuaccucuuccuggcgugacggacgccucuucaacgcaaucauacacagacacaaaccacugcuuauugauaugaauaagguuuauaggcagacaaaccuggagaauuuggaccaggccuuuucaguggcugagcgggaucucggcgucacccgacuguuagaccccgaagauguggacgugccucaaccagaugaaaagucgaucauuacuuacgucaguucucuguaugacgccaugccccgcguuccugaugugcaggacgguguaagagcgaacgaacuccagcuuagguggcaagaguaccgggaacugguguugcuacugcuccaguggaugcgccaucacacagcagccuucgaggagagaagguuuccauccagcuucgaagagaucgaaauccuguggucgcaguuucuuaaauucaaggagauggaacugccggcuaaagaggccgacaagaaucguucuaaagggauuuaucaguccuuggagggagcaguccaagcuggccagcucaaggugcccccuggcuaccauccacuggauguugaaaaagagugggggaaguuacacguggccauacuggaacgggagaagcagcuacgaucagaauuugagagacucgagugucugcagaggaucgucaccaaacuucaaauggaagcgggauugugcgaggaacagcugaaccaggccgacgcacuccugcagagugaugugcgccuucuggcugccgguaagguaccccaacgggcuggcgagguugagagagacuuggauaaagccgacagcaugauuaggcuccuguucaacgaugugcagacguuaaaggacgggcgccacccucagggagaacagauguaccgacgggucuaucgucugcaugagaggcugguggcaaucaggacugaauacaaucuccgccugaaagccggcgucgcugcgccagcaacccaaguggcccagguuacacuucaguccgugcaacggagacccgaguuggaagauucuacucugagguaucuccaggaccuguuagcuuggguagaggagaaccagcaccgagucgauggugccgaauggggcguggaccugccgagcguugaggcacagcuugggucacaucgcggauugcaccaaaguauagaagaguuucgggccaagauugaaagagcuagguccgaugagggccagcucagcccugccacccguggggcauaccgcgacugucugggacggcuagaccugcaguaugcgaagcuccuaaauucuucaaaagcuagacuuaggaguuuggagagccugcauuccuucguggccgcagccacaaaggaauuaauguggcucaacgagaaagaagaggaagaggucgguuucgauuggucugaccgaaauaccaacaugacggcuaagaaagagucguacagcgcccugaugcgggaacuugagcugaaggaaaagaaaaucaaggaguugcagaaugcaggcgaucgccuccugagagaggaccaccccgcuaggccaacuguggaauccuuucaagccgcgcuacagacacaguggucauggaugcugcagcucugcuguugcaucgaggcccaccugaaagaaaacgcugcauauuuccaauuuuucagugauguacgggaggccgaagggcagcuucagaaguugcaagaggcucugcgaagaaaauacucuugugaccgcagcgccaccgugacuagguuagaggaucuccugcaggacgcacaggaugaaaaggagcagcuuaaugaauacaagggacaucuguccggccuagcgaaacgugccaaggcuguuguccaacucaaaccucggcaccccgcccauccaaugagagguaggcugcccuugcuggcagugugcgacuauaaacagguggaggucacaguucacaagggggaugaaugucaguuagugggcccugcucagccaucacacuggaaggugcucaguucuuccggaagugaggccgcaguaccgagcgucugcuuucuggugcccccuccaaaccaagaggcccaggaagcuguuacccgccuugaggcgcagcaucaggcccuggugacguuguggcaccaacuccaugucgacaugaaaucucugcuagcauggcagucccugcgaagagaugugcagcuuauucggucauggagucucgcuaccuucaggacacugaagcccgaagaacaacgccaagccuugcacagccuggaauuacauuaccaggccuuucuccgugacucgcaggacgcuggcggguucggaccugaggauagacugauggcagagcgggaauaugguuccuguucucaccacuaccaacagcuucugcagagcuuggagcagggcgcccaagaagagucaaggugccagcgcugcaucagugagcucaaggacauucgacugcagcuagaagcgugugagacuagaaccguucaucggcugaggcuuccacucgauaaagaacccgcucgcgagugcgcccagagaauagcagaacaacagaaggcccaggcugagguggaggggcugggaaaaggcguagcaagguuguccgccgaagcggagaaggucuuagcucugccggaaccuucuccagccgcacccacacuccggagcgagcuggaacuuacucuggguaaauuggaacaggugcguucccuaucagccaucuaucuggagaagcucaagaccauuagccuggugauccgcgggacacaaggcgcugaagagguccuucgagcccacgaggaacaguuaaaagaagcacaggcuguuccugccacccugcccgagcucgaggcgacuaaggccaguuugaaaaagcugagagcacaagcugaagcccagcagccaacguuugacgcucucagggaugagcugcggggagcacaggaagugggcgagcgccuucaacagagacauggggagagggacguagaaguggagcgguggcgagaaagagucgcccagcuguuggagcgcuggcaggccgugcuagcucaaacagauguuaggcagcgggaacuggagcagcucggacgucaguuaagauacuauagggagucugcggacccucugggcgcauggcuucaagaugcccgccggcgacaggaacagauccaggcuaugccccuggccgacucccaagcagugagagagcagcucaggcaggaacaagccuugcuggaggaaauugagcgccacggugagaaagucgaagagugucagcgguucgcuaagcaguacauaaaugcgaucaaggauuacgaacuccagcuggugaccuauaaagcccaacuugagccaguugcaagcccggcuaagaaaccuaaggugcagucggggucagaaucugucauucaggaguacguagaccuaagaacucauuauagugagcugaccacauugaccucccaguacaucaaauuuauuagcgaaacuuuacguaggauggaggaagaggagcggcuggccgaacaacagcgcgcagaggaacgagagagacucgccgaaguggaggcugcccuggagaagcagaggcagcuugcggaagcacacgcccaagcuaaggcccaggcugagcgggaagcaaaagagcugcagcaacgcaugcaggaagagguugugagaagggaggaagccgcugucgacgcccagcagcaaaagcgaucuauccaggaggaacuccagcaguugcggcaaagcuccgaggcagaaauacaggcgaaagcccgucaggcugaggccgcagagagaucacgccugaggaucgaagaggaaauucgggugguaagacuacagcuggaggcuacagagcgccaaaggggaggcgccgaaggugagcuccaggcacuucgagcccgggcugaagaggcggaagcccagaagagacaagcacaggaggaggcugaaaggcugcgccgucaggugcaggaugagagucaacggaaaagacaggccgaagucgaguuagccagcaggguuaaggcagaagcugaggccgcgcgcgagaaacagcgagcuuugcaggcccuggaggaacuccggcugcaagcagaagaggccgaaagaaggcuucgccaggcugagguggagagagcaagacaggugcaggucgcccuggaaacggcgcaaaggucugcugaggccgaacuccaguccaagcgugcaucauucgccgagaagaccgcucaguuggagcgaagucugcaggaggaacacguggccguugcacaauuacgcgaagaggcugaaagacgggcccagcagcaagcggaggccgagagggcacgcgaagaggcugaaagagagcuagaacgguggcagcugaaagccaacgaggcacucaggcuucgacugcaggcugaggaaguagcccagcaaaagagcuuggcccaggcggaggcugaaaaacagaaggaggaagcagagcgugaggccagacgccggggcaaagcugaggaacaggccgugaggcaaagagaacuggcagagcaggagcucgaaaagcagcgccagcuggccgaggggacugcucaacagcggcuugcggccgaacaggagcucaucaggcugcgagcagaaacagagcaaggagagcagcagagacaguugcuggaagaggaauuagcucggcuacaaagggaggccgcagccgcuacccagaagcgccaggaacuggaggccgagcucgcgaaaguccgugcagaaauggaggugcuucuggccuccaaggcuagagccgaagaggaaucucgaucgacaagcgagaaaucaaagcagagguuggaggcagaagcuggccgguuucgcgagcuggccgaagaggcugccagacucagggcacuggcggaggaagccaaacggcaacgccagcuugcugaggaagacgccgcaagacagcgagcugaggccgaaaggguuuuagcagagaagcuggccgcgauuggggaggcuacucggcucaagaccgaagccgagaucgcauugaaagaaaaggaggccgaaaaugagcgucugcgcagacuagcugaggaugaagccuuccagaggcggagacuggaggaacaagcagcucagcauaaagccgacauagaggaacgccucgcgcagcuucgaaaggcuuccgauagugagcuggagaggcagaaaggauugguggaagacacgcugcggcaaagacgucaggucgaggaagagauucucgcccugaaggcaucuuucgagaaggccgcugcaggcaaagccgaauuagagcuugaacugggucgcaucaggagcaacgcggaggauacccuccgguccaaggaacaggccgagcuagaggcugcaagacaacgacagcuggccgcugaagaggaaaggcgccggagagaggccgaagagagggugcagaaaucauuggcagcugaggaagaggccgcgcgccagcguaaggccgcacuggaagagguagaacggcucaaagcuaaggucgaggaggccagacgacuuagggaacgcgcagagcaagaaucugcccggcagcugcaguuggcucaggaggccgcgcaaaagagacugcaggcugaggaaaaagcacacgccuuugcugugcagcagaaggagcaagaacuccagcagacauuacaacaggagcagagcguucuggaccagcuuagaggggaagccgaggcagcccgcagagcugcggaggaagccgaggaagcacgggugcaagccgagcgagaagcugcacagaguaggcgucaggucgaggaggccgaaagacugaaacaguccgcugaggaacaagcccaggcgcgggcacaggcccaggcugccgcagagaagcuacgcaaagaagcugagcaagaggccgcgaggcgagcccaggcugaacaggcagcccucagacaaaagcaggcugcagaugccgagauggaaaaacauaagaaguucgcugagcagacucugcggcagaaagcccaaguggagcaggaauugaccacacugcgccuccagcuugaggaaacugaccaccagaagaaucuguuagaugaggaacugcaaagguugaaagcagaggccaccgaggcggcuagacagcggagccagguugaagaggaacucuuuucugugcguguccagauggaggaacugucaaagcuaaaagcccgcauugaggcagagaacagggcccuuauccugcgagacaaggauaacacgcaaagauuccuccaggaagaggcugaaaagaugaaacagguggccgaggaagcagcucggcuguccguagccgcgcaggaggcagccagguugcgccaacuggcugaggaagaccucgcccagcagagagcucuugcagagaagaugcugaaagaaaagaugcaagccgugcaggaggcgacacgguuaaaagccgaggcugaacuguugcagcagcaaaaggagcucgcacaggaacaggccaggcgccugcaggaggacaaggaacaaauggcucagcagcuagccgaggagacccagggauuucaacgaacucuugaagcagagagacagcgucagcuggaaaugagugccgaggcugaacggcucaaacugaggguugcggagaugagccgcgcccaagcaagagcugaggaagaugcccagcgguucaggaagcaggcagaggaaauaggcgagaaauugcaccgaacagaauuagccacccaggagaaggucacucuggugcaaacccucgagauccagagacagcagucggaccaugaugcugaacgccuucgggaggcgauugccgaacuggagagggagaaagaaaagcuacaacaggaggcaaagcugcuccaguugaaaucugaagagaugcagacagugcaacaggaacagcugcuucaggagacgcaagcucugcagcaguccuuucucagcgagaaggacucauuacugcaacgugaaagauucaucgagcaggaaaaagccaaguuggagcagcuguuucaggaugaagucgccaaagcucaacagcuccgcgaggagcagcagaggcaacagcagcagauggaacaagagcggcagcgacuuguagcaaguauggaagaggccagacgcaggcagcacgaagcugaggagggugugcggagaaagcaagaggaacugcagcagcuagaacagcaacgucgccagcaggaggagcugcucgcggaagagaaucagagguugcgggaacaacugcagcuucuggaggaacagcaucgagccgcauuagcccacucugaggagguuaccgcuucccagguggcagccacuaaaacacuccccaacggcagagacgcucuggaugggccagccgcagaagcggagcccgaacauagcuucgacggauugaggcgcaaggucucagcccaacggcugcaggaggcuggcauucucagugccgaggaacuucagagacuggcacaggggcacaccacaguggaugagcuagcucgaagggaagacguucggcacuaucugcaaggacgcagcuccaucgccggccucuugcugaaggcgacuaaugagaaauuaucuguguacgccgcacuucagagacagcugcucagcccugguaccgcacugauauugcuggaagcccaagcugcauccggguuucuccuugauccaguccguaacaggcggcugacggugaaugaggccguaaaggaaggagugguuggccccgagcuacaucacaaacuguuaucagccgagagagcugucacagguuauaaggacccuuacaccggccagcagauuucucucuuccaggcaaugcaaaaagggcugaucgugcgcgaacauggaaucagguugcuugaggcccagauugcgacuggcggggugaucgauccgguccacagucaccgaguuccaguggacguagcuuaccggagaggauauuuugacgaagagaugaaccgcgugcuggccgaucccucggacgauaccaagggcuucuucgacccuaauacacaugagaaccucacuuaccugcaguugcuggaaaggugcgucgaggauccagaaaccggucuaugucuccuuccccugacagacaaggcagccaaagggggagaguuaguguauacggauagcgaagcucgugacguuuuugagaaggccaccguguccgcaccuuucggcaaauuucagggcaagacugucacaauuugggagauaaucaauucugaauacuucaccgcugagcaaagacgggaucugcuccgccaguuuaggacugggcgaauuacaguagagaagauaauuaagaucauaaucaccgugguugaggaacaggagcagaagggaagacugugcuucgaggguuugcggucacuugugccggccgcggaacugcucgagagccgcgucauugacagggaacuguaucaacagcuacagagaggcgagcgguccgugcgugaugucgcagaaguggacacgguucgaagggccuugcgcggggcuaacgugaucgccggaguauggcuggaggaggcuggccaaaaacucaguauuuacaaugcacuuaagaaagaccuguuacccucugauauggccguggcgcugcucgaagcccaggcugguacugggcacaucauagacccagcaaccagcgccagacugacagucgaugaggcuguucgggccggauuggugggcccugaauuucaugagaaacuucugucagcagagaaagccgucaccggcuauagggaccccuacacugggcaguccgugagucucuuccaggcucugaagaagggacuaauuccacgcgaacaagguuuaagacuguuggaugcgcagcucagcacaggcgggaucguagacccuucuaaaucccaccgggugccccuggauguugccugugcacgaggaugccuugacgaggaaaccucaagggcucugagcgccccaagagcagaugccaaggcuuacucggacccgucuacaggcgagccugcgacuuauggugaacuccagcagcgcugucgucccgaucaacugaccggguugagucuucugccacuauccgagaaagccgcacgggcuaggcaggaggaacucuacagcgagcugcaggccagagaaacguuugagaagacacccguggaagucccugugggaggcuucaaaggccgcaccgucacugugugggaguuaaucucauccgaguauuuuaccgccgaacagcggcaagagcuguugcgacaguucaggacagggaagguuacuguagaaaaagugauuaagauacucaucaccauugucgaggaaguggagacgcugagacaggagcgccuuucuuucagcggacugcgggcuccaguucccgcaagugaacucuuggccuccggugugcugagcagggcgcaauuugagcagcuuaaggacggcaaaacaaccgucaaggaucugucugaauuagggucagugcguacucuacuccagggaaguggcugccuggcugguaucuaccuggaggacacaaaagagaagguauccauuuaugaagccaugagacgaggguugcuccgcgcaaccacugccgcucugcuucuggaggcacaggccgcuacaggauucuuaguggacccuguucggaaccaaaggcucuacguccaugaagccgugaaagcgggcguggucggcccggagcugcacgaacaguugcuuagcgcagagaaggccguuaccggguauagagauccauacucuggaucgacgaucucacuguuucaggcuaugcagaagggucuagugcuccggcaacacggcauacgccugcuggaggcccagaucgcaacugggggaauuaucgaccccguacauagccacagggugccugucgauguggcuuaccagagaggcuauuucuccgaagagaugaaucgaguuuuggccgaccccagugaugacaccaaaggauuuuucgauccaaacacacaugaaaaucucaccuaccgucagcugcuugagcgguguguggaagacccugagacagggcugagguuacucccccugaagggagcggagaaagccgaagucguggagacuacccaaguauauacggaagaggagacacgcagagcauuugaagagacucagauugauaucccaggcggcgggucucacggagguagcaccaugucccuaugggaaguuaugcagucagacuugauaccugaggaacagagggcucaacugauggccgauuuccaggcuggccgggugacaaaggagagaaugauuaucaucauuaucgagauaauugagaagaccgagaucauucgccagcaagggcuugcaaguuacgacuauguccgaaggcggcucacugccgaagaccuguuugaggccagaaucauaucucuggaaaccuacaacuugcuucgcgagggaacacguagccucagggaggcucuggaagcagaguccgccuggugcuauuuauacggcacggguucaguggcggggguguaccugccgggcagccggcagacucuaucuauuuaucaggcucucaagaagggacuguuguccgccgaagucgcaagacugcuucucgaggcccaggcugccaccggcuuccuguuagaucccguuaaaggggaacgacugacaguggacgaggcaguacgcaagggauugguggguccagagcuccacgauaggcugcuuagugcugaacgggccgucaccggcuacagagacccuuauacugagcaaacaaucagccuguuucaggcgaugaaaaaggaacuaauccccaccgaggaggcacuccgccuguuggaugcccagcuggcuacaggggguauuguggacccaaggcuuggcuuccaucucccucuggaaguugccuaccagcgugguuauuuaaacaaagauacucacgaccaacugucggagcccuccgaagugagaucuuacgucgauccgucaacagacgagcgguugagcuauacccagcuccugcgacgcugcaggagagaugacgggaccggccagcuucugcuaccacucagugaugcacggaagcugacuuuuaggggauugcgcaagcagaucacaauggaggaacuggugagaucccaaguaauggacgaggcuaccgcccuucaguuacgggaaggccugacaucuauugaggaaguuacuaaaaaucuccagaaguuccuggaggggacgagcuguauagcgggaguguucgucgacgccaccaaagaacgacuaucaguguaccaagcuaugaagaaagguaucauucguccuggcacagcauuugaguugcuggaggcccaggcugccacuggguacguuaucgaucccaucaagggacucaaacuuaccguggaagaggcagucaggaugggcauuguggguccagaguucaaagacaagcugcucuccgccgagcgcgcuguaacaggguauaaagaucccuacaguggcaagcugaucagcuuauuucaggcgaugaaaaagggauugauccugaaagaccauggcauuagacuucuggaagcccagaucgcaaccgggggaauuaucgauccugaggagucucaccggcucccgguggaagucgcuuauaagaggggccuguucgacgaggaaaugaacgagauacuaacugaucccucagacgauacgaagggauuuuucgacccaaauaccgaggaaaaccuuacauaccugcaacucauggagagaugcaucacugauccucagaccggguugugucuguuaccccugaaagaaaagaaacgagagcgcaagacauccagcaaaucuaguguucggaagaggagaguggucauuguggacccugaaaccggaaaggagaugucgguauaugaggccuaccgcaaaggccucaucgaucaucagacuuaucuugaacuguccgagcaggaaugcgagugggaagagauuacaaucagcucaucugacggugugguuaagagcaugauaauugaccggcguuccggcaggcaauacgauaucgacgaugcaauugccaaaaauuugaucgacagaagugcucuggaucaguaccgagcggggacgcucucaauaaccgaguuugccgacaugcuaucuggaaacgcaggcggguuccggagccgcuccaguagcgugggauccucuucaagcuauccaaucucgcccgcugucuccaggacucagcuggccaguuggucugauccuacagaagagaccggcccaguggccgguauucuugacaccgaaacacuggagaagguuagcaucacugaagcaaugcacagaaaucucgucgauaacauuacggggcagcgguugcuggaggcucaagccuguaccggaggcaucauagaccccucaacaggugagcgcuuuccggugacugaugcggugaauaaaggcuuaguagacaagauuauggucgacaggaucaaccuggcucagaaggccuucugcggguuugaagauccucgaaccaaaacaaagauguccgcagcccaggcucucaaaaagggauggcuuuacuaugaggcaggccagagauuccuggaagugcaauacuugaccgggggacugaucgagccagacacucccggccguguuccucucgaugaggcccuacagcgggguacgguggacgcucgcacagcccagaaacugagggaugucggggcguauucuaaguacuuaaccuguccaaagacuaaacugaagauuaguuauaaagacgcacucgauagaagcaugguggaagagggaaccggccuucgguugcuggaagccgcugcccaauccacaaagggcuacuacucacccuauagcguuucugggaguggauccacugcagguagccgaaccggcucaaggacagggucucgcgcuggauccagacggggcucguuugacgccacggguagcggguucaguaugaccuucucuuccagcucauacaguuccagcggauauggccguagguacgcgucuggcucaagcgccucccuagggggaccggagucugcaguggcuuga

SEQ ID NO: 60820 - RNA, 1062 nt, Artificial Sequence
  derived and/or modified sequence opt3 from PLEK2__Homo_sapiens__NP_057529
auggaggacggcgugcugaaggaaggguuccucgucaaaagaggacacaucguucauaacuggaaggccaggugguuuauucuucggcagaauacccugguguacuauaaauuggaggguggccgccgaguaacacccccuaaggggcguauauuacuggauggaugcacuaucacguguccaugccuagaauacgagaacagaccgcuccugauuaaacuuaagacccaaacaagcacugaauauuuccuggaggcuuguuccagggaggaacgggacgcaugggccuuugagaucaccggcgcgauucacgcuggucagcccgggaaggugcagcaguugcauucucuccgcaauucauucaaacugccuccacacaucagucugcauagaauagucgauaagaugcacgacagcaacacaggaaucagguccucucccaauauggaacaaggcucgaccuacaaaaagacuuuucucggcagcucauuaguggauuggcugauuaguaacuccuucacagccucucggcuugaggcaguuaccuuggccagcaugcugauggaggaaaauuuucuacgcccuguggggguccgauccaugggagcuaucagaucaggugaccucgcagagcaguuccuggaugacaguacggcccuuuauacuuuugcugaaagcuacaaaaagaagauuucuccaaaagaggaaaucucccugucaaccguggaguugagcggcacaguaguuaagcagggguaucucgccaaacagggacacaagaggaaaaacuggaaggugcggcguuucguccugcgcaaagaucccgcguuuuuacauuacuacgacccuaguaaggaggaaaauagaccagugggcgguuucucucugagggggucccucgugagcgcacuugaggauaacggagucccgacuggcguuaagggcaaugugcaagggaaccuguuuaaaguaauaaccaaggacgauacacacuauuacauucaggccucgucuaaagcugaacgggccgaguggaucgaagcaauuaagaaauugaccuga

SEQ ID NO: 60821 - RNA, 1215 nt, Artificial Sequence
  derived and/or modified sequence opt3 from PLEKHA1__Homo_sapiens__NP_001001974
augcccuacguggacagacagaacaggaucugcggcuuccuggauauugaggaaaaugagaacagcgggaaguuucuccggcgcuauuucauacuugacacccgagaagauuccuuugucugguacauggacaauccucaaaaccugccaucuggaucaagucguguuggugccaucaaauugacauauauuagcaagguguccgaugcuacuaaauuaagaccgaaggcagaguucuguuuuguaaugaaugccggcaugaggaaauacuuccugcaggcgaacgaccagcaggaucuaguggaaugggucaaugugcucaacaaggcuaucaagauuacgguucccaaacaaucugacucgcagccuaauucagauaaccugagccggcacggggagugcggaaagaaacaggugaguuaucgcaccgacaucgucggcggugugccaauaaucacacccacucagaaggaggaaguaaaugaguguggggaauccauugauagaaacaaucuuaaaaggucucaaagccaucugccuuacuuuaccccaaagcccccucaggacuccgccguuaucaaggcaggauauugcgugaaacagggcgccgucaugaagaacuggaaacggcgcuacuuccaguuggaugagaauacaauuggcuacuuuaagucagagcucgaaaaagagccacugcgagugaucccgcugaaggaagugcacaaaguccaagaguguaagcagagugacauaaugaugagagacaaccucuucgaaauuguuaccacuagcaggacauuuuaugugcaggcugauucucccgaggagaugcauuccuggaucaaggcaguaucaggggccauuguggcucaacggggaccuggucguagcgccaguucugaacacccacccggcccuuccgagagcaaacaugcguuccgcccaaccaacgcagccacggcuacuucgcacucuaccgccuccagaucaaauaguuuagucagcacauuuacuauggaaaagaggggguucuacgagucccuggcaaaagugaagcccggaaacuucaaaguucagaccgugucuccgcgggaaccugcuagcaaggucacagagcaggcccuuuugcgaccccagucaaagaauggcccacaagagaaagacugcgaucugguggaccuagaugacgcgagucucccuguauccgauguuuga

SEQ ID NO: 60822 - RNA, 1278 nt, Artificial Sequence
  derived and/or modified sequence opt3 from PLEKHA2__Homo_sapiens__NP_067636
augcccuacguggacagacagaacaggaucugcggcuuccuggauauugaggaacacgagaauagcgggaaguuucuccggcgcuauuucauacuugacacccaagccaacugucuguugugguacauggauaauccucagaacuuagcuaugggagccggugccgucggcgcgcugcagcuaacauauaucuccaaaguuucuauugcuacuccaaagcagaaaccgaagacgcccuuuugcuucgugaucaaugcccucucacaacgauacuuucugcaggcaaacgaccagaaagauaugaaggacuggguagaagcccuuaaucaggcuaguaagauuaccgugccuaaagggggaggccugccaaugacaacugagguccucaagagccucgcagcacccccugcucuggagaaaaagccacaaguggccuauaaaaccgaaaucauaggugggguugugguccauacacccaucucccagaacggaggcgauggccaggaggggucugaaccuggaucgcacaccauucugcguagaucacagagcuacaucccaacaagugguuguagggcguccacuggcccgccccucauuaagucuggguauugcgugaagcaaggaaauguacggaaaagcuggaagcgcagauucuuugcauuagacgauuucaccaucuguuacuuuaaaugcgagcaggacagggaaccucugcggacgauauuccuuaaggauguuuugaaaacucaugagugucuggugaaguccggcgaccuacucaugcgcgauaaccuguuugagauuaucaccucaagucgaacauucuacguccaggccgacagcccagaagacaugcacucuuggauuaaagagaucggugcugccgugcaagcacuuaagugccaucccagagaaacuuccuuuucaaggagcaucagucugacccggccugggucuuccagcuugucgucuggaccaaauuccauucucugucguggcagacccccgcuggaggaaaagaaggcuuuaugcaaagccccuucaguggcgaguagcuggcagcccuggacaccagucccucaggccggcgagaaacuguugcccccaggggauaccuccgaggacucucuuuucacgccccgcccuggagaagguagcgcaccaggcguucugccgucaaguaggauacggcaccgauccgagccccagcacccuaaggaaaaaccauucauguuuaacuuggaugacgagaauauccgcacuagcgauguguga

SEQ ID NO: 60823 - RNA, 3525 nt, Artificial Sequence
  derived and/or modified sequence opt3 from PLEKHA5__Homo_sapiens__NP_001137293
auggccgcugaccugaaccucgaguggaucagccuucccagauccuggaccuacggcauuacaaggggagggcggguguucuuuauaaaugaagaggcaaagucuacuacguggcugcacccugucaccggugaagccguugugacaggccaucgccgacagucaacugauuugccaaccgggugggaggaagcguauacauucgagggagcucguuacuauaucaaccacaaugagagaaaaguaaccugcaagcauccggugacuggccaacccagucaggacaacuguauuuuugucgugaaugaacagacaguugccaccaugacgagcgaggagaaaaaggagaggccuaucuccaugauuaacgaggcaucuaauuacaacgugacuucggauuaugccguccacccaaugucacccgugggucggaccagccgcgcuaguaaaaagguacauaauuucgggaagagauccaacucuaucaaaaggaauccuaacgcaccaguugugcggcgcggaugguuauacaagcaggacagcacaggcaugaaacuguggaagaaacgaugguuuguccuauccgaucucugccuguucuauuacagagacgaaaaggaggaaggcauacuugggucaauccuguugcccaguuuucaaauugcccuccugacuagcgaggaucacaucaauaggaaguacgcuuucaaagccgcgcacccuaacaugcggaccuauuacuuuuguacagacaccggaaaggaaauggagcuguggaugaaagcaaugcucgaugccgcuuuagugcagacggagccagugaagcgugucgacaaaauuacuucugaaaaugccccgacaaaggagaccaacaacauccccaaucaucgcguucugauaaaaccugaaauucagaacaaucagaagaacaaggagauguccaaaaucgaagagaagaaagcacuugaggcugaaaaguaugguuuccaaaaagauggccaggacagaccauugacuaagauuaauucagugaagcugaacagccuacccagugaguacgaaucuggguccgccugcccugcgcagacaguacacuauaggccaaucaaucucagcucgucugagaacaaaaucgugaaugucucccuggccgaucuucggggaggcaaccgacccaauaccgguccgcuguacacggaagcagaccgcgugauucagagaaccaacucaaugcaacaguuggagcaguggauaaagauccaaaaagggaggggacaugaggaagagacacggggcguuauuaguuaucagacucucccucgcaauaugcccagccacagagcucagaucauggccagguacccagaaggcuaccguacccugccucggaacuccaagacacgacccgagucuauauguagcgugacuccaucaacccacgacaaaacauuagggcccggagcugaggaaaagagaaggaguaugcgcgaugacaccauguggcagcuguaugaguggcaacagcggcaguuuuacaauaagcaguccacucucccuagacauagcacgcuuucuucaccaaaaacaauggucaacauuagugaucaaaccaugcacagcaucccgacuucccccucucaugguucgaucgccgcauaucagggcuacagcccucagaggaccuaucgcuccgaagugucaaguccaauucagcgaggggacguaacaaucgaucggcgucacagagcccaucaccccaagcacguuuacgugccugacaggcgcucugucccagcuggacugaccuugcaaagcgugucaccccagucccuacagggcaaaacuccggaggaacugacacuccugcuuauuaagcugcggagacagcaagcggaguugagcucuauaagggagcauacgcucgcacagcugaugcaguuaaaacuggaagcccacuccccuaagaacgagauccuaagucaucaccuccaacgaaauaccauuuaucuggaucaccagcuuagccaggacgaaggucgcgggacuuuguacaaguaccggccagaggaagucgauaucgacgcuaaacugucuagacucugcgagcaggauaaggugguucaugcccuggaggaaaaacuucaacagcugcacaaggagaaauauacauuggaacaggcacuccuguccgccucacaggagaucgaaaugcaugcugacaaccccgccgcaauucaaaccgugguauuacagagggacgaucugcagaauggccuacucaguacaugucgugagcugagccgcgcgacugcugagcuugaacgggccuggagagaguacgacaaguuggaauaugaugucaccgugacgaggaaccagaugcaagagcagcuggaccaccucggagagguucagaccgaaucggcaggcauacaacgagcccagauccagaaagagcuguggcggauucaggaugugauggaaggguuauccaagcauaagcaacagcgcggaacaacugagaucgguaugauuggcucuaaaccuuucagcaccgucaaguacaaaaaugaagggcccgacuauagacuguacaagucagagccagagcuuacaacuguggcugaaguagaugagaguaacggagaagagaaauccgaaccugugucugagaucgagaccagcguugucaagggcucccacuuucccguggguguggucccaccgagggccaagucaccuacgcccgaaagcaguacaauagcaucuuauguuaccuugcggaaaacuaagaaaaugauggaccuccgaacagagagaccacgcuccgcuguggaacagcugugccuagccgagagcaccaggccccguaugacuguggaagaacagauggagcggaucagaaggcaccaacaggcgugucugcgcgaaaagaaaaaggggcucaauguaauuggcgccucggaucagucaccucugcagucuccaaguaaccuucgagacaaucccuucagaaccacacaaacgcggaggcgcgaugacaaggaguuggauaccgcuauccgugaaaacgacgucaaaccugaccaugagacuccggcaacagagauugugcagcugaaggaaaccgagccacagaauguugauuucuccaaagaauuaaagaaaacagagaacaucagcuacgaaaugcucuuugagcccgagccuaauggagugaacucugucgaaaugauggacaaggagagaaauaaggauaaaaugccagaagacgugacuuucagcccccaggaugagacccaaacggccaaccacaagccugaggaacauccggaggaaaacaccaaaaauuccguugacgagcaggaagagacagugauaucauacgaaaguacucccgagguaagccggggcaaccagaccauggcugucaagucucuguccccaucaccugagaguagcgccucccccgugccaucuacacaaccucagcuuacugaagggucgcacuuuaugugcguguga

SEQ ID NO: 60824 - RNA, 3147 nt, Artificial Sequence
  derived and/or modified sequence opt3 from PLEKHA6__Homo_sapiens__NP_055750
augagcaacaagaccggcgggaaaagacccgccacaacuaauuccgacaucccuaaccacaauauggugucugaggucccaccggaaaggcccucaguucgggcuacgcgcaccgcacgaaaggccguggcguucggaaaacguagucauagcaugaagagaaacccuaaugcuccaguaacaaaagccgguuggcuguuuaagcaggcauccucuggcgugaagcaauggaacaaaaggugguucguccucguggaucggugcuuauuuuacuauaaggacgagaaagaagagucgauucuggggucaauacccuugcuuagcuuccgcguugccgcugugcagccuagugauaauaucuccagaaagcacacuuuuaaagcagaacaugccggagucaggaccuacuucuuuucugcugagagcccagaggaacaggaggccuggauucaggcgaugggcgaagcagcccgggugcaaauucccccugcucagaaguccguaccacaggccguucgccacucacaugagaagccggacagugagaacgugcccccuagcaaacaccaccagcaaccaccccauaauucucugccuaagccagaacccgaggcaaaaacacgaggugaaggggauggaagaggcugugagaaggcugaaaggcggccggagcguccugaggucaaaaaggaacccccagugaaagccaacggccuaccugcggggcccgagccagccuccgaacccggaucaccuuauccagaggguccgcgcgugcccggcgggggagaacagccugcacagccaaauggcuggcaguaccacagccccaguagaccugguucuaccgcuuucccaucccaagacggggagacuggaggccauaggcggagcuuucccccgcgaacaaacccugauaagaucgcccagcgcaagucgucuaugaaucagcuccaacagugggucaaccugagaaggggcguuccacccccugaggaccuucggucccccucacgcuucuauccagugaguagaaggguaccugaauacuaugggcccuacagcucccaguacccagaugacuaucaguacuauccgccuggagugcgucccgagucuaucugcagcaugccagcuuacgaucggauaucacccccuugggcccuggaagacaaacgacacgcauuuagaaaugguggcgggccagccuaucaauugagggaguggaaggaacccgcuaguuacggacgccaggaugcgaccgucuggaucccuuccccgagccggcagccaguguauuacgacgagcucgacgcagccucuucaagucugagaaggcugagccuccagccccgcucccacucuguuccucgaucgccaagccaaggcuccuacucacgggcucguauuuauagucccgugagaucuccuagcgccagguucgagcgcuuaccgccccgguccgaagauaucuacgcagacccagccgcuuaugucaugagaaggucaauuagcucuccuaaagugcccccauacccugagguauuucgagauucccugcauacguauaaacuuaacgaacaggacacugauaaauugcuggguaagcuaugugagcagaacaagguugugcgcgagcaggaccggcucguccaacagcugagagccgaaaaagagagucuugaaagcgcacugauggggacccaccaggaguuggaaauguucggcucucagcccgcguacccagagaagcucaggcauaaaaaggauucccugcaaaaucaguuaaucaacauacguguggagcugucacaggcuacaacugcccucaccaauaguacaauugaauaugagcaccuugaaagcgaggucucggcacugcaugacgauuugugggaacaacuaaaccuggacacccagaaugaggugcucaaccgccagauccagaaagagauuuggcggauccaagauguuauggaaggacugagaaagaauaacccguccaggggcacggacacugccaagcaccgagggggacuugguccuucugcuacauacagcucaaauagucccgccuccccacugucuagcgcauccuugaccucaccccucagcccuuucagucuggugucuggcucccaggggagcccaacuaaacccggaucgaacgagccuaaggcuaauuacgaacagucaaagaaggacccgcaccagacauuaccacuggauacgccccgggacaucucucuaguaccuacccgccaagaggucgaagccgagaaacaggcggcccucaacaaggugggcguugugcccccaagaaccaagaguccuacagaugacgaggucacucccuccgcugugguaaggcggaaugcaagcggucugaccaacgggcuuucuagccaggaacgaccaaaauccgccguguuuccuggcgagggaaagguuaaaaugucagucgaagaacagauugauagaaugcgcaggcaucaaaguggcagcaugcgugagaagcggagaucuuugcagcugccggcuucccccgccccagacccuucacccaggccagcauauaaaguggugcgccgacacagaaguauacaugaagucgauaucagcaaucucgaggcggcccugcgggcugaggagccugggggacacgccuacgaaacacccagggaggagauugcacgccuucguaagauggaacuggagccgcagcacuaugacguugauaucaacaaagaauuguccacuccagacaaggugcucauaccugagagauacauugaucuggaacccgacaccccauuaucucccgaggagcugaaggaaaaacaaaagaaaguggagcggaucaagacacuaaucgcuaaaucgagcaugcagaacguagucccuauuggugaaggcgauucaguggacguuccgcaggacuccgagagucagcuccaagaacaggagaagaggaucgagauuucuugcgcccuggcaaccgaagccagccgccgagggagaaugcuuuccgugcagugugcuacucccucaccaccuacgucucccgcgagcccugccccacccgcaaauccuuugaguuccgagagcccacggggagcugauucuucauauacaaugagggucuga

SEQ ID NO: 60825 - RNA, 3366 nt, Artificial Sequence
  derived and/or modified sequence opt3 from PLEKHA7__Homo_sapiens__NP_778228
auggccgcugcaaccgugggcagagacacacugcccgagcacuggagcuacggggucugcagggauggacggguuuucuuuaucaacgaccagcuccgcuguacuacguggcuucauccucgaaccggugaaccaguaaauuccggccacaugauucguucugaucugccgagagggugggaggaaggauucacagaggaaggcgccucauauuuuauagaccauaaccaacagacuaccgcguucaggcaccccgugacaggucaguuuaguccugagaauagcgaguucaucuugcaggaagaaccaaacccccauauguccaagcaagaucggaaucagcgcccuucuucgauggugucagaaaccagcacugcugggacagccaguaccuuagaggcaaaaccaggacccaagauuaucaaauccucuagcaagguccacuccuuuggcaaaagagaccaggccauuaggcggaacccuaaugugccaguugugguccgcggcuggcugcacaagcaggauucaagugggaugcgacuauggaagagaaggugguucgugcucgcugacuacugccuguuuuauuacaaagauagccgggaggaagcaguacuuggaucuaucccgcugcccuccuauguuauaucaccuguggccccagaggaccguaucagccgcaaguacaguuucaaagcuguccauacggguaugagagccuugauuuauaacucuuccacugcgggcagccaagcagaacagucggggaugaggaccuacuacuuuucugccgauacacaggaggacaugaaugcuugggugcgggccaugaaccaggcagcucaagugcucucccgaucaagucugaagcgcgauauggaaaaagucgagagacaggccguuccccaggcgaaucacacugagagcugucaugaaugcggaagggugggcccuggucacacccgggacuguccacaccgcgggcaugacgauaucguaaacuucgagagacaagaacaggagggagaacaguauaggucccagcgugacccccuggagggcaagcgggaucgaucuaaggccagaagcccguacucacccgcagaggaagacgcucucuuuauggauuuacccacaggcccaagggggcaacaggcccagccucagcgcgcugagaaaaauggaaugcugcccgccaguuaugguccaggcgaacaaaacgggaccggaggcuaccagcgggcauuucccccuagaacgaauccagagaagcacucccagaggaaaagcaaccuugcccagguggaacauugggcucgcgcgcaaaagggugacucucgaucauugccgcuggaucagacucuaccccggcaggggccuggccagagucucagcuucccagagaacuaucaaacacugcccaaauccacccgucacccuucuggaggcucgagcccacccccgagaaaucuuccuuccgacuacaaguaugcacaggauagggccucacaucugaaaaugaguucugaggaacgccgggcucacagagacgggacugucuggcaguuguacgaguggcaacagaggcagcaguuucgacacggaagcccaacagcccccauuugccucgguuccccugaguucaccgaucaaggccgcucacggagcaugcuggaggugcccagaucuaucuccguuccaccuagucccagcgacauaccaccgccugggcccccaaggguguuucccccucgucgcccacauacgcccgcagagcgggucaccgugaagccuccggaccagagaaggucuguagauauuuccuuaggagacucaccacgacgggcccgcggccacgcuguuaagaacaguagccauguggauagaaggucgaugcccuccauggguuacaugacacacacugucucugccccuagccugcacgggaaaucagcagacgauaccuaucuccagcuuaagaaagaccuggaauacuuggaucuaaagaugacaggccgggaccugcucaaagaucgaagucugaagccagugaagaucgcggaguccgacacugaugucaaacuuucuauuuucugugaacaggacagagugcugcaagauuuggaggacaagauccgcgcucucaaagaaaauaaggaccagcuggagagcguuuuagaggugcugcauaggcagauggaacaguaucgugaucaaccccagcaccuagagaaaaucgccuaccagcaaaagcuccugcaggaagaccuuguacauauucgggcagaguuguccagagaaucaaccgagauggagaacgccuggaaugaauaucugaagcucgagaacgaugucgaacagcugaaacagacacuucaagagcagcacaggcgcgcuuucuucuuucaggaaaagagccagauacaaaaagaccuguggcgaaucgaggaugugaccgccggauugagugcaaauaaggagaacuuccggauucucguugaaucugugaaaaauccugagagaaagacugucccgcuguuuccccauccaccugugcccuccuuaagcacgucggaaucaaagccaccuccccagccaucuccgccuacaagucccguaaggaccccacuggaggugcgccuauucccccagcuccagacuuacguuccuuaucguccacacccuccucaacugagaaaagucaccuccccgcuucagagcccaacaaaggcuaaacccaagguggaggacgaagccccuccccggccaccuuugcccgagcuguacucuccagaagaucagccuccggcggugcccccacucccuagggaggccaccaucauacgccacacuagcguccgaggccugaaaagacaguccgacgaacggaagagggaucgcgaguuagggcaaugcguuaacggagacucaagaguggagcugaggaguuacgugagcgaacccgagcuugcuacauugucuggugauauggcacagccaucccucggccugguagggccugaaucacgguaucagacgcuacccggacguggccugagugguagcaccucccgccuccaacagucuucgacuauugccccguacgucacacugcgaagagggcuuaaugcugagagcucaaaagccaccuuuccaaggccuaaguccgcauuggaacggcuguauaguggcgaccaucagcgcggaaagaugucugcggaggagcaguuagaaagaaugaaaaggcaccaaaaggcccucgugcgggagcgaaaaagaacacugggccagggggaacgcacuggacuucccagcuccagguaccugucacggccauugcccggcgaucucgguucuguuuguuga

SEQ ID NO: 60826 - RNA, 627 nt, Artificial Sequence
  derived and/or modified sequence opt3 from PLEKHB1__Homo_sapiens__NP_001123505
augagccccgccgcuccugugccaccggacuccgcacuggagucucccuucgaagagauggcccucgucagaggcggguggcuuuggaggcagucaaguauccugcggcgcuggaagcgaaacugguuugcguugugguuagauggaacccuggguuacuaucacgacgaaacagcucaagaugaggaagaccguguucuaauucauuucaaugugagagauauaaaaaucggcccugagugccacgacguacagccacccgaggggaggagccgggauggacuccugacugugaaccuucgcgaaggcgguagacugcauuugugugccgagacgaaggacgaugcacucgccuggaaaaccgcucugcuggaagcaaauuccacaccugucaggguguacucuccauaucaggacuacuaugagguugugcccccuaacgcccacgaggcuacuuacguccggucguauuacgggccaccguacgccggacccggcgugacccauguaauuguucgcgaagauccuugcuauucagcgggcgcaccacucgccauggggauguuagcuggagccgcaacaggugcugcccugggcagccuuauguggagucccuguugguuuuga

SEQ ID NO: 60827 - RNA, 1521 nt, Artificial Sequence
  derived and/or modified sequence opt3 from PLEKHD1__Homo_sapiens__NP_001154970
auguucaccagcaaguccaacucugugucacccaguccuagccuggagcaggccgacuccgaugcucucgacaucucuacaaaaguccaacuuuacggcguucuguggaagagaccauuugggaggccgucggcaaaauggucacggcgcuucuuuauuauaaaggaaucuuucuuguuauauuacagugaguccgagaaaaagucuuuugagacuaauaaguauuucaacauccaccccaaaggagugauuccucuggguggcugccuaguagaaccaaaggaggagcccagcaugccuuacgccaugaaaaucucccaucaggauuuucacgggaauauucuccuggcggcugaaucagaguucgaacagacgcaguggcuugagaugcugcaagagaguggaaaggugaccuggaaaaacgcccaguugggcgaagcaaugaucaagagccucgaggcccagggucugcagcuggcuaaggaaaaacaagaguaucucgacaaguuaauggaagagacagaggaacugugucuucagcgagagcagcgugaagaguuggaaagacugaaucagguccuagaggcagagaaacaacaguuugaagaggugguucaggaacucaggauggagcaagaacagauaaagcgggagcuggagcuuacugcccgcugccugaaagggguggaacaggagaagaaagaauugagacaucucaccgagucucugcagcaaacauuagaggaacuguccaucgagaagaagaaaacccucgaaaugcuugaggaaaacgagaaucaucugcagacuuuggcuaaccagucagagcagccacccccuagcggaggccuacacaguaaucugaggcaaauugaagagaagaugcagcagcuccuggaagagaaacuucuggccgaaaagcggaugaaagagaacgaggaacgcucucgagcguuggaggaagagagagaguucuacuccagccagucgcaagcacuccagaauagccugcaggaauuaacagccgagaagcagcaagcugaaagggagcugaaggccgaagucaaagugcggauggaucuagagcgucgccucagagaggcagaaggcgcucugaggucccuugagcagggguugaacucaaagguacggaauaaagaaaaggaggaacgaaugcgcgccgacguuagucaccugaaaagauuuuucgaggaguguaucaggaacgcggaacucgaggccaagaugccagugauuaugaagaauagcgucuauauccacaaagcagcuacccggcgcauaaaguccugcagauuucauaggcgucggucuagcacgucauggaacgauaugaaaccgagucaguccuucaugacuagccaacuggacgccaacaauauggaagaacuuaaggaaguggcuaaacgacugucuagagaucagagguuccgcgagucaauuuaccacaucauggccacccagcccggagcaccuagugccuugagccgggguggcaaguga

SEQ ID NO: 60828 - RNA, 840 nt, Artificial Sequence
  derived and/or modified sequence opt3 from PLEKHF1__Homo_sapiens__NP_077286
augguggaccaccuggccaacaccgagaucaauagccagagaauugcugcagucgaauccugcuucggcgccucugggcaaccccucgcgcuuccuggaaggguucuguugggugagggcguguuaacaaaggaaugucggaaaaaggcuaaaccacgcauauuuuuccuguuuaacgauauccuaguauacgggucaauugugcucaauaagcgaaaauaucguagucagcauaucauuccgcuggaggaagucacucuugagcuguugcccgagacgcuccaggccaagaacagauggaugaucaagaccgccaaaaagagcuucgugguuuccgcagcuucugcaacagaaaggcaggaguggauaucgcacaucgaagagugcgugcggcgccaacugagagccacuggaaggccuccaucaaccgagcaugcugcccccuggauuccugacaaagcgacagauaucuguaugcggugcacccagacucgcuuuagcgcacugacacgaagacaccauuguaggaagugcggcuucgucgugugugccgaaugcagucggcagcguuuucucuuaccacgccugucccccaaaccuguaagaguuuguucucuuugcuacagggaguuggcugcccagcaacggcaggaagaggcagaggaacagggugcugggagcccaggacagccggcccaccuggcgcgacccauuuguggcgccuccucaggcgacgaugacgauagugacgaggauaaggaagggagccgcgacggagauuggccuucuuccguggaguucuaugcaucaggugucgcuuggagcgccuuucacaguuga

SEQ ID NO: 60829 - RNA, 750 nt, Artificial Sequence
  derived and/or modified sequence opt3 from PLEKHF2__Homo_sapiens__NP_078889
augguggacagacuggccaacagcgaggcuaauaccaggcggaucuccauugucgaaaacugcuucggcgcagccgggcagccccucacaauaccuggacgcguucuuaucggugagggcgugcugacuaaguugugucguaaaaagccaaaagcgcgacaauuuuucuuauuuaaugauauucugguauacgggaacaucgugauucagaagaaaaaguauaauaagcagcacaucauaccgcuagaaaacgucacgaucgacucuauuaaagaugagggagaccucagaaauggcuggcugaucaagacccccacaaaaucauucgcuguguacgccgcaacugccaccgaaaagagugaguggaugaaccauauuaauaaaugcguuacagaucuucugagcaaguccgguaagaccccuucuaacgagcacgcugcagugugggucccagacucggaagccacuguguguaugaggugccagaaagcuaaguuuacacccguaaaucggcgccaucacuguagaaaaugcggguucguuguguguggaccuugcucagagaagagguuuuugcucccaagccaaaguuccaaacccguccggaucugugauuucugcuaugaccugcugucugccggcgauauggcgaccugucagccugcacgcagcgacuccuacucacagagucucaagagcccauuaaacgauaugucugacgaugacgacgaugacgauuccucagacuga

SEQ ID NO: 60830 - RNA, 4158 nt, Artificial Sequence
  derived and/or modified sequence opt3 from PLEKHG1__Homo_sapiens__NP_001025055
auggagcugagcgacuccgauagacccgugucuuucggcucaaccaguagcuccgccucuucgagggacucacacgggagcuuuggaagucggaugacacucgucuccaacucucauaugggucuuuucaaucaggauaaggaaguuggcgcuaucaaacuggaguugauuccugcacgcccauuuagcuccucagaauuacaacgagacaacccggccacugggcagcagaaugcggaugagggaagugaacgucccccuagagcucaguggaggguggacagcaacggcgccccaaagacgauagcagauucugccaccucccccaaacugcuauacguagaccgggugguccaagagauccucgagacagaacgcacuuaugugcaggaucugaagucaauuguugaggacuaccuugauugcaucagagaccagaccaaacugccuuuggguacagaagagaggagcgcucucuucgggaauauucaggauaucuaucacuuuaacagugagcugcugcaagaccucgaaaauugugagaacgacccaguggcaauagccgaaugcuucgucucuaaguccgaggaauuucauaucuacacccaguauuguacuaauuacccccggagcguggcuguauuaacagagugcaugcgcaacaagauucuggccaaauucuuucgagagagacaggaaacccuuaagcacucguugccucugggaucuuaucuacucaaaccaguucagaggauccugaaguaccaucuucuguugcacgagauugaaaaucaccucgauaaagacacggagggcuacgaugugguccuggacgcgaucgauacuaugcaacggguggcauggcauauaaacgacaugaagcguaagcacgaacaugccgugcgcuuacaggagauucagucccugcucaccaauuggaaaggcccggaucuuacaucauauggggagcuggucuuggaaggaacuuucagaauccaaagggcuaagaacgagcggacccuauuucuguucgacaaacuccugcuuauuacaaagaaacgagaugacaccuuuacguacaaggcccacauccugugugguaauuugaugcucguugaagugauccccaaagagccucugaguuucagcguauuccacuauaagaacccaaaguuacagcauacugugcaggcaaaaucccagcaagauaagcgccuguggguccuacaccucaaaagacugauucuugaaaaccaugcugccaagauacccgcgaaagccaagcaggcaaucuuggagauggacgcuauucaccauccuggcuuuugcuacucuccagaagggggaacaaaggcccuguucggcagcaaagaagguucagcucccuauaggcuccggcgcaagagugagccguccagcagaucucacaaagugcugaagaccucagaaacugcccaggacauccagaaaguuaguagggaggaggggagcccucaacuuuccucugcacgucccucgccagcccagcggaauagccagccuuccucaaguacaaugauaucugugcugcgagcuggaggcgcguugagaaacauuuggaccgaucaccagaucaggcaagcacucuuucccagccgccgguccccacaggaaaaugaggacgaugaagacgauuaccagauguucguccccucauuuucaucuuccgaccugaacaguacgagauuaugugaggauagcaccucuuccaggccuugcucauggcauaugggccagauggaaaguacagagacuagcucguccgggcaccgcaucgugcgacgggccucuagcgcuggagagucaaauaccuguccaccggaaauugguacaagugaccguacuagagagcugcaaaacucccccaagaccgaaggccaggaggaaaugacaccuuucgggucuagcaucgagcuaaccauugaugacauagaucauguauaugacaauaucuccuacgaggaucucaagcugaugguugccaaaagggaagaggcagaaucaacuccaagcaagagugcccgcgacucugugcggcccaaauccacgccugagcuugcuuuuacaaagagacaggccggacacagcaaaggcucguuguacgcacaaaccgacgguacucugucagggggcgaagcgucuagucaguccacccacgagcuccaggcugucgaggaaaacauuuaugauacaaucggacugccagaucccccgagcuuaggcuucaagugcucuagccugaagagggccaaacgauccaccuuucuuggguuggaggcagacuucguguguugcgacucacuccgcccuuuugucagucaggauagccugcaacuaucugaagacgaggccccauaccaucaggcuacucccgaucacggauaucugucccuccuguacgacucaccuagugguaaucuuagcaugccccauaagccaguguccgauaaauugucugaggaaguugacgagaucuggaacgaucuggaaaauuauauuaagaaaaacgaggacaaggcccgggauagauuacucgcagcuuucccugugucgaaagacgacguacccgauaggcugcacgccgaaagcacaccagagcuuucacgugacgucggccgcuccgugaguacgcugucuuugccggagagccaggcgcuccugaccccuguuaagucccgggccgggagagcuucaagggcaaauugccccuuugaagaggaucuaauaucuaaggaagggagcuucaugagucugaaccgacucucccuggccagcgagaugccacuuauggacaaucccuacgauuuggcuaacucuggccugucacagacugacccugaaaacccagauuuagguauggaggccacagacaaaaccaagucccggguguucaugauggcacgccaauauagucagaaaaucaagaaagcgaaucagcuccugaaggucaagagccuugagcuggaacagcccccugccucgcaacaucagaaaucuaugcacaaggaucuagcugccauucucgaggagaaaaagcagggaggcccggcaaucggagcuagaauugccgaguacucccaacuguacgaccagaucguguuuagggaaagcccauugaaaauacagaaggauggcugggcaucaccccaggagaguucucuguuacgguccguaagcccuucacaagugcaccaugggaguggagacuggcuccugcacagcacauauuccaacggugagcuugccgacuucugucugccacccgaacaggauuugcgaucuagauacccuacuuuugagaucaauaccaagagcacgccgcgccagcucuccgcugcgugcucaguucccucucugcagaccagugacccacuaccuggcucgguccaaagguguagcgugguggucucccagcccaacaaagaaaauuggugccaggaucaucuguauaacucucuugggcguaagggaauuucagccaaaagccagccauaccaccggucccaaaguucuagcucaguucucaucaauaaguccauggacaguauuaacuauccuagcgaugugggcaaacagcagcuguugucucugcauagauccucaaggugugagagccaccaggacuuacuccccgauaucgcagacucgcaccaacaggguacagagaagcugucugaucuuacucugcaggacagucaaaaggugguagucgugaaucgcaacuugccacucaaugcucagauagccacccagaacuacuucuccaauuuuaaagaaacagauggggacgaggaugacuauguugaaauuaagagcgaggaagacgagucagagcuggaacuaucccauaaccgaagacggaaaucugauagcaaguucguggacgccgauuuuagugacaaugucugcuccggcaacacucugcacagccuuaacucuccgaggaccccuaaaaagcccgugaauagcaaacucggacugaguccauacuugacgcccuacaacgauuccgacaaguuaaaugauuaucuguggcgcggcccuagcccaaaccagcaaaauaucguucagucucuccgugagaaguuccagugucugucgucaagcuccuuugcuuga

SEQ ID NO: 60831 - RNA, 4161 nt, Artificial Sequence
  derived and/or modified sequence opt3 from PLEKHG2__Homo_sapiens__NP_073746
augcccgagggcgcccaggggcugagccucuccaagccuucuccaucacuuggaugcgguagaaggggcgaagugugugacugcgggaccgucugugagacacggacugcuccggcagcccccacgauggcgaguccucgcggaagcggcuccucuaccucgcugucaacaguugguagcgaaggggauccagcucccggaccuacuccagccugcagugcaucccgacccgagccuuugccaggcccgcccauccguuuacaccugucuccugugggcauuccagggagcgccagacccuccaggcuagaacggguagcucgcgagauaguggagaccgaaagagcauacgucagggaccuccggucaaucguggaggauuaucugggaccucuucuggacgguggcguuuuggggcucaguguggaacaagucggaacacuguucgccaacauugaggauaucuacgaguuuagcucugaacugcucgaggacuuagaaaauuccucaagcgcuggcgguauugccgaguguuucgugcagcgcagugaagauuuugacaucuauacccuguacugcaugaacuauccaucuucccuugcguugcugcgagagcuaagccucucgcccccggcagcccuguggcuucaggagagacaggcucaacugaggcauucuuugccucuccaguccuuccuguuaaaacccguacagcggauacugaaguaccaccuccuucugcaggaauuggggaaacauugggccgagggaccaggcacuggcgggcgugaaaugguugaggaagcaaucgugucaaugacagcugucgccugguauauuaaugauaugaagcgcaaacaagagcacgcggccagacuacaggaggugcagaggcggcugggagguuggaccggcccugaacucagugcauuuggggagcuggugcuugaaggagcuuuccgaggcggugggggcggaggcccccgccugagagggggagagagguugcucuuucuguucagccggauguuacuggucgccaagcgcagaggucuagaauacacguacaagggccauaucuuuuguugcaaccucuccguuucugagagcccaagggacccccugggguucaaagugucagaucuuacuauuccuaagcaccgucacuugcugcaggcuaaaaaucaagaggaaaagcggcucuggauccauugucugcagcgacuguuuuucgagaaccacccagccaguauaccggcaaaagccaagcagguacuuuuggaaaauucccuccauugcgcucccaagagcaaaccugugcuggagccauuaaccccgccucugggaucuccaagacccagggacgcgcgcucauuuacaccgggccggagaaacacugcaccuaguccaggucccagcgucauuaggcgcgggcgacggcaauccgagccugugaaggaucccuauguuauguucccacagaaugccaaaccuggcuucaagcacgcuggaucugaaggcgagcuauaucccccagaaucgcagccgccugugagcggguccgcacccccagaggaccucgaagacgccggacccccuacccuggauccaucagguacaaguaucaccgaggagauucuugaauugcugaaccagcguggccucagagaccccgggccuucuacgcacgauaucccgaaauuuccaggagacagccaaguccccggcgauuccgagacucugacauuccaggccuuaccuucaagggacagcucugaagaggaagaggaggaagaggaaggucuggagauggaugaacgcgggccaaguccccuucauguguuggagggccucgaguccagcaucgcugccgaaaugccuucuauuccgugucugaccaagauacccgacguaccaaaucuaccugagauccccucccggugcgaaauuccagagggaucaagacugccuagucucagcgauaucucggacguuuuugagaugcccugccugccagcaauaccguccgugccuaacacucccucucuuagcucaacaccaaccuugaguugugauuccuggcugcagggccccuuacaggaaccugcggaggcuccagccacgaggcgagaacucuucucugggagcaaucccggaaaacugggcgagccuccguccggugggaaggcaggaccagaagaggacgaggaaggcgucucauuuaccgacuuccaaccccaggaugugacacagcaccaggguuuuccugacgagcuugccuuccgcagcugcagugaaauucggucugcuuggcaagcccuggagcagggccaguuggcaagacccggguuuccagaaccucuccugauccuagaggauuccgaccugggaggcgauagcgggucgggaaaggcuggcgcccccucaucugagaggacugcgagucguguccgcgaacucgcccggcuguacuccgagagaauccagcaaaugcagagggcugaaacccgagcaagcgccaacgcuccacggcgcagaccuagggugcuugcccagccgcaacccucuccauguuugccucaggagcaggcagaacccggucuguuaccagcguucgggcauguucucgugugcgagcuggccuuuccucuuacaugugcucaggagagcguaccccugggaccggccgucugggugcaagcagcuauuccacuauccaaacagggcgguucaccugacggccaggggcuccacguuaguaaucugcccaagcaggauuugccaggaauccaugugagcgccgcaacucuguuacccgaacaaggcgggucucggcacguccaggccccugcugcgaccccgcuccccaaacaggagggaccacugcaccuucaggugccugcccugacaaccuucuccgaccaaggccaucccgaaauucagguaccugcaacuacgccauugcccgagcaccgaucacauauggugauaccugcuccaaguacagccuuuugccccgagcagggucacugugccgauauccacguuccgaccacuccugcucucccaaaggaaauuugcagcgacuucaccgucuccgugacaacccccgugccuaaacaagaggggcaucuggauucugaaucgccaacuaacaucccccuaacaaagcagggaggcagcagagacguccaggguccggauccuguuuguucacagcccauccaaccacuguccuggcacggcaguucucuugacccucaggggcccggagacacgcucccaccccugccuugccauuugccagaucugcagauuccgggcaccagccccuuaccugcacacgggucccaucucgaccaccgcauaccagccaacgcgccccugucacuuucucaggagcugccugauacucaagugccagcuacaacccccuugccucucccccaggugcugacagacaucuggguacaggcccuaccaacuagccccaagcagggaagucugccugauauucaaggccccgcagccgcuccaccucuucccgaaccaucccucaccgacacgcagguccagaaacugaccccgagcuuggagcagaagucuuuaaucgaugcacacgugccugccgcgacaccccugccagagaggggugggucacucgacauucaaggacugucccccacuccuguucagaccacaauggugcuuaguaaaccaggcggcagccuggcuucgcaugucgcccguuuggaaucuuccgaucuaacucccccucacagcccgccacccucaagucggcagcugcucgggccuaaugcagccgcucugucuagauaccuugccgcauccuauaucagccaaucauuagcuaggcgccagggaccagguggcggggcccccgcggccagucgaggaagcugguccucugcaccuaccagcagagcuuccucacccccaccgcagccucagcccccaccucccccagcccggaggcugucuuacgcuacgacagugaacauacauguuggcggugggggacgccuccguccugcaaaggcccaagugagauugaaucaccccgcccugcucgcuaguacccaggagucgaugggccugcaucgggcgcagggcgcaccggacgccccauuccacauguga

SEQ ID NO: 60832 - RNA, 4026 nt, Artificial Sequence
  derived and/or modified sequence opt3 from PLEKHG3__Homo_sapiens__XP_011534927
augcccgugagcaccucccugcaccaggacggcucucaagagagaccugucucacucacaaguacuacgagcuccucugggucgucaugcgauagcaggagugccauggaagaaccauccucuagcgaagcuccggcaaagaacggagccgguucccuucggucacgccaucugcccaauaguaacaauaacucuagcuccugguugaauguuaaaggcccuuuaucaccauucaacagccgagcggcugccgggcccgcacaccauaagcugaguuaccuaggacgugugguaagagagaucguggaaaccgagaggauguauguccaggaccuccggucuauuguggaggauuaccugcuuaaaauaaucgacacaccuggccuguugaagccagaacagguuuccgcccucuuugguaauauugagaacaucuaugcucugaauagccagcugcuccgcgauuuagacucguguaacucugaucccguggcagucgccuccugcuucguggaaagaucacaagaguuugacauuuacacucaguauuguaauaacuacccuaauaguguagcugcccugaccgagugcaugagggauaaacagcaggcgaaguucuuucgggaccgccaagaacuuuugcagcacagccugccacuaggguccuaucuccugaagccgguucagcgaauccuuaaauaccaucuguugcuccaggagauagcaaagcacuucgaugaagaggaagacggauuugagguggucgaggaugccaucgacacaaugaccuguguggcuugguacauuaacgacaugaaaagaaggcacgaacaugccgugcggcugcaagagauccagucuuuacugauuaauuggaagggccccgaucucacuacauauggcgaacuuguccuggaggggaccuuccguguucaccgcgugagaaacgaaaggacguuuuucuuguuugacaaaacucuacugaucaccaagaagcggggagaucauuucguauacaaagguaacauaccuugcagcucacucaugcugauugagaguacacgagacucccuuuguuuuacugugacccacuauaagcacagcaaacagcaauacucuauccaggcaaagacagucgaggaaaaacgcaauuggacccaucacauuaagagacugaucuuggagaaccaucacgcuacgaucccacagaaagccaaggaagcgauucucgagauggauucauauuaccccaauagguaucggugcaguccugaacgccugaagaaagccuggagcucccaggacgaggugucuacuaacguuagacaaggcaggcgucagucggagccagggcauagccccuacucccgggcaacauuaccgucaggacagcgaggcuucgugaugccuagucugaaggguagaaggaaaucugaacccaccaagcaccuacuccgccagcugaaugagaaagcucgggccgcugggaugaagcacgccggaagcgcaggcacucuuuuggauuucggccaaccauccagaacaagggggcugcagccugaagccgagggagcuacccaggaggaagaggaagaggaagaggaggucguggaagaggaagaggaagaggaggaagaggaacaggcguuucaaguaucacucgaggaccugacgggucaugaaggcaacgagaagggggcaggacccgagccacccggcagcgaagaggaagaggaggaacaggaggaaucucuugccguugcugagcaggguaaagggcgccgagaauccgagaguagccggucuucccguagaccuucaggcaggaguccaaccagcacagagaagcgcaugucguucgaauccauaucuagccugccggagguggaacccgauccugaggccggaucagaacaggaggucuuuagugcaguggagggcccauccgccgaagagacucccucugacaccgaaagcccugaggucuuggaaacacaacucgaugcucaccaggggcuguuaggaauggacccacccggugacaugguggauuucguugccgcagaguccacugaggaccugaaagcgcuaucaagcgaagaggaagaggagaugggcggggcugcccaggaaccggagagucuccugccuccaucugugcuugaucaagcauccguaaucgccgaacgguuugucagcucguucucaagaaggucuaguguggcucaggaggacuccaagagcucuggauuuggcagcccccgauugguuucccgcucaaguagcgugcugucucucgaagguuccgagaaagggcuggcccggcauggcucagcaaccgauaguuuaagcugucagcuguccccugaggucgacauuucugugggaguagcuacagaagauucgcccagcgugaauggcauggagccaccuucacccgggugcccaguugaaccggacagauccaguuguaagaagaaagagucugcccuuagcaccagggaucguuugcuccuggacaagaucaaauccuacuaugaaaacgcggagcaccacgaugccggauucucaguccgccggagagagucucuaagcuacauaccuaagggucuggugaggaauaguauuucccgauuuaacagccucccccggccagaccccgaaccugugccacccgucggcucuaaacgccagguugggucaagaccuacuuccugggcucuguucgagcuuccgggaccaagucaagcagugaagggcgaucccccuccaaucagcgacgccgaauuuaggcccucgucugagaucgugaagauuugggaagguauggaguccagcgggggcucaccuggaaaaggcccggggcagggacaggcuaauggcuucgacuugcaugagccccuguuuaucuuagaggagcacgaacucggugccauuacggaggagagugcaacagcgucuccagaauccagcucaccuaccgaggggcggagucccgcccaucuggcucgagaacuuaaggagcugguaaaagaauugagcuccucuacucagggagagcucgucgccccacugcacccuagaauagugcaacuaagccauguuauggauucccacgugucagagcgcgucaagaacaaaguguaucagcuggcaaggcaguacucucuccguaucaagaguaauaaacccguuauggcucggccaccgcugcagugggaaaagguggccccugagagagacggcaagucgcccaccguaccaugccuucaagaagaggccggugaacccuugggcgggaaaggaaagaggaaaccuguccugagcuuauucgauuaugagcagcucauggcacaggagcacuccccacccaagccuucuucagcuggcgaaaugagcccgcaacgcuucuuuuucaacccauccgcggugagucagcgaacaaccucucccgggggaagaccuagcgcccggucaccccuguccccaacugagacauuuaguuggccugacgugagggaacuuugcagcaaauacgcaucucgcgaugaggcucguagagccggcggugggcggcccaggggaccaccugucaaucgcucccauucaguuccggaaaacaugguggagcccccacugagcggccgaguagguagaugucggucgcuaucuacgaagaggggccgcgggggaggcgaggccgcucagaguccugggccccucccacaguccaagccugacggaggcgaaacccuguaugugacugcagauuugacacuggaggacaacagaagggucauugugauggaaaaaggucccuuaccgagcccaaccgccgggcucgaggagucauccggacaaggcccuucuagccccguugcgcugcuuggucaggugcaggauuuccagcaaagugcugaaugccagccaaaggaggaaggcucccgggaccccgccgauccuagccagcaggggcguguccgcaaucugcgagagaaauuucaagcauugaacucugugggauga

SEQ ID NO: 60833 - RNA, 3576 nt, Artificial Sequence
  derived and/or modified sequence opt3 from PLEKHG4__Homo_sapiens__NP_001123201
auggagagaccccuggaaaacggcgacgagagcccugauucccaggggcacgccaccgacuggagguucgcugugugcucuuuucgggaugcaugggaagaggaggaaccagccucacaaaugcaugucaaggacccgggacccccucgcccacccgcgggugcuacacaggaugaggaacuccagggcaguccucuuagccgaaaauuccagcugccacccgccgcagacgaguccggggaugcccaacguggaacuguugaaucuucgucaguguugagcgagggcccugguccaagugggguagaguccuuacuguguccgaugucuagccaccuaucccucgcucagggagaaucagacacgcccggcgugggccuggucggggauccuggaccaaguagagcaaugcccagcggucuuucuccuggcgcccuggacuccgauccagugggguugggagacccccucucagagaucagcaagcugcuggaagcugccccgaguggcucuggucucccuaaacccgcggauugcuuacuggcacaggaccuuuguugggaguugcuggccuccgggauggcuacccuaccaggaacaagggacguucagggccgggccgugcuccugcuuugcgcacauagcccugcuuggcugcaaucggaauguucuucccaggaguugauucgccuccuguuauaccugagaucaauacccaggccagagguccaggcccucggccuuacugugcugguagaugcgcggaucugcgcccccaguagcuccuuguuuucugggcuaagccagcugcaagaagcagcuccuggagccguuuaucaggugcuccuggucgguucaacccuucugaaggaggugccaaguggcuugcagcucgaacaacugccgucccagagcuuacugacacacauucccaccgcugggcuaccuacuucucucggaggcggucugccauacugucaucaggccuggcuugacuuccgccgaagauuggaggcacugcuccagaauugccaagccgcuugugcgcugcuucagggggcaaucgaaucagugaaagccgucccccagccuauggagccaggcgagguuggacagcuguugcaacagacagaagugcucaugcagcagguacuggauagucccugguuagcuuggcugcaaugccagggcgggagggagcuaaccuggcucaagcaggaagugccggaggucacgcugagcccugacuaucggacugccauggauaaggcagacgaacuuuacgaucguguggacggauugcugcaccagcucacccugcaauccaaccagcgcauucaggccuuagagcugguucaaacacuugaggcuagagaaucugguuugcaccagaucgagguguggcuccagcaggucggcuggccagcccuggaagaggcaggggagcccucgcuagauaugcugcuccaagcgcagggcagcuuucaggaacuguaucagguggcucaagagcagguaaggcagggagaaaaauuccuucagccuuugacugguugggaggccgcagaacuggaucccccaggggcccgguuuuuagcucuccgagcccaacugaccgaguucucccgcgcacuugcucagagaugucagaggcuggccgacgcggagcgguuguuucaacucuuccgcgaagcccugacaugggcugaggaaggccagagaguucuagcagagcuggaacaggagaggccuggagugguccuccagcaacugcagcuucauuggacccgucaccccgacuugccaccggcccauuuucggaagaugugggcucuggccacgggcuuagggucagaggcaauacgacaggaaugcagaugggcgugggccaggugccaggacacuuggcucgcucuggaucaaaaacuugaggccagucugaagcuaccucccgugggaucuacagcaagccucugugucucccaggugccagcugcccccgcacacccuccacugcgcaaagccuacucauucgaccggaauuugggucagagccugucugaacccgcuugccacugucaucacgcggccaccaucgcagcuugcagaaggccugaggccggcgggggagccuuaccgcaggcuuccccaacuguucccccuccaggcaguagcgauccccgcucucucaaccgacugcaacuugugcuggcagaaaugguagccacagagcgggaguauguccgugcguuggaauacaccauggagaauuacuuuccugaacucgacagaccggaugugccccagggucugagggggcagcgcgcucaucuauucggcaaccuggagaaacuucgggacuuccacugucacuuuuuccucagagagcuggaagccugcacgaggcacccaccucgaguugcauaugccuuuuugcgccaccgggugcaguucggaauguacgcucuguauuccaagaauaagcccagaucagaugcauuaaugaguagcuacggccauaccuuuuucaaggacaaacaacaggcccucggggaucaccuggaccuugcgucguaucuguugaagccaauucagaggaugggaaaauacgcucuccugcuacaagagcuggcccgugcauguggcgguccuacacaggaacuuuccgcccuccgcgaggcucagucucugguccauuuucaguugcggcacgggaacgauuuacuggccauggacgcaauccaaggaugcgaugugaaucucaaggaacagggccagcugguaagacaggacgaguucgugguuaggacuggucgacacaaaagcguccggcgcauuuuucuuuucgaggaacuguugcuauuuucaaagcccagacauggcccaaccgggguggacacauucgcuuauaagaggaguuuuaaaauggccgaucugggacucacugaguguugcggcaacuccaaucugcgguucgaaaucugguuccgaagacgcaaggcgagggacaccuuugugcuucaagccucuagcuuagcaauaaaacaggcuuggacagccgauauuucccaucugcucuggcgucaggcuguccauaacaaggagguucggauggcagaaauggugucaaugggggugggaaauaaagccuucagagacaucgccccgagcgaggaggcuauuaacgauaggaccguaaauuacgucuugaagugucgcgaagugcgaaguagagcgucuaucgcaguugccccuuuugaccacgauucccuguaccucggcgcuagcaacucgcugcccggugacccagccucaugcucugugcuugggagucugaacuugcaucuauaucgggaucccgcacugcucggauuaaggugcccucuguacccauccuuccccgaggaagccgcucuugaggcggaagccgagcugggcggucagccuagccucacugcagaggacucugaaaucagcucccaauguccgucagcuaguggcagcucuggguccgauucaaguugcgucagcggacaggccuugggccgcgggcuggaggaccucccauguguguga

SEQ ID NO: 60834 - RNA, 2373 nt, Artificial Sequence
  derived and/or modified sequence opt3 from PLEKHG6__Homo_sapiens__NP_001138328
augaaggccuucgggcccccucacgagggcccacugcagggacucguggcuagcagaaucgaaaccuacgguggcaggcaucgggcauccgcccaaucuacagcggggcgccuuuauccgcgaggauaccccguccuggacccuucacguagaagguugcagcaguauguuccauuugcucggggcaguggucaggcccgcggguuaagccccaugagacugagggauccugagccagaaaaacggcacggaggccaugugggcgcagggcuacuccacucccccaagcugaaagagcuuacuaaggcccaugaacuggagguacgcuugcacacguucucuauguuuggaaugccucgacucccaccggaggacagaaggcacugggaaauuggugagggcggggauucgggacugaccauagaaaaaucauggcgggagcuggugcccggccauaaggagaugagccaagaacucugccaccagcaggaggcuuuaugggaacugcuuacaacugaguugaucuacguccguaagcugaaaauuaugaccgaccuacucgcagccggucugcuuaaccugcagcgcgugggguugcucauggaaguuagugcugagacacuguucggaaaugugccuuccuuaaucagaacccauaggucuuuuugggaugagguccugggcccaacucucgaagagacacgggccagcggccaaccccuugacccuauugggcugcaguccggauucuugaccuuuggucagcgauuccacccauaugugcaguacugucuacgcguaaagcaaacgauggcguaugcaagagaacagcaggagacuaacccccuguuucacgccuucguucaauggugcgaaaaacauaagaggucaggccggcagaugcucugugaucugcuuaucaaaccgcaccagcgcauaaccaaguacccucuguugcuccaugcugugcugaagagaagucccgaggccagggcacaggaggcuuuaaaugccaugaucgaagcggucgagagcuuucugcgucacauuaacgggcaagugcggcagggagaggaacaggaaucucuagccgcagcugcccagcgaaucggcccauacgaggugcucgagccucccuccgacgaagucgagaaaaaucugagaccauucucaacacuugauuugacuagccccaugcuggguguugcuagugaacauaccaggcaacuccugcuugaggggccugugcgcguaaaggagggccgggaaggaaaacuggacguguauuuguuucucuucucugauguccuguuagugacaaagccacagagaaaagccgacaaggcaaaaguuauuaggccgccccugaugcuagagaagcucgugugccagccucugcgcgauccaaacuccuuccuuuugauccaccugaccgaauuucagugugucagcucggcccuccuggugcacugccccucuccuacggaccgagcucaaugguuagagaagacucagcaggcgcaggcagcccugcaaaaacuuaaggcugaagaguacguacagcagaaacgggaguugcucacacuguaucgugaccaagauagagaauccccaucaaccaggcccaguacuccgagccuagagggcucccagucuagcgccgaagggcgcacaccugaguucucaaccauaauuccacaucugguugugacggaagacaccgaugaggacgcaccccucgucccugaugacacaagugauuccggauacgguacucugauccccggcaccccaacagggagccggucuccucuuucaagauugaggcagcgagcccugcgccgggaccccagauuaacuuuuaguacccucgagcugagggauauuccacuucguccgcacccucccgacccacaggcuccccaacgccggagcgccccugaacugccagagggaaucuugaagggcgguucccucccccaggaagauccuccgacauggucugaggaagaggacggggcaucggagagaggcaauguggucguggaaacccugcauagggcgcgacuacggggacagcugccaagcucccccacucacgcugacucagccggcgagaguccuugggaaucuagcggggaggaggaagaggaaggaccacucuuccugaaagcaggucacacgucccuucgccccaugagagccgaggauauguugagggaaauccgggaggagcuggcuucacagcgaauugaaggcgccgaggaaccuagagacagccgcccgaggaaguuaacacgugcacaacuccagcggaugagagggccccauauaauccagcuggauaccccacuuucugcuuccgagguuuga

SEQ ID NO: 60835 - RNA, 4482 nt, Artificial Sequence
  derived and/or modified sequence opt3 from PLEKHH2__Homo_sapiens__NP_742066
auggccgagcugagcgaacccgagggcccuguggacuggaaggaaagaugcgucgcucucgagucccagcuuaugaaauucaggguucaagcaucuaagauccgggaacuguuggccgagaaaaugcagcaguuagagcgccaggugauugaugcggaacgacaagcugagaaggccuuucagcagguacaggugauggaagacaaacugaaggcagccaacauacaaaccucagagagugagacacgucuauacaauaagugucaggaucucgaaagccugauccaggagaaagacgaugucauucagaaccuugaacugcaauuggaggaacagaagcagaucaggauucaagaggcuaaaaucauagaggaaaaggcagccaaaaucaaggagugggugacuguuaagcucaaugaacuggagcuggaaaaccagaaucucagauuaauuaaccagaaucagacggaggagauccggaccaugcaauccaaacugcaggaagugcaggggaagaaaucuucgacagucucaacucuuaaguugagcgagggacagcgccugaguucccuaaccuucgguugcuuucucucuagagcuaggagcccaccgcaagugguaaaauccgaagagaugucaaagauuaguagcaaagaacccgaguucacagagggcaaggacauggaagagauggaaaucccugagaagucuguugauaaccaggugcuggagaauaaccgggggcagcgcacccuucaccagacuccauguggauccgaacaaaaucgaaaaacaagaaccucauuugccacggacggcgguauaagccagaacaguggggcgcccgucucugauugguccagcgacgaggaagauggaucgaagggcaggucuaaaucccggugcacuucaacccugaguagccauacauccgaggaaggcgugcaguguucucguauggggagcgagauguauuugacugcaucagacgauaguuccagcauuuucgaggaagagaccuuuggaaucaagcgcccugaacacaaaaagcucuacucuuggcagcaagaggcccaguggaaggcuuuaaauucaccacuggguaaaggcaacagugaacugagcaagaaagagcaggacuccucuucggacgagcucaauaagaaauuccaaagccagagacuugauuauuccucaaguucuagcgaagccaacacacccuccccuauucugaccccagcauugaugccgaagcaucccaacucacuaagcgggaagggaacgcagcuggugccuucuucccaccucccacccccuaaacugaggaucccaaaugucuuuaguaucagcguugcucuugccaagcggcaucugucucagccccaauuguccucagaccgaauguucggcacuaaccgcaaugcgauuaguaugauaagaccgcucaggccucaggagacagaucuggacuuaguggauggugacagcaccgaaguacuggagaacauggauacuucgugcgacgaugggcuauuuuccuacgacucucucgauagccccaauucagacgaccaggaacacugugauagugccaaaaagguggcauauuccaaaccaccuacacccccacugcaccgguuccccucuugggagagccgcaucuacgcugucgccaaguccggaauuagaaugucagaggcuuuuaacauggaaagcgugaauaagaacagugccgcaacccuuucuuauacgaccuccggcuuguacacaagccugaucuacaaaaauaugacuaccccuguuuauacaacucucaagggcaaagccacccagauaucgucaucuccauuccuggacgauaguuccgggagcgaggaagaggacucuagcagguccucaagucguacaagcgagucugauucccggucacgaaguggaccggguagccccagagcuaugaagaggggcgugucccuuucuucggucgcgagcgaaucagacuacgcaauuccuccagaugccuauuccaccgacacugaguacagucaacccgaacagaaacugccuaagacgugcucuagcuccucagauaacgggaaaaaugagccauuggaaaagucuggauaucuccugaagaugagcggcaaagugaagaguuggaaacgccggugguucguauuaaaggguggggagcugcuauacuauaaaucccccagcgacguuaucagaaagccgcagggccauaucgagcucucugcuucauguuccauucugaggggagauaacaagcagacagugcaacuuaccacugaaaaacacaccuacuacuugacagccgacaguccuaauauccuggaggaauggauuaagguccuccagaacgugcugcgcguccaggcagccaauccauuaagccugcaacccgagggcaaaccuaccaugaaggggcuuuugacuaaagugaagcauggauauucgaagcgaguuuggugcacacucauagguaaaacgcuguacuauuuucggucucaggaagauaaguucccccuaggccagaucaaacugugggaggcuaagguggaggaaguagaccguuccugugacagcgaugaggacuacgaagccucagggagaagucuccugucuacccacuauacuauugucauccacccaaaagaucagggaccuacauaccuuuugaucggcuccaagcaugagaaggacaccuggcuguaucacuuaacaguggcagcggguagcaacaacguuaauguggggucagaauuugagcaacucgucugcaaacugcuuaacauugauggcgagcccaguagccagauauggaggcauccaacucugugccacuccaaggaaggaaucauuucuccguugaccacgcucccuagcgaggcucugcagaccgaagccaucaaacuauucaagacaugucagcuguuuauuaaugcagccguggacucccccgcuaucgauuaccauauaucacucgcccaaucugcacugcagaucugccuuacucacccagaguugcagaacgagauuuguugccagcugaucaaacaaacccgccggagacagccccagaaucagccuggcccauuacaaggguggcagcuccuggcucuuuguguaggacuguuccuaccccaccauccuuuucucuggcuguugaggcugcacuuaaagcgaaacgccgacagucgcacagaguucgguaaauacgcgauuuauugccagcgguguguggagagaacucaacagaauggcgauagggaagcccguccgucgcgcauggagauccucagcacccugcuucggaacccauaccaucacucccugcccuuuucuauaccuguucacuucaugaaugggauuuaucaggucgugggauuugacgcuucaacgacaguggaagaguucuugaacacccucaaucaggauacuggcaugagaaagccagcacaaagcgguuuugcccuguucacagacgaucccuccgggagggaccuagagcauugccugcagggcaacaucaagauuugugacaucauaaguaaaugggaacaggcuucuaaggagcagcaaccuggaaaaugcgaaggcacccgaacuguccggcuuaccuacaagaaucgccucuauuucagcguucaggccagaggggagacagauagggaaaaacuguugcugauguaccagacgaacgaccagaucauuaauggauuauuuccgcucaacaaggaucuggcacuugagauggcggcccuguugucacaaguggagaucggcgacuucgaacggcccuuuuccaccccagcuggucacgugacuaaccaguguaagguaaaucagacacucaaacaagucauugagaaguucuauccuaaacgauacagagaugggugcagugaagaacagcugcgccagcuaugccagaggcugagcacccguuggauggcccuucggggacauucugcagcugacugugugagaaucuaccucacaguugccaggaaguggcccuuuuucggcgcaaaacuguuuuuggccaagccaauaacuccuuccucauuagguagcaccuuccuguggcucgcugugcacgaagauggccugucgcuucuggaguauaacucuaugcgcuugauugucaguuacguguauaagucccuaaugacguuugggggauaccaagacgauuucaugguugugaucaauaacacacauagcaaagacaagcccaccgagaaacugcucuuugcgauggccaagccaaaaauccuggaaauuacucuuuuaaucgcaucauauauuaauaacuuccaccagcagaaggcugccuuucaccaucuguccgccccggcucucuugucugcacagacccgaggcccucaagccagaaugauggggagccagccccugcucaguuccagccggccaacaaagggacccacucugcuuuga

SEQ ID NO: 60836 - RNA, 3171 nt, Artificial Sequence
  derived and/or modified sequence opt3 from PLEKHM1__Homo_sapiens__NP_055613
augcugagcguggucgagaacggccucgacccccaggccgcuaucccuguuauuaagaaaaagcuggugggguccguaaaagcacuucaaaagcaguacgugucuuuggauaccgucgugacaucagaagacggagaugccaauacuaugugcagugcguuagaggcuguuuucauacacggucugcaugccaaacacaucagagcagaagccggcgggaagaggaagaaaagcgcucaucagaagccacuaccgcagcccguguuuuggccucuccugaaagcagucacgcacaagcauauuaucuccgagcuugaacaccugaccuucgugaacacagacguaggacggugucgcgccugguugcgacucgcucugaaugauggccugauggagugcuaucucaaauuacugcuucaagagcaggcccguuugcacgaauacuaucagccaacugcgcugcuaagagacgcagaggaaggugaguuucuccugucuuuccuucaggggcugaccucguugucauuugagcucagcuacaagagugccauucugaacgaauggacauuaacuccccuggcucucuccggacuuuguccucugucugaguuggauccacuaagcaccuccggcgccgaacugcaaaggaaggagucacucgacaguaucagccauucuuccggcucagaagauauagagguucaccauagcgggcacaaaauccggcgcaaucagaagcugacagcaaguucucuuucccuggacaccgcuagcucgucucaguuguccugcucacucaacagugauagcugucuguuacaggagaauggauccaaaucucccgaccacugcgaagaaccuaugagcugugauucagaccuggguacggccaacgcggaagacagugauagaucccuacaagaggugcuccuggaauuuagcaaggcccaggucaauucugugccaacuaacggccuuucacaggagaccgagauuccgacaccccaagcaaguuugagccugcaugggcucaauacuuccaccuaucugcacugcgaagcuccugccgagccacuucccgcucaggccgcaucuggaacacaggacggcgugcauguccaggaaccuaggccacaagcccccucgccgcuggauuugcagcagccuguugagagcaccuccggucagcaacccucaaguacggugucugaaacugcucgggagguagggcagggaaacggccuccagaaagcgcaggcacacgacggcgccgggcugaaguuaguggucagcuccccaacaucaccuaaaaauaagagcuggaucucugaggaugacuuuuaccgccccucccgagaacaaccacuggagagugcuagcgaucaucccauugccucuuauagaggaaccccugguuccaggccaggccuacaccggcacuucucacaggaaccgcguaagaacuguagucucggggcacuggaccaggccugcgugcccagcccuggacgcagacaggcucaagccgcaccaucgcagggccauaaauccuuuaggguugugcaccggcgacagaugggucuuucuaaucccuuccgcggguugaugaagcugggcacugucgagagaaggggagcgaugggcaucuggaaagagcucuuuugugaacugagcccuuuagaguuccggcuguaccuuucaaacgaggagcauacaugcguggaaaacugcaguuugcuccgcugugaguccguagggccagcucacucugauggaagauuugagcugguuuucagcgguaagaaacuagcccugagggcauccucacaagacgaagccgaggauuggcucgaccgugugcgggaagcucugcagaagguccgaccccagcaggaggacgaaugggugaauguccaauacccggaucagccugaggagccacccgaagccccucagggcugccuuagccccagugacuugcugucugagccagcagcuuuacaggggacccaauucgauugguccagcgcccaggugccugaacccgacgcgauaaaggagucgcuccuguaucuuuacauggauagaacguggaugccauauauuuucucacugucuuuggaagcccucaaauguuucaggauccgcaacaaugagaagaugcugagugacucccacggaguugagaccauucgggauauccuaccggacacaagccugggcgguccuuccuuuuucaaaaucauuacugcuaaggcagugcucaaacugcaggccgggaacgcugaagaggccgcacuuuggagagauuugguaaggaagguccuggcgagcuacuuagaaaccgccgaggaggcugugacacucggcggaucccuggacgaaaauugccaggagguucuuaaguuugccacucgcgaaaacggcuuccugcuacaauaucucguggcaauacccauggagaaagggcuggauucacagggauguuuuugcgcugguuguagucgacagaucggcuucagcuuuguccggccaaaguugugcgccuucucugggcuguacuauugugacauuugccaucaagaugacgcauccgugauccccgcccguauaauucacaauugggacuuaaccaaaagaccuaucuguaggcaggcucucaaguuucugacacagauccgcgcgcagccacuuauuaaccugcaaaugguaaaugccucauuguacgaacauguggagcggaugcaccucaucggaagaaggcgagagcagcugaaacuacugggcgauuaccuuggucucugccgcaguggggcacugaaggaauugagcaagcggcugaaccauagaaauuauuuacucgagucuccccacagguucucuguugcugaccugcagcagauugccgauggcgucuacgaaggauuucuuaaagcccugauagaguucgcuucgcaacacguguaucauugcgacuuguguacccagcguggcuucaucugccagauuugucagcaccaugauaucaucuuuccuuucgaauuugacacuacggugcgcugcgcagaguguaagacagucuuccaccaaagcugccaggccguugugaaaaagggguguccgcggugcgcgagaaggcgaaaauaccaggagcagaacauuuuugcuuga

SEQ ID NO: 60837 - RNA, 681 nt, Artificial Sequence
  derived and/or modified sequence opt3 from PLEKHO1__Homo_sapiens__NP_001291653
augcugacccucgaccuuauccaggaggaagaucccagcccugaggaaccaacauccugcgccgagucuuucagaguggaccuggauaagucagucgcucaauuggcaggcaguaggcggcgcgccgacagcgauaggauucagccguccgcggaccgugcuucuucguuaucaagacccugggagaaaacugauaagggggccacguacaccccucaggcacccaaaaagcugacaccaacugaaaaaggaaggugugccagccuagaggaaauacucagucagcgggacgcugcauccgcccgcacccugcaacuuagagcugaggaaccuccaacacccgcccugccuaacccaggucaguugucuaggauccaggaucucguugcgcggaagcuggaggagacccaggaacugcucgcagaggugcaaggcuuaggggacggaaagcgcaaagccaaggauccgccccgaagcccuccagacuccgaaucagagcagcugcuuuuggaaacugagagacugcuaggcgaggcuaguagcaauuggucucaggccaaaaggguacuccaggaagugcgggagcugcgugaucuuuaucgccaaauggaccugcagacacccgacucccacuugagacagaccacgccucauucacaauaccgaaagagccucauguga

SEQ ID NO: 60838 - RNA, 1473 nt, Artificial Sequence
  derived and/or modified sequence opt3 from PLEKHO2__Homo_sapiens__NP_079477
auggaggaagagggcgugaaggaagccggggagaaacccagaggagcucagauggucgacaaggcagguuggaucaaaaagagcuccggcgggcugcucggauucuggaaagauagguaccuucuguugugccaagcccaguuacugguuuaugaaaacgaggacgaucagaaguguguggagaccguagaacuaggcucuuacgagaagugccaggaccuccgggcgcugcuuaaacgcaagcaccgauuuauucuguugcguucaccugguaauaaagugagugauauaaaguuccaagcuccaacaggggaagagaaagagagcuggaucaaggcccucaacgaaggaauuaauagaggcaagaacaaagcauuugacgaggucaagguggauaaauccugugcccuggaacauguuacuagggaccgggugcgcggcgggcagagaaggcggccgcccacgcgcguccaccugaaggagguggcuucugcagccucggauggacucuuacgacuggaccuugauguaccugacucagguccacccguuuucgcuccuagcaaucaugugagugaagcccagccaagagagacccccaggccuuugaugccaccgacaaaacccuuucuggcgccugagacuaccuccccaggcgaucgggucgaaacacccgugggggagcgugcaccuaccccagugucugccagcuccgaagucucacccgagagucaggaagacagcgagacuccggcugaggaagacucuggauccgagcaaccucccaacucaguucuaccagauaagcucaaagugagcugggaaaauccuaguccccaggaggccccagcagcugaaucugccgagcccucccaggcgccuugcagcgagacaucggaagccgcaccacgcgagggcgguaagccgcccaccccuccacccaagauccugucugaaaaacuuaaggcuuccaugggggagaugcaggccucaggaccuccagcucccggcacgguacaagugagugucaacggcauggacgauagcccggagccugccaaaccaucccaggcagaagggacucccggaaccccucccaaggacgccacaacuucuaccgcucugccaccuugggauuugcccccacaguuccacccgagauguagcucacucggugaccuguuaggcgaggggccuaggcauccccugcaaccacgggaacgacucuaucgcgcgcagcuugaggugaaaguugcaagugaacagacagagaagcuguugaauaaggugcuaggauccgagcccgccccugucagcgcugaaacccugcucucucaggccguggagcaacugagacaggcaacgcagguacuucaggaaaugagggaucugggcgaguugucacaagaagccccaggucuccgggagaaacgcaaggagcugguuacuuuauacagaaggagugcucccuga

SEQ ID NO: 60839 - RNA, 1053 nt, Artificial Sequence
  derived and/or modified sequence opt3 from PLEK__Homo_sapiens__NP_002655
auggagcccaagagaaucagggaaggcuaccuggugaaaaaggggagcgucuucaacaccuggaaaccuauguggguugugcuccuugaggacggaauugaauuuuauaagaaaaaguccgauaauucuccaaaggguaugauaccgcugaaaggcucaacauugacgagucccugccaggacuucgggaagcggauguuuguauucaaaaucacuaccacaaagcaacaggaucacuuuuuccaggccgcauuuuuagaggaacgcgacgcuugggugcgagauauuaaaaaggccaucaaguguauugagggaggccagaaauucgcgcguaagagcacuagaagguccauccggcugccugagaccauagaccuaggugcucucuaccugucuaugaaagauacagaaaaggggaucaaagagcuuaaccuggaaaaggacaaaaagauuuuuaaucauugcuucaccggaaacugugucaucgauugguuggugucgaaucaaucaguucgcaacagacaggagggccucaugauugccagcagucugcugaaugagggcuaucuccagccagcaggggacauguccaagucugccguggauggaacugcugaaaaccccuuuuuagacaauccugaugcauucuacuauuuuccagacagcgguuucuucugcgaggaaaacuccucagacgaugacgucauccugaaagaggaauuuaggggcgugauaauuaagcaggggugucuuuugaaacaaggacaccggcgcaagaauuggaaaguacgaaaguucauccugagagaggaucccgccuaccuacauuauuacgacccugcuggcgccgaggauccacucggugcgauucaccugagggggugcguugugacaagugucgaaagcaacucuaauggacggaaguccgaggaagagaaccuuuuugaaaucaucaccgcagacgaggugcauuacuuccugcaggccgcuacgccgaaagagcguacugaauggauucgcgccauacagauggcaucaagaaccggcaaguga

SEQ ID NO: 60840 - RNA, 2433 nt, Artificial Sequence
  derived and/or modified sequence opt3 from PLG__Homo_sapiens__NP_000292
auggagcacaaggaagugguccugcuccuucuguuguucuuaaaaagcggccagggggagccccuggacgauuacguuaacacccaaggagccucccuauuuucugugacaaagaaacagcucggugcuggcucaaucgaagagugcgcagccaagugugaagaggacgaggaguucacuugcagagcguuucaguaucauaguaaagaacagcaauguguaauuauggcugaaaauaggaaaagcuccauaaucauucggaugcgcgaugugguccuguucgagaagaaaguguaccuuucugagugcaagacggggaacggaaagaauuaucgaggcaccaugucgaagaccaaaaacgguaucacuugucagaaguggucaagcaccaguccucaccguccaagauuuuccccggccacacaucccucugaagggcuggaggaaaauuacugcaggaacccugacaaugauccacagggacccugguguuauaccacugacccugagaagcgguacgauuauugcgacauuuuggaaugugaggaggaaugcaugcacuguagcggcgagaacuacgauggcaaaaucuccaagacaaugucagggcucgaaugccaggcaugggacagucaaagcccacaugcccacggauacauacccucuaaauucccuaauaagaaccugaaaaagaauuauugccgcaacccagauagagagcugaggccgugguguuuuaccacggaccccaauaaacggugggaacucugcgauaucccucgcuguacuaccccacccccuuccucagguccaacauaccagugcuuaaagggcacuggggagaacuaucgaggaaauguugcugugaccgucagcggccacacaugucagcauuggagugcacagacaccccacacgcauaacagaacuccggagaacuucccuugcaagaaucuggacgaaaacuacuguaggaaucccgacgguaaacgggccccauggugccacacaaccaacucucaagugcguugggaguauuguaagauuccuuccugcgauagcucgcccguaucuacugaacagcuugcuccaacagccccuccugaguugaccccaguugugcaggacuguuaccacggggauggacaauccuaucgcggcacgucaaguaccacaacuaccggcaaaaagugccagagcugguccucuaugacaccgcauagacaccagaaaacucccgaaaauuacccuaacgcggggcugaccaugaauuacugcaggaacccagacgcagauaagggacccugguguuuuacaaccgacccuagcguccggugggaguauugcaaucuaaagaaauguucagguacugaggccagugugguggcuccacccccggucguucuccugccugauguggaaacgccauccgaggaagacugcauguucggcaacgggaagggauaccgaggcaaacgcgccacaaccguaacugguacccccugucaggauugggcagcucaagagccucauagacacagcaucuuuacacccgagaccaauccaagggccgggcuugaaaagaacuauugccggaauccugacggcgaugugggaggccccugguguuacacuacaaacccacgcaaacuguaugacuacugcgacgucccgcagugugcggccccuucuuucgauugcgggaagccccagguggagccaaagaaaugucccggaagaguuguggguggcugcgucgcacauccucacucauggccauggcaagugaguuugaggacgcguuuugggaugcacuucugcggaggcacccucauuagccccgaauggguacugacugcugcccauuguuuagagaaguccccucggccgucuucguauaaaguuauccugggugcucaccaggaagugaaucucgagccacauguccaggagauagaagugagccgacuuuuccuggagcccacaagaaaggacauugccuugcuaaaacuguccucacccgcagucaucaccgauaaggugauuccagccugccuccccaguccuaacuacguuguggcugacaggacagaauguuuuaucacuggguggggcgagacccagggaacguucggcgcggggcugcuuaaggaagcacagcugccgguaaucgagaacaaagucugcaaucgcuacgaguuuuugaacggacgggugcaaucuaccgaacucugugccggucaccuggcuggcgggacagauagcugccagggagacuccggcggucccuuaguuuguuucgagaaggauaaauauauucugcagggggugacuucauggggccuaggaugcgccagaccaaauaagccuggcgucuacgugaggguaagccgcuuugugaccuggauagaagggguuaugcgaaacaauuga

SEQ ID NO: 60841 - RNA, 291 nt, Artificial Sequence
  derived and/or modified sequence opt3 from PLGLB2__Homo_sapiens__NP_002656
auggagcacaaggaagugguccugcuccuucuguuguucuuaaaaagcggccagggggagccccuggacgauuacguuaacacccaaggaccuucccuauuuucugugacaaagaaacagcucggugccggcucaagagaagagugcgcugcaaagugugaagaggacaaagaguucacuugcagggccuuucaguaucauaguaaggaacagcaauguguaaucauggcggagaaucgcaagagcuccauuauaauccggaugcgagaugcugugcuguucgaaaaauga

SEQ ID NO: 60842 - RNA, 1569 nt, Artificial Sequence
  derived and/or modified sequence opt3 from PLIN1__Homo_sapiens__XP_005254991
auggccgugaacaagggccugacccuccuugacggggaucugcccgagcaggaaaaugucuugcaaagaguuuuacagcugccugugguaagcggaacaugcgaguguuuccagaaaacuuacacguccaccaaggaagcucacccucuaguggcaucugucugcaacgccuaugagaaaggugugcagucagcgaguagccucgcugccugguccauggaaccgguugugaggcggcugucuacacaauuuacugcagccaaugagcuugcuugucgcggccuggaccauuuggaggaaaagauccccgcacuccaguacccuccagagaaaauugccucggaacugaaggauaccauaucaacacgacugcguagcgcuagaaacaguaucuccguccccauugccucuaccagcgacaaggugcucggggcggcauuagccggaugcgagcuggcuuggggcguagccagggauacugcagaguucgcugccaauacacgggcgggucgccuugccuccgggggagcagacuuggcucugggcucaaucgaaaaaguuguggaguaucuacucccuccagauaaggaagagagugcccccgcuccuggccaccagcaggcccagaaaagcccaaaggcaaaaccgucucugcuuuccagagucggggcccugaccaacacguugucaagguacacugugcaaaccauggcucgggcgcucgaacagggacauacaguggcaauguggauucccggugucguuccucugagcaguuuagcccaguggggcgcuucuguggccaugcaagcaguaucccgccgaagaagcgaggugagggucccauggcugcacucgcucgccgcugcccaggaggaagaccaugaggaucagacugacaccgaaggggaggauacagaagaggaggaggaacuugaaaccgaggaaaauaaguuuucugagguggcagcgcugcccggaccucggggcuugcuaggugggguugcucacacgcugcaaaagacucuccagacaaccaucuccgccgugacuugggcaccagccgcuguccugggaauggccggccgugugcuucaccugacacccgcaccggcuguaucaaguaccaaaggccgcgccaugagcuuguccgacgcgcucaaggggguuacggauaacguggucgacaccgugguccauuaugugccucugcccagauuaucucugauggagccagaaagcgaguucagggacauagauaauccucccgccgaaguugagcggcgagaggcugaacgcagagcaucaggagccccaagugcuggucccgagccugccccaaggcuagcacagccgcggcgcucccucagaagcgcgcagucucccggcgccccuccagggcccggacuggaagacgagguggcuacaccagccgcaccaaggcccggcuuuccggcuguaccucgugaaaaaccaaagcggcgagucucagauaguuucuuuagacccagcgugauggagccuauccuugguaggacucacuacucccaauugcgcaaaaagucuuga

SEQ ID NO: 60843 - RNA, 1314 nt, Artificial Sequence
  derived and/or modified sequence opt3 from PLIN2__Homo_sapiens__NP_001113
auggccagcguggcugucgacccccagccuuccguugugaccagaguagugaaccugccacucgucucuucaacauacgaucuuaugaguagcgcauaucuguccacuaaggaccaauacccguauuugaaaucugugugcgagauggccgaaaauggcguuaagacgaucaccucgguggcgaugacaucagcuuuacccauuauacagaaacuggagccucagaucgccgucgcaaacacuuacgccuguaaggggcuagauaggauugaggaacggcucccaauccugaaucagcccagcacccaaauuguggcuaacgcaaaaggagccguaacaggugcuaaggacgccguuaccacuacagugaccggcgcgaaggauagugucgcauccacgaucacuggggugauggacaaaaccaagggagccgugacaggcucugucgaaaagacuaagagcguuguguccgguucaauaaauaccguacuugggagucgcaugaugcagcuggugagcucuggagucgagaacgcuuugacaaaauccgagcuccugguggaacaguaucugccucucaccgaggaagaguuagagaaggaagccaagaaaguugagggcuucgaucuggugcagaagccaucauacuauguccgacuuggcagcuugaguacgaaacugcacucucgugcauaccaacaggcucuauccagagugaaggaagccaaacaaaagagccagcagacuaucucgcagcuccauucuacaguacaccugauugaguuugcgaggaaaaauguuuacuccgccaaccagaagauccaagacgcacaggauaaacuuuaucugucauggguggaauggaaacggaguauuggguacgacgauaccgacgagagccauugcgcugagcacaucgaaucccgcacuuuggccauagcuagaaaucucacacagcagcugcaaaccacgugucauaccuuacugucuaacauucagggagucccccagaauauccaggaucaagccaagcacaugggugugauggcaggcgacauuuauagcgucuucaggaacgccgcuucauuuaaagaggugagugacucccuccuuacaagcucuaaggggcagcugcagaaaaugaaggaaucauuggaugacguuauggauuaccuagugaauaacacuccucugaauuggcucguaggaccauucuauccgcagcugaccgagagucaaaacgcgcaggaccagggcgcagaaauggauaagagcucccaggagacacaacggucugagcacaaaacucauuga

SEQ ID NO: 60844 - RNA, 1269 nt, Artificial Sequence
  derived and/or modified sequence opt3 from PLIN3__Homo_sapiens__NP_001157666
augagcgccgacggcgcugaggcagauggguccacccaggugacagucgaggaacccguucaacagccuucugugguagacagaguggccucaaugccacugaucaguagcacuugcgauauggucuccgcggcuuacgccucuacgaaggaaucguauccgcacauuaaaaccgugugugacgcagccgagaagggaguuaggacacucacugcugcagccgugucaggugcucagcccauacuuagcaaacuggaaccucagaucgccagugcguccgaguacgcacaucggggcuuggauaaguuagaggaaaaccugccaauucuacaacagcccaccgagaaagucucuggggcccaggaaauggugagcuccgcuaaggacacaguagccacccagcucucagaggcaguugaugcuacucgcggagccgugcaaaguggcgucgacaagacaaaaagcguggugaccggugggguccagucuguuaugggaucccgacugggccagauggugcuuucaggcguagauacggugcuggggaagucugaggaaugggcggacaaucacuugccucucacugaugccgagcuggcacguaucgcuaccagucuggacggauucgaugucgccucugugcagcaacagagacaggaacaauccuauuuuguuaggcucgguagcuuaucggagcggcugcgccagcaugcuuacgaacacucucuuggcaaauugagagccacaaagcagagggcacaggaggcccugcuacaacucucccaggugcugucacuuauggagacugucaaacaggggguggaccagaagcugguagaaggacaagagaaguugcaucagauguggcucaguuggaaccagaaacagcugcaaggcccagaaaaggagcccccuaaaccagaacagguugagagccgggcuuuaaccauguuccgcgacauugcgcagcagcugcaagcaacaugcaccucccucgguucuagcauccaggggcuuccgacgaaugugaaggaucagguccaacaggcccgaagacagguggaggaccugcaggcuacuuuuucaaguauacacuccuuccaagauuugagcagcucaauccuagcccagaguagggaacgggucgcaagcgcccgugaggcucuggaccacaugguggaauauguugcccagaacacacccgugaccuggcucguaggaccuuuugcaccaggcauuacugagaaagcgcccgaagagaagaaauga

SEQ ID NO: 60845 - RNA, 4074 nt, Artificial Sequence
  derived and/or modified sequence opt3 from PLIN4__Homo_sapiens__NP_001073869
augcagacccugggcagcuucuuugggucccuccccggauucucuucagccagaaaccuuguggcuaaugcacacaguagcgccagggcgcggccugcugccgacccaacaggugcaccggccgcugaggcagcccaaccccaggcucaggucgccgcgcauccugaacagacugcaccauggacggagaaggaacugcaacccuccgagaaacagaugguuucuggcgccaaggauuuggugugcucgaaaaugucacgcgcuaaggacgccguaagcagugggguggcauccgucguggauguugcuaaaggagugguccagggcgguuuagacaccacacgaucugcccugacugggaccaaggaagugguaagcuccggaguuacaggcgcgauggauauggccaagggcgcagugcaagggggacuagacaccucaaaagcuguccucacugguacaaaggauaccgugaguacgggccugacuggggccgugaacgucgcuaaaggaaccguucaggccggcguggacacaacuaagaccguacuuacagguaccaaagauacggugacuacaggggucaugggagcagugaaucuggccaagggcaccguucagacuggcguggagacaagcaaggcugucuugaccgggacgaaagacgcggugucuaccggacucacaggugcaguaaacguugcccguggcuccauccagacugggguggauaccucaaagacaguccugacuggaaccaaagacacaguguguagcggcgucaccggugcuaugaauguggccaaggggacuauucagacgggcguugauacaaguaaaaccgugcugacuggaaccaaggacacaguaugcucuggcgucaccggggcaaugaacguggccaaaggaacuauacaaacagguguugacacguccaagaccgugcucacuggcacaaaggauaccgucuguagcggggugacaggagcuaugaauguagccaaaggcacuauccagaccgguguggacacgaccaagacaguuuuaacugggaccaaaaacacagucugcucgggcgugacuggagcagugaaucuggcgaaggaggcuauucagggcgggcuugauaccacgaaaucuauggucaugggaacaaaggacaccauguccacugguuugacaggcgccgcaaacguugccaagggggcuaugcaaaccggacugaauacuacccagaacaucgccacaggcacgaaagauaccguguguucaggugugacuggggcaaugaaucuagcuagaggcacaauucagaccggaguagacacaacuaagaucguccucaccggcacgaaagauacagugugcagugggguuaccggagccgcgaacguggccaagggcgcuguccagggugggcuggacacuaccaaaagcgugcuuacaggaacuaaggaugcaguuuccaccggccugacaggugccgugaauguagcuaagggcacgguccaaaccgggguggacacuacaaaaaccguguugacuggaacaaaggauaccgucuguucuggcguuacgagcgccgugaacguagcaaaaggggcggugcagggaggccucgacacuaccaagucagucgugauagguacaaaagacaccaugaguacugggcugacaggagccgcuaacguugccaagggcgcagugcagaccggugucgauacagcuaagacuguguuaaccggcacgaaagacacaguuaccacugggcuggugggagccgucaauguagcaaagggcaccgugcagacagggauggauacuaccaaaacgguucucacaggaaccaaggacacuaucuacuccggcgugacaagcgccgucaacguggcuaaaggugcgguacaaaccgggcuuaagacuacacagaauauugccaccggaacgaaaaacacuuuuggcucuggugugaccucagcagucaauguugcuaagggcgccgcccagacagggguggauaccgcuaagacagugcugacuggaaccaaagacacggucacaacuggcuugaugggggcagugaacguugccaagggaaccguacagacaaguguggauaccacuaaaaccguccuaacaggcacgaaggacacugugugcagcgguguuaccggggcggcuaauguggccaaaggagcaauccaaggcggccuggauacaaccaaguccguccucacugggacaaaggacgccgugucuaccggacugacgggugcuguaaaacuugcaaagggcacuguccagacagggauggauaccaccaaaacugugcugacaggaaccaaggacgccguuuguucgggcgugacaggugcggcuaacgucgccaaaggggcagugcagaugggaguugauacugccaagacgguguugaccggcacaaaggacacugucugcagcggcgugaccggggcugccaauguagcaaaaggagcugugcagacaggucucaagaccacucaaaacauugccacgggcaccaaaaauacacugggguccggaguuacuggcgcggccaaggucgcaaaaggugcugugcaagggggauuagacaccacaaagucagugcugaccggcacuaaggaugccgucaguacaggccuaacgggggcuguaaaccucgcaaaaggaaccgugcagacugguguugacacaucuaagaccgugcugaccggcacaaaagauacugucuguagcggggugacgggagccguuaauguggccaagggcaccguccagacagguguggacacugcuaaaaccguacuuuccggggcgaaggaugcagugacaaccggaguuacuggcgccgucaacguggcuaaaggcacggugcagacaggggucgacgccucaaaggcaguuuugaugggaaccaaggauacuguguucagcgguguaaccggcgccaugucuauggcuaaaggggcggugcagggaggccuggacacaacuaagaccguccucacagguacgaaagaugccguguccgcagggcugaugggaaguggcaauguugcuaccggcgccacucacacagggcuuagcaccuuucagaacuggcugccuucuacuccagcaacauccuggggagguuugaccucaaguaggacgaccgacaacggcggggaacaaacagcccucagcccccaggaggcuccuuucucgggaaucuccacuccaccggaugugcugucugucggccccgaaccugccugggaggcggcagccaccacaaaggguuuagcuacugacguagccaccuuuacacagggggcugcaccaggccgggaggauaccggacugcuagccacuacgcauggccccgaagaggcuccucgccucgccaugcugcagaaugaacuugagggguugggagacauauuccacccaaugaacgcagaggaacaagcgcagcuggccgcuagccagcccgguccgaaagugcucucagccgagcagggcaguuauuuuguuagacugggggacuuaggaccuuccuucaggcaacgggcauuugaacaugcugugucucaucugcagcacggccaguuccaagcccgcgauacacuugcacaguugcaggacugcuuucgacucauugagaaggcccagcaagcucccgaaggucagccaagacuggaucaggggagcggcgcguccgccgaggacgcagcuguccaggaagagagggaugccggagugcuaucacgggucugcggccugcuccgucaacugcacaccgccuacagcgggcuugugaguucuuugcagggacugccugcagaguuacagcagcccguuggucgcgcuagacacucccucugugaacuguauggcaucguggccagcgcggggucgguagaggaacuuccagcugagaggcuggugcaaucacgggaaggaguccaucaggccuggcagggcuuggagcagcuccuggagggucuacaacacaaucccccucugucuuggcucguugggccauucgcacugccggccggcggacaguga

SEQ ID NO: 60846 - RNA, 1392 nt, Artificial Sequence
  derived and/or modified sequence opt3 from PLIN5__Homo_sapiens__NP_001013728
augagcgaggaagaggccgcucagauccccagauccucugugugggaacaagaccagcagaacgucguucagagggugguagcacugccucucgugcgggcgaccugcacagccgucugugauguguacucagcugccaaggaccgccacccacuucugggcagugcaugccgauuggccgagaauuguguuugcggguuaacuacgcgugcucuggaucaugcacaaccgcuacucgaacacuugcagccccagcuugccaccaugaacagccuggcuuguagaggauuggacaaacucgaggagaagcugccuuuccugcagcaaccauccgaaacaguggucacuucugccaaagaugugguagcgucgucaguuaccgguguggucgaccucgcaaggcggggccgcagauggagcguggaguuaaagaggagugugucccaugccgucgauguugugcuggaaaaaucugaggagcuuguagaccacuuuuugcccaugacagaagaggaacuggcugcccuagcagcugaggccgaagggccugaggugggaagcgucgaggaucagcggcgccagcagggcuauuucgugcgacucgguucccugucagcgagaauuaggcaucuugccuacgaacacaguguugggaagcugcggcaaagcaagcaccgugcacaggacaccuuggcucagcuccaagagacucuggaauuaauagaucauaugcagugcggagugacaccaaccgcccccgcuuguccuggcaaaguccacgagcuguggggcgaaugggggcagcgcccaccggagucuagaaggcggucccaggccgagcucgaaacgcuugugcugucacgaagccugacucaagagcuacagggaaccguagaagcacuggagaguucuguucgcggucuccccgccggcgcucaggaaaagguggcggaggucagaagguccguggacgcacugcagacagccuuugcugaugcccggugcuuccgcgacgucccugcagccgcucuugccgaggggagaggaaggguggcacaugcgcacgcuuguguugacgaacuguuggagcucgugguacaagccgucccacugcccugguuagugggcccuuuugcaccaauccugguugaacgucccgagccgcuaccugaucucgccgaccugguggaugaggucauuggugggcccgacccacggugggcucaccuugauuggccugcccagcagcgagcaugggaagcugagcauagagacggaagcggcaauggcgauggggacaggaugggaguggccggugauaucugcgaacaggagcccgaaacuccaucgugucccguaaaacacaccuugaugccugagcuggacuucuga

SEQ ID NO: 60847 - RNA, 1812 nt, Artificial Sequence
  derived and/or modified sequence opt3 from PLK1__Homo_sapiens__NP_005021
augagcgccgcugugaccgcaggcaagcuggccagagcgcccgcugacccugggaaagccggagucccagguguugcagccccgggcgcucccgcagccgcuccuccagccaaggagauccccgaagugcucguagauccuaggucccggcgccgauacgugcgugggagauuccuuggaaaaggcgguuuugcgaagugcuucgagauuucugacgcagauacaaaagaagucuuugccgggaagauagugccaaagucacuguuguuaaaaccccaccagagggagaagaugaguauggaaaucagcauucaucggucccuggcucaccaacauguugugggauuccacggcuuuuucgaggacaacgauuuugucuucgugguacuagagcucugucgcagaaggucucugcuugaacugcauaaacggcgcaaggccuugacugagccugaagcacgauauuaccucagacagaucguucugggcugccaguaucugcacaggaaucgggugauucaccgugaccucaaauuagggaaccuguuucuuaaugaggauuuggaggucaagaucggagacuucggucuggcuacgaagguggaauacgauggcgagcgcaaaaagacccuaugugggacaccaaacuauauagccccggaagugcucucgaaaaagggacauucauuugaggucgacguuuggagcaucggcugcauuauguacacucugcuuguggguaaacccccuuucgaaaccaguugucugaaggagacauauuugagaaucaaaaagaaugaguacuccauuccaaagcacaucaaccccguagcggccucucucauacagaaaaugcugcaaaccgauccuacugcaaggccaacaauuaaugaauuacugaacgacgaguuuuucaccagcggguacauccccgcucggcucccgauuacgugccuuacuaucccuccccgauucuccaucgccccaucaagucuggauccuagcaaucgcaagcccuugaccgugcuaaacaaaggacuggaaaauccacuccccgagagaccuagggaaaaggaggagccagucgugcgggaaacaggcgagguuguggacugucaucugucugacaugcuucagcagcugcacuccgucaacgcuucaaaaccgagcgaacgcggcuuggugagacaggaggaagccgaggaucccgcaugcauuccuauauuuuggguaaguaaguggguugacuauucugauaaguacgggcucggauaucaacugugugacaauuccgugggugucuuauucaacgauagcacuaggcugauccuauacaaugacggcgauucgcuccaguauauugagcgugacgggaccgaaucuuaccugacaguguccucacacccaaacagucuuaugaaaaagaucaccuugcugaaauauuuucggaacuacaugagcgagcaucuccugaaggccggagcuaauauaacgccccgagaaggcgaugagcuugcgagacugccuuacuugaggacuugguuccgcacacgguccgcaauuauccuccaccugucuaacgguagcguccagaucaacuuuuuccaggaccauaccaaauuaauucugugcccacuaauggccgcugugacuuauaucgaugagaagagagacuuuaggacauaccgccucucacugcuugaagaguauggguguugcaaggaauuggccagucgacugcgguacgcacguaccaugguugacaaacuccuguccagcagaucugccucaaauagguuaaaggcuaguuga

SEQ ID NO: 60848 - RNA, 2016 nt, Artificial Sequence
  derived and/or modified sequence opt3 from PLK2__Homo_sapiens__NP_001239155
auggagcugcucagaaccaucacauaccagcccgccgcuagcacuaagaugugcgaacaagcacuuggcaaaggguguggagccgacuccaagaaaaagaggccuccacagccgcccgaggaaucucagccuccacagucacaagcucaggugcccccugcgauuagucggauaaucgucgauccaacgaccgguaaacgcuauugccgaggcaagguucuggggaagggaggcuucgccaaauguuacgagaugacagacuugacuaacaauaagguguaugcagccaaaauuaucccccacagccguguagcuaagccucaucagagagagaaaauugauaaggagaucgaguuacacaggauacugcaucacaagcaugugguccaguuuuaccacuauuucgaagacaaagagaacaucuacauucuacucgaauauugcucccggcgcucuauggcacacauccugaaggccagaaaagugcuuaccgagccagagguuagguacuaccugcggcaaauugugucggguuugaaguaucuccaugaacaggagauccugcaccgcgaucugaaacucgggaacuuuuucauaaaugaagcuauggaguuaaaggucggagacuuuggccuggccgcgcgacuugaaccguuggagcauagaaggcggacaauuuguggcacccccaauuaccugucaccugaggugcuaaacaaacaggggcacggaugcgaaagcgauaucugggcacucgguuguguaauguauacuaugcugcuuggccguccacccuucgagacaaccaaucugaaggaaacguaccgcugcauuagagaggccagguauacuaugccuaguuccuugcucgcuccagccaagcaccugaucgcaucuauguuaagcaaaaaccccgaagaccggccgucccuggaugacaucauucgacaugacuuuuuccuccagggguuuaccccugaucgccuuucaaguagcuguugccacacaguucccgauuuccaucugucuuccccagcuaagaacuuuuucaaaaaggccgcggccgcauuguuuggaggcaaaaaggacaaggcuagauacauagacacucacaauagggugucaaaagaggaugaggacaucuauaagcuacggcaugaucugaaaaagaccagcauuacacaacagccuaguaaacaccgcaccgacgaagaacuccagcccccaacgacuacagucgccagaucugguacccccgcuguggaaaauaagcaacagaucggggaugccauaaggaugauugugcguggaacucugggcuccuguagcucgucuuccgagugccuugaagacucaacaaugggcagugucgcagauaccguugcccgggugcugcgagggugcuuggagaacaugccugaggcugacuguaucccaaaggaacagcucagcacguccuuccaguggguaaccaaauggguggauuacucuaauaaguacggauucgguuaucaacugagcgaccacacagucggcguguuauuuaacaauggggcgcauaugucacugcuaccggauaaaaagacuguucacuacuaugcagagcucggacagugcaguguguuccccgccaccgacgcuccugaacaguuuaucucccaggucacagugcugaaauacuucagccauuauauggaggagaaccuuauggacggcggugauuugccaucuguaacugacauuagaaggccccgccuguaccuccugcaauggcuuaagucagauaaggcccugaugauguuguuuaacgacgggaccuuccagguuaauuuuuaucacgaucacacaaaaaucauuauauguagucagaacgaagaguaccuccugaccuacaucaaugaagaccggauuagcacuacguucagauuaacaacccugcuaauguccggcuguucuucggagcucaagaacaggauggaauaugcacugaauaugcuuuugcagcgcugcaacuga

SEQ ID NO: 60849 - RNA, 2817 nt, Artificial Sequence
  derived and/or modified sequence opt3 from PLK4__Homo_sapiens__NP_001177728
auggcuaccugcaucggcgagaagauugaagacuucaaaguggggaaccugcucggaaaggguagcuuugccggcgucuacagagcagaguccauacacacagggcuugaaguugccaucaaaaugcuguauaauuacuucgaggauucuaacuauguguacuugguauuagaaaugugucauaauggagagaugaacagguaucugaagaaucgggugaaacccuuuucagagaacgaagcgcgccacuucaugcaucagauuaucacuggcaugcuauaccuccacagucaugguauucugcaccgagaccuuacgcugagcaauuugcuccugacccguaacaugaauaucaagauagcugauuuugggcuggccacacaacucaagaugccucacgagaaacauuauacuuuaugcggaaccccaaacuacaucuccccggaaauugcaacaagaucugcccacggccuggagucggacgucuggucacuuggcuguauguucuacaccuugcugaucgggaggcccccuuuugauacugacacagugaagaauacccuaaacaaaguugugcucgcugauuaugagaugccaucguuccugaguauugaagcaaaggaccuuauccaucagcuguugcggcgcaaucccgccgauagacucucccugucuagcgucuuagaccacccuuuuauguccaggaacucaaguacgaaaagcaaggaucugggaacuguggaggacucuauagauuccggucacgcuaccauuucaacagccaucacugcgagcaguucuaccuccauuagcggcagccucuucgacaagcggcgccuucugaucgggcagccauugcccaauaaaaugacaguauuuccuaagaacaaaucuuccaccgacuucucaaguagcggagauggcaacuccuuuuacacgcagugggguaaucaagaaacuucuaacagcgggcgaggaagaguuauccaggacgcagaggaaaggccacauucacgguaucuacgucgcgccuacaguuccgauagaagcggcacaucuaauucacagagucaggcuaagaccuauacuauggagaggugccacagcgccgagaugcuguccgugucuaaacggucgggcgggggagaaaacgaggaacgauacagcccgacagacaauaacgcaaauauuuucaacuucuuuaaggagaaaaccuccucaaguucugguagcuucgaacgccccgauaauaaccaagcucucuccaaucaucuguguccuggcaagacgccauuucccuucgccgacccuaccccacagacagagacuguccagcagugguuugggaaccuucaaauaaaugcgcaccugagaaagaccacagaguaugauucaaucagccccaacagggacuuccagggacauccggauuugcagaaagacacuucuaagaaugccuggaccgauacaaaagugaagaaaaacuccgacgcaagugacaacgcucacagcgugaagcaacagaauaccaugaaguacaugacugcccuccacucuaaaccugaaauuauccagcaggagugcgucuuuggcuccgauccccugucagaacaaaguaagacgcgggguauggagccaccuuggggguaccagaaccgcacauuaagaagcauaaccucgccccugguugcucauaggcuaaaaccaauucgucagaagacuaaaaaggccgugguauccauccucgacucugaagaggugugugucgagcuggugaaggaauaugcaagccaggaguacguuaaagaagugcuucaaaucucaagugauggcaauaccauuacaaucuauuaccccaacggaggccggggguucccuuuggccgaccgaccaccgucccccaccgauaauauuucuagauauagcuuugacaaccugccugagaaguacuggaggaaauaucaguacgcuucccgcuucguccagcucgugcggucaaagagcccaaaaauaacuuacuuuacaagauaugcgaagugcauccugauggagaauagucccggagcagauuucgaaguaugguuuuacgacgguguuaagauucacaaaacggaggauuucauccaggugaucgaaaagaccggcaaaucuuauacucuuaaguccgagagcgaagucaacucgcugaaagaggagauuaagauguacauggaccaugccaaugaagggcacaggauauguuuggcucucgagucaaucauuucugaagaggaacgcaaaacacgaagugccccuuucuuuccaaucauuaucggacggaagcccggcuccaccagcucuccgaaggcacugagcccuccacccuccguggauucaaacuauccuacacgugagagagccaguuucaauaggauggucaugcacagcgcugccucucccacucaagcaccaauauuaaacccuuccauggugaccaaugagggucuggggcuaacgaccacagcgucaggcacugacaucaguagcaacucccucaaagauugccugcccaagucugcucagcuuuugaaaucgguuuuugugaagaauguaggaugggccacccagcugacaagcggcgcagucugggugcaguucaacgacgggucacaacucguugugcaggccggagucuccaguauuucuuacacuagcccaaacggucagaccacgcgcuauggcgaaaaugagaaacugccggacuacaucaagcaaaaguuacagugucuguccucaauucuuuugauguuuucuaacccuacacccaauuuccauuga

SEQ ID NO: 60850 - RNA, 1011 nt, Artificial Sequence
  derived and/or modified sequence opt3 from PLK5__Homo_sapiens__NP_001230008
auguacaccgugcugacaggcacucccccuuucauggccagcccacucuccgagauguaucagaacaucagagaagggcacuacccggagcccgcucaucuuucugcaaaugccaggcggcugauuguccacuuguuagcgccuaacccagcugaacgccccucacuggaccaucuacuccaagaugacuuuuucacgcagggauuuaccccugaucgacugccagcccacaguugccauagcccucccauauucgcaaucccaccgccccuuggucguauuuuuagaaagguuggccagaggcuguugacacagugucggccuccaugccccuucacuccuaaagaggccuccgggccaggagaaggcggucccgacccggauucuauggagugggacggggagucgucacucagcgcuaaggaagugccuugucuggagggacccauccaccugguagcacaaggcacccuccagagugauuuagccggcccagaagggucccgcagaccugagguggaggcugcccugaggcaccuucaguugugccuggacgucggacccccagcgacacaggauccccuaggugaacaacagccuauucucugggcaccaaaauggguggacuauucuagcaaguacggcuuuggguaucagcugcuugauggaggccggaccggucgccauccgcacgggcccgccacuccucgaagagagggaacacugccaacccccguuccuccagcuggccccggcuugugucuccugagguucuuagccuccgaacaugcacugcuccuucuguuuucaaaugggauggugcaggucaguuucagcggagugccggcucaauugguacuaucuggugagggcgaagggcugcagcucacgcugugggagcagggauccccuggcacuucauacagccuugacguuccacggagucacgguugcgcccccaccacagggcaacaucugcaccacgcguugcguaugcuccagucuaucuga

SEQ ID NO: 60851 - RNA, 549 nt, Artificial Sequence
  derived and/or modified sequence opt3 from PLLP__Homo_sapiens__NP_057077
auggccgaguuccccagcaagguguccaccagaacaucuaguccugcucagggcgcagaagccucagucagcgcgcugaggccagaccucggguuuguucggucccgccuuggagcucugauguuguuacaacuggugcuaggucuccugguaugggcccuuaucgcagauacuccguaccaccuguaucccgccuacggcugggugauguucgucgcuguguuuuuguggcucguuacgauugugcuguucaaccuguaucucuuucaguuacauaugaaacuguacauggucccuuggccacuuguguugaugauauucaauaucucugcaaccguacuguauauuacagccuuuaucgcuugcucggccgcgguugaccuaacuucacuccgagggacccgucccuacaaccagagagcagccgcuagcuucuuugccugucuggugaugauugcauauggagucagugcuuucuuuuccuaccaggccuggaggggcguggguucuaaugcggccacaagccaaauggcagggggauacgcuuga

SEQ ID NO: 60852 - RNA, 159 nt, Artificial Sequence
  derived and/or modified sequence opt3 from PLN__Homo_sapiens__NP_002658
auggagaaggugcaguaccugaccagaagcgccaucaggcgggcuuccacaauugaaaugccccaacaggcacgccagaaacuccagaaccuuuucauaaauuuuugccugaucuugauuuguuuacugcuaaucugcauuaucgucaugcuccuguga

SEQ ID NO: 60853 - RNA, 2214 nt, Artificial Sequence
  derived and/or modified sequence opt3 from PLOD2__Homo_sapiens__NP_000926
augggcgggugcaccgugaagccccagcugcuccuucuggccuuggucuuacacccuuggaacccaugucugggagcugacagcgagaaaccguccucuauccccacagauaagcuacucguuauuacuguggcaacgaaagaaucagacgguuuccauagauuuaugcaaagugccaaguacuucaauuauaccguaaaagugcugggccagggggaggaauggaggggaggcgaugguauaaacagcaucgggggaggccagaagguccggcuuaugaaggaggugauggaacacuacgcggaccaggaugaccugguugugauguuuacagagugcuucgaugucauuuuugcuggcgggccugaggaaguguugaaaaaguuccaaaaagccaaucauaagguaguuuuugcagccgacggaauccucuggccagauaaacgccuggcugacaaguaucccgugguccacauugguaagcgauaccugaacuccggcggguucaucggauaugcaccuuacgugaaucguauagugcagcaguggaaccuccaggauaaugacgaugaccaauuauuuuauacuaaagucuacaucgacccacugaagagagaggccauuaacaucacccuugaucauaaauguaagauuuuccagacauugaauggcgcuguugacgaagugguacugaaauuugagaacgguaaggccagggcgaaaaauaccuucuacgagacucuacccguggcaaucaacgggaauggaccuacaaagauacuccugaacuauuuuggcaauuacgucccaaacucuuggacccaggauaacggcugcacgcuuugugaauuugacacuguggaucugucggccguugacgugcacccgaaugucucaauugggguguucaucgagcagcccaccccuuucuugccacgguuccucgauauucuguuaacacuggacuaucccaaggaagcucucaaacuuuuuauccacaacaaggagguauaccaugaaaaagauaucaagguuuucuuugacaaagccaagcacgagauuaagacuauaaaaaucgugggaccugaggaaaaucugagccaagcagaggcucgcaacauggguauggauuucugcagacaggacgaaaagugugacuauuacuuuagugucgaugccgacguggucuugaccaauccaaggacacuaaaaauucugaucgagcagaaccggaagauaauugcgccccucgugacccgccauggcaaacugugguccaauuucuggggagcccuuucuccggauggguauuacgcacgaagcgaagacuacguugauaucgugcaaggcaacagaguaggugucuggaaugugccuuauauggcuaacguuuaccugaucaaggggaagacguugagguccgagaugaaugagcggaacuauuuugugcgugacaaacucgaucccgacauggcccugugccgcaaugcuagagaaaugggcgucuucauguacauuucaaacaggcacgaguuuggacgguuacugaguacugccaauuauaacacaagccacuacaacaaugaucuauggcagaucuucgaaaacccaguggacuggaaggagaaauauauuaaucgagauuacucuaagauauuuaccgaaaacaucguagagcagccuugucccgacguguucugguucccaaucuuuuccgagaaagcaugcgaugaacucguugaggaaauggagcauuacggcaaguggucagggggaaagcaccaugacagccgcauuagugguggcuaugagaauguccccacugacgauauccacaugaaacagguggaccuggaaaacguguggcuucauuucauuagagaguuuauagccccugucacauugaagguuuucgcuggguacuauaccaaaggauuugcgcugcucaauuucguggugaaguacucuccagaaaggcaacggucccugcgcccgcaccacgaugcaagcacguuuaccaucaacauugcccuuaauaacguaggcgaggacuuccagggugggggcuguaaauuucugagauauaauugcucgaucgaaucucccaggaagggaugguccuucaugcauccuggccguuugacacaccuccaugaggggcugccagucaaaaacggaacucgguacauugcugugucauuuaucgaucccuga

SEQ ID NO: 60854 - RNA, 834 nt, Artificial Sequence
  derived and/or modified sequence opt3 from PLP1__Homo_sapiens__NP_000524
augggccugcucgagugcugugccagaugccuugugggggcucccuucgcaagccuggucgccaccggauugugcuuuuucgguguugcguuauuuuguggcugugggcacgaagcucugacaggaacugagaagcuaaucgaaacguacuucuccaaaaacuaucaggacuacgaguaucucauuaaugugauacaugccuuucaauacguaaucuauggcaccgcaucuuucuuuuuccuguacggugcccuucuguuggcugaaggguuuuauacaacuggagcagugaggcagauuuucggcgauuacaagaccacaaucugcggcaaagggcucucagccaccgucacuggaggucagaagggccgggggagucgcggacagcaccaagcucauagccuggagcgagugugucacugccugggcaaauggcucggucauccugacaaguuuguugggauuacauacgccuuaaccguggucuggcugcuuguguucgcguguuccgcaguaccaguuuauaucuacuuuaacacguggacuaccugccagucuauagccuucccgucgaagacaucagcuagcaucggaaguuugugugccgaugcacguauguauggcgugcugcccuggaaugcuuucccuggcaaagucugcggguccaaccuacucucuauuugcaagacugccgaguuucagaugaccuuccaccuguuuaucgcggccuucgugggagcagcugccacacuugugagccuguugaccuuuaugauugcugccacguacaauuucgcaguccucaaacugauggguagaggcacuaaguuuuga

SEQ ID NO: 60855 - RNA, 459 nt, Artificial Sequence
  derived and/or modified sequence opt3 from PLP2__Homo_sapiens__NP_002659
auggccgacagcgagagacuguccgcucccggcugcugggcagccuguaccaacuucucuaggacacggaaggggauccuccuuuuugcggaaauuauacugugcuuggugaucuuaauuuguuucucagcuaguacuccuggauacagcucccugucugucaucgagaugauucuagccgcaaucuuuuucguuguguauaugugcgaucuccacacgaaaauaccauuuaucaauuggccguggucggacuucuuucgcacccugauugccgcuauccuuuaccugauuacaucaaucguaguguuggucgaacgagguaaccauagcaagauaguggcaggcguucucgggcugauugccacuugucuguucggauaugaugcuuacgugaccuuucccguccgucagccuagacacacagccgcgccaaccgaccccgcagauggcccuguguga

SEQ ID NO: 60856 - RNA, 1518 nt, Artificial Sequence
  derived and/or modified sequence opt3 from PLRG1__Homo_sapiens__NP_001188493
augguggaggaaguccagaagcacagcguucauacccugguguucagaucccucaaaaggacacacgacauguuuguagccgauaacggcaagcccgugccucuugacgaggaaucucauaaacggaagauggcuaucaaacugcgcaaugaguacgggccagucuugcacaugccgacuucaaaggaaaacuuaaaggagaaaggaccccaaaaugcaacggauaguuaugugcauaagcaguacccugccaaccagggucaggagguugaauauuucguggcgggcgucgcucugaccgccgacacaaaaauucaacgaaugccaagcgaguccgcagcccagucucuagcuguggcacucccccugcagacuaaggccgaugcuaaucguaccgccccuucggggucagaauacagacacccaggagcgagcgacaggccccagccuacagcaaugaacaguauaguaauggagaccggcaauacuaaaaacuccgcccuuauggcuaagaaggccccaacaaugccgaaaccccaauggcacccuccauggaagcuguaucggguuaucucuggucauuuggggugggugcgcugcauugcagucgagcccggaaaucagugguuugugaccggcagcgcugauagaacgaucaaaauuugggaccucgccuccggcaagcugaaacugucacucacugggcacaucaguaccgugaggggagucauaguuagcacacggucuccuuacuuauucuccuguggugaagauaaacaggugaagugcugggaccuggaguauaacaagguaauccgccauuaccacggccaccuuucagcgguguacggguuggaucugcauccaacuauugacguccuagugaccuguagccgagauaguacagccagaaucugggacguuaggaccaaggcaucugugcacacgcucuccggacauacuaaugcugucgccacagugcggugccaggcugccgaaccccaaauuaucaccggcagccacgacacuacaauacgucugugggaucuuguagcagguaaaacccgcguuacgcugaccaaccauaagaaaucggugagagccgucguguugcacccgaggcacuauacauuugcuucuggguccccugacaauauuaagcaguggaaauuccccgauggaucauuuauccagaaccucaguggccauaaugcgauuaucaacacucugaccgucaacagcgacggcguguuaguuuccggggcagauaauggaacaaugcaccugugggacuggcggacugguuacaacuuccaacgagugcaugccgcuguacagccaggcucucucgauagcgagucagggaucuuugccugugcauucgaccagagugaaucccgccuucugaccgccgaggcugauaagacaauuaaggucuauagagaggacgauaccgccacugaagagacgcacccugugagcuggaaacccgaaauaaucaagaggaaacgguuuuga

SEQ ID NO: 60857 - RNA, 1890 nt, Artificial Sequence
  derived and/or modified sequence opt3 from PLS1__Homo_sapiens__NP_001138791
auggagaacagcaccacaacuaucuccagagaagaacuggaggagcuccaggaagccuucaauaagauugacauagauaacucuggcuacgugucagacuaugagcuucaagaucuguuuaaagaggcuaguuugcccuuaccuggguacaaggucagggaaaucguugagaaaauucugagcguggcagacuccaauaaggauggaaaaaucucuuucgaagaguuuguaucgcuaaugcaggagcucaagucaaaggacauuagcaaaacguuccggaagaucauaaacaaacgcgaagguaucaccgccauuggcgggacaaguacuaucuccucugagggaacccagcacagcuauuccgaagaggaaaagguggcguuugucaauuggauuaacaaagcucuggagaaugauccagacugcaagcaucuuaucccgaugaaccccaaugaugacucacuguucaagaguuuggccgauggcauacuccuguguaaaaugauuaaccugagcgagccugacacaaucgaugaacgagcaauuaauaagaaaaagcucaccccauuuacuaucucugagaacuuaaaucuggcccuuaacuccgcuucagcaaucgguugcacagugguuaauauuggggccagcgacuugaaagaaggaaagccccaccuggugcuaggccuccuguggcagauaaucaaagucggccuuuucgcugacauugagaucagucguaacgaagcccugauagcguugcucaacgagggggaggaacuggaggaauuaaugaagcugucuccugaggaacuccuucugagaugggugaauuaccauuugaccaacgcaggauggcacacgauuuccaauuuuagccaagauaucaaggacucgagggccuauuuccaucuacugaaccagaucgcuccaaaagguggcgaggaugggcccgccauugcaaucgaccucucuggaauuaaugagacuaacgaucugaagcgggcuggccuuaugcugcaggaagccgacaaauuggguuguaagcaguuuguaaccccugcggauguuguguccgggaauccaaaacucaaccuggccuucgucgcaaauuuauuuaacacauacccgugccugcacaagcccaauaacaaugacauagauaugaaccuacucgagggagaaucaaaggaggagcgcacuuucagaaauuggaugaacagucugggcgugaacccuuauaucaaucaccuuuacagcgacuuggcugaugcccuggugauuuuccaacucuacgaaaugaucagggucccaguuaacuggucccaugugaauaaacccccuuauccagcucugggcgggaacaugaagaaaaucgagaauuguaacuacgccguagaacuuggaaagaauaaagcaaaguuuucucugguggguauugccggccaggacuugaacgaggggaauagcacccucacacuggcuuuagucuggcagcugaugcggcgcuauacccuaaacgugcucucagaccugggagaaggcgagaagguuaaugaugagauaaucauuaaaugggugaaccagacgcuuaagagugcgaauaaaaagacuuccaucagcucuuucaaagacaagucaauuaguaccagcuugcccguccuggaucucaucgacgcaauagccccgaacgcugugcgacaagaaaugaucagaagggagaaucuguccgaugaagacaaguuaaacaacgccaaauacgcaauuucuguagcccggaagaucggugcucguauuuaugcccugccugaugaccuuguugaggugaaacccaagauggucaugacaguguuugcaugcuugauggggaaaggccucaaucgcaucaaguga

SEQ ID NO: 60858 - RNA, 1854 nt, Artificial Sequence
  derived and/or modified sequence opt3 from PLS3__Homo_sapiens__NP_001269266
auggaggaccugaacagcaauggcuucaucugcgauuacgaacuccacgagcuuuuuaaggaagccaacaugccccugccuggguauaaagugagagagauuauacagaaguugauguuagacggagauaggaauaaagacgguaagaucuccuucgaugaauuugucuacauuuuccaagagguuaaaucuucagacaucgcuaagaccuuucggaaggcaauuaaccgcaaagagggcaucugugcccuagggggaacaagugaacugagcuccgagggcacucagcauucuuauucggaagaggagaaguacgcguucgugaauuggauaaacaaagcucucgaaaaugauccagacugccgacacguaaucccgaugaaccccaauacggaugaccuguuuaaggccgugggugaugggauuguccuuuguaaaaugaucaaccugucagugccugacaccauugaugagcgugcaaucaauaagaagaaauugacaccauucauaauucaggaaaaccucaaucuggcccugaacagcgcuagugcaaucggaugccauguugugaauauuggcgccgaggaccucagagcuggcaagccccacuuaguccuggggcuuuuguggcagaucaucaaaauuggacuguuugccgacauagaacuauccaggaacgaggcgcucgcagcccugcuucgggauggugagacucuggaagaguugaugaagcucucuccugaggaacuguuacugcgcugggcuaacuuccaucucgaaaauagcggcuggcaaaagaucaacaauuuuuccgccgacauuaaacuuaucgauuucucaaacagugugaaagacagcaaggcauauuuucaccuguugaaucagauagcuccaaaggggcagaaagagggagagcccagaauugauaucaacaugucuggcuucaaugaaaccgacgaucuaaagagggccgaguccaugcugcagcaagcggacaaacucgguugucggcaguucguaaccccugccgauguugugucagggaacccaaagcugaaucuugcauuugucgcuaaccuguucaauaaauacccggccuugacaaagcccgaaaaccaggacaucgauuggacucuccuggagggagaaacacgcgaggagcgaaccuuuagaaauuggaugaacagcuuaggcgugaauccucacgugaaccaucuguaugcugaccuacaggacgcccucgucauucugcaacuuuacgaaaggaucaagguuccaguggauuggaguaaaguaaacaagcccccuuacccaaaauugggcgcaaauaugaagaaacuggagaacugcaauuaugccguggaacucgggaagcaccccgcuaaguucucucuggucggaauugguggccaggaccuuaacgaugggaaucagacgcugacuuuggcgcucguguggcaacugaugcggcguuacaccuuaaacguucuggaggaccuaggagauggccagaaagcaaaugacgauauaaucgugaacugggucaaucgcacacucuccgaggccgguaagagcacuucgauucagucuuuuaaagacaagaccaucuccucaagucuggcugugguagaucuuaucgacgccauucagccgggguguauaaacuaugauuugguuaaaagcggcaaucugacagaagacgauaagcauaacaaugcaaaguacgccguguccauggcuagaaggaucggagcccgggucuaugcacucccugaggaccugguggaagucaaacccaagauggugaugaccguuuucgcgugcuuaaugggccgagggaugaaacgcguguga

SEQ ID NO: 60859 - RNA, 957 nt, Artificial Sequence
  derived and/or modified sequence opt3 from PLSCR1__Homo_sapiens__NP_066928
auggacaagcagaacagccaaaugaaugccucccaccccgagaccaaccugccugugggcuacccaccgcaguaucccccuacagcuuuccaggggccacccggauacucugguuauccuggcccacaggucucauaucccccuccaccggcagggcauaguggacccggcccugccgguuuuccaguucccaaucaaccuguguacaaccagccaguauacaaucagcccgugggggcggcuggagucccguggaugccugcaccccagccaccucucaacugucccccaggccuugaauaucugagccaaaucgaucagauuuugauacaccagcagaucgaguuacuggaagugcuaacuggcuucgagacgaauaacaaauacgaaauuaaaaauuccuuugggcaaagaguuuacuucgccgccgaggacaccgauugcugcacaaggaacuguugcggacccucucggccuuuuacucuccgcaucauugacaauaugggucaggaggugaucacccuggaacgaccacuucguuguucgucaugcuguugcccguguugccugcaggagauagaaauccaagcucccccuggcgucccaauuggguaugugauccagacauggcaucccuguuugccuaaguucaccauucagaacgagaagagagaggauguacucaaaaucagcggaccaugcguugugugcaguuguugcggcgacgucgauuuugaaauaaagucccuggacgagcagugugugguggguaagauuucuaaacacuggacugggauccugagggaagcauucacagaugccgacaauuuuggcauucaauucccccucgauuuagacgucaagaugaaagcuguuaugaucggagccugcuuucugaucgauuucauguuuuucgagagcaccggcucccaggaacagaagucaggggugugguga

SEQ ID NO: 60860 - RNA, 888 nt, Artificial Sequence
  derived and/or modified sequence opt3 from PLSCR3__Homo_sapiens__NP_065093
auggccggcuaccugcccccuaagggguaugcuccaagcccgcccccuccauaccccgugaccccuggauauccagagcccgcacuccacccugguccaggccaggccccgguccccgcgcaaguuccugcuccagcccccggguucgcacuuuuuccuuccccaggacccguggcccugggcucugcugcaccguucuugccuuuacccgguguaccaucagggcuggaauuucuagugcagaucgaccagauucucauacaucagaaagccgagagagucgaaacauuccugggaugggagacuugcaacagguacgaacuucggaguggcgcuggccaaccucuggggcaggccgcggaggagagcaauuguugcgcacgcuuguguugcggagcccgacguccccucagagugaggcuggcugauccaggugaccgggaaguucugcgccucuuaagaccccugcacuguggcugcuccuguugcccuugugggcuucaggagauggaagugcaggccccaccgggaacgaccaucggccaugucuugcaaacauggcaccccuuucugccuaaguucucuauucaggaugcagacaggcagacugugcuacggguaguugguccaugcuggaccugugggugcggaacagauaccaacuuugaggugaaaacucgcgacgagucgcgaucagucggcagaaucagcaagcaguggggcgggcucgugagggaagcucugacagaugccgacgauuucggacuucaauuuccccuggacuuggaugugcgggucaaagcgguucuccugggugccaccuucuuaauugacuauauguuuuucgagaagcguggcggggcaggaccuagugcugugacguccuga

SEQ ID NO: 60861 - RNA, 720 nt, Artificial Sequence
  derived and/or modified sequence opt3 from PLSCR4__Homo_sapiens__NP_001121778
augagcggcgugguccccaccgccccugagcagccagcuggggaaauggagaaccaaacaaagccgcccgacccuagaccagaugcacccccugaauacaauucccacuuccugccaggacccccugguacugccguuccaccgcccacgggcuauccugggggacucccaaugggcuacuauucuccccagcagccuucaaccuuuccacuuuaccagcccgugggugggauccauccgguaagguaucaaccuggaaaauaccccaugccaaaccagagugugccuauuacauggaugcccggcccaacucccauggcgaauuguccuccaggccuggaguauuugguccaguuagaagugcaguguccgcccgggguuaccauaggauucguggcugagcacuggaaccugugccgggccgucuacagcauccaaaaugagaagaaagaaaacgugaugcgcguacgagguccuuguuccacauacggcugcgggucugacucgguuuuugaggugaagucacuagauggaauuagcaauaucggcaguauuauccguaaauggaacggucuccuguccgcaauggccgacgcugaucauuucgacauacacuuuccacuugaucuggacgucaagaugaaggcaaugaucuucggggccugcuuuuugauugauuucauguauuuugaaagaucucccccucagaggagccgguga

SEQ ID NO: 60862 - RNA, 816 nt, Artificial Sequence
  derived and/or modified sequence opt3 from PLSCR5__Homo_sapiens__NP_001078889
auggccagcaaggacgcucagaaccaaagaaggggccugcccggguuccucccuggagcaccagauccggaccagucccuucccgccucuucaaauccugguaaccaggcguggcagcugaguuugccauuacccagcuccuuucugccuaccgugucucuaccacccggccucgaguaccugucgcaacuugaucugaucauuauacaccagcaggucgaauugcucgggaugauccugggaacagagacuucaaauaaauaugaaauuaagaacagccugggccagcggaucuacuucgcuguugaggaaaguauuugcuuuaaucgcacguucuguuccacccuccgaucuugcacauuacguaucacugacaacagcgguagagaggugauaaccguaaauaggccucugcgguguaacuccugcugguguccaugcuaucuucaagaguuggaaauccaggccccgcccgggacaauugugggauacgucacccagaaaugggauccuuuucugccaaaguucacuauccagaaugcaaacaaagaggacauucuaaagaucgugggccccuguguuacaugcggcuguuuuggggauguggacuucgaagucaagaccauaaaugagaaacucacgauuggaaagaucucaaaauauuggagugguuuugugaacgauguauucacuaaugccgacaacuuuggcauucauguuccugcugaucuggacgugaccgucaaggcagccaugaucggggcuugcuuccuuuuugauuucauguucuuugagcacagccuggccggauuguga

SEQ ID NO: 60863 - RNA, 1197 nt, Artificial Sequence
  derived and/or modified sequence opt3 from PLTP__Homo_sapiens__NP_001229849
auggcccuguucggcgcucucuuucuugcacuguuggccggggcgcacgcugaguuccccggaugcaagaucagagugaccagcaaagccuuagaacuggucaagcaggagggucuaagguuucucgaacaagagcuggaaacaauuacuauaccugaccuucggggcaaagaggggcauuucuacuauaacaucuccgagaagguuuacgauuuucugucuacguucauuaccucaggaaugcgcuuuuugcucaaucagcagaucuguccagugcuguaucacgcaggcacaguacugcucaacaguuuacuggacacugugccgguccgaagcuccguggaugaacuuguugguauugacuacucuuugaugaaagaucccguggccucgaccucaaaucuggacauggauuuccguggggcauuuuucccucuaacagagagaaacuggagccucccaaauagggcugucgaaccccagcugcaagaggaggaacggaugguguauguagccuuuagugaguucuuuuucgacuccgcuauggaaucuuacuuccgcgccggagcgcuucagcuguugcucguuggcgauaaggugccucaugaccuggauauguuacugagagcaaccuauuuuggcagcaucguccuccuuuccccagccgugauagacucaccccugaaguuggagcuaagggugcuggcuccuccacggugcacuaucaaaccgagugggacaaccauuagcgucacggccucuguuacuaucgcacucgugcccccugaucagccagaaguacagcuguccucaaugaccauggacgcucgccuuagcgccaagauggcgcugcgaggaaaagccuugagaacacaacucgaccugaggcgguuccguauuuacaguaaccacucugcauuagagucccuggcucuaaucccccuccaggccccucugaagacuaugcuucagauaggugugaugccaauguugaaugagcgcaccuggagaggcguccagauuccccugccggaagggaucaacuuugugcaugagguugugacaaaucacgcuggauuccucaccauuggcgccgaucugcacuuugcaaaaggucuuagggaagucaucgagaagaaccggccugccgacgugcgagcuagcacggcgcccacuccaucgacagcagccguauga

SEQ ID NO: 60864 - RNA, 1329 nt, Artificial Sequence
  derived and/or modified sequence opt3 from PLVAP__Homo_sapiens__NP_112600
augggccuggccauggagcacgggggaagcuacgcuagagccgguggcuccucuagggggugcugguauuaccuccgguauuucuuucuuuucgugucacugauccaguuuuugauuauauuaggacugguccuauucaugguuuacggcaacgugcauguaaguaccgaaagcaaucuccaagcaacagagcgccgagcggaaggucuguauucccagcuucugggguugacugcuucucagucgaaccucacgaaggagcugaauuuuaccacacgugccaaagacgcaaucaugcagauguggcugaacgccagaagggaucucgaccggauuaaugcuucauuccgccaaugucagggagauagagugaucuacacuaacaaucagagguauauggcagccauuaucuuaagcgaaaagcagugccgggaccaauuuaaagauaugaacaagaguugugacgcucugcuuuucauguugaaucagaaagucaagacccuggagguggagauagccaaggagaaaacaaucugcaccaaggauaaagaguccguucuacucaacaagcgcguggcggaagaacagcuggucgagugugugaaaacucgagaacuucagcaccaagagagacagcuggcaaaggaacaguugcaaaagguacaggcccucugccugcccuuagacaaagauaaguuugagauggaccugaggaaucucuggcgggauucuauuaucccucguagccuugacaaccugggcuacaauuuguaccauccacuaggcuccgaacuggcuucaauucgcagagccugugaucacaugccgagucucaugagcucuaaaguugaggagcuggcaaggucccuucgggcugacaucgaacgaguggcccgcgagaacucagaccugcagagacagaaguuggaagcgcaacaggggcucagggccagccaggaggcaaaacagaaggucgaaaaagaggcucaagcccgggaggcuaagcugcaggccgaaugcagucgccagacacaguuagcacuggaggaaaaggccgugcuaagaaaagagagggauaaucucgcuaaggaacuggaggagaaaaagcgugaagcggagcaacuucggauggaauuggcaauacgaaacucugcccuggacaccuguauuaaaacgaagucccagcccaugaugccugugagcagaccaaugggacccgucccuaacccacagcccaucgauccugcuucgcucgaggaguucaagaggaaaauucuggaaucucagcgcccaccggccgguauccccguugcaccuuccucaggcuga

SEQ ID NO: 60865 - RNA, 1503 nt, Artificial Sequence
  derived and/or modified sequence opt3 from PLXDC1__Homo_sapiens__NP_065138
augagaggcgagcuguggcuccuugugcuggucuugagggaagccgcucgggcauuaagcccccagccuggggccggacacgacgaggguccaggcuccgggugggcggcuaagggaaccguucgcggcuggaaccgacgugccagagaaucuccgggucaugugucagagcccgauaggacacaacugagucaggaccuagggggaggcacucucgcaauggauacgcugccugacaaucggacccgcguaguggaagauaaccacagcuacuaugucuccagacuuuacggcccaucugagccccauucgagggagcuguggguggacguugccgaagcuaaucggucacaggugaaaauccacacaauuuugagcaacacucaucgccaggcaagucgagucgugcucuccuucgauuuuccuuucuaugggcacccacugagacaaauaaccaucgccacaggagguuuuauuuucaugggcgacguaauccacaggaugcugaccgcuacucaguacguugcaccccucauggcgaauuuuaacccuggguauucugauaauagcacaguggucuacuucgacaacggaaccguguuugugguccagugggaucauguuuauuuacagggcugggaggacaaggguuccuucacguuucaagcagcccugcaccaugaugggcggauuguguucgcuuacaaagaaaucccaaugucaguaccggagauaaguagcucucagcaccccgugaagacuggacuuuccgacgccuuuaugaucuugaauccuucaccagacguccccgagagccgucgcagaaguauuuucgaauaccacaggaucgagcuggauccuucuaaagugaccuccaugagcgcaguugaauuuacaccacuacccacuugccuccagcaucggucgugugacgcuugcaugucuuccgaucugaccuucaacuguucauggugccacgugcuucagcgauguaguagcggcuucgaccgcuauagacaagaguggauggauuacggcugcgcccaggaagcggaggggaggaugugugaggacuuucaggaugaagaccaugauuccgccucuccggacacuagcuucucaccuuaugauggagaccugaccacgacaaguuccagcuuguuuauugacucucucacaaccgaggaugacacuaagcugaaucccuacgccgguggcgauggguuacaaaacaaucugucaccaaagacaaaaggaaccccuguccaccucggcacgaucguggguauaguacuugcuguucuguugguggccgcuauuauccuagccgggauuuauaucaacggccaucccaccaguaaugcagcccuguucuuuaucgaacggcgcccacaccacuggcccgcuaugaaguucagaagccauccugaccacuccacauacgcggaggucgaaccaucuggacaugagaaagagggcuuuauggaagcagagcagugcuga

SEQ ID NO: 60866 - RNA, 1443 nt, Artificial Sequence
  derived and/or modified sequence opt3 from PLXDC2__Homo_sapiens__NP_001269665
auggccagauuccccaaggcugaccuggcagccgcgggcgugaugcuccuuugccacuuuuucaccgaucaguuucaauucgcugacgggaaaccuggagaucagauccuggacuggcaguacggugucacacaggccuuuccacauacugaggaagagguugaaguggauagccacgcauauucccauagguggaagcggaacuuggacuucuuaaaagccguagauacgaaucgcgcuucugugggccaagacucaccggagccccgaaguuuuaccgaucugcuacucgacgaugggcaggacaacaauacacagauugaacgugucaaccugagcuucgauuuuccuuucuacggacacuuucuuagagagauaacuguggcaaccggcgguuucaucuauacaggggagguugugcauaggaugcugaccgccacucaguacauugcuccauugauggccaauuuugaccccuccgucucucggaacucgacagugcgcuauuucgacaauggaaccgcgcucguaguucaaugggaucacgugcaucugcaggacaacuacaaucugggcucauucacguuucaggcaacucucuuaauggauggcagaaucauuuucggguauaaggaaaucccuguccuggugacccagauaagcaguacaaaccacccagugaaagucggacuuuccgacgccuuuguugugguacacaggauccaacagauucccaaugugcggcgccgaacuaucuacgaguaccauagagucgaauugcagaugucuaagauuaccaacaucagcgcuguggagaugacaccucugccaaccugucuacaauucaauaggugcgguccguguguuuccucacagauaggcuuuaacugcaguugguguagcaagcuccagcggugcaguuccggguucgaucgucaccgccaggacuggguggauucaggaugucccgaggaaagcaaagagaagaugugcgaaaauacggagccugucgaaacuucuucuagaacaaccacuacagugggcgccaccacgacccaauuuaggguacugacaacuacccggcgagcaguuacaucccaguucccaacuagccuucccaccgaggacgauacaaaaauugcucugcacuugaaggacaacggugccucgaccgaugacucugcggccgagaaaaagggagggacucuccaugcaggccugaucauuggcaucuuaauccuggugcucauugucgcuacggccauacuugugacagucuauauguaccaccauccuaccuccgcugccucaaucuuuuucauugaacgcagaccaaguagguggcccgcaaugaaguuucggcgcgggagcggacacccggccuaugcugagguggaaccuguuggugagaaagaaggcuucaucguguccgagcaguguuga

SEQ ID NO: 60867 - RNA, 5691 nt, Artificial Sequence
  derived and/or modified sequence opt3 from PLXNA1__Homo_sapiens__NP_115618
augccccugccuccaagaagccuccaggugcuucuguuguuacugcuacuccugcuucuguugccgggcaugugggccgaggcugggcuccccagggcaggagguggcucccaaccuccauuccggaccuuuucugccucagacugggggcugacacaccuggucguucaugaacagacuggagagguguacguaggcgcggugaaccgcaucuauaagcucagugguaauuuaacgcugcuucgagcucacgucaccgggcccguggaagauaacgagaaaugcuacccuccacccagcguucaguccuguccucauggauugggcucuacagacaaugugaacaagcugcuacuccuggauuaugccgcaaaucgucuucuggccugcggcucggcuucacaggggauuugucaauucuugagacucgacgaucuguuuaaauuaggagaaccacaccauaggaaggagcacuaccugagcaguguccaggaggcagguuccauggccggcgugcucauagcugggccgcccggacagggccaggccaaacuuuucguagguacuccuaucgacgggaagucugaauauuuuccaacccugagcucccggcgcuugauggcgaacgaggaagaugcagacauguucggauuuguuuaccaagaugaguucgugucaagucagcuaaagauucccagcgacacacugucuaaauuuccugccuucgauaucuauuacgucuacuccuuuagaucagagcaguucguguauuaccucacccugcagcuugacacucaacugacaagcccagaugcugccggcgaacacuuuuucaccaguaagauugugagguugugcgucgacgaccccaaauucuauucuuacguugaguuuccgaucggcugugaacaggcagggguggaguaucggcucguacaggaugcuuaccugucccgcccuggacgagccuuagcgcaucaacugggucuagccgaagacgaggaugugcucuucacggucuuugcacagggccagaagaauagagugaaacccccaaaggagagcgcucugugccuuuucacuuugagggccauaaaggaaaaaaucaaggagcggauucagucguguuaucguggggaaggaaaacugucucucccuuggcugcuuaacaaggagcugggcugcaucaauucccccuugcaaauugacgaugacuuuuguggucaggauuucaaccagccacucgggggcaccguuacaaucgaaggaacuccccuguuuguggacaaagaugacggcuuaaccgcugucgccgcauacgauuaccgcgggagaacagugguauucgccggaaccaggucaggucggauacgaaagauucugguugaccuaaguaauccuggcgggcgcccagcucucgcguaugagagcguggucgcacaggagggauccccgauccugagagaccuuguguugucucccaaccaccaauaccuguaugccaugacggaaaaacaggucacuagggugccuguugagagcugcgugcaguacacaucaugugaacucugccugggcagucgggauccacauugcgguugguguguauuacacuccauuugcagccgcagagacgcuugugagagggccgaugaaccccagcguuuugcagccgaccugcuucaaugcguccaguugaccgugcagccucggaauguuucugugacuaugucacaggucccacucgugcugcaagcuuggaacguacccgaucuaagugccggggugaauuguagcuucgaggacuuuacagaguccgaaucuguucuggaggauggccgaauccacugcagaucgccgagcgcaagggaagucgcgccuaucacccgcggacagggcgaccagcggguggugaagcucuaucugaaguccaaagagacggggaagaaauucgcuucagucgauuuuguuuucuacaacuguagugugcaucaaucuugccuuagcugugugaacggauccuucccaugccacugguguaaguauagacauguaugcacccacaaugucgccgacugcgcauuuuuggaggguagggugaacguuucagaagauuguccccagauucugccuagcacacagauauacgugcccgucggcgugguuaaaccaaucacuuuagccgcucgcaaucucccucagccccaaucugggcagcgaggauacgagugccuguuccauauuccaggcuccccggcccgggugaccgcacuucguuuuaacaguagcucucugcagugucagaauuccucauauaguuacgaagguaacgacguaagcgauuugccugucaaucucucggugguguggaacgggaauuucgucaucgacaacccccaaaauauacaggcucaccuguauaagugcccagcccuaagagaguccuguggccugugccucaaggcggaccccagguuugaauguggauggugcguugccgagcgccgguguucucugagacaccauugcgcugcagauacaccugccagcuggaugcacgcuaggcauggcucaagucgauguacugacccaaaaauucuuaaguugucccccgagaccgggccucgccagggaggcacacggcugaccaucacuggugaaaacuuagggcucagauucgaggaugugaggcugggaguacgugugggcaaaguccuuugcucuccgguggaaagcgaguacaucuccgccgaacagauuguuugcgagaucggugacgcaucaagcgugcgcgcgcacgaugcccuggucgagguguguguucgggacugcaguccacacuauagagcucuaucucccaagagguuuacguucgugacaccuaccuuuuaccgagucuccccaagccggggcccccucucggggggaacuuggauuggcauagaagggucacaucugaaugccggaucugauguagcagugaguguuggcggucgcccuuguuccuucagcuggagaaacucuagggagauccggugcuugaccccgcccgggcaaagcccaggauccgcuccuauuaucaucaauauuaaccgagcccagcugacaaaccccgaagugaaauauaauuacaccgaggacccaacuauauuaagaaucgauccugaauggucaauuaacaguggcgguacacuccugacggucaccggcacuaaucuugcaacagugcgcgagcccaggauccgugccaaguacgggggaauugagcgggaaaacggcugucugguauauaaugacaccacaauggugugcagagcuccaagcgucgcgaacccgguuaggucuccucccgaguugggggaacgcccagaugagcucggauuugugauggacaaugugcgaucccugcuaguccugaacucaacuaguuuccuuuacuaucccgauccugugcucgagccacugagccccaccggcuugcuggaauuaaagccuuccucuccgcucauccugaaagguagaaaucuucugccacccgccccugggaacucgcgguugaauuacacgguucucauaggaagcacccccuguacacugacuguaucagagacccagcuacugugcgaagcaccaaaccuuacaggccaacacaaggugacugucagggcugguggcuuugaguucuccccugggacccuccagguguauagugacucucuguugacguuacccgccaucguuggaauuggcgggggaggcggucugcuccugcuugugaucgucgccgugcugauugcuuacaaacgcaagagccgugacgcagauagaacauugaaacggcuacagcugcagauggacaaucucgaauccaggguagcccuggaguguaaggaggcguucgcugaacuucaaaccgauauccaugaguuaacuaacgaccuggauggggccggaauaccauuucucgacuaucgcacauacgcaaugcgagucuuguucccuggcauugaagaucacccggugcugaaggagauggaaguucaggccaauguggagaaaucacucacccuguuuggccagcuucugacuaagaaacauuucuugcuaaccuuuaucagaacacuggaggcucagcggucuuucagcaugagggaccgcgggaacgucgcaagucucauuaugacggccuuacaaggagaaauggaguacgcgaccggugugcugaagcagcuucuguccgaucucaucgaaaaaaacuuggagagcaagaaucaccccaaacugcuccugagaaggacugaaucuguugcugagaagaugcuuacaaacugguuuaccuuccuacuguauaaguuuuugaaagagugcgccggcgaaccauuauucaugcuguacugugcaauaaagcagcagauggagaaagggccuaucgacgccauuacaggagaagcucgguauucacucuccgaggauaagcugauccgucaacagauugacuacaaaacucuuacccugaauugcgugaaccccgagaaugaaaacgccccagaggucccugugaagggccucgacugcgauacgguaacacaggcaaaggaaaaauugcuggacgcugccuauaagggugugcccuacagucagcgcccgaaagcggccgauauggaccuagaguggcgacaagggagaauggcaaggaucauacugcaggaugaagacguuaccacuaagauugauaaugacuggaaacggcucaacacccuugcucacuaucaggucacagauggaagcucgguggcccuggugccaaagcaaacuucugcuuacaauaucuccaacagcucaaccuuuacaaagaguuuaucucgcuacgaguccauguugagaacggcaagcucaccugacagucugaggagccggacccccaugaucacuccagaucucgaguccggcacaaaacuguggcaucuugucaagaaucacgaccaucuggaucagcgagaaggcgacagagggucuaaaaugguaagcgagauuuaucucacccgcuugcuggccacuaagggaacauuacagaaauucguggacgaucuauucgaaaccaucuuuuccacggcccacagggguucagcucugccccucgcgauuaaguacauguucgacuuucuugaugagcaggcagacaagcaucaaauacacgaugccgacguucggcacacuuggaaaucuaacugucugccuuugcguuucugggugaaugucaucaagaacccgcaguuuguguucgauauucauaaaaauaguaucaccgacgcuugccugucgguuguggcccagacauuuauggauagcuguuccaccucugaacacaagcucggcaaagacucacccagcaacaagcugcuuuaugcaaaagauauuccaaacuacaaguccugggucgagagauauuacgccgacaucgcuaagaugccugcgauaagugaucaggacaugucugccuaucucgcagagcaaagcaggcugcauuugucacaguucaauuccaugagugcucugcacgaaaucuacagcuacauuacuaaauauaaggacgagaucuuagccgcacuagaaaaagaugagcaggcccgccggcagcgacugagaucuaagcucgaacaagugguagacacaauggcucuuuccucauga

SEQ ID NO: 60868 - RNA, 5685 nt, Artificial Sequence
  derived and/or modified sequence opt3 from PLXNA2__Homo_sapiens__NP_079455
auggagcagagaaggcccuggccucgggcccuggaaguggacagccgcuccgucguucuccuuucugugguaugggugcuguuggcuccaccggcagccggcaugccccaauucucaaccuuucacagugagaaccgagauuggacauucaaucauuuaacuguccaccaggggacgggagcgguguacguuggugcuaucaaccguguguauaagcugaccggcaaucuaacaauucaggucgcccauaaaacugggccugaagaggacaacaagagcugcuacccaccccucauagugcagccuuguuccgaaguacugacccuuacaaauaacguuaauaaacuguugaucauugauuauucugagaacagacuccuggcaugcggaucgcuguaccaaggcguguguaagcucuuaaggcuggacgaucuuuuuaucuuggucgagccaucacacaaaaaggaacauuaucugagcagugugaauaagaccgguacuauguacggggugauuguccgguccgagggagaagacggcaaacuauucaucggcacagccguugaugggaagcaggacuauuuucccacccucucuagccgcaaacugccuagagauccagaguccucagcuaugcuugacuacgagcugcacagugauuucgugagcucuuugauaaagaucccguccgacacgcucgcacugguaucacacuuugauauuuucuacaucuauggauuugccagcgguggcuucguguacuuuuuaacuguccagcccgaaaccccugaggggguggcuauuaacagugccggagaccuguucuauacaucuaggaucguucggcucugcaaagacgauccaaaguuucauuccuacgugagccuucccuucggcuguacucgcgcgggugucgaauaucgacuguugcaggcagccuaccuagcuaagccuggggacucgcuggcccaagcauucaauauaaccucucaggaugacgugcucuuugcuauuuucuccaaaggacagaagcaguaucaccauccacccgaugacucagcccugugcgcguuuccgaucagagccauuaaccuucaaaucaaagagaggcugcagaguuguuaccagggcgaaggcaauuuggagcucaacuggcuguuagggaaggauguacaaugcacaaaagcaccuguucccaucgacgauaauuucuguggacuggacauuaaccagccacuagguggcagcaccccuguggaggggcucacgcuguacacuacaucccgggaucguaugaccucugucgcuagcuauguguacaacggauauucagucguguuuguuggcacuaagagugguaaacuuaagaagauacgcgccgacgggcccccacacggcggagugcaguacgaaaugguauccgucuugaaagacggcagccccauccugagagauauggcuuucucuauugaccagagguaucucuacgugaugucagagcggcaaguuacacgagugccugucgaaaguugcgagcaguauaccacguguggggaaugccugagcuccggagauccacacugcgguuggugugcccuucauaauaugugcucucgcagagacaagugucagcaggcaugggagccgaacagguuugccgcuucgaucagccaaugcgugucccuggcgguacaccccucaaguauaucugugagcgagcauucccgguugcucucacugguugucagcgaugcaccugacuuaucugccggcauugcuugugccuucgggaaucugaccgaaguggagggacagguguccggcagucaggucaucugcaucagcccaggucccaaagauguuccugugauuccacuagaccaggauugguuugggcucgaacugcaacuucgcucuaaggagacaggcaaaaucuucguguccacugaauuuaaguucuacaacuguucagcacaccaguugugccugaguuguguaaauagcgccuuuagaugccauugguguaaguacaggaaccucugcacccacgaccccacaacuugcucguuccaggagggacguauuaauauauccgaggauuguccgcagcuggucccuaccgaagagaucuuaauuccagugggcgaaguuaaacccaucacacugaaggcucggaaccuuccucaaccccagucugggcagcgaggauaugagugcguguugaauauccaaggugccauucacagagucccagcacucagguucaacagcucaagugugcagugucagaauuccucuuaccaguaugacggcauggauauaagcaaccuggcgguugacuuugcugugguauggaaugggaacuucaucauugacaauccucaagaucuaaaaguccaucuguacaagugcgccgcacagcgcgaguccuguggacucugccugaaagccgaccggaaguuugaauguggcuggugcucaggugagagaagguguacccuucaccagcauugcacuagccccaguucuccaugguuggauugguccagccacaacgugaaguguucgaacccgcagaucacggaaauucugacagugucagggccucccgagggcggaacccgcgucacuauccacggcguuaauuuagggcucgacuucucugaaauagcucaucacgugcaaguagccggagugccaugcaccccccugccuggcgaguauaucauugcagagcagaucgucugcgaaaugggucaugcucuuguggggacaaccaguggaccaguucgacuguguauuggcgagugcaaacccgaauuuaugacuaagucccaccagcaguacacauucgugaacccuagcgucuugucucucaauccgauccgggguccagagagcggcgggacgauggugaccauaacuggacauuaucugggcgccggguccucaguugcgguguaccuaggaaaccaaacaugugaauuuuacggccguaguaugagcgagauugucugcguaucucccccuuccucaaauggucuggggccagugcccguuagugugagcgucgauagagcccacguggacuccaaccuccaguucgaguauaucgaugacccuaggguacagcgcauugaaccggaguggucuaucgcuucgggacacaccccccugacaauaacuggcuuuaaucuugaugugauccaagaaccacggauuagagucaaauucaacgguaaggagagcguuaauguguguaaaguggucaacaccacgaccuugacaugccuggcaccuucauuaacuaccgacuacaggcccggccucgauacaguggaacgaccagacgaguuuggguucguuuuuaauaacguacagucccugcuuaucuauaaugauacuaaguucauuuacuauccuaaccccaccuucgagcugcuaaguccaacgggagugcucgaccagaagccgggcucuccuaucauacugaaagggaagaauuugugucccccagccagcggaggcgcuaaacugaacuacacagucuuaauuggugaaacccccugcgccgugacuguuuccgagacacagcuccugugugaaccuccaaaccuuaccgggcaacauaaggugaugguccacgugggaggcaugguauuuucacccgguucugucagcgugaucagugacucccuguugacucucccugcaaucguuagcauugcggccggcgggucucugcuacugaucauugugauaaucguccuuauugcuuauaaacgcaagucacgggagaaugaucucacccugaaaagauugcagaugcagauggacaaccuggaguccaggguggccuuagaaugcaaggaggcauucgcugaacuccagacagauaucaaugagcugacgagugaccuugaucguagcggaauuccguaccuggacuaccgcaccuaugccaugcggguuuuguuuccaggcaucgaagaucaucccgugcucagagagcuggagguccaagggaacggacagcagcacguggaaaaggcacuaaaacuguucgcccagcuuauaaauaacaagguauuucuccugacuuucaucaggacauuggaguuacaacgaucguuuucuaugcgggaccgcggcaauguggcuucccugauuaugaccggucuccaggggagacuggaauacgcgacagauguucuuaaacagcuguugagcgaccuaaucgauaagaaccuggagaauaaaaaccauccuaagcuccugcuuaggcggacugaaucagucgccgagaagauguuaaccaauugguucgcauuucugcuccacaaauucuugaaggagugugcuggagaaccccuguuuaugcucuauugcgccauuaaacagcaaauggagaagggcccaaucgacgccauaacgggcgaagcucgauacagucugucugaggacaaacuuauuagacagcagaucgaauauaagacacugaucuugaacugcgugaauccugauaacgagaauucccccgagauuccagugaagguccuaaacugugacaccauaacucaaguaaaagaaaagauccuggaugcaguguacaaaaacguuccuuauagccagcgcccgagggccguggacauggaucucgaguggcgucaggggcggauugcgagagucguguuacaggacgaagauaucaccacaaagauugagggagacuggaaaaggcugaauacucuuaugcacuaccaaguuucagaucgcaguguggucgcucuggugcccaagcagaccagcuccuacaacaucccagccucugcaagcauaucccgaacaucaaucucuagauaugacaguucguuccgguacacggguagcccugauucccucaggucucgcgcccccaugauuaccccagacuuggagucaggcguaaagguguggcaucugguuaaaaaucacgaucauggggaccagaaggaaggagaccguggcagcaaaauggucuccgagaucuaucucacuagacugcuugcuacaaaggguacccuacagaaauucguggaugaccuguuugaaacuuuguucaguacagugcaccgggggucugcauuaccucuggccauuaaguacauguuugauuuccucgacgagcaagcggauaggcacagcauccaugacaccgauguccgccacacguggaaaucaaacugccugccccuucgauuuuggguuaaugugauaaagaacccgcaguucguauuugacauucauaagggauccaucacugaugcuugucugaguguggucgcccagaccuucauggacagcugcucuacauccgaacacagacucggcaaagauucaccaagcaauaaguugcuguaugcaaaagacaucccuucguacaagucuuggguggagcgguauuacgccgauauugcuaaacuacccgccaucagugaccaggacaugaacgcauaccuggcugagcaauccaggcuccaugccguugaauuuaauaugcuuagcgcgcugaacgagauauauucauacguguccaaguauucugaagaguuaauuggcgccuuggaacaggaugagcaggcacgcagacaaaggcuggcuuacaaggucgagcagcucaucaaugccaugagcauugaaaguuga

SEQ ID NO: 60869 - RNA, 5616 nt, Artificial Sequence
  derived and/or modified sequence opt3 from PLXNA3__Homo_sapiens__NP_059984
augcccagcgugugccugcuccuucuguuguucuuagccgucggcggggcucugggaaacagaccuuuuagggcauucguugugaccgacacaacucuaacgcaccucgccguacaucgggugaccggugaggucuuugugggcgcgguuaaucgcguguucaagcuggcuccaaaccuuacagaacugcgagcccacgucacugggccgguggaggauaaugcacguuguuaccccccuccauccaugagaguaugcgcccauagguuggcucccguugacaacaucaauaaacuccugcugauugauuaugcagcccggcgccucguggcuuguggaucuauauggcagggcaucugccaauuuuuaagacuggacgaucuuuucaaguugggugaaccucaccauaggaaagagcacuaccugucaggggcccaggaaccagacaguauggcgggagucauuguggagcagggccagggccccagcaagcuauuuguggggaccgcagucgauggaaaauccgaguauuucccuacacucucuucgcggaagcugaucucagacgaagauagcgccgacauguuuagucuuguuuaccaagaugaguucguguccucucagauuaagaucccaagcgacacccuguccuuguauccggcuuuugauauauacuauaucuacgguuucguaucagccaguuuuguguacuuccucacucugcaguuagacacacagcaaacccugcucgacacggcaggcgaaaaauucuuuacuagcaagauuguccgcaugugugcuggggauucugaguucuauuccuacguggaguuucccaucggaugcucauggcgaggcguugaauauagacuugugcagagcgcccaccuggcgaaaccugguuugcuacuggcccaggcacucggggucccagcugacgaggaugugcuguucaccauuuuuagucagggacaaaagaacagggccucucccccucggcagacaauccuuugucuguucacuuuguccaauauaaacgcucauauucgucgcagaauccagagcugcuacaggggcgaaggcacccucgcccugccaugguuacugaauaaagagcuacccuguauuaacacaccgaugcaaaucaaugggaacuuuugcggacucguacugaaucagccucuugguggcuugcacguuaucgaagggcugccccuccuggcagacucgaccgauggaauggccucuguggcugcguauacguaccggcagcauuccgucguguucauuggcacucgaucagguagucuuaagaagguccgcguggacggguuucaggaugcacaccuguaugagacaguuccagugguagacggcagcccuauauugagagaucuccuguucucccccgaccacaggcauaucuacuuacugucugagaaacaagucagccagcuaccaguggaaaccugugagcaguaccagucaugcgccgcuugccucggaaguggcgauccccacuguggguggugcguucugcggcaucgcuguugcagagaaggagccugucuuggugcauccgccccucacggcuuugcugaggaauugagcaagugcgugcaagucagggugcguccaaacaauguaucugugacuucaccggggguucagcugacagucacccuccauaacgugcccgaccugagugccggagugagcugugcauucgaggcggcugccgagaacgaagcagucuuacugccuuccggcgagcuuuugugcccaucucccucgcuccaggaacugcgggcccuaacgcgaggucacggggcuaccagaacaguuaggcugcagcuccugagcaaagagacuggcgugcgcuuugccggagcagacuucguguucuauaauuguuccguacuucaaucaugcaugaguugugucggcucuccuuacccaugccacuggugcaaguaucggcauaccuguacaagcagaccccacgaaugcuccuuucaggaggggagggugcauucaccggagggauguccugaaauuuugccaagcggugaucuguuaauccccguuggcgugaugcagccucucacucugcgcgcuaaaaaccuuccccagccacaaucugggcagaagaauuacgagugcgucgugcgaguucagggacggcaacagcgugugccugccguaagauucaacuccaguagcguccagugucagaaugcgucuuauuccuacgaaggcgacgagcacggugauaccgagcuggacuuuucaguggugugggauggggacuuccccauagauaaaccaccgaguuuuagggccuugcucuauaagugcugggcucaacgcccuagcuguggccugugccuaaaggcagacccccgguucaacuguggauggugcauuucggaacacagaugucagcugaggacacauugcccagcccccaaaaccaauuggaugcaccucucccagaagggcacucgaugcucucauccucgcaucacgcagauccacccacuggucgggcccaaagagggaggcacacggguuaccauugugggugaaaaccuuggguugcugagcagagagguaggauuaaggguggcuggcguccguuguaauucaaucccugccgaauacauuagugcagagcgcauagugugcgagauggaagagucccucguuccgucuccacccccugguccaguggaacugugugucggcgauugcagcgcggacuuucggacucaauccgagcagguguacucauucguuacccccacauuugaucaggugagcccuaguagagggccggccucuggaggcaccaggcuuacuaucuccgggagcucgcuggacgcuggaucacgagucacaguaacggugcgggauucugaaugucaguucguucgcagagacgccaaggcaauugugugcaucaguccccuauccacccucggcccaagccaagcuccuaucacucuggccauugacagggcaaacauaucuagccccgguuugaucuauacauacacccaggauccaacagucacucggcuggagccuaccugguccauuaucaaugggucaacggccauuaccgugaguggaacacauuuacucacuguacaggagccccgagugagagcuaaauaucgcggcaucgaaaccacaaacacuugucaagucauaaaugacaccgcgaugcugugcaaggccccagguaucuuucuuggcaggccgcagccucgugcacagggggagcaccccgaugaauucggauuucuguuggaccacguucagacggcucggagccucaacagaucuuccuucacauacuauccagaucccucauucgagccucugggcccaaguggggugcuagacgugaagcccggaagccaugucgugcugaaaggcaagaaucuuauuccugccgccgcugguuccucuaggcucaacuacaccguucugaucgggggacaaccguguucguugacuguaagcgauacacagcuguuaugcgacucaccaucccagaccggccgccagcccgugaugguccucguggguggccuggaauuuuggcuugggacucugcacauuagugcagagcgagccuugacccucccugcgaugaugggacuggcugccggcgggggacuacugcuucucgcaaucacagccguucugguggcuuauaaaagaaagacgcaagaugcagaccggaccuugaaaagguuacagcugcagauggauaaccucgagucucgcgucgcccuggaauguaaggaggcguucgcugaacuucagacugacauaaaugagcugacaaaccauauggaugaggugcaaauucccuuuuuggacuaccguaccuacgccguaagaguccuauucccaggcaucgaagcacacccugugcugaaggagcucgacacacccccaaauguugaaaaagcccugcggcuuuuuggucaguuacugcauagcagggcuuucgugcucacuuuuauucacaccuuggaggcccaguccucauucucuaugcgcgaucgagggacggucgcaagccugacaaugguggcucuccagaguagacuggacuaugccaccggacuucugaagcaauugcuagcggaucugaucgaaaaaaaccucgaguccaagaaucacccuaaauuacugcuucggaggacugagagcguugccgaaaagaugcugaccaacugguuuacauuccucuugcauaaguuucugaaagagugcgcaggcgaaccgcucuuccugcuuuacugcgcuauaaagcagcagauggagaaaggccccaucgacgccauuacuggggaagcucgcuauucucuaucagaggauaagcugaucagacaacagauugacuacaaaaccuugacauuacacugugugugcccagagaaugaaggauccgcacaggucccugugaagguacugaacugugauaguaucacgcaggccaaagacaagcuccuggauaccguguauaaggguauacccuacagccaaaggccaaaagccgaggacauggaucuugaauggcggcagggccguaugacucgcauuauccugcaggacgaggacguuacaaccaagaucgaaugcgauuggaaacgacucaauucguuggcucauuaucaggucacugacgggucucugguggcgcuagugccuaagcaagucuccgcauacaacauggccaauagcuucacauuuaccagaucacugaguagguacgagucucuccuucggacggcuuccagccccgauucacugcgcaguagagccccgaugauuacuccagaccaggagaccggaacaaaauuauggcacuugguaaagaaccacgaucaugcagaccacagggaaggcgaucgggguagcaagaugguguccgagaucuaucugacccgacuccuggccacuaaagggacacuucagaaguucguugacgaucuguuugaaaccguguucucuacagcucauagaggaagcgcgcucccuuuggccauuaaauacauguuugacuuccuggaugagcaggcagaccaacgccagauauccgaucccgacgucaggcacacuuggaagucaaauuguuuaccacuacgguuuugggugaacguuaucaaaaauccccaguucguguuugacauucauaagaacucuaucaccgaugcuugccugagugucguggcccaaacguucauggacucguguagcacauccgagcaccgucucggcaaggauucuccuucaaacaaacuucuguaugcaaaggacauuccgaauuacaaaagcuggguagaaagauauuacagggauaucgccaagauggcuuccauaagugaccaggauauggacgccuauuugguggagcagucucgccugcacgcgagcgauuuuucaguucucuccgcacugaacgaacuuuacuucuacgucaccaaauaucggcaggagauccucacugcccuggaccgagaugcuaguugcagaaagcauaaguugaggcaaaaacuggaacagauuaucagcuuagugucuuccgacucauga

SEQ ID NO: 60870 - RNA, 1479 nt, Artificial Sequence
  derived and/or modified sequence opt3 from PLXNA4__Homo_sapiens__NP_001099013
augaaggccaugcccuggaacuggaccugccuucucagccaccuucugauggugggcaugggguccucuacauuguuaacuagacagccugcuccacugucacaaaaacagaggaguuucgucacguuucggggagagccggcagaagguuucaaucaucuaguuguggacgagcgcaccggccacaucuaccucggggccguaaaccgaauuuauaagcugagcuccgaucuuaaagugcuggucacacaugaaacuggacccgacgaggauaauccuaagugcuacccaccccguauagugcagaccugcaacgaaccuuugacaaccacuaauaacguuaauaaaaugcuccugaucgacuauaaggagaacagacugauugcguguggcucucucuaccaggguaucugcaaguuacugaggcuugaggauuuguuuaaacugggggaaccauaucacaagaaagagcauuaccuaucgggagugaaugaaucaggcagcgucuucggcgugauuguaaguuauuccaaccucgacgauaagcuguuuaucgcuacagccguugacgggaaacccgaguacuucccuaccauaucuagccggaaacuuacgaaaaauuccgaggcagauggaauguuugccuacguguuccacgacgaauuugucgcuucaaugaucaagauuccaagugauacuuucaccaucauuccggacuuugauaucuauuacguguaugguuucagcucuggcaacuuuguguacuuccugacauugcaacccgagauggucuccccuccagggucaacuaccaaggaacagguuuauacaagcaagcucgugcgccuguguaaggaggacaccgcauucaauaguuacguagaagugcccauaggaugcgagagaucuggcgucgaguauagguuacugcaggccgcuuaccucuccaaagccggugcggugcuugggcggacgcugggaguucacccugacgaugacuugcuauuuacuguguucagcaagggccagaaacgcaagaugaagucgcuggaugaaucugcacucuguauuuuuauccugaaacaaauuaacgaccgaaucaaggagagacuucaguccugcuacaggggcgaagggacacuggauuuggccuggcucaaagucaaggacaucccauguucaagugcucuguuaaccauugaugacaauuucugcggacuggauaugaacgcaccccuaggugugagcgacaugguacggggcauaccgguuuuuacugaggaucgugaccgcaugacauccgugaucgccuaugucuacaaaaaccauucucucgcuuucguggggaccaagagcggaaagcugaaaaagaugccuggcacgucacuuugucccaccuuggaacugcagacagguccaagaagucacagggccacugucacccucgagcugcuguuuuccagcuguucuucaaauuga

SEQ ID NO: 60871 - RNA, 6408 nt, Artificial Sequence
  derived and/or modified sequence opt3 from PLXNB1__Homo_sapiens__NP_001123554
augcccgcccugggaccugcucuccuucaggcacugugggccggguggguguugaccuuacaaccacugccgcccacugcguucacuccuaacggaacguaccuccagcaccucgcucgcgacccaaccagcgguacacuguaucuuggcgccacuaauuuucuguuccaguugucccccgggcuccagcuggaagcaaccgucucuacaggaccuguucuggauucaagggacugccucccacccgugaugccugaugaauguccacaagcccagccgaccaacaaucccaaccaguuacugcuuguaaguccuggcgcuuugguggucugcgguagcgugcaucaggggguuugugagcaacggcgccugggacagcuagaacagcuccugcuucgaccagagcgucccggcgacacucaguacguggcagccaaugauccugcugucuccacagugggccugguagcccaaggguuggcgggagaaccacuccuguuuguugguaggggcuauaccucuagaggggugggaggcgguauacccccgauuacgacucgggcauuauggccucccgacccacaggccgcuuucucguacgaggagaccgccaagcuggcagucgggcgccucucagaauauagccaccauuuugugagugcuuucgccagaggagcguccgccuacuuucuuuuccugaggcgggauuugcaggcacaaucucgcgcuuuucgagccuaugugagcagagucugccuaagggaccagcacuacuacuccuauguugagcugccucucgcuugugaaggcggccgguacgggcugauccaggccgcagccguggcuacaucacgugagguagcgcauggagaggugcuuuucgcagccuuuaguagcgcugcacccccaacugucgguagacccccuucugcagccgcuggcgccuccggggcaucagcgcugugcgcuuucccauuggaugaaguggacagacucgccaacaggacccgggaugcauguuauacacgagagggacgcgccgaagacggcaccgagguugcuuacaucgaauaugaugugaauagcgacugcgcccagcugccggucgacacguuagaugcauaccccugugguagugaccacacuccuucuccaauggcuuccagagugccccuggaggccacaccuauucuagaguggccagggauccaacucaccgcgguagccguuacuauggaagauggccacacaauugcuuuucugggagacagccagggccagcuucauaggguguauuuggggcccggaucggauggucacccguacucuacccaguccauccaacagggcucagcagucagucgggaccugacguucgaugggaccuucgagcaucucuacgugaugacacagagcacucugcuuaaggucccuguggccuccugcgcucagcaccuggacugugccucuugcuuggcacaccgcgauccauauugcggaugguguguucuccugggcagaugcagcaggcguucagaauguagucggggucaagggcccgagcagugguuaugguccuuucagccugaacugggcugccuacagguggcggccaugagccccgcuaacauaucucgagaggagaccagagaaguauuccucucagucccagaccugccuccccuuuggccaggagagaguuacagcugucauuuuggcgaacaccaauccccggccuugcugacagggucuggagugaugugcccuucgcccgauccaagcgaggcacccguucucccuaggggugcugacuauguguccgucucaguggaacugcgcuucggcgccguagugaucgcaaagaccagcuuaucuuuuuacgacuguguugccgucacagagcugcggccaagcgcucagugccaggcguguguguccucaagaugggggugcaauugguguguguggcaacaucuuugcacacacaaggccagcugcgaugcaggacccauggucgcuucucaucaguccccuuugguuaguccggacccacccgccaggggcgguccuagcccaucucccccuaccgccccgaaggcucucgcaacucccgccccagauacgcugccuguggagcccggggcgccauccacagcuaccgccucagacauuaguccuggcgcaagccccucgcuacuguccccauggggaccgugggccggcucugggagcaucucaaguccuggauccacuggcucuccccuccacgaggaaccaagucccccuuccccacagaacggucccgggaccgcugugccugcaccgacagauuuccgcccaucagccacccccgaagaccugcuugcgagcccuuugagucccucugagguagcugccgucccuccagcagaucccggaccagaggcccugcacccuacugugccguuagaccuacccccagcuacaguuccugccacgaccuuucccggcgcaauggguuccgugaaaccagcucuggauuggcuuacucgagaaggcggggagcugccugaagccgacgaguggacaggaggcgaugcgcccgccuucagcaccucgacauugcucucaggggacggagauucugcagaacuggagggcccgccagcuccucuaauucugcccaguucccucgacuaucaguacgacacuccaggucugugggagcuugaagaggccaccuugggggcuagcucuugucccugcgucgaaagcgugcaaggauccacgcugaugccuguucauguggagcgggaaauccguuuacucggcagaaaucugcaccuuuuucaggaugguccgggcgacaacgaguguguaauggagcuggaagggcuagaggucgugguggaagcaagggucgagugcgaacccccaccugauacccagugucauguuacaugccagcaacaccagcucucauaugaggcccugcagcccgaguugcgcgugggacuguucuuacggagagccggcaggcuccgaguagacagugcugaagggcugcacgugguccuuuacgauuguagcgugggacauggcgacugcucucgcugucagacugcgaugccucaauacgguugcguuuggugugagggggaacggccaagaugcgugaccagggaggcaugcggagaggccgaagcugucgccacacagugucccgcaccucugauacacuccguggagccauugacuggccccguugaugguggcacccgugugacgauucgcgggucaaaucucggacagcauguccaagacguacugggcauggugacaguugccggggugccgugcgcugucgaugcgcaggaauaugaggugaguagcucccuaguauguaucaccggagccucuggcgaagagguggccggugcuacugccgucgagguuccugggcggggaagaggcgugucggaacacgacuuugcauaccaggauccaaaggugcauagcauuuuccccgccaggggcccucgagcugggggaacacggcugacccuuaacgguucaaagcuccugacuggccgcuuggaggacaucagagucgugguuggggaucagccaugccaccuguuacccgaacaacaguccgagcagcucaggugugaaaccaguccgcggccuacacccgccacgcugccaguagcggugugguuuggagcaaccgagcgaagacuucagcgcggccaauucaaauauacucuggacccuaauaucacaucugccggucccaccaagagcuucuuguccgggggaagggagauuugcguccguggccagaaccucgacgugguucagacaccacggauaagagugacugucgugucaaggaugcugcagcccucucaaggccuagggcgccgaagacggguagucccugaaaccgcuuguagccugggaccaaguugcuccagccagcaguuugaggaaccgugucacgugaacucuucacagcuuaucacgugcaggacacccgcccucccuggucugccagaggaucccuggguucgcguggaguucauuuuggacaauuuagucuuugauuucgcuacccugaacccuacuccauuuuccuacgaggcagaccccacccuccaaccucugaauccggaggauccaacaaugcccuuccgucauaaaccuggcaguguguuuagcguugaaggggagaaccuugaccuggccaugucgaaggaagagguggucgcuaugaucggagauggccccugugugguaaaaacuuugaccagacaccaucuauauugcgagccaccuguggaacagccccugccacggcaccaugcccucagggaggcaccggacucucugccugaguucacaguucagauggguaaucuucgcuuuuccuuagggcacguccaauacgauggagagagccccggcgcguucccaguggccgcucaggugggccugggggucggaacgucacucuuggcccuggguguaauaauuaucgugcucauguaucgaagaaagaguaagcaggcacugcgggacuacaaaaagguucagauccaacuugaaaaccuggagucuuccgugagggaucgcugcaaaaaggaguuuaccgacuugaugacugaaaugacagaccuaaccagcgaucugcucggcucagggauucccuucuuagacuacaaagucuaugcugagagaaucuuuuucccuggacacagggaaaguccacugcaucgggaucuuggcgugcccgagagccgucgcccuacuguugaacagggucuggggcagcucuccaauuugcugaacucuaaacucuuccugacaaaauuuauucacacccuugagagccagcgaacguucuccgccagagacagggcauacguggccucacuacugacugucgcuuugcauggaaaguuagaguauuuuaccgauauacugcggacacuccugucugaccuuguggcgcaauacguagccaagaauccgaaacugaugcuccgcagaaccgaaacugugguugagaaguugcugacaaacuggaugaguaucugucuauauaccuucgucagggauucggugggcgaaccacuguacaugcucuuucggggcauuaaacaccagguggacaaggggcccgucgauagcguuacaggaaaagcaaaguauacucuuaaugacaaccgacuguuaagagaggauguggaauaccgcccuuugacccugaaugcucuccuggccguagguccaggcgccggggaggcacagggagugcccgucaaggugcuugacugcgauacgaucucccaggcuaaagagaagaugcuggaccaacucuacaaaggcguuccuuugacacagaggcccgacccacggacccuggauguggaauggcguucuggugucgccgggcacuuaauccuaucagacgaggauguaacuagcgaagugcagggacuguggagaaggcucaacacccuucaacauuauaagguuccggacggcgcgacaguggcucuggucccuuguuugacuaaacacgugcugcgcgagaaucaggauuacguccccggcgagcggaccccaaugcucgaagacguggaugaagggggcauucgaccuuggcaucugguuaagcccuccgacgaaccagagccucccagaccgaggcgcgguagucuucggggcggggaaagagagcgugccaaggcaauaccagagaucuaucucacgaggcuguugucuaugaaaggaacacugcagaaguucguggaugacuuauuucagguaauucuaagcaccucacggccugugccccuggccgucaaauacuucuuugaucuccuugacgaacaagcucagcagcacggcaucuccgaucaggacacuauucauaucuggaagacaaacagucugccauugcgcuucuggauaaacaucauuaaaaauccccaauuuguuuucgacgugcagaccagcgauaacauggacgcaguccugcucgugaucgcccagacuuucauggaugcgugcacacuggcugaccacaaacuuggucgagauucuccuauuaauaaguuacuguaugccagagacaucccgagguacaaacggaugguagagcgcuauuacgcagauauaagacagaccgugccagccuccgaccaagaaaugaacucaguucucgcugaguugagcuggaauuacucgggggaucugggcgccaggguggcacuacacgaacuguauaaguacauuaacaaauauuacgaccagaucauuacggcucucgaggaggauggaacugcccagaagaugcagcuuggcuaucgacugcaacagaucgcggccgcagucgaaaauaaagugaccgacuuguga

SEQ ID NO: 60872 - RNA, 5799 nt, Artificial Sequence
  derived and/or modified sequence opt3 from PLXNB3__Homo_sapiens__NP_001156729
auggagcugacccccgccagcucccucacaugcucucuucugucaccuagauugccaggcaguuucccgcaguuaaggcgggugcccccuuguagccgcccauggcugcccaaggcuccugucauggcacgauggccacccuuugggcuaugccuccugcuucuguugcucuccccuccaccgcugccccugacuggagcccaccguuucucugcgccuaacacgacccucaaucauuuagcucuggccccagguagaggcacacuuuacguuggggcagugaacagguuguuucaacugucgcccgaacuacagcucgaggccguagcugugacuggaccugucaucgacucaccagauugugugcccuuccgggacccggcagaaugcccucaggcccagcugaccgauaaugcuaaccaacuucuguugguuagcagucgcgcccaggagcucguggcguguggccaggucagacagggugugugcgaaacaaggcggcugggggacguagcagagguuuuauaucaagccgaggaucccggagacggccaguuuguggcugccaauaccccaggcgucgcaacuguggggcugguggucccucuccccggacgcgaucuucuguugguugcucgaggucuagccggcaaacuguccgcgggggugccaccccucgccauuagacagcuggcaggaucucagccuuucagcuccgaaggccuugguaggcugguagugggggacuuuucagauuacaacaauaguuaugucggagcuuucgccgacgcucggagcgccuacuuuguguuccgucgcagaggcgcaagggcccaagcugaguaucggucuuacguugcgcgaguguguuugggcgauacaaaccucuauuccuacgucgaagugccacuggcaugccaggggcagggauuaauacaagccgcuuuucuggccccggguacccuacucggcguauucgcagccgggccccgcggaacgcaggcugcccugugugcauuuccuaugguugagcuuggcgcgucaauggagcaggcuagaagguugugcuacacugccggugggcggggcccaagcggagcagaagaggccaccguggaauauggcgucacaagucgcugugugacucugccccucgacucuccugaguccuacccaugcggggaugaacacacccccagcccgaucgcuggaagacagccucuggagguccaaccacuucugaaguugggucagcccgugucggccguugcagcucuccaggccgacggccauaugauugcguuccugggggacacacagggacaauuauauaaaguguuccugcacggcucucagggucagguauaccauucccagcaagucgggccucccggcucagccaucaguccagaucuacuccuggacagcuccggaucucaccuuuauguguugaccgcucaccagguugauaggauuccuguggcagccugcccccaguuuccagacugugcuagcugccugcaggcccaagauccgcucuguggcuggugcguccugcaggggcguuguacgcggaagggacagugcggucgagcaggccaauuaaaucaguggcuguggucauacgaggaagacagucauugucuucacauccaguccuugcucccugggcaucaccccagacaggagcaaggacaggugacucugagcguaccaaggcuacccauacuggaugcggacgaauauuuccacugcgccuuuggcgauuacgacucucucgcucauguggaggguccucacguugccugugucacaccaccccaggaucaggugccucugaacccgccagggaccgaccaugugacugucccccuugcauugauguucgaagacguuacaguggcugccaccaauuuuucauucuacgauugcagugcagugcaagcccuggaggcugcggccccuugucgcgcaugcguaggcagcaucuggcggugccacugguguccacaguccucucauugcgucuauggagagcacugucccgaaggcgagagaacgauuuacucggcucaggaaguggacauccagguuagggggccuggagccugcccgcaaguggagggcuuagccgguccccaccucgucccaguggggugggaaagccaucuggcucuucgcguucgaaaccugcagcacuuucggggauugccugcauccuuccauuguuggcucgagcugcccggcgagcuacguggucugccagccacccucgaagagacagcgggcgauucagggcugauucacugccaggcucaccaauuuuauccuaguaugucucagagagaacuucccgugccaaucuacguaacucagggagaggcccagagguuggacaauacccaugcacuguaugucauauuauacgauugugccaugggccacccggacugcagccauugucaagcugcaaaccgcucccucgggugccuguggugugccgauggacagccugcgugccgguauggcccccuuugcccacccggugcuguggagcugcuauguccugccccaucaauugacgcaguggaaccccucacagggccuccggagggaggccuggccuugacuauccuggguagcaauuuaggcagagcuuucgccgauguccaguacgcaguuucuguggcuuccaggccaugcaaccccgaaccuagucucuaccgaaccagcgcccgcauuguaugugugacaucucccgcgccaaacgggaccacuggaccuguccggguggccaucaaaucccagcccccaggcaucucaagucaacacuuuacguaucaggacccuguucugcuuagccugucgccgagaugggggccccaggcaggaggcacacaguugaccauuaggggucaacaucuccagacugggggaaauaccuccgcuuucgugggcggucagccaugcccuauacuggagcccgucuguccagaagccaucgugugccguacacgcccucaggcugcacccggcgaggccgccguucuaguggucuuugggcacgcucaacggacccugcuugcgucuccguucagauacacugcaaacccacagcucguagccgcugagccuagcgccucauucaggggaggcgggcgacugauucgggugcgcggaacaggcuuggauguugugcagagaccccuguuaagugucuggcucgaagcagacgccgaggugcaagcuuccagggcgcagccacaggauccccagccucggcgaucuuguggugccccggcagcugacccccaagccugcauccagcuggggggaggccuucugcaguguagcacgguaugcuccgugaauucaagcaguuugcuccuguguagaucuccagcagucccugaccgcgcccacccccagaggguuuuuuucacccuagauaacgugcaaguggacuuugcuuccgccagcggcgggcagggauuccuguaucagccuaauccacgucuugcgccccucucgcgggaagguccugcaagaccauacaggcugaagcccggccaugucuuggauguggagggggaaggauuaaaccugggcauaucaaaggaggagguucgcguacacauuggucgaggggaaugccucgugaaaacucugacaagaacccaucuuuauugcgagccgccugcccacgcuccacagcccgccaauggaucuggccugccucaauuugucgugcagaugggcaacguucaguuggcucuagggccagugcaauacgaagcagagcccccgcugagugccuucccugucgaagcucaggccggaguggguaugggcgcagcgguacucaucgccgcuguccugcuuuuaacacugauguaucggcauaaguccaaacaggcccucagggacuaccagaagguguugguucaacuggagagccucgagacuggggugggagaucagugucgcaaagaauuuaccgaccugaugacggagaugaccgaucuuucuagcgaccuggaaggcuccgguauccccuucuuggauuaccguacauaugcagagagagcuuuuuucccagggcacggaggcugcccucuacagcccaagccagagggccccggggaagacggacacugugccacuguccggcagggucugacccaacucucaaauuuacugaacaguaagcuuuuucugcucacauugauucauacucuggaggaacagccuagcuucucucagagggaucgcugccacguggcaucccuccugucacuugcccuacauggcaaacuggaguacuugaccgacaucaugcgaacguuacugggggaucucgcugcgcacuauguucacagaaauccaaagcugaugcuucggaggacagaaaccaugguggagaaacugcucacuaacugguugaguauuugucuguacgccuuucuacgcgaggucgcaggagaaccgcuguauaugcucuucagagcuauacaguaccaaguggacaagggccccguagacgccgugacagguaaagccaagaggacccuuaaugauagccggcuguuacgugaggacguugaauuccagccuuugacucugaugguccucguggggccaggagcaggcggcgcugccggguccucugagaugcagcgcgugcccgcgcgaguccuggauaccgacacaaucacgcagguaaaagaaaaggugcuugaucaaguuuauaagggaaccccuuuuucgcagagaccaagcgugcaugcucuggaccucgaguggaggucagguuuggccggccaccugacuuuauccgaugaggaccuaacaagugucacccagaaccauuggaaacggcugaauacacuccaacacuacaaggugcccgauggggcaacuguuggacuugugccucagcugcaucgcggcucuaccauuagccaguccuuggcccagagaugcccgcugggugaaaacaucccaacgcucgaggacggggaagagggaggcgucugucuguggcaccuugugaaagcuacagaagagcccgagggcgcaaagguaaggugcucaucucuccgggaacgagagccugccagagcgaaagcuauccccgaaauuuaccugacccgcuugcugagcaugaaggggacuuuacaaaaguucguggaugacaccuuucaggccauacuaaguguuaacaggccaaucccuauugcagucaaauaucuguucgaccuccuugaugagcuggccgagaagcacggaaucgaagaccccgguacauugcauauuuggaaaacuaauucccugcuccugcgguuuugggugaacgcucuuaagaauccacaguuaaucuucgaugugcgugucagcgacaacguugaugccauacuggcagugaucgcucagaccuuuauugacucuuguacaacgucagagcacaaaguaggcagagauuccccggugaauaagcucuuguacgccagggaaaucccucgcuauaagcaaauggucgagcgguacuaugcggacauucgacagaguagccccgccucguaccaggaaaugaacucugcacuggcugagcuauccgggaauuauaccagcgccccacauugccuggaggcacuccaggaacuuuacaaccacauccacagauacuaugaucaaauaauuucagcucuggaggaagaccccgugggacagaaauugcagcuggccuguaggcuccaacagguugccgcgcugguggagaauaaggucacugauuuauga

SEQ ID NO: 60873 - RNA, 4707 nt, Artificial Sequence
  derived and/or modified sequence opt3 from PLXNC1__Homo_sapiens__NP_005752
auggaggugagcagaaggaaggcucccccucggccaccgcgccccgccgcaccucugccacuccuugccuaccuguuggcguuagcugcccccggccgaggggcagacgaaccugucuggcguuccgagcaggccaucggagcuauugcagccucucaagaagaugguguuuucguggcuucaggcaguugccuggaccagcuagauuauagccucgagcacucccugucuagacuuuacagggaccaggccgggaacuguaccgaaccaguaucgcuggcgcccccugcacggccacgcccgggauccagcuuuaguaaauugcuccugcccuauagagagggcgccgcuggucugggagggcucuuacugacaggcuggacuuucgauaggggcgccugcgaggugcggccucuugggaauuugucccgcaacucucugcgaaauggaacggaagucgugagcugucauccacaggguuccaccgcaggcguuguguacagagcugggaggaacaaucggugguaucuagccgucgcggccacauacgugcuccccgagccugaaacugcaucacguugcaacccagcugccagugaccacgauaccgcuauagcccugaaggacacagagggacgcagccuugcaacccaagagcugggcagauugaaacucugugaaggugccgggucucugcauuuuguagaugcuuucuuauggaauggauccaucuauuuucccuacuacccguauaacuacacuucaggcgcggcaacaggcuggccuagcauggccaggauugcucagaguaccgagguucuguuccaggggcaggccucucucgacugcggacacggucaucccgauggccggcgacuucuguuguccagcucgcuaguggaagcacuggacgucugggccgggguguuuucugcugccgcaggagagggccaagaacgcagauccccaacgacuaccgcgcucugucuguucaggaugucagagauccaggcucgggccaagcgcgugaguugggauuuuaaaacagcagagagccacugcaaggaaggugaccagccugagagaguccagcccauugccuccucuacucuuauccacagcgaccugaccucaguuuaugggacagugguaaugaauaggaccguguuguuccucggcacgggagauggccaacuguuaaaggucauacugggggaaaaccuaaccaguaauuguccagaggugaucuacgaaauuaaagaggagacacccguuuucuauaagcucgugccugacccagucaaaaacaucuacauuuaucugaccgcuggaaaggaagugcgucggauccgaguagccaauugcaacaaacauaaguccuguagcgagugccuuacugcaacagauccgcacugcgguuggugucauucuuugcagagaugcaccuuccagggcgacuguguucacucagaaaaucuggagaacuggcucgauauaaguagcggggcuaagaaaugccccaagauucaaaucauuagguccucuaaagaaaagacgaccgugacaauggucggaucguuuagcccucgccacuccaaauguauggugaagaacgucgacucaagucgggagcugugccagaauaaaucucagccaaacagaacuuguaccugcagcauccccacaagggccacuuacaaggauguguccguugugaauguaauguucucauucggcagcuggaaccuuucugaccgcuuuaauuucaccaacuguuccagucugaaggagugcccugcgugugucgaaacagguugcgccuggugcaaaagcgcucgacgguguauccauccauuuaccgcaugcgaucccucugacuacgagcguaaucaggaacaauguccgguggccguugagaagacuuccgggggcggaagaccuaaagagaacaagggcaauaggacgaaccaggcucuccagguguucuauauuaaaucaauagaaccacagaaggucaguacauugggaaagagcaaugugaucguaaccggggccaacuuuacucgcgcaucgaauauuaccaugauccugaaagguacaucaaccugcgauaaggacgugauacaaguuucucacgucuuaaacgacacucauaugaaauucagccugcccucaagucggaaggagaugaaagauguguguauucaguuugacggcgggaauugcuccucugugggaagccuauccuacaucgcgcucccucacuguucacugaucuuccccgccacaacguggauuagcggcggucagaacaucaccaugauggggagaaacuuugaugucauugacaaucuuauaaucagucaugaauugaagggcaacauuaauguuucugaguauugcguggcuacuuacuguggauuccuggccccaucccucaagagcucgaaagugaggacaaacguaaccgucaagcugcgagugcaggauacauauuuagacugcggcacucugcaauaccgcgaagauccucgguuuaccggguauagaguugagucagagguggacacggaacuugaggucaaaauccagaaggaaaaugauaacuucaauaucucuaaaaaggacauugagauaaccuuguuucacggagaaaacggccagcucaauuguaguuucgagaacaucacaaggaaucaggaucugacuaccauucuaugcaagaucaaagguauuaagacagcauccacuaucgcuaacagcucuaaaaaggugcguguuaaacuggggaaucucgagcuguacguggaacaagagagcguacccuccaccugguacuuccuuauagucuugccagugcuguuagugaucgucauuuuugccgcaguuggagugacgcgccacaagucaaaagaacucagucggaagcagagccagcaacuggagcuucuggaaucugaguugagaaaggagaucagggacggcuucgccgaacuccagauggauaaacuggacguaguggacuccuuugguacagucccguuccuagauuauaagcauuuugcucugcgaaccuucuuuccugagucaggcggguucacucacauuuuuacagaagacaugcauaaccgggaugcgaaugacaaaaacgagagucucaccgcccuggaugcacuuaucugcaacaagagcuucuuggugacuguuauacacacccuggagaaacagaagaauuuuuccgugaaggaccgcuguuuauucgcuucuuuucucacaauugcccugcagacgaaacuugucuaccugaccucgauccuagaagugcucacuagagaucugauggagcaaugcagcaacaugcagcccaaguugaugcugaggcggacagaaucaguuguggagaaauuacucaccaauuggauguccgucugucugaguggauuccuucgagaaacaguaggcgagccauucuaucuguuggugacuacccucaaccagaagauuaauaaagggcccguugacgugaucacgugcaaggcccuguacacacuaaacgaggauuggcugcuuuggcaggucccugaauuuucuaccguggcucucaauguaguguucgagaagauaccagaaaacgagagcgcagacgucuguagaaauaucuccguuaacgugcuggauugcgacacuauuggacaagccaaagaaaagaucuuucaggcguucuugucuaaaaauggcucacccuauggucugcaguuaaacgagauugggcucgagcugcagaugggaacccgccaaaaggaacuucuggauaucgacagcaguuccgugauauuggaggacggcauuacaaaacucaauacuaucggucacuacgaaaucagcaacggcucuaccauuaaggucuuuaagaaaaucgcuaauuucacaucagauguggaguauuccgacgaucauugucaccugauucuaccugacagugaagccuuucaggauguucaggggaagaggcaucguggaaaacacaaguucaaaguaaaggagauguaccugacgaaacuucucagcaccaagguggcaauacauucgguccuggagaaguuguuucggucuaucugguccuuaccgaacagcagagccccauucgcuauuaaauacuuuuucgacuuccuggaugcacaagccgaaaacaagaaaaucacugaccccgaugugguucacauuuggaagacaaauucacucccucugagguuuugggugaacauccuuaaaaauccacaguucgucuuugacauaaagaagacuccccacaucgauggcugccugagugugauugcgcaggcuuucauggacgccuuuucuuugacugagcagcaacuagggaaagaagcaccuacaaacaagcugcucuaugccaaagacaucccgaccuacaaggaggagguaaaauccuauuacaaggcuauucgcgaucugcccccacuuagcucaagugaaauggaggaauuuuuaacgcaggagagcaagaaacaugaaaaugaguuuaacgaggaagucgcccugacugagaucuauaaguacauagugaaauauuucgacgaaauucucaauaaguuggagcgagaaagaggacuggaggaggcacagaaacagcuccugcacguuaaggugcuuuuugaugaaaagaaaaaguguaaauggauguga

SEQ ID NO: 60874 - RNA, 5778 nt, Artificial Sequence
  derived and/or modified sequence opt3 from PLXND1__Homo_sapiens__NP_055918
auggcccccagagcugcaggaggggccccucugagcgcgagagcugccgcagccuccccaccgcccuuccagaccccuccacggugccccgugccucuccuucuguuguuacugcugggagcugcacgcgccggugcucucgagauacaacgacguuuuccaucucccacuccuacuaacaauuucgcccuggacggcgcggcagggacggucuaccuugccgcuguuaacagacuguaucaguugucaggagccaaucucagucuggaagcagaggcugccgugggcccaguaccggacagcccccugugccacgcgccucagcucccacaggccuccugcgaacaucccaggcgguuaaccgacaacuacaauaagauucugcaacuugauccuggucagggguugguggucguguguggaucuauauaucagggcuuuugccagcugcgcagaaggggcaacaucucggcaguugcugugcgguucccacccgccgcuccgccugccgagcccgucacaguguuuccaucaaugcuaaauguagcagccaaccacccuaaugcuagcacuguugggcucgugcugcccccagcggcaggagccgguggcagucgccuucuggucggggcuaccuacacaggauauggcuccucuuucuuuccccgaaacaggagcuuggaagaccauagguucgagaauaccccugagauugccauccggucccucgauacucguggugaccuggcaaaauuauuuacauucgaucugaacccaucagacgauaauauucucaagaucaaacaaggggccaaggaacagcacaaacuuggauuugugagugcuuuccugcauccgagcgaucccccuccaggcgcccagucuuacgcauauuuggcgcuaaacuccgaggcucgcgccggcgauaaggaaucacaggcaagaagccugcucgccaggauaugucugccccacggggcuggaggugacgccaagaaacuuaccgagaguuacauccaacugggcuugcagugcgcagggggagcuggccggggugaucucuacucucgacugguguccgucuuuccugcccgcgagagauuauucgcgguuuucgaaaggccacaggggagccccgccgcucgggcagccccggcugcccugugugcauuucgcuucgcggacgugagagccgcuauuagggccgcacguacggcuugcuuuguagagccugccccagacguggucgcagugcuagauucgguugugcaaggcacuggacccgccugugaacggaagcucaauauccagcugcagccugagcagcuugacugcggcgcugcgcacuugcaacauccccugucuauucuccagccacugaaagccaccccugucuuccgagcacccgggcuuacauccguggcuguagccucaguuaacaacuauacugccguguuucugggaaccgucaaugguagauugcucaagaucaaccugaaugaaaguaugcaaguggucagcaggcgcgugguuacaguggcuuacggcgagccaguacaccaugucaugcaguucgauccggcagacuccggguauuuauaccugaugaccucucaccaaauggcccgggugaaaguugcggcuuguaacgugcacagcacgugcggagauugcgucggcgccgcagacgccuauugugguuggugcgcucuagagacuagauguacacuccagcaggauugcaccaauucaagucagcaacauuuuuggacuuccgcaagcgaagggccuucuaggugucccgccaugacagugcugccaucagagauagacguacgccaggaauaccccggcaugauucuucagaucaguggcagcuugccuucccugucuggcauggagauggcgugcgauuaugggaacaauauucgaaccguggcucggguuccaggacccgccuucggucaccagaucgcauacuguaaccuccugccucgugaccaauuuccgccauucccuccuaaucaggaucaugucacgguggaaaugucggugagagucaacggcaggaauaucguuaaggccaacuuuaccauuuacgacugcagccgcacagcucagguguauccacacacugccuguaccuccugcuuaucagcacaauggcccuguuucuggugcagucagcagcauucuugcgugagcaaucagucccggugugaggcuucaccuaacccgacaagcccccaagacugcccaagaacucugcuuucuccuuuggcccccguaccaaccgggggaucccagaauauacucgucccucuggcgaacacagccuuuuuccagggcgcagcucuagaguguaguuucggucuggaagagaucuuugaagccguguggguuaacgagagcguggucaggugcgaucaggugguucuccacaccacucgaaagucucaaguguucccccugucccuucaguugaaagggcgcccagcucgguuucuggacucaccggaaccuaugacgguaauggucuacaauugugcaaugggcagucccgauugcagccaguguuuaggaagagaggaccucggccaccugugcauguggucggauggguguaggcuucguggaccacugcagcccauggccggcacaugcccugccccagagauucgcgcuaucgaacccuuguccgguccucucgacgggggaacccugcuaacuauacggggcagaaaccuggguaggcgacucucugauguggcgcauggcguguggauugggggagucgcaugugagccgcugccagaccgguauaccguuagcgaagagaucgugugcguaacaggccccgccccugggccccuuucaggaguggucaccgugaaugcuaguaaggagggcaaaucccgcgauagauucucuuacguuuugccacuggugcacagcuuagaaccuacuaugggucccaaggccgggggaacaaggaucacgauucauggcaacgaccuccacgucgguuccgagcugcaagugcuuguuaaugauaccgacccaugcacugaacugaugcggacagauaccucaaucgcauguacaaugccugagggcgcccuaccggcucccgugccagucugcguacgauuugaaagacgcgggugugugcacggaaaccucacuuucugguauaugcagaauccuguuauuaccgcgauaagccccaggcguaguccagugucuggcgggcggacgaucaccgucgccggagagagauuucauauggugcagaacguauccauggcagugcaccauauuggcagggagccuacacugugcaaagucuugaauagcacucugaucaccugucccucgccgggugcuuuaucaaacgccucugcaccaguugacuucuuuaucaaugggcgcgccuacgcugacgaaguggccguggcggaggaacuccuggauccugaggaagcacaacgaggaaguagauuccggcuugacuaucugcccaacccacaguuuuccacagccaagagggagaaauggauuaagcaccaucccggcgagccuuugacucucgucauacacaaggaacaggauagccugggucuacagucucacgaguaccgcgugaaaaucggccaaguuagcugcgacauucagaucguauccgaucguauuauccauuguucagugaaugaaagucugggggcugccgucggacagcuuccgauaaccauccaggugggcaacuucaaucaaacgauugcuacacuccagcuagggggaagcgagaccgcaaucauuguuucuaucgugauaugcuccgucuugcuguuacucucagugguagcccuguuugucuucuguacuaagaguagacgggcugaaagguacuggcagaaaacacuucugcagauggaggagauggaaagccaaauucgcgaggaaauccgaaagggcuucgccgaguugcagaccgacaugacugaucucaccaaagagcugaacagaucccaggguauucccuuucuagaauauaagcacuucgugacacggacguuuuucccaaaguguucuucgcuguacgaggaaagguauguucuuccuagccagacccucaacucacaaggguccagucaggcacaggagacucauccccuguugggagaauggaaaaucccugagucuugucgcccaaauauggaggaaggcaucagcuuauuuuccucacugcucaacaauaagcacuuccugaucguguuuguccaugcgcuugagcaacagaaagacuucgccgugagagauaggugcucucuggcuagcuugcuaacaauugcccugcacggcaagcucgaauacuauaccaguaucaugaaagagcugcuuguugacuuaauugaugcauccgcugccaagaaccccaagcugaugcuccggcguacagaaagcguggucgagaaaauguugacuaauuggaugucuaucugcauguacucaugucugcgcgagaccgugggggaacccuuuuuccuccugcuuugcgcaauaaagcagcagauuaacaaaggauccaucgacgccaucacggguaaggcucgauauacacugaaugaggaaugguugcuaagagagaacauugaagcgaaaccaaggaaucugaacguaaguuuucaaggcugugggauggauagccucucggugcgggccauggacaccgacacuuuaacccagguuaaggagaagauccuggaggcauucugcaaaaauguccccuacucucaguggccgcgcgcugaagauguggaccuugagugguucgccuccagcacacagucauacauucugagagaucucgacgauacaaguguggucgaagacggaaggaagaaauugaacacccuggcccacuauaagauaccugagggcgcaucucucgcuaugucccugaucgauaaaaaggacaauacacuuggucggguaaaagaucuagacacggagaaguacuuucaucugguguugccaaccgaugaauuagccgagcccaagaaaagccaccgacaaucacauagaaagaaaguucugccugaaauuuaucucacucgccugcuuaguacaaaggggacccugcagaaauuccucgacgacuuguuuaaggcgauccugagcauuagggaggauaagccaccccuagcugugaaauacuucuuugacuuccuggaggaacaggccgagaagcggggaaucuccgauccggacacucuccacauauggaaaacaaacucucuuccucugcguuuuugggucaauaucuuaaagaacccccaguucguguuugauauugacaaaaccgaucacaucgacgcauguuugagcguuauugcccaggcuuucaucgaugcaugcuccauaucagaccugcagcucggcaaggauucuccaacgaacaagcugcuuuaugccaaagaaauuccugaguacagaaagaucgugcagagguauuacaaacaaauccaggacaugacuccccugagugaacaggagaugaaugcgcaucucgcugaagagucgcgcaaguaccagaacgaguuuaauaccaacgucgccauggcagaaauuuauaaauacgccaagcgguaucgaccacaaauaauggcugccuuggaggcaaaucccacagcuagaaggacccagcugcagcacaaguucgaacaggugguagccuuaauggaggauaacaucuacgaauguuauagcgaggcguga

SEQ ID NO: 60875 - RNA, 1509 nt, Artificial Sequence
  derived and/or modified sequence opt3 from PM20D1__Homo_sapiens__NP_689704
auggcccagagaugcguguguguccuggcucucguugcaaugcuucuguugguguuccccaccguaagcagguccaugggcccucggucuggggagcaccaacgcgccucacgaaucccaagucaguuuagcaaggaggaacguguggcgaugaaagaagccuuaaagggagccauucagauaccgacagucacuuucuccucugagaaaucgaacacgaccgcacuggccgaauuugguaaguacauccauaaaguguuccccacaguugugucaacuagcuuuauucagcacgaggucguggaggaauauagucaucuauucaccauccaaggcuccgacccuucucuccagccauaccugcuuauggcucacuuugauguaguucccgcaccugaggaagggugggaggugccacccuucagcggacuggagagagacggcauuaucuaugguagggggacauuggaugacaaaaauuccgucauggcccuccugcaggcucuggaacucuuacugauacggaaguacaucccucgcagaucauuuuucauuagucuuggacaugaugaggaaagcucuggcaccggcgcccagaggaucuccgcguugcugcaaucacgcggggugcagcuagcauuuauuguggacgagggagguuucauccucgaugacuuuauaccaaacuucaaaaagccgauugcccugaucgcugucagcgaaaaaggcaguaugaaucuuaugcugcagguuaacaugacuucugggcacuccagcgcucccccuaaggagacaucgauuggaaucuuggcagcugccgugucucggcucgagcagaccccaaugcccaucauuuucggcuccgguacgguagugacuguccugcaacaguuagcgaaugaauuuccuuucccagugaacauaauccugucaaaucccuggcucuuugagccgcuuauuagucgauucauggaaagaaacccucugaccaaugccaucauaaggacaacuaccgcauugacaauuuuuaaagcugggguuaaguucaacgugauucccccagucgcccaggcuaccgugaauuuucggauccacccuggacaaacgguacaggagguucuagaacugacuaagaacaucguggccgauaaucguguccaguuccaugugcucagcgcauuugacccccugccagucucccccucugaugacaaagcccuuggcuaucagcuguugcgccaaacagugcagagcguuuucccugaggugaacaucaccgcuccaguaacuucaauuggcaauacagauaguagauuuuucaccaaccucacgaccgggauauacagguuuuauccgaucuacauucagcccgaggacuucaagcggauccacggagucaacgaaaagaucuccgugcaggcguacgagacacaaguuaaguucauuuuugaacugauacagaaugcagacacugaucaggagccugugagccauuuacacaaacuguga

SEQ ID NO: 60876 - RNA, 165 nt, Artificial Sequence
  derived and/or modified sequence opt3 from PMAIP1__Homo_sapiens__NP_066950
augcccggcaagaaagccagaaagaacgcucagccuagcccagcaagggccccggcggagcuggaaguggagugcgcuacccaacuccggcgcuucggggacaaacuuaauuuucgacagaagcuguugaacuuaaucuccaaacuguucuguucuggaacauga

SEQ ID NO: 60877 - RNA, 498 nt, Artificial Sequence
  derived and/or modified sequence opt3 from PMCH__Homo_sapiens__NP_002665
auggccaagaugaaccugagcuccuacauccucauucuuaccuucucucuguuuucacagggcauauuguuaagugcuagcaaauccaucagaaaucuggacgaugacaugguguucaacacauuuaggcuagggaagggauuccaaaaagaggauacugcagaaaagucugucauugcccccucgcucgagcaguauaaaaaugacgaaagcucauuuaugaacgaggaagagaauaagguuaguaagaacacggguuccaaacacaauuuccugaaccauggccuuccucugaauuuggcgaucaagccauaccucgcucugaaagggucuguggccuuuccggcagagaacggaguacagaauaccgaaagcacacaggagaagcgggaaauuggcgaugaggagaacuccgccaaauuccccaucggucgccgagacuuugauaugcugcguugcaugcucgggagaguguauaggccuuguuggcaagucuga

SEQ ID NO: 60878 - RNA, 1728 nt, Artificial Sequence
  derived and/or modified sequence opt3 from PMEL__Homo_sapiens__NP_001186982
auggaccuggugcucaagagaugccuucugcacuuggccgucaucggcgcuuuacuggcaguuggggccaccaaaggaagccaggugugggguggccaacccguauacccucaggagacagaugacgcguguauuuucccagaugggggaccgugccccuccggcucuuggucacagaagaggaguuuuguguaugucuggaaaacuuggggucaguacuggcaagugcuagggggaccuguuagcggccucuccauaggcacggggcgggcuaugcugggaacccauacaauggaagugacugucuaucaccgccgagguucucguucguacgugccacuugcccauucaagcagugcauucaccaucacagaccagguacccuuuuccguuucugugagccagcugagagccuuggauggcgggaacaagcacuuccucaggaaucagccucugaccuuugcucugcaacuccaugacccauccggauauuuagcagaggccgaucugucauacacuugggacuucggcgauaguagcgguacacuuauuucucgggcuuuggucgugacccacacguaucuggaacccgggccugugacugcccaggucguucuacaggcggcaaucccacucaccuccuguggaucaagcccggugcccggcacaacugacggccaccgcccuaccgccgaggcuccaaacacaaccgccgggcagguacccacgacugaaguggucggaacaaccccuggucaagcaccaacugcugagcccaguggcacaaccucugugcagguuccgacgaccgaggugauuuccacagccccuguccagaugcccacugcggaaagcaccgggaugacaccagagaaagugccuguaucggaaguuaugggaacuacccuggccgagaugucuacacccgaggcaaccggcaugacuccagcugaaguguccaucgucgugcuuucagguacgacagccgcucaagucaccacuaccgaguggguggaaacaaccgccagagagcugcccauaccugaaccagaggggccggaugcaaguagcaucauguccacugagucuauuacaggcagcuugggaccccuccuggacggcacggccaccuuaaggcugguuaagcgccaggugccucucgauugcguacuuuaccgguacgggucauuuagugucacucuggacaucgugcagggaauugaauccgcugagaucuugcaggcgguuccaagcggugaaggcgacgcauucgagcuaacagugucuugucaagggggacugcccaaggaagccugcauggagauaucaaguccuggcugucagccacccgcucagcgacucugccagccgguccugccuagcccagccugucaacuugugcugcaucagauuuugaaagguggguccggcaccuauugccucaauguaucucuggcagauacaaacucguuagccgugguuagcacucagcugaucaugcccggacaggaggcuggccuagggcaagucccucucauugugggaauccugcuuguguugauggccgucguucuggcaucccucaucuacagaaggcggcugaugaagcaggacuuuucagugccccagcuuccacacaguucuagccauuggcugcguuugccucgcauuuucuguuccugccccauaggugaaaauucaccacuccugagcggccagcaaguguga

SEQ ID NO: 60879 - RNA, 780 nt, Artificial Sequence
  derived and/or modified sequence opt3 from PMEPA1__Homo_sapiens__NP_001242905
augcccgccaucccugcucacggcgcagagcuggaguucgugcagauuauaaucauugucguugugaugaugguaaugguggucgugauuaccugccuccuuagccauuacaagcuguccgccagaucuuuuaucucaaggcacagucaagggcggcgccgagaggacgcguugagcuccgaaggauguuuauggccaucugagucgacaguuucagguaacggcaucccggaaccccagguguaugcuccuccacgucccacugauagacuggccgucccuccauucgcacagagggagcgguuucaucgcuuccagcccacguacccuuaucuacaacacgagauagaccucccaccgaccaucagccugagugauggggaagaacccccuccauaccagggacccugcacacuucagcugagagacccugaacagcaauuggagcucaauagggaguccgugcgggccccacccaaccgcacuauuuuugauucugaccugauggauagcgcucgacugggcgguccguguccucccuccucaaauagugggaucagcgcaaccugcuauggaucuggcggcagaauggaagggccaccucccacauacuccgagguaauuggacauuauccagguagcucauuccagcaccagcagaguucugggcccccuucccucuuagaaggcaccaggcugcaccauacucacaucgccccacuugagagcgcugccauauggucgaaagaaaaggacaaacaaaagggacauccguuguga

SEQ ID NO: 60880 - RNA, 663 nt, Artificial Sequence
  derived and/or modified sequence opt3 from PMF1-BGLAP__Homo_sapiens__NP_001186590
auggccgaggcuagcuccgcaaaccugggcucugggugcgaagagaagagacacgaaggaucaaguagcgaguccgugcccccugguaccacaaucucuagggucaaacuccuugacacuaugguugauacguuccugcagaaguugguggccgcgggcucguaccaacgguuuaccgacuguuauaaaugcuucuaccaguuacagccagcuaugacacagcaaauuuaugauaaguuuauagcccagcugcagacuucaauccgcgaagagauuagcgacaucaaagaggaagggaaucuagaggcaguacucaacgcccuggauaagauuguggaagagggaaagguccgaaaagagccggcuuguaauggcacccccugcggugcaaugugucguaacagaaggccucggacaaguuccuggcagaugccaucuuggcaagggggaggccgcuggagaagcugcuccuacaggucacggcccaguagccgcccuggccgaugugaagcccagagaugcagggugcagcagcgguguucucuuugcguucaagcugggggacagcgugguuccgaggaaacccaggcccugccagugucaauggcgggcagccccaguccuuugccagggucuccgggagcacaagagggcggugucuga

SEQ ID NO: 60881 - RNA, 543 nt, Artificial Sequence
  derived and/or modified sequence opt3 from PMF1__Homo_sapiens__NP_001186582
auggccgaggcuagcuccgcaaaccugggcucugggugcgaagagaagagacacgaaggaucaaguagcgaguccgugcccccugguaccacaaucucuagggucaaacuccuugacacuaugguugauacguuccugcagaaguugguggccgcgggcucguaccaacgguuuaccgacuguuauaaaugcuucuaccaguuacagccagcuaugacacagcaaauuuaugauaaguuuauagcccagcugcagacuucaauccgcgaagagauuagcgacaucaaagaggaagggaaucuagaggcaguacucaacgcccuggauaagauuguggaagagggaaagguccgaaaagagccggcuuguaauggcacccccugcggugcaaugugucguaacagaaggccucggacaaguuccuggcagaugccaucuuggcaagggggaggccgcuggagaagcugcuccuacaggucacggcccaguagccgcccuggccgacuuuauaccgaaaauagagggucuuggcuguuguguuga

SEQ ID NO: 60882 - RNA, 1902 nt, Artificial Sequence
  derived and/or modified sequence opt3 from PML__Homo_sapiens__NP_002666
auggagcccgccccugcuagaagcccaaggccgcagcaagaccccgcacggccucaggaaccaaccaugcccccuccagagacacccuccgaaggccgccagccuucuccaucaccgagucccacugagcgagccccugcgagcgaagaggaguuccaguuucugcguugccaacagugucaggcugaagccaagugcccaaaacuccuucccugucugcacacguugugcuccggguguuuagaggcaucuggaaugcagugcccuaucugucaagccccauggccccugggugcugauaccccggcacuagacaacguguucuuugaaucgcuccagagaaggcugucagucuaccggcagauuguugaugcccaggcugugugcacacgcuguaaggagagcgccgacuucuggugcuuugagugugaacaacuucugugcgcgaaaugcuucgaggcacaucagugguuuuugaagcacgaagccagaccucucgcugagcugaggaaucagaguguacgggaauuucuggauggcacucgcaaaaccaacaauauauuuuguuccaaccccaaucaucgaacaccaacccucacuucuaucuauugcagaggguguagcaagccuuuaugcuguuccugcgcccugcuugacucaagucacagcgaguugaagugugauauuucugcagagauccaacagaggcaggaagaacuggacgcuaugacacaggcccuacaagaacaggauuccgcguucggagccgugcaugcacagaugcacgcugccgucggccagcucggucgggcucgugccgagaccgaggagcugauucgcgagagagugaggcaaguuguggcacacguccgggcccaggaacgagagcuucuggaagcuguggacgcgcgcuaccagagagauuaugaggaaauggcaucaagguuggggcggcucgacgccguacugcagcgcaucagaacgggaagcgcuuuaguucaaaggaugaaaugcuacgccagugaucaggaggugcuggacaugcauggcuuucuccgucaggcacuuugucggcugcgacaggaggaaccccaaucuuugcaggccgcugucagaacugacggcuucgaugaguuuaaggugaggcuacaggaccuguccagcugcauaacccaagggaaagaugccgcagugucgaagaaagcgucuccagaagcugccuccacaccccgcgacccuaucgaugucgaccucccagaggaggcagaacggguuaaggcccaggugcaggcucugggacuugccgaggcacagccgauggcuguagugcaaucaguccccggugcccacccugugccaguuuaugcguucaguauuaagggccccagcuacggggaagauguguccaacacuaccacagcccagaaaagaaaguguucucagacccagugcccuaggaaagucaucaagauggagagcgaagagggaaaagaggcucgccuggcacgaucaaguccagaacaaccccggccguccacgagcaaggccgugucuccuccacauuuggacggucccccuucaccccguaguccaguaauuggcagcgagguuuuccucccuaauuccaaccacguggcuucuggggccggagaagcagaggaaagagucguggucaucucgagcuccgaggauucagacgcggagaauaguucuagcagggaacuggaugacuccucaagcgagucuuccgacuuacagcuggaaggccccaguacucuacgcgugcucgaugagaaccuggccgacccacaggcugaagaucggccgcuuguuuucuucgacuugaaaauagauaaugagagcggcuuuucuuggggguauccucaccccuuccugauuuga

SEQ ID NO: 60883 - RNA, 789 nt, Artificial Sequence
  derived and/or modified sequence opt3 from PMM1__Homo_sapiens__NP_002667
auggccgugaccgcucaggcagccagaaggaaggagcggguccugugccucuucgacguugauggcacacuuacucccgcgcgccagaaaaucgacccugaaguggcugccuuucugcaaaaguugcgaagccguguacagauugggguggucggagguuccgauuacuguaaaauagcagagcaguuaggcgacggggaugaagugaucgagaaguucgacuauguuuuugccgaaaacggaacggugcaauacaaacacggcagacugcuaucuaagcagaccauucagaaucaucucggugaggagcugcuucaggaucugaucaacuucugcuugucauauauggcucuccugaggcugccaaagaaacgggggacauuuauugaguuccgcaauggaaugcucaacaucaguccgauaggcagaagcuguacuuuagaagaaaggaucgaguuuuccgagcuggacaagaaagaaaagauucgggagaaauucgucgaagcacuuaagaccgaguuugccggcaagggguugcgcuucucucgaggagguaugaucucguuugauguguuccccgaaggcugggacaaaagauacugccuggauucacuagaccaagauagcuuugacacaauucacuucuucgggaaugagaccaguccuggaggcaacgacuuugagaucuucgcugauccaaggacuguaggucauuccguugugucuccccaggacacaguccagcggugucgugaaauauuuuucccugagaccgcccacgaagcguga

SEQ ID NO: 60884 - RNA, 741 nt, Artificial Sequence
  derived and/or modified sequence opt3 from PMM2__Homo_sapiens__NP_000294
auggccgcucccggcccugcacugugccucuucgacguggaugggacccuuacagccccaagacagaagaucacuaaagagauggacgauuuucugcaaaaguugaggcagaaaauuaagauaggagucguugguggcagcgacuucgaaaaagugcaggagcaguuagggaacgauguaguggaaaaguacgacuaugucuuuccggagaauggacugguggcguacaaggauggcaaacuacucugucggcaaaacauccagucccaccugggugaagcucuuauucaggaccugaucaauuauugcuugucuuacauugccaagaucaaacuccccaagaaacgcgggacguucauagaguuucgaaacggaaugcugaauguuucaccuaucggccguaguuguagccaggaggaaagaauugaguucuaugaacuggauaagaaggagaacaucaggcaaaaauuuguggcagaccuccggaaggaguucgccggcaaaggguuaaccuuuuccauuggaggucagaucucuuucgaugucuuuccagacggcugggauaagcgcuacugccugagacauguggaaaaugacggguauaaaacaauauacuucuuuggagacaagacuaugcccggcgguaacgaucacgagauuuucaccgacccuaggacaaugggguacucgguaaccgcuccagaagauacucggcgcaucugugagcuuuuguucucauga

SEQ ID NO: 60885 - RNA, 483 nt, Artificial Sequence
  derived and/or modified sequence opt3 from PMP22__Homo_sapiens__NP_000295
augcugcuccuucuguugagcaucauuguguuacacgucgccguucuggugcuacucuucguauccaccauagugucucaguggaucgucggcaacgggcaugcuacagaccuguggcaaaauugcucaacgaguagcuccggaaacgugcaccauuguuuuucuucgucacccaaugaguggcuucagagcguucaggcaacuaugauucugaguaucauuuucuccaucuugucucucuuucuguucuuuugccagcuguucacccucacaaaggguggcagauuuuacauaacugggaucuuccaaauuuuagccggacugugugugaugagcgcggcugccaucuauaccgucaggcacccugaauggcaucuuaacuccgauuacucauauggcuuugcauacauuuuggccuggguggcuuucccacuggcacuacucagugguguaaucuauguuauacugcggaaacgcgaguga

SEQ ID NO: 60886 - RNA, 1185 nt, Artificial Sequence
  derived and/or modified sequence opt3 from PMPCA__Homo_sapiens__NP_001269873
augaagagaaacacccugguggagcuccuuacauucuggaaaaauuggcacuuuaggcuguuguuagaccugacugccaagaugaaauucugccuacgguggaaaagcaugggcgucuccguuacggcucgccaucaggaugaagagguggaaaugacccgaauggcaguacaauuugagcucgaagaccugaaccuucgucccgauccugagccacuguugacagagaugauccacgaagccgcguacagagagaauacuguggggcuccauagguucuguccgaccgaaaacgucgcuaagauuaaucgggaggugcugcacucuuaucugcgcaacuacuauacacccgacagaaugguucucgccggagugggugucgagcaugaacacuuaguggauugcgcaaggaaguaccugcuuggcguacagccugccugggggucagcugaggcaguugacauagaucggaguguggcccaguauaccggaggcaucgcuaaguuggaacgcgacaugagcaaugucucccuggguccaacucccauuccugagcuaacacacaucaugguggggcucgaaucuuguucguuucuggaggaggauuucauuccauuugccgugcuuaacaugaugaugggaggcggcgggucauucagcgcgggaggucccggcaaagggauguuuagucgacuguacuugaauguccucaacagacaucacuggauguauaaugcaaccuccuaccaucacucuuacgaagacacgggacuguuaugcauccacgccagcgcugauccuaggcagguucgggagaugguggaaauaaucacuaaggaguucauucugaugggcgguaccguagacacaguggaacucgagcgugccaaaacucaacuuaccuccaugcugaugaugaacuuggagucacgcccagucaucuuugaagauguggggagacagguucuagcaacaaggagucggaagcugccgcaugagcucuguacccugauucgaaaugugaaacccgaagacgucaagcgcguggcuagcaagaugcuuagaggaaaaccugccguagcggcccugggcgacuugacggaucucccaacuuaugagcacauccagacagcacugucuuccaaggacggcagguuaccccggaccuaccgccuguucagauga

SEQ ID NO: 60887 - RNA, 1470 nt, Artificial Sequence
  derived and/or modified sequence opt3 from PMPCB__Homo_sapiens__NP_004270
auggccgcugcagccgcgagagugguccugagcuccgcugccaggcggcgccucuggggcuucucugagucacuucugauccgaggggcagccggacguaguuuguacuuuggugaaaacagauuaaggagcacccaggcugcaacacaaguugugcugaauguacccgagacucgggugacgugccuagaauccggccuccgcgucgccucugaggacucggggcugucaaccuguacagugggacuuuggauugaugcuggcagcagauaugaaaacgagaagaauaacgguacugcccacuuccuggagcauauggcguuuaaagggaccaagaaaaggagucaguuggaccucgaacuggagauagaaaauaugggagcacaccugaacgccuacacaucccgggagcagaccguuuauuacgcuaaggccuucucuaaagaucucccucgcgcaguggagaucuuagcugacauuauccagaauagcacucugggcgaagccgagauugaacgagagagaggcgucauccuuagggaaaugcaagagguggagacaaacuugcaggaaguaguuuuugauuaucugcaugcgaccgccuaccagaauacggcacuagggcggacuauacucggaccaaccgagaacaucaaguccauuucacguaaggaccugguggauuauaucacaacucacuacaaagguccgcgcauuguccuugcugccgcuggcggggugagucaugacgaacuguuggaucucgccaaguuccacuuuggagacagccugugcacccacaaaggcgagauccccgcauuaccuccauguaaguucacagguucugaaauaagagugagggaugacaaaaugccccuggcccaucucgcuauugcggucgaggcaguugggugggcccacccugauaccaucugccuuaugguggcuaauacgcugauuggaaacugggaccgguccuuuggcggcgggaugaauuugucaagcaagcuagcccagcugacuugucauggaaaccucugccacaguuuccaaucuuuuaauacauccuacaccgacacuggucuguggggccuuuauaugguaugugagagcucgacaguggcagauaugcugcacgucgugcagaaggaauggaugcgauugugcaccucuguuacggaguccgaaguggcccgcgcuagaaaccuccugaaaaccaacauguuacugcagcuagacgggucaacaccaaucugugaggauaucggaaggcagaugcucugcuacaaucggcgcauucccauaccugaacuggaggccagaaucgacgcagucaacgcggagacuauuagggaaguguguaccaaguauaucuacaaucguaguccagcuauagccgcaguaggcccgauuaaacaacuucccgauuucaagcagauccggagcaacaugugcugguugcgagacuga

SEQ ID NO: 60888 - RNA, 2799 nt, Artificial Sequence
  derived and/or modified sequence opt3 from PMS1__Homo_sapiens__NP_000525
augaagcagcugcccgccgcuaccgugagacuccuuagcuccucucaaaucauuacaucagucguuagugugguaaaagagcugauagaaaacagcuuggacgcaggcgccacuuccguggaugucaaguuagagaauuacggguucgacaaaaucgaagugagggauaacggagaggguauuaaggcgguugacgcuccugugauggccaugaaauauuacacgucuaagaucaauucgcacgaagaucuggagaaccuaaccacauauggcuuucgcggggaggcacucggaucaauuugcuguaucgccgaaguccugauaacuacccggacagcugcagacaauuucagcacccaguacgugcuugauggcaguggucauauccugucccagaagccaucucacuuggggcagggaacuacaguaaccgcccuccgacuguuuaaaaaccugccgguucguaagcaauucuauagcacggcuaaaaagugcaaagacgagauuaagaagauccaggaucucuuaauguccuuuggcauucugaaacccgaccuuagaaucguguucguccauaauaaggccgugauauggcagaaaucaagggugagugaucacaagauggcguugaugagcguccugggcacugcaguuaugaacaauauggaaucuuuucaguaccauuccgaggagucacaaauuuaucuaagcggguuccucccuaaaugugacgccgaucacaguuuuaccucucuguccacaccagaacggagcuucaucuuuauuaacucgcgccccgugcaccagaaggacauccuuaaacugaucagacaucacuacaauuugaagugccucaaggagucuacuaggcuguacccuguauucuuuuuaaaaauugacgugccaaccgcugaugucgacgugaaccugacacccgauaagucccagguucuccuucagaauaaagaaucagugcugauagccuuggagaaccuaaugaccacguguuauggaccucugccaaguacuaauagcuacgaaaacaacaagacagacgucuccgcagcugauaucgugcucucuaaaaccgccgagacugacguacuguucaauaagguugagagcucagguaagaacuauaguaauguggauacauccgucauuccguuccaaaacgacaugcauaaugaugaaagcggcaaaaacaccgacgauugccuuaaucaccagaucucuauaggggacuuuggauacggccacuguucaagugagauuagcaacaucgacaagaauacgaaaaacgcguuccaggauaucuccaugucuaaugugucgugggaaaacagccaaaccgaguauuccaagacaugcuuuauuucaagugucaaacauacucagucugaaaaugguaacaaggaccacaucgaugagagcggggagaaugaagaggaagccggacuggagaacuccucagaaauuagcgcagacgaguggucucggggcaacauauugaaaaauuccgugggcgagaacaucgaacccguuaagauucucgugccugagaagagucugccauguaaaguaagcaauaacaauuaccccaucccugaacagaugaacuuaaaugaggauucuugcaacaagaaauccaaugucaucgacaacaagucagggaaggugaccgcuuaugaucugcuaaguaaucgcguuauuaaaaagccaaugagcgccucggcucucuucgugcaggaccaucgaccccaauuucugauagagaacccgaaaacaucccuugaagaugccacuuugcagaucgaggaacuguggaagacccucucugaggaagagaaacugaaguacgaggaaaaagcaacaaaggaccuugagagauacaauagccagaugaagagggccauugaacaggagucacaaaugagucugaaagauggacggaagaaaaucaagccuaccuccgcuuggaacuuggcgcagaaacacaagcucaagacuucucugagcaaucagcccaaauuagacgaacugcuacagucccaaauugagaagcgucgcucacagaacaucaaaaugguccagauaccauucagcaugaagaaccucaaaaucaauuuuaagaagcagaacaaaguggaucuggaggaaaaggacgagccuugucuuauucauaauuugagauuccccgacgcauggcugaugacgaguaaaacagaaguaaugcuccugaacccauauaggguggaggaagccuuacuguuuaagcggcuuuuggagaaucacaaacuccccgcugagccucuggaaaagccaaucaugcuaaccgagucucuguucaacgguucccacuaccucgauguucuguauaagaugacugccgacgaucaacgauacagcggcucgaccuaucuuucagacccgcgcuugacagcaaauggguuuaaaauuaagcugauccccggagucucuauaaccgaaaacuacuuagagauugagggcauggccaauugccucccuuucuaugguguggcugaucugaaagaaauccuuaacgccauucugaauagaaacgcaaaggagguguacgaaugcaggccacggaaagucaucaguuacuuggagggggaagcgguucgccucuccagacagcugcccauguaucuaagcaaggaggacauacaggauaucauuuacaggaugaaacaucaauuuggcaaugagaucaaggaaugugugcacggacguccuuucuuccaucaccugacuuaucucccagagacaacguga

SEQ ID NO: 60889 - RNA, 2589 nt, Artificial Sequence
  derived and/or modified sequence opt3 from PMS2__Homo_sapiens__NP_000526
auggagagagccgaaagcuccucuaccgagcccgcuaaggcaaucaaaccuauugacaggaagucagugcaccagauaugcaguggccaagucguucugagccucuccacagccgugaaagaacuuguagagaacucucuggaugcgggggcuacuaauaucgacuugaaguuaaaagauuacggaguggaccugauugaagucucggauaacgguuguggcguggaggaggaaaauuucgaggggcuaacgcucaagcaucacaccucaaagauccaggaauuugccgaccugacacagguugagacuuucggauuucggggcgaggcacuuagcagucugugcgccuuguccgaugugaccauuucuacaugucaugcuagcgcaaaagucgguacccgccucauguucgaccacaacgggaagaucauacagaaaacuccauauccgcgaccccguggaacaaccguguccguacaacagcuguuuucaacgcugccuguuagacauaaggaguuccagaggaauaucaaaaaggaauacgccaagauggugcagguccuccacgcuuauugcauuaucagugccggcauucgggugagcuguacuaaccaauuaggccaggggaaacgccagccaguggucugcaccggagguucucccuccaucaaggaaaauauaggcucaguuuuugggcagaaacaacugcagagccuuauuccuuucgugcaguugccacccagugauucuguaugugaggaauacggacuguccugcagcgacgcgcuacacaaccucuuuuauaucucgggcuucauuucucaauguacacaugguguggggagauccucaacugauaggcaguuuuucuuuaucaaucggcgcccuugcgacccagcaaaggucugucgacuggugaacgagguuuaccacauguauaauagacaucaguacccguucgugguccuuaacaucaguguggauagcgagugcguagacauuaauguuacccccgacaaaaggcagauacuguugcaagaagagaagcuccuguuagccgugcugaaaacaucccucaucggaauguucgauucugacgucaacaaacuuaaugugagccagcagccucuguuggaugucgaaggcaaccuaauuaagaugcacgcugccgaccuggagaaaccaaugguggaaaagcaggaucaaucacccagucuccggaccggcgaggagaaaaaggacguuuccaucagccgucugcgcgaagcauuuucucuuagacacacgacugagaacaaaccucauucaccaaagacacccgaaccgaggcggaguccucuggggcagaagcgaggaauguugagcuccucuaccucgggugcuauaagcgauaaaggcgugcuccgcccccagaaggaggccguauccucaagucacgggccaucugacccuacugauagagcggaagucgagaaagacagcggacauggcuccacaucaguggauagcgaggguuucucuauucccgacaccgggucccacugcaguagcgaauacgccgcaucuuccccaggcgacaggggaucacaggagcauguugauagucaagaaaaggcucccaaaacggacgauagcuuuucggacguggauugucacuccaaucaggaggacaccggcugcaaguuccggguccugccucagccaacaaacuuagccacuccgaauaccaagcgcuuuaaaaaggaggaaauccugucuagcucagauaucugucagaagcuagugaacacacaagacaugagugcuucccagguagauguggccguuaagauuaauaaaaaggucgugccccucgacuucucuaugagcucccuggcaaagagaaucaaacagcuucaccaugaggcccaacagucagaaggggagcagaacuauaggaaguuucgugcuaaaauuugcccuggagaaaaucaggcggcagaggaugaguugcggaaggaaauaagcaaaacuauguucgccgagauggaaaucauuggucaauuuaaccugggcuucaucaucaccaagcucaaugaggacauuuuuauaguggaucagcacgcuacagacgaaaaauacaacuucgagaugcugcagcagcauaccguccuucaagggcagcgacugaucgccccacagacuuugaaucucacggcaguuaacgaggccgugcugauugaaaauuuagagaucuuuagaaagaacggauucgacuucgugauugaugaaaaugcucccguaacagagagggccaagcugaucagucuaccuaccucuaaaaacuggacuuuuggcccacaggacgucgaugaacucauauucaugcuguccgacagccccggugugaugugucgcccgucgcggguuaagcaaauguuugcaucaagagcgugcaggaaaucugugaugaucgggaccgcucuuaacacaagugagaugaagaaauugauuacccacaugggcgagauggaucacccuuggaauuguccacauggacgccccacuaugcgacacaucgccaaccugggcgucauuucccagaauuga

SEQ ID NO: 60890 - RNA, 579 nt, Artificial Sequence
  derived and/or modified sequence opt3 from PMVK__Homo_sapiens__NP_006547
auggcuccccugggcggggccccuagacucgugcuucuguucagcggaaagaggaaauccgguaaggacuuugucaccgaggcauugcagucucgguuaggcgccgauguuugcgcggugcugcgccuaucagggccacucaaagaacaauacgcucaggagcacggacugaacuuccagcgacuucuggacacaaguacuuauaaggaagccuuucguaaagauaugaucagauggggcgaggaaaagaggcaggcagacccggguuucuuuugucggaagauuguagaggggauaagccaacccaucugguugguguccgauacgcgcagagucucugacauucagugguucagggaggccuacggagcugugacccagacaguucggguggucgcacucgaacagucgcgccaacagcgaggcuggguguuuacuccuggcguagaugacgccgagucagaaugcgggcuggauaauuucggagacuuugauuggguuaucgagaaccaugguguggagcagagacuggaggaacagcucgaaaauuuaauugaguucaucaggagccggcuguga

SEQ ID NO: 60891 - RNA, 1281 nt, Artificial Sequence
  derived and/or modified sequence opt3 from PNCK__Homo_sapiens__NP_001034671
auggaggccgcuuucggccagguggcagggagcgccugccccagaaggggaggugaaggccgggacuggaaggcggagucccuggcugaucucuggccuaaaucuucaccaggggacagucaccgcugguguaagggaccgggcgccggucccgcagggccucaacuucgagaagccgcucgugcaagcuccggacugggcggcgggggaagacauccaucuaggauccccgccauugcuuugcaggauauguuacugcucaaaaagcacaccgaggacauaucgucagucuacgaaauccgggagcgccuagguagcggcgccuuuagugagguugugcuggcgcaggaaagaggguccgcacaucuuguagcccugaaaugcauuccuaagaaggcuuugaggggaaaagaggcccucguggaaaacgagaucgcaguccugcggcgcauuucucacccaaauaucguggcucuggaggauguucaugaaagccccucccaccucuauuuagccauggagcuggugacaggcggugaacuuuucgaccgaauaauggagagagggucauacacugaaaaggaugcgagucacuuggucggacaggugcugggcgccguaagcuaucuacauucucucggcaucguucacagggaccugaaaccugagaaccuucuguacgcaacgccauuugaggauuccaagauuauggugucagacuucggguugagcaaaauccaagcuggaaauaugcucgguaccgccuguggcacaccgggguaugucgcucccgaacuguuagagcagaagccuuacggaaaggccguggaugugugggcacugggcgucauuaguuauauccuccuuugcgguuacccacccuuuuacgacgaaucugauccugagcuguucucccagauauugcgggccagcuaugaauuugacucgccauucugggacgauauuucugaguccgcuaaagacuuuauccgucaucuacuggagcgcgauccccagaagagauucacuugucaacaggcgcucaggcaccuguggauuucaggggacaccgcauuugaucgggacauccuuggcaguguuagcgaacagauccgcaaaaacuucgcccgaacacacuggaagagagcuuuuaaugccaccuccuuccugaggcauauucggaaauugggacagauaccggagggcgaaggggcaucugagcaaggaauggcccgccacagccauucaggucucagagcuggccagccucccaagugguga

SEQ ID NO: 60892 - RNA, 429 nt, Artificial Sequence
  derived and/or modified sequence opt3 from PNKD__Homo_sapiens__NP_001070867
auggccgcuguggucgcagccaccgcgcugaagggcagaggggcuaggaacgcccggguucuccgcggaauccuugccggugcaacagcuaauaaagcaagccacaaccgaacucgugcccugcagucccauucuucacccgagggcaaggaggaaccugaaccauugaguccggaguuagaauacauucccagaaaaagggggaagaauccuaugaaagcugugggacuggccugggcgauaggcuucccaugcgguauccuacucuuuauucugacgaagcgggagguagacaaggaucgcgugaaacaaaugaaggcaagacagaacaugaggcuuagcaauaccggggaguaugaaucccagcgguuccgcgccucuucgcagucagcucccagcccugacgucggaaguggcgugcaaacauga

SEQ ID NO: 60893 - RNA, 1566 nt, Artificial Sequence
  derived and/or modified sequence opt3 from PNKP__Homo_sapiens__NP_009185
augggcgagguggaagcccccgggagacuguggcucgagagcccuccaggaggugcuccgcccaucuuccuuccuuccgacggccaggcacuggucuuggggaggggaccauuaacccaaguuacagaucggaagugcucucgcacucagguggaacugguagccgaccccgagacgcgaaccguggcggucaaacagcuaggcgugaacccuucaacaacugguacccaggaacucaagccagggcuggagggaagucuuggcguuggcgauacacuguacuuggugaaugggcuccacccccugacccugcguugggaggaaacuagaacaccugagagccaaccagacaccccgcccggaacgccucucgucucccaggaugaaaagagggacgcugaguuaccaaagaaacggaugcgcaagucuaaccccgguugggagaaucuggaaaaacuuuugguguuuacugccgcaggcguaaaaccucaggggaagguugccggauucgaucuggacggcacccuaauuacaacuagaucggguaaaguguuuccaaccgggcccucagauuggaggauacucuauccggagaucccucggaagcugcgcgaacuugaggcugaaggauacaaacuggucauuuucacaaaccagaugagcaucggccgaggcaaguugcccgcagaggaguuuaaggccaaaguggaagcuguggucgagaagcucgggguuccauuccaagugcugguagccacccaugcgggauuauauagaaaaccugugacggguaugugggaccacuugcaggaacaggcaaaugauggcacucccauuaguaucggggacuccauauuugucggagaugccgcuggcaggccagccaacugggcacccggucggaagaaaaaggacuucucuugugcugaccgucucuuugcccuuaaucugggguugccuuucgcgacaccagaggaauuuuuccuaaaauggccggccgcaggcuuugagcugcccgcuuucgauccucgcaccgugagcagauccggaccacucugccugcccgagucaagggcccuucugagugcuagcccugaaguuguggucgccgugggcuucccaggggcaggaaagucuacuuuucugaagaaacaucucguauccgccgguuacguucacgugaaccgggacacacugggcucauggcagcgaugugucaccacgugcgagaccgcuuuaaagcaagggaaacgcguggcgaucgauaauacaaaccccgacgcagccagcagagcuagguauguccagugugcccgggcagccggagugccgugccgcuguuuccuguuuacugcuacccuagaacaggccagacauaauaacagguuccgugagaugacagauaguucucacauuccuguuuccgacauggugauguacggcuaucggaagcaauuugaagcaccaacucucgcggaggguuucagcgcuauccuggagauucccuuucgacuuuggguagaaccuagauuggggaggcuguacugccaguucucggagggcuga

SEQ ID NO: 60894 - RNA, 1596 nt, Artificial Sequence
  derived and/or modified sequence opt3 from PNLDC1__Homo_sapiens__NP_001258791
auggacgugggcgccgaugaguucgaagagagccugccccuccuucaggaacugguccaagaggcugacuuuguuggguuggauaucgaguucaccggauuaagauccaaccugucugguccucagcagauuucacuauuugaccucccaagugagugguaccugaagacaaggcagagcgugcaacaguucacuguaugccagauaggccuuuccguguuuucugcaaucgagggggaagccaauaaauauauugcgcacucguguaacuucuaccuguuuccgacgaccuucggaaucuuggauucagaguuuagcuuccaggcuaguuccguccaauuucucaaucaguauggcuucaacuacaauaaguuucugaaaaacgguauucccuauaugaaugaagaacaggagaagaaaauccggcaugacauacugacagggaacuggcgcgugcgaucuagcccugauaaggaccagaucaagguugugauugaugaagucacucguuggcucgaguuagccaaagaaggagacuggaugacccugccaggcaucacaggcuuccaagcauucgaggugcagcuuguauugagacaggcccugcccaauauuuggaccguucuaaaggaugaagggguggucgugaaaaagguguccaaacaacacaggugguaccuccagaacacuucaugcgaccgggagaguuguuggaaggagaauauccugcuuagcgcucgcggauuuucugucuucuuucagaugcugguuaaggcacagaaaccuuuggugggucauaacaugaugauggaucuccugcacuuacaugaaaaguucuuuagaccacugcccgaguccuaugaccaauucaaacagaauauacacucacucuuuccuguacuuauugacacaaagagcgugaccaaagauaucuggaaggaaaugaacuucccaagggucaguaaucugucugagguguacgaaguuuugaacuccgaccuaaacccgacgaaaaauagcggccccgagauugugcacgccucgcggugcgagaaguacgucgaaacuaaguguccucaugaggcugccuaugaugcguuucugugcgggucugugcuccugaaaguagcacaccuucuguugcagaagaucuaccauaucgacccaguucccgaauccucauucccucaguaucucgaugugcuggccccauacgucaaccaagugaauuuaauucgcgcuggaguccccaaaauaaacuuuaguggcccggacuauccuagcauccgacccccaauucugauccuauccgugaagagauggccugguguuucugagcaacagguguaccacaaauuccagaaucucuguaaguuugauguaaggcggcugacccguagccaguuccuuuugcugacaaacaaguucaaagacgcccgcaauauacucaaggaauauagagaucaccccacucugugcauuucacuuuacagguacuggcggcauaguccaaacgucaauugucugcuccaggugugcgggaucguuaccgcaugggcuuugcuggccuuuaucuuaggacgauccggcacauga

SEQ ID NO: 60895 - RNA, 1398 nt, Artificial Sequence
  derived and/or modified sequence opt3 from PNLIP__Homo_sapiens__NP_000927
augcugccccucuggacccuuagccuguuguuaggcgccguggcugggaaggaggucugcuacgaaagacugggauguuucuccgacgauucuccuuggucagguaucacagagaggccacuacacauucucccguggagucccaaagacguuaacacucgguuucugcuuuauacgaaugaaaacccuaauaacuuccaggagguggcagccgauagcuccucuauaucgggcucaaauuuuaagaccaaccgcaaaacacgauucaucauucauggguuuaucgacaagggagaagagaauuggcuggcgaacguaugcaaaaauuuguucaagguggagagcgucaacuguauuugcguggauuggaagggcgguagucguacuggguacacccaggcuucccaaaauaucagaauaguuggagccgaaguggcauauuuugucgaguuccuccagucugccuuuggcuacagcccauccaacgugcacguaaucggccauucacugggggcucacgcagccggagaagcugguaggcggacaaauggcaccauugggcgcaucacuggacuggaccccgccgagccuuguuuccagggcacaccagagcucguuagauuagaucccagugacgcgaaauuuguggaugucauucauaccgacggugcaccuaucgugccaaaccugggguucggaaugagccaaguggucggccaccuugacuuuuucccgaauggcgggguugaaaugcccggaugcaagaaaaacauauugucucagauuguggauaucgaugguauuugggagggcacgagggacuucgccgcuuguaaccaucugcgguccuauaaguacuauacugacucaaucguaaauccugauggguuugccggauucccaugcgcaagcuacaacguguuuaccgcuaauaaauguuuccccugcccuaguggcgguuguccacagauggggcacuacgccgaccgcuaucccggcaagacaaacgaugucggacagaaguuuuaccuagacacuggcgaugcgucuaauuucgcccgauggagauauaaaguguccguuacccucagcgggaagaaagugacaggacacauccuggucucgcuuuuugguaacaagggcaauucuaaacaauacgaaauuuucaaggggacccugaaaccggacuccacgcauucaaacgaguuugauagugacguggauguaggagacuugcagaugguuaaguucauaugguauaauaacgugaucaauccuacucuccccagggucggcgcaagcaagauuaucguggaaacaaacgucgguaaacaguuuaauuucugcuccccagagaccgugcgggaggaaguucuguuaacucugacaccuugcuga

SEQ ID NO: 60896 - RNA, 1413 nt, Artificial Sequence
  derived and/or modified sequence opt3 from PNLIPRP2__Homo_sapiens__NP_005387
augaugcugcccccuuggacccucggccuucuguuguuagccacagugagagggaaggaggucugcuacggacagcuggguuguuucagcgacgaaaaaccaugggcuggcacucuacaaaggccgguuaagcuccugcccugguccccugaggauaucgacacgcgguuucuucuguauaccaacgaaaauccaaacaauuuccaguugauuacagggacugagcccgauaccauagaagcaucuaacuuucagcucgaccgcaaaacacgauucaucauucacggauuucuggauaaggccgaggacucauggccuagugauaugugcaaaaagauguucgagguggaaaagguaaauuguaucugcguggacuggcgucauggcagcagagcgauguacacccaggcuguccaaaacauuagggugguuggugccgagacugcauuucugauccaggcccucuccacacaguuaggguauucucuggaagaugugcacgucauaggacauucgcuuggcgcucacaccgcagccgaggcuggccggcgcuugggagggagaguggguaggaucacgggccuggacccagccgggcccuguuuccaggaugagccugaagagguacggcuagacccaucagaugcgguuuuuguggacgucauucauacugacagcaguccgaucgugcccucccucggauucggcaugucucaaaaagugggucaccuggacuuuuucccuaaugggggaaaggaaaugccaggcugcaaaaagaacguccuuagcaccauuacagauaucgauggcauaugggaggggauuggagguuuuguuuccuguaaucaucugcgcucauucgaauacuauaguagcucuguguugaaccccgacggcuuccucggguacccuugcgcauccuaugaugaguuucaggagucaaaauguuucccaugccccgccgaaggauguccgaagaugggccacuacgcugaccaguuuaaggguaaaacuagcgccguagagcagaccuucuuucugaauacaggggaaaguggcaacuucaccucuuggcgauacaagguguccgucacguuaagcggaaaagagaaggugaauggcuauaucagaauugcacuguacgggucgaacgaaaauucuaaacaauaugagaucuuuaagggaucccucaaaccugaugcuucacacacuugcgccaucgacguugauuucaacguggguaagauucagaaggucaaauuucuuuggaacaagaggggcauaaaucugagugagcccaaauugggggcgagccagaucacagugcaauccggagaagacggcaccgaguacaacuucugcucuagcgauacuguagaagagaauguucuacagucacuguauccauguuga

SEQ ID NO: 60897 - RNA, 1062 nt, Artificial Sequence
  derived and/or modified sequence opt3 from PNMA1__Homo_sapiens__NP_006020
auggccaugacccugcucgaggacuggugcagaggcauggaugugaacagccagagggcacuucuggucugggggauccccguuaauugugacgaagcugagauugaagagacauugcaagccgcgaugccucagguguccuaccggauguuaggacgcauguucuggcgagaagagaacgcuaaggccgcacugcuagagcucacuggugccguagauuaugcugcaauaccacgugaaaugccgggcaaagggggaguguggaagguccuguuuaaacccccuacgucugacgccgaguuccuugaaagacugcacuuguuucucgcuagggagggcuggaccgugcaggauguugcccgggugcuggguuuccagaauccaacacccacuccugggccagagaugcccgcggaaaugcugaacuacauccucgacaaugucauucaaccuuuaguggagucaaucugguauaagcgccugacccuuuuuaguggaagagauauuccaggcccgggcgaagagacauucgaccccugguuggaacauaccaacgagguacuggaggaauggcagguuagcgauguggagaaaaggcggcgccuaauggaaucccuccgagggccugcagccgacgucaucagaauacugaagucuaauaacccagcuaucacuacagccgagugccuuaaggcacuggaacagguguuuggaucgguggagucaagcagggaugcucagauuaaauucuugaauaccuaccaaaaccccggugagaagcucagugccuaugucauccggcuggaaccuuuacugcagaaaguuguggagaagggcgcgauugacaaagauaauguaaaccaggcccgucucgaacaggugaucgcaggggcuaaucacuccggagccauacgcagacaacuuuggcugacgggcgcuggugaggggccagcccccaacuuguuucagcuacugguccagauuagggaagaggaggcaaaggaagaggaagaggaggccgaagcuacucuccugcaacuuggacuggagggccauuucuga

SEQ ID NO: 60898 - RNA, 1095 nt, Artificial Sequence
  derived and/or modified sequence opt3 from PNMA2__Homo_sapiens__NP_009188
auggcccuggcucuccuugaggacuggugcagaaucaugagcguggaugaacagaagucccugauggucaccggcauucccgcagacuucgaggaagccgagauacaagaaguuuugcaggagacauuaaaaucucuggggagguaccggcuacucggaaagaucuuucgcaaacaggagaacgcgaaugcugugcugcuugaacuguuggaggauacugacguaucagccauuccuagugaagugcaggguaagggcggggucuggaaagugaucuucaagacgccaaaccaagauaccgaguuucucgagcgacugaaucuguuccucgaaaaggagggacagacaguuagcggcauguuucgugcauuaggucaggaagggguguccccggccacuguccccuguauuucuccugagcugcuugcucacuugcugggacaggcaauggcccaugcuccacaaccccuacucccuaugagauauaggaaacugcggguguucucgggcucagccguaccagcgcccgaagaggagagcuuugaaguuuggcuugagcaggcaaccgaaaucgugaaggaguggccugucacagaagccgagaaaaagcgcuggcuggcugagaguuugagaggcccagcccucgaccugaugcacauagugcaggcagauaacccguccaucucuguggaagagugcuuagaggcuuucaaacaggucuuugggagccuggaauccaggcggaccgcccaaguucgcuaccucaagacuuaucaggaagagggagagaaggugucagcguacguacuucgacuggaaacauugcuaagaagggccguggagaaacgggcaauuccccgucgcaucgcugaccaggucagacuggaacaagugauggccggugcuacccucaaucagaugcugugguguaggcuucgggagcugaaggaucagggcccuccacccaguuucuuggagcucaugaaaguuauucgagaagaggaagaggaagaggccagcuuugagaacgaaucuaucgaggaaccugaggaacgcgacggguauggaagauggaaucaugagggcgaugacuga

SEQ ID NO: 60899 - RNA, 849 nt, Artificial Sequence
  derived and/or modified sequence opt3 from PNMT__Homo_sapiens__NP_002677
augagcggcgccgacagaucccccaacgcuggggcagccccugauucugcgccaggacaggcugccguggcaucagccuaccaaagguucgagccgcgggcuuaucugcgcaauaacuacgcacccccucgaggugaccucugcaauccaaacggcgucgggcccuggaagcugcguugucuggcccagaccuuugcuacaggagaaguuaguggcagaacuuugaucgauauugguagcgggccuacgguguaucaguuacuguccgccugcucucacuucgaggacauaaccaugacagauuuucuagaaguaaauaggcaggagcucggacgguggcugcaagaggaaccaggcgcguucaacuggucgauguacucacagcaugcaugucuuaucgagggcaaaggggaaugcuggcaggacaaggagcgccagcugagagccagggugaaacgggucuugcccauugaugugcaccaaccucagccacucggagcugguagcccggcaccccugccugccgacgcucugguuagugccuuuugucucgaagcgguguccccagauuuagccucuuuccagcgcgcacuggaccauaucacuacccuuuugcgacccggcgggcaccuucuacucauuggagcucuggaggagagcugguaucuugccggcgaagcuagacugacagucgugccuguauccgaggaagagguuagggaagccuuggugcggucagguuacaagguccgugaucuccgcaccuauaucaugccagcacaucugcagacugggguggacgaugugaaaggagucuuuuucgccugggcucaaaagguuggcuuauga

SEQ ID NO: 60900 - RNA, 2154 nt, Artificial Sequence
  derived and/or modified sequence opt3 from PNN__Homo_sapiens__NP_002678
auggccguggcugucagaacccugcaggagcaacucgaaaaggcaaaagagagccuuaagaacguugacgaaaauaucaggaaacugacaggccgggaucccaacgacgugcgcccuauucaggcccgauuguuagcgcuguccgggccaggagguggccgugggagaggaucucuacuccugaggcggggcuucucagauaguggugggggaccgcccgcuaagcagcgcgaccuugagggcgccguaagcagacugggcggggaaaggcggacucgccgagaguccagacaggagucugauccugaagacgaugacgugaaaaagccagcauugcaaucgucagucguggccacgagcaaggagaggacccggcgugaucucauacaggaccagaauauggaugaaaaaggaaagcagcgcaacagaaggaucuuuggucugcugaugggcacacuccaaaaauucaagcaggagaguacuguugcuaccgagcggcagaaacgacgccaggaaauugagcaaaaguuagaagugcaggcagaggaagagagaaagcaggucgagaaugaaaggcgggagcuguuugaagaacgcagagccaaacaaacagaacuuagguugcuggagcagaagguggagcuagcucagcuccaggaagaguggaacgaacacaaugccaaaaucauuaaguacauccguaccaaaacuaagccccaucuguucuauauaccugggcggaugugcccagcgacacaaaaacuuaucgaggaaucccagcgaaagaugaacgcacuguuugagggaagaaggauugaguucgccgaacagaucaauaagauggaggcucgcccccggagacagucuaugaaagaaaaggagcaccaaguaguuaggaacgaggaacagaaagccgagcaggaagagggcaagguggcacagcgcgaagaggaguuggaagagaccgguaaucaacauaacgacgucgaaauugaggaagcuggggaggaggaagagaaagaaaucgccauagugcacagcgaugcggagaaggaacaggaggaggaggagcagaagcaggaaauggaggugaaaauggaggaagagacggaaguccgagaguccgaaaagcaacaggacucacagccugaggagguuauggacgugcucgaaaugguagagaaugugaaacaugucauugccgaucaagaagugauggagacuaaccggguugaaaguguggagccaagcgagaaugaagcaucuaaggagcuggaaccggagauggaauuugagaucgagcccgacaaagaauguaaguccuuaucaccuggaaaggagaacgucagcgcucuggauauggaaaaagagagugaggaaaaggaggaaaaagagucugaaccacagcccgagccuguggcccagccacagccccaaucccagccgcagcuccagcuucaaagccagucgcagccuguacugcagucucaacccccaucccagccugaggacuugucacuagcuguucugcagcccaccccacaagugacacaggaacagggccaccuccugcccgagcguaaggauuucccugucgaaagugugaaacuuacugaggucccaguggaaccgguucugaccgugcaccccgagagcaaguccaagacaaaaaccagaucuaggagccgcggccgggccagaaacaagacgucaaaaaguaggucccgaagcagcucaaguagcuccucuucgagcuccucaacuagcucuagcuccgggucaucuucuuccaguggaaguucuuccucacgcaguagcucguccucuagcucaaguacauccgguucuagcucccgggacucaagcaguucuaccuccagcucgucagagucuagaaguaggucccguggccgcgggcauaaucgggauagaaagcacaggcgaagcguagaccggaaacgcagagauacuucuggauuggaaaggagccauaaguccucaaaaggcgguaguagccgggacacaaaggggucuaaggauaaaaacucccgaucagacagaaagcgcaguauuagcgaguccucuaggucgggcaaacguagcucacgguccgaaagagacaggaagagugaucgcaaagacaagcgaagauga

SEQ ID NO: 60901 - RNA, 759 nt, Artificial Sequence
  derived and/or modified sequence opt3 from PNO1__Homo_sapiens__NP_064528
auggagagcgaaauggagacccaguccgccagagcugaagagggcuucacacaagugacuaggaaagggggacggcgcgcaaagaagcgacaggccgaacagcugucugcggcuggugagggcggggacgccggacguauggauacggaggaagcaagacccgccaaaaggccugucuuuccaccgcucugcggcgacggucuucugucagggaaggaggaaacccggaaaauccccguuccugcuaaccgcuacacaccauugaaggagaauuggaugaagauuuucacucccauaguggagcacuuaggacugcagaucagauuuaaccuaaaaaguaggaauguagaaauucggaccuguaaggagacaaaagaugugagcgcacucaccaaggccgcugacuucgucaaagccuuuauccugggcuuccaaguggaagaugcgcuugcacugauucgcuuggacgaucucuuucuggaguccuucgaaaucacugacguuaagccucugaagggcgaucaucucucucgagccauagggagaaucgcuggaaaagguggcaagacaaaauuuaccauugagaacgugacgaggacucggaucgucuuagccgacgugaagguacacauucuggggucguuccagaauaucaaaauggcacguaccgcuauaugcaaccuuauuuugggaaauccacccucaaagguuuauggcaacauccgcgccguggcgagcagaagugccgauagguuuuga

SEQ ID NO: 60902 - RNA, 531 nt, Artificial Sequence
  derived and/or modified sequence opt3 from PNOC__Homo_sapiens__NP_006219
augaaggugcugcucugcgaccuucuguuguuaagccuguucuccucugucuuuucaaguugucagagagauugccuaaccugucaagagaaacuccaccccgcccuggacagcuucgaucuugaaguuugcauccuggagugugaagagaagguguuuccuuccccauuguggacaccgugcacuaaaguaauggcuaggucuucguggcagcucucacccgcagccccugaacauguggcggcugcccuguaccagccacgggcaagcgagaugcagcaccugaggcgaaugccccgugucagaagucucuuccaagagcaggaagaaccugaaccaggcauggaggaggccggggaaauggagcagaagcaguuacaaaaacgcuuuggagguuucacgggcgcucggaaguccgcacgcaagcuggccaaccagaaaagauuuucugaguucaugaggcaguaucuuguguugagcaugcaguccucacaacggcgccgaacccugcaucagaaugggaacguuuga

SEQ ID NO: 60903 - RNA, 870 nt, Artificial Sequence
  derived and/or modified sequence opt3 from PNP__Homo_sapiens__NP_000261
auggagaacggcuacaccuaugaagacuacaagaauacagccgaguggcugcucagccacacuaaacauagaccccagguggcuaucauuugcggguccggacuugguggccugacggauaaguugacccaagcacagauauucgacuauggggaaaucccuaacuuuccaaggucuacagucccgggacacgccggccgguuaguuuucgguuuucugaaugggcgcgcgugugugaugaugcagggacgauuccauauguacgagggcuauccccuauggaaaguaacuuuuccugugcgugucuuccaccuccugggcguggauacccuuguugugacaaacgcugccgggggacugaauccaaaguuugaagucggugacauuauguugaucagagaucauauuaaccuccccggcuucucagggcagaauccucugaggggaccaaacgacgagcgguuuggcgaucgcuuccccgcaaugagugacgccuacgauagaaccaugaggcaacgggcucugagcacuuggaaacagaugggugagcagcgcgaacuccaggaggggacauaugugaugguagcaggaccuuccuuugaaaccguugccgagugccgaguguuacaaaagcugggcgcugacgccgucggcaugucuacggugccagaggugaucgucgcgagacacugugggcuuaggguuuucggauuuucguugauaacuaauaaggugaucauggauuacgaaucacuggagaaagcaaaccacgaagagguacuagccgcugguaagcaggccgcacagaaacucgaacaguucgugagcauucugauggcuaguaucccgcuucccgacaaggccuccuga

SEQ ID NO: 60904 - RNA, 1341 nt, Artificial Sequence
  derived and/or modified sequence opt3 from PNPLA1__Homo_sapiens__NP_001139188
auggugcagaugaugagacaauuccuguacaggguccuccccgaggacagcuauaagguuaccacaggcaaacuucacgugucccugacucgguugacggauggggaaaacguaguggucucugaguuuaccucaaaggaagaguuaaucgaagcccuguacugcaguuguuucgugccuguuuauugcggacuaauuccaccgacauaccgcggugugugggcuuuucucacucugcccccucagcgauauauagacggcggguucaccggaaugcagccaugugcauuuuggacagaugccaucaccauuagcacuuucuccggccagcaagacaucugcccccgugauuguccugcgauuuuucaugacuucagaauguuuaauugcucuuuccaguuuucgcuugagaacaucgcuaggaugacacacgcccuguucccacccgauuuggucauacuccaugacuacuauuaccgggguuacgaggaugcagugcuguaucugcgcagacucaaugccguauacuuaaacucaagcaguaaaaggguuaucuuuccucggguggaagucuauugucagauugagcuggcucuugggaaugaaugcccagagcgcucccagccgucuuugcgagcaagacaagccagccuggagggagcuacccagccccacaaggaaugggugccuaaaggcgacggcagggggucccauggaccacccgugucacagccuguccagacgcuagaguucacuugugaaaguccaguuagcgcccccgugucuccgcucgagcaaccucccgcgcagccacuggcauccucaaccccucuuagccugagugguaugcccccaguaucuuuccccgccgugcacaagccuccauccagcacaccgggcucgucuuugcccacuccuccacccgggcucuccccucugucaccacagcaacagguccagcccaguggaagcccggcucgguccuuacacucucaggccccuaccagcccacgucccucacugggcccuaguacagugggugcaccccaaacccucccacgcuccagccuuucugcuuuuccugcccagcccccaguugaggaacuggggcaggagcagccgcaagcgguggccuugcuagucucaaguaagccuaaaagcgcagugccccugguacauguuaaggaaacgguguccaaaccauacgucacugagucucccgcugaagauucgaacugggugaauaaggucuucaaaaagaacaagcagaaaacaagcggaaccagaaagggcuuuccuaggcacuccggcaguaaaaagccaucaucuaaagugcaguga

SEQ ID NO: 60905 - RNA, 1515 nt, Artificial Sequence
  derived and/or modified sequence opt3 from PNPLA2__Homo_sapiens__NP_065109
auguuccccagagagaagacauggaacaucagcuuugccggcugcggguuccugggaguguacuaugucgguguugcuuccugucucagggaacacgcaccuuuucuuguggccaaugcgacacauauuuacggcgcuucugccggggcacugacugccacggcuuugguaaccggagugugcuuaggcgaggcuggugccaaauucauagaagucucaaaggaggcucggaaacgcuuucuggggccacuacacccgaguuucaaccucgugaagaucauucguagcuuucugcuuaaaguucugcccgccgacucccaugaacacgcgucuggacgauugggcaucucgcucacaagagugucagauggcgagaaugucauuaucagccauuucaacaguaaggacgagcugauacaggcaaauguguguuccggguuuaucccuguauauugcggacugauuccacccucucuccaagguguuagguacguggauggcgggaucagcgacaacuuaccucuguaugaacuuaagaauacuauuaccgucuccccauucucaggagagagugauaucuguccccaggacagcucuacaaacauacacgaauugcgggugaccaauacuuccauucaguuuaaccugcgcaaucuauacagacucucaaaagcccuguucccuccagagccgcuugugcugagggagaugugcaagcagggcuaucgggaugguuugcgcuuucuccaacgaaacgggcuguuaaauagacccaacccucugcucgcacuuccacccgccaggccucacggaccagaagacaaagaucaggcagucgagagcgcucaggccgaagacuacagucagcugcccggcgaggaucauaucuuggaacaccuaccggcgcggcugaaugaggcccuccuggaggcauguguugaaccuacagaccuucugaccacguugucuaacaugcuccccgugcgucuggcuacugccaugaugguaccauacaccuuaccucuggaguccgcucucagcuucacaauucgccuacuggaauggcuucccgaugugccagaggacaucagauggaugaaggaacaaacuggcucgaucugccaguauuuggucaugagggccaaacggaagcuggggcgacaucuccccucucgccugccugaacagguggagcuuagaaggguucagucccugccaucagugccguugaguugugcagccuaccgggaggcucuccccggauggaugcgcaacaaucugagcuuaggugacgcgcuggcaaagugggaggaaugccaaagacagcuacuccugggccuuuucuguaccaacgucgccuuuccuccagaggcuuugaggaugcgugcccccgcagauccugccccagcucccgccgacccggcauccccucagcaccaacuggcggggccagcuccccuccugucuaccccugcccccgaagcacggccagugauuggagccuuaggccuguga

SEQ ID NO: 60906 - RNA, 1446 nt, Artificial Sequence
  derived and/or modified sequence opt3 from PNPLA3__Homo_sapiens__NP_079501
auguacgacgccgagagaggcuggagccuguccuucgcugggugcggauuucucgguuucuaucacgugggcgcaaccaggugucuuucugaacacgcgccccaccuguugcgggaugcccgcauguuauuuggggcuucagccggagcacugcauugcgucggcguucuaagugguaucccucucgagcagacacugcaagugcuuagcgaccugguacgaaaggcccguuccagaaacauugggauauuccacccaucuuuuaauuugucgaaauuccucaggcagggacuguguaagugccugccggcuaacgugcaucagcucaucucaggcaaaauuggcaucagcuuaacucgggucagugauggggaaaaugugcugguuuccgacuuucgcucuaaggaugagguggucgacgcacuuguguguagcugcuucauucccuuuuacuccggauugaucccuccaucauucagagguguaagguauguugauggcggggugagugacaacguccccuuuauagaugccaaaacgaccaucacagugagcccuuucuacggagaauaugacauuuguccaaaggugaagucuacuaauuuucugcacgucgauaucaccaaacuaucccuccggcugugcacaggcaaccuuuaccuguugucacgcgcuuucguucccccugaccucaaggugcugggugagauuuguuuacgaggguaucuggaugccuucagauuucucgaggaaaaaggaaucugcaauaggccacagccgggccuuaagagcaguucugagggcauggaccccgaaguagcgaugccuuccugggcaaacaugagccuggacucgucuccagaguccgccgcuuuggccgugcggcuagagggggaugaacugcucgaccaucugcgucuuucaauacugcccugggaugagaguauuuuggacacccucagcccucgccuggcaacugcuuuauccgaagagaugaaagauaagggagguuacaugucuaagaucuguaaucugcuaccaauuagaaucaugagcuacgucaugcuccccugcacacugccgguggaaucagccaucgcgauuguucaaaggcuugugaccugguugccugacaugcccgaugacguccuguggcuccagugggugacgagucagguauucacucggguucugaugugccuucugccagccucccgaagccagaugccugugucuucacaacaggcaagucccuguaccccagagcaggauuggcccugcuggacaccuuguagcccaaaaggcugcccggcugagacuaaggccgaagcuacaccccgcuccauauugagaucuucgcucaacuuuuuccuggggaauaaagucccugccggagcagagggcuuaagcaccuuuccauccuucucacuggaaaagagucuauga

SEQ ID NO: 60907 - RNA, 501 nt, Artificial Sequence
  derived and/or modified sequence opt3 from PNPLA4__Homo_sapiens__NP_001166143
auggccagacugaggagcggcauggaguccaucuugcccccuucugcucacgaacuugcacagaaccggcugcaugugucaauuaccaaugccaagacacgcgagaaccacuuggucaguacuuucagcucccgagaagacuuaauaaaaguucugcuagcgucuucguuugugccaaucuacgcugggcucaagcugguagaguauaaaggacaaaaguggguggaugguggccuuacgaaugcccugccgauuuugcccgucgggcguaccgugacaaucucaccuuucagcggaagacucgacauuaguccacaggauaaaggccagcuggaccuguacguuaacaucgcaaagcaggauauaaugcucuccuuagccaaucuggugaggcuuaaccaagcucucuuucccccuucuaagcggaaaauggaaagccuguaucagugcgguuucgacgauacugucaaguuucuacucaaagagaauugguucgaguga

SEQ ID NO: 60908 - RNA, 948 nt, Artificial Sequence
  derived and/or modified sequence opt3 from PNPLA5__Homo_sapiens__NP_001171146
augggcuuccuggaggaagaggggagauggaaccucagcuuuuccggagccgguuaccuuggcgcucaccaugugggggcaaccgaaugccugaggcagcgggcgccccgcuuguuacaaggagcccgacguaucuaugguucuucaaguggcgcucugaaugccgucagcauuguuugugggaaguccguggacugcccuucuacaauaacuguaucgccauuccacggaacgguggauaucuguccgcagucaaccagccccaaccuacaugagcucaaugucuuuaacuucaguuuucagauuuccacagaaaauuucuuucugggccuuaucugccugauuccuccaucuuuggaggugguugcagacaacuguagacagggcuaccucgaugcccugagguuccuggagcggcgcgggcucacuaaagaacccguguuauggacccuggucagcaaggagccuccagcucccgcagacggaaauugggaugccgguugcgaccaaagauggaaaggcgggcuuuccuugaacuggaaggugccucacguacagguuaaagaugugccaaauuuugaacagcugucaccggagcuagaggcugcccucaagaaggcguguacaagggaccccagucggugggcacgcuucuggcauagcggaccuggccagguccugaccuaucuucuguugccaugcacucuccccuuugaauacaucuauuuccgaucuagaaggcugguggugugguuaccugaugucccagccgaccugugguggaugcaaggucuccuucggaacauggcucuggagguguuuucccguacaaaagcccaguugcuagggcccauaucaccgccugcaacccgcguucuggaaacgagcccccuccagccacagaucgcuccucacagagaggaacugggacccacucaccaagccuga

SEQ ID NO: 60909 - RNA, 4128 nt, Artificial Sequence
  derived and/or modified sequence opt3 from PNPLA6__Homo_sapiens__NP_001159583
auggaggcaccccugcagaccggcaugauggggacaagcucccacggacucgcuacuaacucuucaggugcaaagguggccgaaagagacggcuuccaagauguccuugcgccuggggagggaagugcuggcaggaucugcggugcccagccaguuccguuugugccccagguacugggggugaugauuggagcaggcgucgccgugguugugacggcugucuugauauuacuggugguacggcgccuacgaguuccuaaaaccccagcacccgacggcccucguuacagauucaggaagcgggauaaagugcucuuuuaugggcgcaagaucaugagaaaagucagccaguccacaucuucgcugguggacacuucagugagcgccaccaguaggccacggaugcgcaagaaacuuaaaaugcugaauauugcuaagaaaaucuugcgaauccaaaaggaaacacccacccuccagagaaaagagccuccaccggccguccuggaagcggaucugacugagggagaccucgcaaacucccauuuacccucugagguucuguacaugcuuaagaaugugaggguauugggucacuucgaaaagccucuguuucuagagcucugucggcauaugguguuccagcgucugggccagggggauuaugucuuucgcccaggacaacccgacgccagcauuuacgugguucaggauggccuucuggaauugugccucccugguccagacgggaaagaguguguggucaaggaggugguacccggagauuccguuaacucacuguuaaguauacuggacgugaucacaggccaccagcauccgcagagaaccgucagcgcuagggccgcacgggauucuacggugcuccgacuuccugucgaggcuuucuccgccguguuuacuaaauaucccgaaucacugguucgcgugguacaaauuaucauggucagauugcagagggugaccuuccuagcgcugcacaauuaccucggccugacaaacgaacuuuuuagccacgagauucagccacugcgguuguucccuagucccgggcucccaacucgcaccucucccguuagaggauccaagaggauggugagcacaucggccaccgacgaaccucgugagacgccaggucggccgcccgacccuacuggcgcaccacugcccgggccuacaggagauccagucaaacccaccucuuuagagacuccguccgcuccucugcuaucacgaugcgugaguaugccaggcgacaucagcggucuccaagggggccccagauccgauuuugacauggccuaugaaaggggacgcauaucuguaagccugcaggaggaggcuucaggcgggagucuugccgccccugcccggacacccacccaggaaccaagagaacagccugcuggagcgugugaguacuccuacugcgaggaugaaagcgcaacggguggcugucccuucgggccauaucaaggaaggcagaccucuucaauuuucgaggccgcuaagcaggaauuggccaaacugaugcgcaucgaggacccgagucuccugaauagccgagugcuucugcaucacgcaaaggccggcacaauuaucgcucggcagggugaucaagacguuuccuugcauuuuguccucugggggugccugcacguguaccagcguaugaucgauaaggccgaagacguguguuuauucgucgcacagccuggcgagcugguuggacagcuagcggugcucacuggcgagccccugauuuuuacccuuagagcucaaagggauugcacauucuugcgcauaucuaaaucggacuuuuaugaaaucaugcgggcccagccaagcgugguacuguccgcagcccacacugucgcugccagaaugucacccuucgugaggcagauggacuuugcaauugauuggaccgcuguugaggccgggcgagcgcucuaccgccagggagaccggagugauuguacauauaucgugcugaacgguagauuaaggucugucauacaacguggcagcgggaagaaagaacuggugggagaguacggccgcggugaccuuauugggguuguggaggccuugacccggcagccuagagcuacuacgguacaugcagucagggauacagaacucgccaagcugccagagggcacccuaggacacaucaaacgacgguauccccagguggugacucgccugauccaucuccugucccaaaagauucuuggcaauuugcagcagcugcaggggccuuucccggcuggaucaggcuuaggugucccaccccacagcgaacucaccaacccugccucuaaucuggcaacaguugcgauccuuccagugugcgccgagguacccaugguggcuuuuacccuggaauugcaacaugcccuccaggcaauugggccuacucugcuacugaacuccgacauaaucagagcuaggcucggagccagugcacuggauagcauucaggaguuccggcuuucuggcugguuggcccagcaagaggacgcucaccgaaucguccuguaccagacagaugcguccuuaacgccguggaccgugagaugccuccgccaggccgacuguauccugauuguuggucuuggcgaucaggaacccacucuggggcaacuagagcagaugcucgaaaauacagcagugagggcucugaagcaguugguccuguuacaccgugaggaaggagccggcccaacccggacaguggaguggcucaacaugagaucauggugcagugggcaucugcaccuuagguguccucgccgacuguuuagcagacggucgcccgccaaauugcaugagcucuacgaaaagguuuucuccaggcgcgcugaccgucacucugauuuuagcagacuggcacgggugcuaacuggaaauaccauagcccugguccuuggcggugggggagcgaggggcugcucacacaucgguguacucaaagcucuggaggaagccggcgugccaguugacuuggucgggggaacgaguauuggcuccuucaucggggcacuguaugccgaggaacgcucugcuagccgaaccaagcaaagagcacgggagugggccaaauccaugacaucaguguuagagccugugcucgaccugacuuaccccguaaccagcauguucacaggaagugcguuuaacaggucuauucaucgcguguuccaggauaagcagaucgaagaccuuuggcugccauauuuuaacgucacuaccgauauaacggcuuccgccaugagaguucacaaggacggcagcuuguggagguacgugcgggcaucgaugacacucucagguuaucugccgccucuaugugaucccaaagacgggcaucugcuuauggauggaggcuacaucaauaaccucccagccgacauugcucguucuaugggugccaagaccgugaucgcaauugaugucggcagucaggacgagacugaucuguccacauauggggacagcuugucuggauggugguuacuguggaaacgccucaaucccugggcugauaaggugaaaguuccugacauggccgaaauccaaagccgacuggcguacguauccugcgugagacagcuugaggucgugaagucaaguagcuacugugaguaucugaggccacccauagacugcuucaagaccauggauuuuggcaaauucgaccagauuuacgauguuggguaucaguacggaaaggccguguuuggcgguuggucucgggggaacgucaucgaaaagauguugacugaccgcagauccaccgaucuaaaugagucaaggcgggcagacgugcuggcuuucccuaguagcggauuuacagaucucgccgaaauuguaucccgaaucgagccgccaacgucuuaugucucggacggcugugcugauggcgaagagagcgacugccugaccgaguacgaagaggaugcagggcccgacuguucaagagacgaaggagguuccccugagggcgccagucccucuacugccagcgaaauggaggaggaaaaguccauacuucgccaaaggcggugcuuaccacaggagccucccgggucagcuacagaugcguga

SEQ ID NO: 60910 - RNA, 2349 nt, Artificial Sequence
  derived and/or modified sequence opt3 from PNPLA8__Homo_sapiens__NP_001242937
augagcaucaaccugaccguggacauuuacauauaucuccuuuccaaugccagaucugucugcggcaagcagaggucaaaacaacuguacuucuuguuuaguccuaagcacuauuggcggaucagccauauuuccuuacagcgcggguuccacacaaacaucauucgauguaaauggacuaagucugaggcucauucgugcucaaaacacuguuacagcccuaguaaucauggacugcacaucgguauacuaaagcucuccacgucugcaccaaagggccugaccaaaguuaacaucugcaugagccguauuaaguccacacuuaauucagugaguaaagccguauuugggaaccagaaugaaaugaucagcagacuggcgcaguucaagccgucuucccaaauuuugaggaaagugucagauagcggauggcucaagcagaagaacaucaaacaggcuauaaagagucugaaaaaguauucugacaaauccgccgaaaagagccccuuuccugaggagaaaucgcacauuaucgauaaggaagaggacauuggcaagcggucucuguuccauuacacuuccucaaucaccacaaaauuuggugauaguuucuauuuucucagcaaucacaucaacuccuacuucaagcgcaaagagaagaugucucagcaaaaagaaaaugagcauuuuagagacaagagcgaauuagaggauaagaaagucgaggaagggaagcugaggucaccagaccccggcauucuugcauacaaaccuggaagugaguccgugcacaccguugauaagccaacuagccccucugccauaccugacguguugcaggucucaacaaaacagaguaucgcuaacuuccugagccggccaaccgaaggcgugcaggcacugguagggggauauauugguggccucguuccgaagcugaaguacgauuccaaaucucaaucggaggaacaggaggagcccgccaagacggaccaggcugugagcaaagaucgcaaugccgaagagaagaaacgacuuucccugcaaagagaaaagaucauagcgagggucucaauugacaaccggacucgugcauuggugcaggcccuccgcagaaccacagacccuaagcuguguaucacuaggguggaggaauuaaccuuucaccuacucgaguucccagaggggaaaggagucgcuguuaaggaacggaucauucccuaucuucugcgauugcgccagaucaaagaugagacacuacaggccgcagugagagaaauucuggcucucauaggcuacguagacccugugaaggguagggggauccggauucugaguaucgauggaggcggcacccgcggggucguggcccuucaaacgcugagaaaauugguugagcucacucagaagccagugcaucagcuguucgacuauaucugcggagucucuacaggugcgauuuuagccuuuaugcugggccuauuccacaugccccucgaugaaugugaggagcuguacaggaaacuugggagcgacguguuuucccagaauguaauaguuggaaccgugaagaugucauggagccaugcauucuaugauucucaaacuugggaaaacaucuugaaggaccguaugggcuccgcucugaugauugagacagcccggaacccgaccugcccuaaagucgcugccgugaguacgaucgucaaucgagguauuacccccaaggcauuuguguucagaaacuacgggcacuuuccaggcaucaauagccauuaccucggaggcugucaguauaaaauguggcaggccauaagggcuucuuccgcggcaccuggguacuucgccgaauaugcucugggaaacgaucuucaccaggacgguggccuguugcucaauaaccccucagcccuggcaaugcacgagugcaaguguuuauggccagauguuccccuggagugcaucgugagucuagggacaggacgcuacgaaagcgacguacggaauacugucaccuauacaucgcucaaaacuaagcuguccaacgugauuaauucugccaccgacacagaggaaguucauaucaugcuugauggcuugcugccuccagacaccuacuuuagauucaacccggugaugugcgagaauauuccccucgaugaaagcaggaacgagaagcuggaccaauuacagcuggagggucuuaaauauaucgaacgcaaugagcagaagaugaaaaaggucgcuaaaauauugucacaggaaaagacuacgcuccaaaagauuaacgauuggaucaaacugaagacagacauguacgaggggcuacccuuuuucaguaaacuguga

SEQ ID NO: 60911 - RNA, 786 nt, Artificial Sequence
  derived and/or modified sequence opt3 from PNPO__Homo_sapiens__NP_060599
augaccugcuggcugagaggcgugacagccacuuucgggaggcccgcugaguggccuggauaccucagccaccuuuguggucgguccgcagccauggaccugggcccaaugcgcaagucuuaucgaggggaucgugaagcguuugaggaaacgcauuugaccucauuagacccggucaaacaguucgcugccugguuugaggaagcaguucaaugccccgauaucggagaggccaacgcuaugugucuggcaacaugcacuagagacggcaagccuagugccaggaugcuacuccugaaagguuucgggaaggauggauuucgguucuuuaccaauuucgagagccgcaaaggcaaggaacuugacuccaacccauuugcuucucugguguucuacugggagcccuugaauagacagguaaggguggaaggcccugucaagaaacucccagaggaggaagccgaguguuauuuucacucgcggcccaagucaagccagauuggggcggugguuagucaucaguccucugugauaccugaucgcgaauaccugcgaaagaagaacgaggaacuggagcaacucuaucaggaccaggaggucccaaaaccgaaaagcuggggagguuacguguuauauccccagguaauggaguucuggcaaggccagacaaauagacugcacgauaggaucguuuuucggcgugggcuuccuaccggagacuccccauugggccccaugacucaucgcggugaagaagauuggcuguacgagagacuagcaccuuga

SEQ ID NO: 60912 - RNA, 2352 nt, Artificial Sequence
  derived and/or modified sequence opt3 from PNPT1__Homo_sapiens__NP_149100
auggccgcuugcagauacuguugcagcugucugaggcuccggccccuuuccgacggcccuuuccuguugccacgccgagaucgugcauuaacccagcugcaagugagagcccuauggucuucagcggggaguagggcugucgccguugaccucggaaaccggaagcuggagaucagcuccgguaaacuugcacgcuuugccgauggcucugcugugguacagucgggggacacagcagugauggucacugccgugucaaagacgaaaccgagccccagucaguucaugccucugguuguggauuauagacagaaggcugccgcggcaggaaggauuccaaccaauuacuugcggcgcgaaauaggcacauccgacaaagagauccucacuucucgaauuaucgauagaagcauuaggccccuguuuccugccgguuauuucuacgacacccaaguccugugcaaccucuuagcuguggaugggguaaaugaaccagacguucuggccaucaacggagcauccguggcucuuucauugagugauauacccuggaauggcccugucggcgccgugcggaucgggauuaucgacggagaguauguggucaacccaacacguaaggaaaugagcagcuccacccugaaucuaguuguggcgggugccccgaagucacagauuguaaugcucgaggcaagcgcugagaacauccugcagcaggauuuuugucacgccauaaaagugggcgucaaguacacucaacagauuauccaggggauucagcaacuugugaaagaaacaggaguuaccaagcgcacgccccagaaacuguucacuccuaguccagagaucgugaaguauacccauaaguuggcuauggaaagacucuacgccgucuuuacagacuacgagcacgacaaagugucuagggaugaggcaguaaauaagauccggcuggacacugaagaacaguuaaaagaaaaguuccccgaggccgauccuuaugaaauuauagaguccuuuaacguuguggcuaaagaggucuuccgaagcaucgugcugaaugaauacaagcgcugcgacggcagagaucucaccucgcuuaggaacgucucuugugagguggacauguuuaaaacacugcaugguuccgcguuguuccaacgggggcagacccagguucuaugcacggugacuuuugauucacuggaaaguggaauuaagagcgaccagguaaucacagcaauaaauggcauuaaggauaaaaacuucaugcuccacuaugaguucccacccuacgccaccaaugaaaucggcaaggucacugggcugaaccgcagagagcuuggacauggugcucuggccgagaaagcauuguauccggugaucccuagggacuuucccuucacaauucguguuaccuccgaagugcucgagucuaacggcagcucaaguauggccuccgcuugugggggaagccuggccuuaauggauucuggcgucccaaucucaagugcaguggcggguguagcuauugggcuggugacgaagaccgacccugaaaaaggcgagauagaagacuaccggcuacucacagauauccugggaauugaggacuauaauggcgauauggacuuuaagaucgccgggacuaacaagggaaucaccgcacuucaagccgauauuaaauugcccgguauaccaaucaagauuguuauggaggcuauccagcaggccagcgucgcuaaaaaggaaauucugcagaucaugaauaaaacaauauccaagccccgagcaucuagaaaggagaacggcccugugguggaaacuguccaaguuccacucucgaaaagggccaaguucguggggccgggaggcuacaaucugaaaaagcugcaggcggagaccggugugacaaucagccagguagacgaggaaaccuuuuccgucuucgcccccacuccuucagcuaugcacgaggcacgcgauuuuauuacggaaaucugcaaagacgaucaggagcaacagcuugaguucggggccguguacacagcuaccauuacugagauccgggacaccggcguuauggugaaguuguauccaaacaugacagccguccuccugcacaauacccaguuagaucagagaaagauaaaacaucccacugcacugggacuagaggugggccaagaaauucagguuaaguacuuugggagggacccugcggauggacgcaugcgacucagucggaaagugcugcagucuccagccacaacgguaguccguacccuuaacgacagaagcuccaucgugaugggugagcccauuucacaaucuucuuccaauagucaguga

SEQ ID NO: 60913 - RNA, 984 nt, Artificial Sequence
  derived and/or modified sequence opt3 from PNRC1__Homo_sapiens__NP_006804
augaccguggucagcguuccccagagagagccucuggugcucggcgggaggcuugccccacugggauucuccucucgggguuacuuuggcgcuuugccgaugguaacaacugcacccccuccauuaccccgcaucccugacccacgagcccugcccccuacgcuauuccucccacacuuucuugggggagauggcccgugccugacaccccaaccucgugcgccagcugcccugcccaacagaucauuggcaguggccggugggaccccuagggcugcaccaaagaaacggcgcaagaaaaaggucagagccagucccgcuggacagcucccgagcagguuccaucaguaucagcaacaccggccuucccuggaaggcggccgcucucccgccacugggccaucgggagcgcaggaggugccuggucccgcagccgcucuggccccaucacccgcagcugccgcgggcaccgaaggggccagcccugaccucgcaccauuacgaccggcugcccccggacagacaccucugagaaaagagguucuuaagaguaagaugggcaaauccgaaaagauugcuuugccacauggucagcuggugcacgggauacaucuauacgagcaacccaaaaucaauaggcagaagucuaaauauaaccucccucugaccaagauuacuagcgccaagcggaaugagaacaauuuuuggcaggauuccgucucaagugaccguauccagaaacaagaaaagaaaccauucaagaacacagagaauauuaaaaacagccaccuuaagaaaucugcauuucugaccgaagugucccagaaggagaauuacgccggagcuaaguucucagaucccccgagcccuaguguauugccaaaacccccuucucacuggaugggcuccacgguugagaacagcaaucagaaccgcgaacucauggcggugcaucugaagacuuuacugaaaguccaaaccuga

SEQ ID NO: 60914 - RNA, 1080 nt, Artificial Sequence
  derived and/or modified sequence opt3 from POC1A__Homo_sapiens__NP_001155052
auggccgcucccugcgcagaggacccuagccuggaaagacacuucaagggccauagggaugccgugaccugugucgacuuuuccaucaacacaaaacagcucgcgucugggucaauggauaguugccuuaugguuuggcacaugaagccacaaagccgggcuuaccgcuucacuggacauaaagacgccgugacguguguaaauuuuuccccgucuggucaccuguuggcaucgggcucacgagauaagaccgugcguauuuggguccccaacgugaaaggggagagcacaguuuucagagcccauacugcuaccgugaggaguguccacuuuugcuccgacggacagucuuucgugacagcaagcgaugacaagaccguaaagguuugggccacucaccggcagaaauuuuuauucucccugucacagcauauaaauugggugcgcugugcuaaguuuaguccugauggcagacuaaucgucagcgccucugacgauaaaacagugaagcucugggacaaauccucaagggaaugcgugcacagcuauugugagcaugguggguucgucaccuacguugauuuucacccaaguggaacgugcauugcggcagccggcauggacaacacugugaagguaugggacgugcggacccaccgccugcuucaacauuaucagcugcacucugcugccgucaauggcuuguccuuccaucccagcgggaacuaccucaucacagcaucgucugauuccacucugaagauucuggaccucauggaaggacgauuacuguauacccuucacggucaucagggcccugcuacaaccguggccuuuucaagaacgggggaguacuucgcgaguggaggcagcgaugagcagguuaugguguggaaauccaauuucgacaucgucgaucacggugaagugacuaagguaccaaggcccccugccacauuggcaucuagcauggggaaccugaccguuucaauacuagagcaacggcucacucugacagaagacaaacuuaagcagugucuggagaaucagcaguugaucaugcaacgugcuaccccauga

SEQ ID NO: 60915 - RNA, 1311 nt, Artificial Sequence
  derived and/or modified sequence opt3 from POC1B__Homo_sapiens__NP_001186706
augcuguggaacuucaagccccacgccagagcuuacagguaugugggccauaaagacgucguuaccagcgugcaguuuuccccucacgggaaucuccuugcaucugccucacgggaucgcacaguacgacuguggaucccagacaagcguggaaaauucagugaguuuaaggcgcauacugcuccggugagaagcgucgauuucuccgccgacggucaguuuuuggcaacggccucugaagauaaaucgauuaagguguggucaauguacaggcagcgguucuuauauagccuguaccgccacacccauuggguuagaugcgcuaaguuuagucccgacggcaggcuaauaguguccuguucugaggauaaaacaaucaagauuugggacacuaccaacaaacagugcgucaauaacuucagcgauuccgugggguuugcaaauuucguagacuuuaacccuucaggaacauguaucgccagugcuggcagcgaucagaccguuaaggugugggacguccgggugaauaaacuccugcaacacuaucaggugcacucugguggggucaacugcauuuccuuccauccaucaggaaauuaccuuaucacugccagcagugauggcacacugaagauauuggaccuccuggaaggccgccugaucuauacccuccaggggcacacgggacccguuuuuacugugucuuucuccaaggguggcgaguuauucgcgagcgggggagcagacacccagguacugcuuuggcgaacaaacuuugaugaauugcauuguaaaggccugacuaagagaaaucuaaaaaggcuccacuucgacucgccuccacaucugcuugauauuuacccccggaccccucacccacacgaggagaagguggaaacagucgagaucaacccgaaacuggaagugauugacuugcaaaucucuacucccccuguuauggauauacucuccuuugacucaacgacuacaaccgagaccaguggucguacacugccagauaagggggaggaagccugcggauacuucuuaaaucccagccugauguccccugagugucucccaaccacgaccaaaaagaagacagaagacaugucugaucuucccugcgagagccagcgcucaauuccgcuggcugugacugacgccuuggaacauaucauggagcagcuaaacguccugacccagacagugaguauucucgagcaaagacugacucuuaccgaagauaaacugaaggacuguuuggagaaucagcagaaacucuuuuccgcaguacaacaaaagagcuga
